United States Patent 9,328,346 (POLYCOMB-ASSOCIATED NON-CODING RNAS) - sequence listing, part 80

SEQ ID NO: 14907 - RNA, 1245 nt, Homo sapiens
agcaggggccauuuaugacccagggacauugcugggguuggggggagugggccaggagcgggcaaggaguugucuugauagaaacgcugauucccguggggagacagcaaauuagucacucuccuuaagccuuacuuuccuuaucuguguaaugaagguaauaacacaaccagcgucuuacgauuguuacugggacuaaggggauauuuaauguaaagcuauuauaugggccuggcucacaggcagagcuucuguguuagcuucugcugcuguugcuguaguugcugcuacugguaccucuccuuaacauuuuucacagauugagguugucuaaguguucacauucauccauaucuucucacuucaguucaugaaaccacaucacacaagaucagucaaugcugaaauuuaccuccagucuuucucccucucgaacacgaauuggaggacguaucuuuccaccugucuauaaaacacucauuucugagacuuccccaguuuggggaagacggauaaagaagggaaucaguuuugcacuuugcuggaagcgccuguaagaaugccccauuggcagagacucgcuuuguggagcucaacuuggaaauuaauuuacaauggaaauugaaggaaaaucuacuucauguccacaccaagaaggguggccucaaugccucuccuucaguucacuccuugugccuuccaaaaggaaguugauucuucguauguagaauuuucuggacaccuagaacaccuacacccagaaaccaggucccagagagaugcagagccacggucaccauugcuuguguagacaccagggguaggaaguggaaggaagguagcgccugagggugcagcuucccagggaccaccaccucucccagccucaauggcgggagagaacaaacccaagggagaagcuacgggccagcaucuucccucccucccucuuggcccccaccagggcuagggucaacaccccaaauugaaagcaucuguugucaagcugcagcaggcagggaaacccugucaccagguuaaggcuuaagucagagcauuuugccaaauucaacacguccaagccucccacuugucccccaagaaaauuucucagggauucacaucuuucccagucacccccuggccagugaggaagcaccgugcaucgagaagagcauagcuuugagucgucuauguggagcugguuccaucugagcucugccucuuccuggcugugucuuuuug

SEQ ID NO: 14908 - RNA, 21316 nt, Homo sapiens
agucugguuuugggcgggaauugaaaccgccgcugaagccaacaagaauuugagaacuguaaauaccaagccuugaaagggaccauggugcggccugugagguggguaguuccugacauucgucgggggugggaggaaaacuaagggaaaagacaugagacuaaggggaaaggaucgaguaagaccggagggcagcgauggugggguuaggauggacgguuaucaagaacccagucuccagugagagccacccguugcucagaaguauccuagcaucguagcuuuuuccuucucuuugccucccuucacaaccgucgccguuucuuuuaccaagaccuuguuagcguuugaacagcgcuuuacauuucaccgagcgcccaauuauguguuauuuuauuuguuuaucacuguaguuauuugauauagaaagaguaagcauuccuguuguauugauuuaacauuucuacguauagaggguaaguuaucugagucauacagcccaguaaguggcagggcaauacucaaaccuaagucaucucacucaagauccucugugcuuuccaucgugguauuagaaacgauucuucuauuuacacaguugagugccauggaagccuauaguuagccauucauuuaauaaaguuauugaauauauucacuucuuuaguguacgaggugcuggagguuacauuccagugggaggugagguuagggggccgaaaauaagccucgaaauaugagagugcgaaagaggaaagcacuacuuuaaauauaguaguuaauaugugacucugaggcgauaaugcaugcacugagucaugaaucaggguagagggaauaggagccaaggccccauacuugaccauauuuuagggacagucuaaugcuauaggauuaacaagcaguggggagaaucguagggggauuaggccagagaaauaggcaggugccagaacagauagggucuuguaagucuuagaaaggaguuuagguuuuauuuuaagucaaugggaagucaguggaggguuuuaaguaggggagaggaaucuaaguuugcuuuuauaaaggucacuggcuguugguggagaauaaaugauggauagggugaccagaacgggagcaggaaaaucagguauuauaucauuggagagcgguuugggauaggguauuauuagugggcauggaauggaacagaugaauuugggauguauuucggaggcacuguggacagaacuugcugaugaaguagauguacagguaagggaaagaaagaaucagagaugacuccacaauaguuuuggucugagcuacaggauggaugaucuuuguauuaagauagggaagacuaggaaaaggaagguuaggaggugugagggaucaagauuucuguuucgaacaugcugaauuugaaauggguuuuaagcauccaggcaguggagucauaaucccuuuguaaggaacagcaguuguuaaaguauggucuacagaccucugugggucccuggaaacuucucuagaggucuaugaggucaaaacuccuuucauaacaauacuaagauaugauuugccuuuuucgcugcuuugucauuugcacugcagugaccccgauaaaacugcuggcaccucagaacaauuaaggcaguggcacuaaauuguacuacuagucuuugcaauguuuacugccauacucuuaaaaguaaaaaaaaaaaaaaaaaucauuucaguuaagaauaugcuugaugaaguaguggaaauuauuauauucaucauagcuuaacccuuaaguauacuaauuaaaaauaggcuauugauuuuauuuuacuauuauucaaguucagaauuuauaaagggguuuucacauuuuauucagcucuaacuucuuuaacucugaagaguaagagaguaauaugagugcacuuuuuaauaguuugcgugaggaaacaggaaguacacauaaagcacuucuguauacugaugcgugauaguuaucucaaggaaaagcacuugugagauugucugaguugugagcugagcuuacuaccucuuuuucauagaacauucuuuuuacuugaaagaacaaccagcugacaaauuagguuauucacauuuagccauuugacaaaaauauagaaauaaaaacuagaaaaacauuuuauuuagugccuagaggagggaggaaaaaauuauuuuuuucacuuugaauaucauuuucuucuaaugcccucugaaguaguacaaguugagcaucccaaauuugaaaugcuccaaaauuugaaacuuuugcaguaccuacauggcacucaaaggaaauguucauuggagcacuucagauuuuagauuuucagauuugggaugcucagcugguaaguauauaaugcagauauuccaaaaucugaaaaaauccaaaauucaaaacauuucugguuccaagcauuucagauaagggauacucaucucaggugguaggaacaaggucacucaccauuuuuaaguguccguugcauaaaaauguuauuugguaugguggagagauugaaaagaaaguagcuuuuagugucaagaaauuuauaaucuaguaaggaagauagaaugcacacacaaaacagaagaacacguacaacgggaacuuacaaaugcccaacagcaauuaaacaguauagcaauuauaaauguuaauuauguagauuauucuuuguaaguuaccugaauuuuuuuccuuuaucauauaauugaaaagccaacaauacccagguauaucagguauaguuguaacuauuuuagcuaaugauaaauccccgcgguaaaaugcaaaucauguuuuagaguuaaauauucuuacuugaacccaaacacauuuucauuuauugaaacacauuucauuuaacacauuuuuauuuauuucguuuauucauuauuuauuaauaaaugaauaauauuaaauaaauaaauaauauucauuaauagccuuaaguaauaguggugagaaauugacauuuguguuaaugaaaaaauucuguuuuggucauagacauaagaaaccagucaauuacucacaguuugaccacucugacagugaugguaaguaaagcuucuuauuuuuguucuaaagauuuggaaacucauuuccucggaauuuauaugacauauauagcucaaacacugacuaaauugcccaaaugcauaugagguaggucuggaaagauaguuuucuaaucauuugggauaauuaugcugauaauuauacugauaaaaauuauguuaguaggugauaaaugaacaggccaggugaaaagucucuuuagaucuaaacuacucuaaaguccauaguugcaacauagagguuugucuccuauuccaucccugaagaaggaaaacacugucuuuuugagauacaaagauguuacagcauauuauauaaaaucccuauuaauuguacuauaaaacaagaccuugaagaaagguuaggcuuauguuaugccuuuuaagcauuagucauauguuuacuugacucugcuaugauugaaaaguuugaggaacauugcauuagauuauguuauauguugaaguggauuuaauauuucuuucuuagaccacuagaguuuucuguaagucaaauauuuaguaagucuucgguuugaaggaaucuguuuuugccuugagcacagccuuaacuguaucuaccacuugggaaaaagaguguagaguauaacaucuagcuuuuuuuuuuuuuuugucaucagucugucaucagauacuuauaaauugccagguguguaguaguagguggggggaguccuaaguuaucuuauuuuuacauggggaagcauauaagagacaacaaguauuagugcuugcugaguaugugaugaagacugcauagacccugaaaguaugcauauauguguuguauacauguggaaaagccacagcaguaguuuuacguugacagucaagaguagaacuacaacaguucagaggauugguaagacagaaaaaccugugagaaacaguaauggacuggaaaagaacauccuuuugcaagaaaauaagaaguuacuuugguaggaucuuaggaagaucauuaugguaauggaaagagaaaauacuacuauuguaaaaauccucaaauaggagcuacuuucucuuccccccauaaugcuuauuuccucuagcaugguuaauguacuaggaauagguaaugggcuuuuuuuucucuuuuuuuugagacggagucucacucuugcaccuaggcuagagugcaacagcgcgaucuuggcucacugcaaccucugccucccagguucaagcgauucucccaccucaccuccugaguagcugggauuauagguguccgccaccaugccuggcuaauuuuuguauuuuuuaguagagacaggguuucaccacuuuggccaggcuggucuugaacucgugacuucaggugaucugcccgccuuggccucccaaagugcugggauuacaagugugagccacugugccuggcccaaguaaugggcuuugaaaaaagauauuuggcuacauugugaaguucccauaaaaauaauuuauuuccacuuuucaaugugauuaaauucuaccaauuuuucuaaugguuuuacagguuuuuaaucauuuuuucuuugacacuuauaugcugucuuaauugcuuuugcaguuuuuagugaauugguuuuugauagacugauauuuuuaaauauaaagggcacaaaaacaaaagucgaaauagauaaaugagaguaaagauaaacaaaauacuaacaaugauuuuuaaauuguggaaauuaaacaauuugccuagccuauaaaaacuugaacacacaugguaaugauuuucauuuaugaagaaaauaauauuuuucuuuugguuuuaauucacacaugaauagaugauuuuguuucugcaacuguaccuuuaaacaagaaauccagaacagcaccaaaggaguuaaaacaagauaaaccaaaaccuaacuugaacaaucuccggaaagaagaaaucccaguacaagagaaaaccccuaaaaaaaggugagagguaagacaugcaguaaauauaugacauuagauguguuaauuuuaaagagacacagauucgaacccuugauuuaaauuagaacuugggcagagucauaggucuuauuuuacuaggugcagucagaaaacaggacguacuauuuuuuucuggcuuucugacuuaaagaaauucacaaacauucaaggaaguaucauuaaauauuaagacaauaaugauuguagaauucagaaguuaugacugguuuugacaggacccagcacuuaucucugaauuccucaaaucauacgagacuacuuuguuaaaaaugacauuagaugacuuaagaugauuaagacacaagaugacuuaauaugaggacaguuuuuaaaauauaaaaccauguauuuucuugcagaaaaagaugucuucuccccauguuguuaagauuuauccagcagugagaaguucccauaguuucuagacuaaccguggaauuccauuagauaguaucaagaggcagaaaggagugaaggaaguccuuagagacccaaaacuugcaguauggagaagagaugggcggaaggggaauauuaacaaauggaacauggcauauauaauguuuuacugccacaaguuucucuaugaaaagugaguuagccuggagaaacuuaccucaugucaugcucuuuuuugcuuuucuuuuuuuugguuuuuguuugugaguuucuuguauuacauuuuaaauauauagaaaaaggaacccacacgugggagaaaauauuuguaaaucagauaacugauaagggacuguauccagaguauacacagaacucguaaaacucaacaguaaaaagacuaacaacacaauuuaaaaugugcaaaagauuucaauagacuuucuccagagaagauaaacaaauaaccaauaaacacaugaaaagaugcucaauaucauuagcugugagggcaaugcaaaucaaaaucagaaugagauaauacuucacacccacuagaugacuuaauacaaaagacaaggaauguggagaaauuugaacccucauauauugcuggugggaaaguaaaauggugcagcuaaauuggaaaaugguuuagcaguuccucaaaauguuaaacagaguuauuacaugacccagccuauguauguauccaagagaaaugaaaacauaugcccacacaaaaacccauacaugaauguucacagcaacauuauucauaauagcuaaaaaaaaauggaggcaaucuaaaugucuaucugcuaaugaauggauaaguaaaaugugguuuccacaaaauggaauauuuuucagccauagaaagaaaugacaacugauaacugauauauacugcaauauggaugaaccuuggaaacaucauucugagugaaagaagccagauauacaggucacauauuacaugauuucauuugcaugaaauguccagaauaggcaaauccauagaaacggaaagcagauuaaugguugcuaggaggggagagggguaaacaggaagugaaugcuaauggguaugggguuucuuuuugggguaauaaagauguucugaaauuagguaguguuggugguuuuacagcucugugaauguacuaaaaacugcugaauuguuuacuuuaaaagguaaacuuuaugauaugugaauuauaucuuaagaaaacuguuauucuaaaaaaauaaauucuuuaagguacaucucagugcuucuuccuuuauguaacuuuuccuuaucugucuuugacguuuucuuccucuuauacuccauagcacuuuugagcagcuugaauaggacuuuauagucugccuuuuauaggauaauuauuagcaugucuuguuuccccacccuccuccuuuaauugcagacucccugaagguacuuuuaguauuccagcuagugcagugccuuguacaaaguaagugcuugguaaaauauuuguuaaagucuggauugggaggaagagauguaaaaaaaugauaauaauuuuaauuuaauguaagagcuauaaaaucugcuaaaggggagugggugaggucaaggaagaguuuuaaguggaagugauguuugaaccaagucuguuuuggguugaguaggguguuucccaccuggacacagcugguaguaaggugacacauuacaaugaaagggaacagucauugcaaagaggcacaugguccuccuauuucaaaccucuuauucuguauguaacaugauacugugacauuuuaggagucuuaucuuaucaucaaaggucuauuaaugaugauuguuuaaaaacauuuuugcgaaguuagcaacucuugaauaguaauuuggagaaaucucaaacuuugcucuuuaguugagauugauauuuugaagaacucauuauuacuuguguaucuauuuuaggauggcuuuagaugacaagcucuaccagagagacuuagaaguugcacuagcuuuaucagugaaggaacuuccaacagucaccacuaaugugcagaacucucaagauaaaaguaacuuuauuuucuguauauuuagcuuuaaaaccuucuuaaugcuuuugugauuauuuguuugggugggccuucacagaggaaacagguaaaaugugaauacuuugcacuauaaauagacccauuugcagagaauacgauuggauuuaguucuuaauucagcugccuaaaucucauacaaacagacauacaucucugcuuaacacccagaauaagcuugagggcacggacugugagccucaguguucgaauuauauguuguuguacagugaacauuuaauuucuucaucaaaugauuugaucuguacaguccuaacaauccaucuccauuuuuuccagaucaguuaaacauacccuaauuaugguaauuuuuauuacuuacaaaggucaaagguauuaauuugguuagcaaguucaguagacuuaagagaauggcuuuuggauuucucuguugauuuucuccuuugauuuuucuggcaauauauuaauauucuagagaggcagaaaucauuauuccugaaaaagauacucuacugcuaaaaugcuuuuuggcuuaaaguuuuuauguugggggauauuuuagcuuauuaucuuauuuagggguauacauggagcuuuuuucuuuguuucuuaaaucaguacugccuccuuauuuauuuauuuauuugagacagggucucucucugucauccaggcaggaauacaguggcaugaucauggcucaauacaaccuugaccuccuaggcucaagcaguccuccugccucagccuccugaguagccgggacuacaggcaugugccgccaugccuggcuaauuuuuuauuuuguagagaggggucucacuauguugcgcaugcugcccucaaacucccagccucaagcaauccuccugccucagccucccaaagugcugggauuacaggcgagagccaccuuaucuggcugccuccucuuuaaaaagaaaugaaaguuugauuaggaagacuuuuaguaaccaagaaucaaagaaacaucaaaagagaauuaucaugaauuacauuuaaaauggaggcacugaaauucaucucucucuuuuaagacauuguagaauguauaaggggaguuccuuagaaguauuaauauuauaccauuucuuauuaaauaaugcaccuuauagcauuggaauuuaauaguaccaauuauuaugucuuaaaguccucuuagaaugcuuugggucauuuuaagguuauuauaacgauuggagaguucuuaacguuaguaaaagcauggauuugccuacacagaauugauaguuuauugaccauuuccuguauauuaggcacaauaauaagcaauuccuaugugagauccacauuuggucuucuguaauaccacuggguaagacacuauuuuuaucuccacauuauagaugaggaaauucagucuuaggauaagcaacuugcccauggucauauagccaguuuacaugguagagccugaauuuaaacauguuagauuucagagcccagacuucuaaccauauguuaaccucucugaauaaaauuauugugccaguuggaguuugggaucauuuauuuauaucuaaaugcuauuacauuuuaguacuaauuuuccuauaucuagacauugauuaagauauaucugaauuuucuuucuuauuccuuauauuuaggcauugaaaaacauggcaguaguaaaauagaaacaaugaauaagucuccucauaucucuaauugcaguguagccagugauuauuuagguaaguuuuuuauauuaauaauuuuucucaucaacaaugcuguuucucugacuuuuguuuaaauugcugaaauuguggcuagaagcaaguucuuuaaauuugucaagacucucuugaugucauggccuuuauuucuuuguguuuuagucucauucugucguacugcagacacacauucuucccugaagggucauaacuacccguggcuucuaguuggagcaacugaccuuugaagaaaggggcugcauauucccaauucuaguuugaaaauuuugggggaaagauuaucucuguuugggucuuggauuuaucccuaaaacuagagguguucccagggcacugauguaccaugguugacccagauugggcuaauagucuauuacuggaagcaugggagggaugaaccugggcaaauaaaaacaauagcuguaauagagucuggucugcaguucuugaaauaucaguugucacagaaaguuuuccauugauuuuuaugccucuccugaagauuuggauaagauuacuguggaagaugauguuggugguguucaagggaaaagaaaagcagcaucuaaagcugcagcacagcagaggaagauucuucuggaaggcagugauggugauagugcuaaugacacugaaccagacuuugcaccugguagguuuuauucuacuucgaaauuaauucuaugggaauucagucaaaaaaguucuuggaagcuauuaauugugcaaagcacuguguuaaaccuuuggggugugcaaacuucagggacacacagaacaguucaauucagugauagcauuuggggaaaaaguuuuuucuacgaguuaaccuuuaagcuaugccuugaaaaaugaguagcguuucaacaaacuaaagguguaaaguagcauuucugacuaacagaaaggcauuaccuguggaauagacaaaugcucuauuugucucuaacugaggcuugcugggaugaacauggaagaggcucgagagggaggcugguacuaaucagggagggucucagacccacuggaagaaguguaggcuuuuuuuuccuggagguaguagaaauccaugaauuauucugaggcagaagugauaugaaaucuauauuuuauuaugaugguuuuuagacucauuuagaaauugggcaaauggaaaguguagugaccuugacagaacauuauaacauauuaauuaaaaauuuaaauucauaaauucauaaauguaggccaaaucaagauaccauauuuuagauuuugauauacuaucaacaaacaauaacagauuugcucaucgucacuuauucgacuaauauuugaaugcuuuuuaugugcauuauauucuagauacuagggauacaauagugaaaaaaacaaacagcuccuguccuucuggaacaacggaaauacaugaaaaaagacuguuuugcauuuguuuuacuuugggagggccugggagacaggaaaaugcaaagacacucuuugagcgccaaugugaugcuuaaaggaaauacucauuugagcauuuuggauuucuggaauuggaaugcccaacugguauaaugcagauguuccaaaacccaaagaaaaucugaacccugaaacaugucuggucccaagcaccucagauaagggauacucagccuauacuauaugaucuagcaauccacuucugaguauguauccaaaacgauugaaagcaggaucucagggagacauuugcauacccguguucauagcagcauuauucauaauagccaagaaguggaagcagccccaaagugacauuucaguuuucccccugcauucgcuuguccuggaugagaauagaaaggaccaugugugaccuucauuagggaaagaaaagagaaaauugcagagaagauaagucuuuucucuaacaguucccaaaauccguaacugaaguguuugggccuuccagauuuuccucuaugggaugcgaaugacuuggaauuuugggaauuccaacuccccaucucuaauuuuauuuaaauugcuuucucaauugacugacgaagauuaguuggaccccauuucugaacaagcuuguuacacagaaauguugccagggccuacuguuuauccucuugagccaagaagagaauccuucagacuucuaaguuacugaacacaugcaguaucagaacuauuggauacacagaaaguuuuguuguagauaauauauuuggaaaguuuggagaaaguuccucuaccccuugccuucuuugagcggagagcuucuuaggauugcuugaauuugcaggcugcauuucuaacagcccucaugggaccugcuggccuuucugggcugauucucuauagcacgggaaccguuaugugaacaugugaguugauuaucuuuaacauugugugugggaacaaugauagaauaaggacauugcaauuugaagaucauaaugacauuguuuuuuguuuuuguuucguuuuguuuuuugagauggaaucucgcucugucgcccaggcgggaguguaguggcacgaucuuggcugaccauggccuccgccucacagguucaagcaauucuugugucucagccucccaaguagcugggacuacaggcaugcgccaccaugccuaacuaauuucuguauuuuuaguagagauggaguuucagcauguuggccaggguggucuugaacuccugaccucaugugauccaccugcuuuggccuaccaaaguguugggauuacagaggugaaccacugugcccagcccauaaaugacauuguugauuuagguaaaggucaucaauggaagguugauaaggaucuuuacaauguugaauucaggcuggcaucaccugaaccaccuaagagagggacaaccacacauuauaugauuucugaugugauguaauaugaaguacaaagaauauacuuaugaaguauauucuugccgucccuccuccccccaccaccaaaaaaagcgagccugaauccacucaagccuugagagcagaauuccagcucacauaaaaugcaagaauauggccgggcacaguggcucacaccuguaaucccagcacuuugggaggcugagguggguggaucaguugaagucaggaguucgagaccagccuggccaacauggugaaaccccuucucuacuaaaacacaaaaauuagcugggcgugguguugugugccuguaaucccagcuacuugggaggcugaagcaggagaauugcuugaaccugggagacagagguugcagugagccaggauugugccacugcacuccagccugggcgacagagugaggcuccaucucaaaaaaaaaaaaaaaaagcaagauuaaguuaaaugacaccaugagcuagaaaacagacaaauccagaauuuaggacauucuacaggacaauugacucaacugcuucagcaagucagacacaagggaggacagggagaagauacugcucuauauuaaaagagauuaauauagacugaauagaagaugauaccaagaaacuaguguugguauugcuagauguaauaauggcauuguuguaugagaaaaugcuuauguuuuuuagagauacauucugaaguauguaggaauguaaugaugugaugccuugauuuuauuuuaauauacuacaaaagggaauagaagaagaagagcgagauagaugaaacaaauggagcaaaauguugauaauuguugaaucugaguggugguuuauuacugucuacugugguauagguuugaaaauuuuauaugauuguauuuuacauauaauauuucuuauagauagguagauauuaguauguggggacaauagugguuaucucugaguggugagauuacagaguagauuuucuuuaauaaaguuuuguauggucuguauuuucuacaaucagcauguacuguuuauuuuucauuuuauuuguacauuuuuugauuuaagcauuuucugcaauaagcauguccauaauauuaaaaauguaaaaaaguuuuauauuaauauaggacuaacccuauuuacacuuaguuuucagaguuuaucuacaaggcaugguuuucugauccuaacccccucaaaaaauagaaagaucauugcuuaacuaucagguuaggaaaugcuuuuuucuagagcagcuguagcacuuucaaaauuagaucacuggcuuauauuuugccacgaagugcagaaaagcauuuuugagaaauaaagguuugucccaaaugaaaucagcucuaggauuaucugcuaagauuguuguguaugguuaucucaauucucauuuggucuguuccagaauguugaaguuuaugugauuaagggaaggcucacuauuaccauaaaugucacuguuuugaaagacuagcuauugucauacccuaccauucuuuucaaaagucacugaguuaaaaugguaaaaucugaaguaaagauuacugaugggaaauuuauagugauggugguaauagcaaacaauuuuauuuugcucaguauauugcagauguuauucuaaaugcauuauauauauauuaacucauuuaauccacgcaacaacccuuugauggagguuuacaguuauccccauuuucuaggugaggaaacugaggcucagugaaguuagugaccugucugaggaugcaaacccaggcacccacaauggcaaccacugcaguguucugcuacuggaaacagugcagcacaaaggugcauaagaaucugaaagcuguggauaaaguuaaggcaacagaauccucacuuuuuagagcaaagaugaacuauauaaucuucuguuuuaggugaagauucugaggaugauucugauuuuugugagagugaggauaaugacgaagacuucucuaugagaaaaaguaaaguuaaagaaauuaaaaagaaagaagugaagguaaaauccccaguagaaaagaaagagaagaaaucuaaauccaaauguaaugcuuuggguaagcuugguccaaaacacuuaauuuuauaaaggaaauguaugugguuuguuugccguauuuuucuuauuuuugccuuuguucucuuuaacauuuuccuaacguccauuucuuguuaaaauauguaaaaggaaggugggguggggaagggagaaaagcggacaagaaugcugacuccacuacguaugcuagcacuuacuguauaugaccucacuuugguacucauggcugccgucugugguuagcuguugucaccugcauucuacagugaaaaacugagugucagagagguuaaauaauuuguuggaaaucuuacaucuaauaggugaagggcuagaauuugaacccauguuuguccauucagagucuaagcuguaucuuggaccauauuuucuccagacaaaacaaggaaguuugcauaauucuaauuuuuugcuuuugugcuuuacuuagucugauuugagagcucuuuugccacauguuuagggcccuuuuuuuuuuuuuauuuccccaaaacaaauuccauuagaaacuacuuuuaugauaaaacguuuaaaauuuauggugacucgaacauggaauaccuguuucuuguguaaaagaaguuaggauauuuuugaguucauaguauaugauagguuauugcaaaauauaacugucauuaacugaguuuguuuuauuucuugauaaucauuuuuaugucuugguuuauuuaauauauaugcuauugauauuaaaaguuccauuauuuagucuuuccauuuauucauaggagcugcugucaccuucaguagccuguugcugaguacuuacuaagaauuaaaugagaauuaaguacugauugaguuauauucuucucucuccuguauuuugaauuaaugagguuuuuuaauuagaguguuuuuuuuuuaauugaugacuucaucuggguuccagaaauucugaguaucagaagucgaaagugguucucacugggcuaaaaucaaguagucagcaaaacugugguccuuuguggaggcucuaggagacaaaccacguucuugucuuuucuagcuccuugagggugcauuucuuggcuuguggccccuuccaccuucagagagcaauggcagggacuuucucacaucauguuacucgacucugacuuucuuccugcucacguuuacuuauaaggacccugugauuacauugggccccuccagauaauucaguguaauuuccccaucuaagauucuuaauuacaucugcaaagucccuuugccauguaagguaacauauucacauguucuggcaaugacgauguagacaucugaggagccaguauucugccuacuacaagcuauaauaggaaaaaguuauuaacaccaugaauauauuuuguauuuucuuuagauguuuguuuaugcuucuucaccaagacacacuaauaacuaaaaauaaaacuucaguucccaaguuggaguuuaccauuuaaaaucuuuucucuaucccuuggagcaaguugcuucacaacugagauuuaauauauaauauuagaaaugaaauuuaaccauuaagugauaggacuaggaauuaggaaaaauggauuauauuuuuaguccuacuaguaauguauuggguaaacuuugcgaauugugucuagcacauguuauaauuuucccuugauagaaaaaauguugagagcuaugcuguccaauaugguaaccucuagccauguguggcuauauuacauuugaauuaauuaaaauuaaguaaaauuuaaaaaucaguuccucaguuuugcaagccacauuucaagugcacaguaacuguauauggcuagcggcuaccauauuggacagcacaaaacacaaaacauuucuauaaucacagaaaguuccaucagacagugcugaucuagaggaugcagauguuaacauuaggaagaguauacggugaaaauguucauguuuauauguguugaaauaccccuagguaucucaaaacaagcacugucugaaagugaacuuaaugccaccucuccucccuccccaccaccaaaaaaauaaauaaauagaaccaaaacauacuuccaggcuuguguuuauucucuagauaaauggcaccaucaaagugugcccaugacaggaaccugcaagucauggauuauuucuucaucuccauugcugccucccaccuauuuuugccaaaacauaucuaaugugcuguuuuccuucuauucuccaccuuagcaggcccccauuuccucuuaccugauuaccauaauaaccuucuaaguagccuacuucuccuacacuaccaccagaaagauguuuuuaaaauacaaaucacuccugagaaaaauaugugcaugacugugacuagccagacucuuguacauggucugcaaagcucuucauaagugaucuacacccagugucuaucucucacauuuccuacccuugagauuucugcuccagccguacacugaaccagucaguacuacugauucuggaacuuggugcauccuccaucuuugcacacuguacucccucugccuggaaagcuucucucaauucaccuuuacucuucaaucuugauuugguucagaccauccucacucaccuccuucuaacuuuaaaacacauacccccagauugcaguuuccuuuucuacuuggcauaccuuuagagucugccauaucccuuaccacacugcauuuuacacaucuuuacuuuccuguucuucccacugaagucuagugacuaaaccuuaaaguccuugggagcaggagccauguuucuaacccuagagccugacacauaaucucacugacacauacucacgagacacuauuguguaaugguuaguuacaaggaugggauuuuggaggaaaaucugguuucuaagcuuagaugcuuacuagcugucagacuacaggcagauugcuuaacgucucuguuuccuucucugagaguggggauaguaauaucuguauuggaguuguuguaaagaguuagagguaaugugugugauaugccuaccacacugccuggcauauuaaugcucauaaaagauggcuauucuuaggcucucaauaaauguuuguugauuaauaaguuuauuuuuuauaugauuauguaacuuuauaauuuuuacacauauaugcuagacuuacuuuuucuuccugcaugacaaacauuuuuacguauauuuuucaaauaagugacuucgguggacucugcuccagcugccgucaaaucagaaucucaguccuugccaaaaaagguuucucugucuucagauaccacuaggaaaccauuagaaauacgcaguccuucagcugaaagcaagaaaccuaaaugggucccaccagguauggcauauuuaucaucaaggacaggagcuuggaaaauuaucacugguaaauuuuuuuccuaguuacaaacaucaugugugagcauuuccccauauuauuacauauucuucaaaaccaaaguuccugguugcugcauauauucauuuauuuaaccauuccuuauuauuggacauccagguuuauuauuuuuucagugcuauaaauaagauugcaauaagugcaaauguccuuauuuuagaaaucucugggcauauuacugauuauuuuccuaggauaaaauuucuaguaggaaaauuacaguguuaaaggguguaaacauuugagauuccugaaguauguauuucuggcagcaaaucuuuugcucaggaccugcugaccuccacagucugacugaagccuugggaucuauauguggcaauucuagcauuuaacaaaugcccuagcaaacucaaccucuugcuuucacaaauuucacuucucuguuuucuuuugcuccacagccaagucucauggauccuucaagaauucuuugaccuucacccuucuugacauuacuaaaacccuaauccaggcccaaauuguugcugccuuuccuaaccaguccugucuuuacuuucugucauccaccugcaugaaccguccacuucagugaaauugaaacacuuuuugucucucaaacauguuguauguaugccucucucagggccucucuuaauccuccucugccuggugugucuuucuucauguguccccucuccuugccugagcccuuccaauucuacuccuguuuuucuuuugaggggccucucuugauugguccacagugcucacuccccugcugacuacuauucauagauuuaggcgugagcugugaggcugcaugauuacuuaacuuacagagucuucauuucaucaugugaaauauugggaacaacuguaaucuuuaaaguccauucugguuuacaacuucuaagauuuuuaaugaggacuuaaaaacuuuuuggagaaggaaaggagggaagauuaauuacuugaugucauaucauucaaagaguaauacuuaguauauuucuaaaaauaauuaaugcuuccccaaugaaggaaauuuaaauggagugauauaacuauagaaauuuaaaaguagcauaauuaaaaaaauacaaggaaacaguggaaugauggauaaagaguuaaugucaucaagcacaaagugcuuaucaagucagcaugugacagucaggcaagugauguaaacgagugaauugggcccaugcaguagacuugcguggguaggaauuuuguuggacucaggagcgcguacccuuuugaaggaagcagcugcuacucagcuccaucguauuguuuccaugcaagauuaugggcuugguauuucuagaucugauugcuguuuucaagagaagccagaaauccagauuuuaauaugaaaucugcuaauuuuuguaaguugauuuuuuuuguuguuguuguuagcaccaugugaaccaaaacaauauaucugagagcuagauuuggcccucagauugccaguuuguuaccuaucuuauacaacuggagaagaccaccaagaccccaaaaguaaaauuagccagaggcauaaauauaacaguguccccaagaacuauuaauacaacaagaaaauaugaagaguuucagucucacugguaauuaaggaaguguaaauuaaaauaaaauacuauuuuauaccuuucaaacuagaaaacaauaaagcaguauagucugaguuauaggguagcagguauaauuauuuauuuuaaauuuauaauacuguuguguaggcgagcaacuacagucaccaucaacugugaacauucauguggauaauuuugaaauagauggaaauaauugcgacauuaggauaauaguauaaugaaacuaguauaaauaaauaacaauauuugccauuuuuaaagguauuuaauaauugaaaaauagacucuucaaggacuacuuguaaaaauugcaggaccuuaaaaaugcauuugcuuuuucuauuacuuuagaaauuauaauuauaugcauuuuuguaugccuuuacaacuagcauuauuuguucccagccuuccuuuuucagcuuucauggugagguuuuagugucauuaccuuggcuucugggauguuuggaaauaggcaauacuguauuaauuucugcucuuuagaacauucuguucuuuugaucuaguuuauugcuugauagacacuggaaagcagaauaaugcuuaacuaccuuuuuuuugcugcuuauuuuauaaauuaaucuuuguuaagagauuucugacaucaucagcaucacaucauauguuuccuuucagcggcaucuggagguagcagaaguagcagcagcccacuggugguagugucugugaagucucccaaucagagucuccgccuuggcuuguccagauuagcacgaguuaaaccuuugcauccaaaugccacuagcaccugagugugguacaggaggaauguuugguugggagaaucacagcuuuacaaggguguuuauauuugauuuguguuuauauuugaggcagguauuguaauauaaaggaauccauuaccauguccuauaaaugaccucuagccauuuuaugauuauguucucuguaaaacucuucaagacuucaaugagaaguuuguuuauaagaauuaucuucucauaccuuuccuugugaagagcguauucuguuuuucuaucaguucgacaugaaguccacaucacaugcuguucuuuucuaguuacaugaugugccuuucuagcuuugucuaguuuauagcaccuuaacuuuaacuguucaguuuuaucuggcagaggaaaacauucuuauuucuuucagaagacauuucugaaaucuuauaagcuacuuaagcuacguugucaguuuuaucgcaaagauguuuuguauuuuagccaaaucuuuuuauaguacaaacuuagaauuauuuuacacacuaaaaugguugcaguuuuauggcauaugucuccgauuuagaugguuauucucuagaaaauaguauuuaaagacauuuuaugaaaucuucauugucaaaaccuuuaauaaaaguggaaauauuuugaaaugcccuuuuucuugauaccacucauccacguguuccugauuguccacauuucaugauaaaaugagagcuccgcagagaauguuagccuuucuguuguaaauguaaucuucaaguagucacuuuuuguuaaguucuuuagaaaguaguugucaaguacuuagucaucccuauuaugauaugagauaguacagcuuuucaggaagcuuagaucugaauuuacuuugaaaaacaauuguaaugaauauuuuauauuuacauugagaauuucaacuagcuucugaucaauuuuuaauaaaaaauuuucaaaucauguuagcuguuaaaaaauguauaauaacucaguuuuucuugguuuauggaaauaucuauauuaaugugaaaauaauuaauuuagaauugugauuaaagugagcauuugucuauugcuguuguacacuucuuuuaucuaacguauauuuuuauagugucauauaccagcccccuaaccugccccaccuguccccuuuuuaaaaacauauuuuccaguuacauagcacugagguacuc

SEQ ID NO: 14909 - RNA, 50635 nt, Homo sapiens
cagcugguuucccagugcaggacgcgcugacagcucgagugagcggacugcccaggacuucggaacuagacgaggugagcccagaaccgagugaggaugcccuuucagacugacaaccguuacagagggauuaguccccucacccggcugaaguuucucagcucgaccgucugucuuccuuuucccugauuaaugugagccucagagccuccgcucuguuggcuguguguguucgguccagaccuuccaucccauuuucuuaugggaaaccuuccuggauuucacgguugcuaaaacugaacccaggcuucaggauagaccauuagucuaaaaaaagagcgagaggagaaagaacuaaaguuaucaguuucuugaaacacaagucuaaauguugaaccagagcuuuugugucugccuucucuuuuuuuuuucaacauuccugauucauucauauuuuugcauuuaucagugguugauucuuuuuuauugcuguguaguauuuaucucauaaaauaaacaaguuuacuauucuccuacuaauacgcauuuugguuguuuccaguuugggguauuauaaauaaaacuuauaugagcauucuucuggguguacuuuagcgaacauaugcguguguguguauuuggauauauacuuaggaaugaaauuucuacaucauagaauauaccuuuauguaguuuugguaguuuucuaacauuauaaaaauuuguauugcuuuacguuuaauuuuaauucuuucugaguaaaacaaauacccuaucucuuugcauuauggugaaauagacgaagauuuuuguguauagccuacauacagauuugaaaauauagucuggauaauucaacuuagccccgccccacgacauguacaaaaguccuuugaguuuuuuuuauauuucaggugauaucuuuuuaaauaaccguaugaauaauuuuuuguucuuuauuuuuccagugagcaccauaaaauaaaaacgccauacaauccaacaauuauuuauuaguucuugccauucgcaacauccugccuaauacauggaauacaagacaguauuccuuccacuucaagaagacuguuuucuagccaagaguaagaaauagagcgugauaagugccaugauucaaauaagucuaggcuaauaugagagccugucgggacccaauccaguuuuagggaguuggauaagucuuccuagaggcuuaacugagaccugaagaauuagcaauuguuauccaaugaaauuaagaucaguaagagugcucuaggcaaaggaaaaggcauucaaaaagauucggcauggaaggagaaguuugguguugacagaaguucagaauggcuggaaaauaaaauuugugaauuuguguauuaggaaggagaggugcaguuucugagagaagaguggaaauauaagcagggguguuguaaacugggauaaagaguuugcauuuuauccugagagcaauggaaugucauagaaaguuuuuaagcggaugaacaacaugaucagauaaguauauuccuuuuuuaaaaaggaagauuacuauaacuucaguguagaaaauaauguaagaacugauuugaugggagaaagccuagccauaggaaguccaguuacaaggcugaugaauaaauaaaucuuuaauugauguugauucuuacugccuuuaacuagauuuucuucuuccuuaguagugucuaguuugccuuuggggugugggccggaaguggagguccuguacucucucuuuucuguguaucuucuucccacauggaaaucuuucuaacacuuucuuacuccccuucccccagucggaucucaugaccacaaccucuaaguucuccaggaucacuccuuggucccugaucugcuucuuugacuuucuuuuuaccaacgguuucuuaagcuuuguauuuccccacccaugaacucucccuaagaauucucucugcucuucucuccaugguccuucccuauuauugagaacccugccuuggaauauaaaguacuuuauggccauaauuuuuuuucuuaaaucaaguuuaaaacaaagugucuuuuuuuuuuuuuuuaaagaagcacuuuguuuucaucaugaagauggaaguacagggauaaacacuugggaaaaacuagaauaauuggcucauagacaaaaucucuugaaugguggaauguuuucuuagaaaugggacagcaauaaugaaacauaauuucuuuauggacuuauaaccuacugcuuuuuuguuaguucuguagaaauccugucaaagaauaugaagaaaaacagagaaagauucugcaauagagagagagaauuuguauauaaauuuaaaguaggaagucagugcuuagaacugagagugccacucaaauuuccuguucaagagaaugccagucauuugcauggacgucugaugcugcugcacaguuuaccgugcuuuauagaaaaaggugaggacuguuuuuuuuuuuaaguaacaccacuuuauuaguuucaauagucugucauuggaaguuucauauuagaaagcauaaaccuaagaagcuuuggaaacagccauaacauaggaacugauuccaagaauaaaaacauuucuccagagcuuucuuuuauugaguguuuuuuccuauaagugguaguuguuuauaaaauauaaaaauuagauuuuauaaugaaaaauuagcuacaaaguuuggaauuagaggagcucuucugaauuuaguugggugaaguuauaaggcaguuuagcuaucgcuaauugugcuaauagaauuauagugcuaaauugguugcccuuuuaauaaucuggucauuaauuucugagaugccauagaacagaaaguguacuaauuuuugaauagucuuugcuuaccuaaauuaguuuuauaaaguuagauguauuaaaccauuuuuaaaggucugugcucuaucucacagucuaggaaaaauuuaaaauucagaauauguuagaucacagguuagaguuauaagagaaccuagaaacuuuauagcccaaucacauuguacaaacaaggaaacuggaacauaaagagguuaaauuauuuacccuaggcagugguucuugaaauaugguuucuaaucauuuagcagcaacagcaucaccugcaagcuuguuagacaugcaaauucucgggcugcaucccauuucugcugaaucagaaacuaggguagcauguggcagucuguuuaaauaaggccuccagggguuucuaaugcacacuuaagauugugaaccacagucuaaagucgcgaacauagugauaauaauagagccaaagccagaacacagguguccuaacuucucucucagugcucuuccguuauaucauucucuaaguggugucuguaaaacugaaaucggucagucaucuaaguuaaauguguuaauaagcuagucauuuaacuucucuuucaaaggauguaacaauguacccuuuaaaguuacauggaaaacucuuuuuaauguaaauacaguaauguucagaccuucaaaaucuguagcauuuucuuuauguccuuauacccacuuggcuucaaacugaaauaucaggcuuaagaaaguaacauuacuuuauuaguaucaagggaauacguaagaguuaagacuuuugaccuuucucuaugcaauagccuguaauaguaaaggaaaauaaucaugaaauuaguuaaaugauccccuaagcugauuucauuuuaguuggagauucuauuaagaguaucagcuugauaaaauaaaauuucaugucugggcaagguggcucacaccuguaaucccagcacuuugggaggcuaaggcaggugaaucacuugagcugacgaguucaagaccagccugggcaacauggugagaccuaucuuuaccaaaaauacaaaaauuagccaugcaugguggcaugcaccuguggucccagcuacucgggaggcugaggugggaggaucacuggaguccgggaauucagggcugcagugaacugugaucaugccacugcacuccagccuguguaacagagagagagaccccaucucuaaauaaaaaauaaaaauuuaacaauaagauuucacauuggaauucucagccaaguaaaauguucccuauuuauaccuggauuuugcugacgaugguguuugaugucccuguaacagacuuaaaagaagcucugacucaguuuauagaagaagaaucccucagcgauuaugauagagaugcugaagcaucccuggcagcugugaaaucaggugaaguagauuuacaucagcuggcgaguacaugggccaaagcuuaugcugagguaagaaaauaggucagauuguaaauuucaaggauauucuggauuuuggugaaaauuuuuaaaaugcugugguaauccugaaaucguuauaagauccuuuuucuccacauacaauauucuauaauguauauguugcugcuucugugcuuccuauaucagggugagcacauaagacaaaaugcuauuuauguaauaccuuuguaaaacaagaggcuacuugcauauaucucaccagcacagggucuccagauuuaguaauuaaaaauauaggacacccaguuaaguuagaauuucagauaaaugaauauuuuuuaguauaucaacauauuacauggaacauauuuauacuaaaaaaaauuguucacuauuuaucugaaauucuaauuuaagugaguguucuguguuuuaucuggcaacccuaaaucagcaacagcauucauguaaccuuugguuuacuuuuauaaacuuaucuucauuauuguuguguagucacaucauaucauuuucuauuuaaauaauauacccuguuucauaaagucuaagaugccauuagguauaucacaaaugauuuuauuuacuaagaaagagcacugcaaauuaaacuaugagagaaugccaagaugacaucaaguauaagaggcaaagaaaagacucaaaaauauccauuguauuuaucaaguaaucuugucuguggcaagaucaguuucgguaaguugguggugguggaaaugagauuucacugacucuaagcaugugggaguguggaaauaggaagaauuaguauacuaacugaagaaguucgaauauaaagaggugaaggauggggcacuggcuaaaugggaacacaaggucagagguuuguuuguuuguuuuuuaaggcggcaaaguuuaggacuagaagggauagaauccagaacucaaauggagaauuaaucauaacugggaagacagaugcuucuccacuuacagccaaagagaagcaggaaagguuggauauaaauucagauaauuuuauuaauuugguagcaggaaguugagaauauucucuucugaguguuucaacuuuaaggaaagacagguuauuuguuuagaugaggcaguagguauaaaaagauuguuggauauuuaaggagaaaaccgagcagcgaaugauaggauugccaggcaucauugaggccaagauuaagaguggcaccaguuugucaccauaaacuuuauagaguuuugugauuuuucugcuacagcucucuaaagcccgacugcaggcauagagaagaggaauaagaugaggguuuuguuagguggguaauauaagguacaucagucaagggaguugaggauaucggcaagacagugguugaaugcuagaucacaaaauguaagcuacauagggaaagaagugaagcuaaguggcaguugauggcugauuuaaaaaaaaaugaaaacauugagaaacuuaugaaguggagguccugaugagguuaaauaucaauuaccuggggauuauugagcgagaaaucuuggguggagguuguagucagagacuagaauguuugaauacugacggacugaguuucuggugaggauacuaaauggauggcugaggugguguggagaacuaguaaauguugcagguaaacgaugacuaucugggcuggugguacagggguaaaagaauuuaccaagacaguuguagauaaagaaagguagguuuauuagagaaaguaggaaaauauguugcgaggaggcaaugggcaggccaacagaagagaagcugacuucaaggaaacaaaggcuugcuggagauuuuauaggacagcguuuaugcuguaugcuguacagugcugugugcaguacugauaaccccaagacugcagugagcugcagucuugcagcuaucuugcaggugucuggugaaaggugagugcaggagggcuacguggccuggaccagggguguccaaucuuuuggcuucccugggccacacuggaagaagaauugucuucggccacacauaaaauacauuaacaugagggauagcugaugagcuaaaaaaaaaaaaaaaaaaaaauucacaauuuaugaauuuguguugggcggcauucaaagccauccugugccacagguuggacaagcuuggucuggaccaugaggaaaggcagacuuauagcuuaucugcuuucucuuuuugcuuuccccugguccugccagccugauuccuuuucccuaauugggacuccacaguaaagauuguagaguucgggaaaguaagaaggcagugccuuggauggguuuccacauggauauccaaguaacccagguugauggcaggauguggggcagagaggaauucuuugaacuuggugccaaagcuuuacaggaaugagggugagugacagacagguagguuguuagauaaugauggccaugaaagauaaggggugcugaaugguuugaaccucaaagaagucaggcguuaugccugaaaguggagguggagaaauaauggccuggacauugaaucgcuuucucucugcagucacuuccucagugccccauuccucucagccgucccaguccccuuucuaguagcaucuguccugagggaguggcguaaauuaggucaaggaaaaaccuaugcuuaguucuucucacguagguaucuucuaccuauucauaaagcuuccccuaggcugaguuuaaaauuaaugcugcagauuuuuguaguuagaugaucugguaguggggcuacugaacaucugguguuguguguggccaagcacaucccuacagucuuacaguagcuccucccuacaaaauuucaacuuugcccugaagugaauuuuaaacagaaguuaagucccauaggcugguuauaauuccuacagcagucgcacgucuaaagaugaacaguuaucagaacaguuuuggaguuucagaggcauagaguagaugaaaucguaguucuagguucagcuagucuccugccuuuugauguggcaacugauugaagugaaagagaacaaauuagaaaaguuuuccuguugacugacugaguucaagauagcuguuuaugugauguguuuguuuguuuuaagguaaauuauuacucuuaagucauauuauaaauuccaguuuuuaauauuuucguggguaagaaaagggaagaauuuaguuuuuuuuuuuacagguaucuuuugcaaagaucuauaauggaaaaaacaucaaaaucuuuguuuuauuuccacuuaaugccauuaagucauaugaucuuugacuucucaguguaucaguuuccuccgaugaguugaggaggcagcccuugggauaggcaucuguaccucccuggauguauucgugugugcugagggcauucccauuuuguuucucccuguuucugcuuuucuugucuaucagcguuuacucagucccuucaucauuuuaauagcuaccauuuuuauauccuuaaaagccugcugauauuuuaaaaagaaaauguaacacuagaaaaggucaaacuaaaugcauaauuacacauuuaucuugauauagguaugcaugaauuuggcuuucauucgcaggugaccacauaggucaccuuauuuucuaaauauguaaccuacuuuaacaguauuuuuuuaauaaugaaaaguuuucucugauuauguaacuaaugcaugcaaguuauuuuaccauacaguauguuagaauauaaauaaaggcuaucagaaaucccacuguccugaaauagccaccauuagcauuuuguugaucaucugugugugugugauuucacagaaaugaggucacagcauaagcuuuuauuguggacacuuccuaucccuuccuccacauuaguaccuccuucucauuucugcuuccggguaacuuauauuaagaacuuagucuguaucucuccacauuuuuuuuuucugugcuuagacaauccuguauaauacacacacauauauuuacacacacauauauauauaagagggucuuucugucauugaagugcaaaaauggaaucauacauacuuuucuaguaguguguuaaauaaaaauacuagaucaugauuuaagauugucuguauauuaucuuguagaccacguuagagcaugcaaggccugaagaacccagcugggaugaagauuuugcagauguguaccaugacuuaauucauucuccugccucugaaacucucuuaaauuuggaacauaauuacuuuguuaguaucucagaacugauuggugaaagagauguggagcugaaaaaauuacgagagagguauuucaaauuucuugcauuaucagaauuaaauguuacguugucaaauagauggccugcagaacaacuuguuuuuauuuuuuacaaaaaggauaagauagaaaaaaaaacuucaauauuagaaauuaauuuucuuguauguuuaaauguguaacuacaacugggaggguccucauagguuuauauaccuucugagugguuuaacuaaguaaaugauacuggugggccuuauauauucuuaucucuaauaagaggaauagauuacuucuguugaagguuuguuuuguuccaggcacugugcaaacugcuuuggaugcccuaucucauuugaucuuuaccauaacccuacuauuauuuccauuuuacagaugaagaaguuuuugcuuaaauaaguaacuuguccaagggcaugcuggaauuugaaaccaggaaaccugacuucagaacuguuaaccacuguaccauucugucucccuauucagaaccucuguauugcccugcucuaacuaugaccauggcucuuucaguucauuuuguacgcucaaguaccuuagaaaaaaauaauaacacuaguauuguuccaagaaauuguaauuagauuugaauuccugcuguauggauuacuuaacacaguauacaaacaaugcuuuuauuauuuaucuuuucuucagaguauguaaaaaacuucuagcauuauuuauuuuaaaguaauaaguggcuucccugacugcuuucuaguaacucuauauaaauugugauaggaauucaggauguguccuucuagauaauccauuguaauuuagcagaaucuaauaauauuuauuaucuuaaaaacacuuauuuaagacauuggguguauaugccauuaagauaauaguuuuaguguugcuuugauugugagaguauauuaggacuaaaucacuuuuguuuguguguguguguguguguguguguguguguguguguguguguaacugauuuaauagucccaaaggaguaaauuuaaaaagaugugcugguuuguuccugguucucauuagcuucccauuagaauacaguaaggcuagcaagaugagaauaaucuuuggagcauugucaugguuaagaaaauuuuaaguacagaaaaauaauaaggaaauguauuuaauaauuguuccugagggauacucucuucuguguacuaaauuagcauauuuauuauauugcauagauuuguaaauuuucauaacaauuguacuccucuggaccacuuauucucauacuuuguaaaauauuagaaugaucucuuugucaaaaagaacaugcuguuuugagauauuugucacuguuuauagguuugguuuguugaccagcuguauuggggcaguuuauuccuuuuugaugagauaccugcagugagugguugccacuagguauauaguugaaacauauuucccuggggaagacaaaauuuuuuucuaguucuuuauuauguagcccauaaaauugugaauauaguuuaaaaagaagaacaaaauauagaauuagguuuuuaaaaauacguaaaaguagaauuaccuaauacuaauuaauuacuuucuguugaacuucauuuguuugauuuuuccuccuaggccuucaaauaauauaaccuucaagucauccugaaucuguuauuagccgucagguuuucugugacuauacucauucugccucuuuggguauauugauaaauucccauuuuggcucccuauacuuccauuccuaguacuuucauugagcuguugagugacucuaacuugcagcauaguuugcugccucuacccccuagaaaacuauauaucuagccauuaauagucuauaaugcuuccuuauucuaaaucugaagauuuguguucuacaugauucuucaucuuuugggaaguucaauuaacgugcuaauuaccugcauuuacugguauucauacuuuuuuuuuucauggaauaguuuuuuaguagagguuuguuuugacuuauuuuauuguuugaaaucauauuuggccauauuucuugaugggguuuggccuucuuuuuucuuucuaaacauauaaauaauacuugaauucaucuaguuuuaaaaguuuuguaauuuauuuuuaaccuguccaaaccgcuagcuugaaaaagaaaaauaagcuguauuccucugguagguaauauuuauugcaaaggugaacaguaugacuuaagguaaguugaaauucacuagugucuguggagguugacccgaaauuuuggugcuuaauuuauuuauccauuucaugagcagaagugacacauuuucuuauuucauuuuaaugccauuguacaucuuuaaaagacaguuucucggcacagcaucaauaauacaaguuauaaugauuuuuuuucuuaaaguaucuucaagauaauauauagguugccagaguugucacaucucacauacugagccaggcuauauuuaguauuucaucugagacguaauaaaauuuucuucuaucuuaaucauagaaaaaauauauuguaucaucaacuauaugauuagcuaguugccuuuuggacauauuuaggaugaaauaaauguucaugaaauuuuauuuguugaauuucugucugucuuuuucuucacaagagaugugcucuuuuuuuaagcaaaccagauucuagauauuucuuuaaacuuuaaaaauggcaaugauaccuuuuauccacuagagggaacauguguaauguaaaauaguaauauauauuuauaucuguuuguauuuauaaaugguuagcaguuauuucuguuucuaaauaagaaucucacuugcaagcauaauuuucauuugacccauaauaguuauuaaaaguuaauggagucaucugccuuagaacuaagugggauuuaagugauauugaauauuuacuaccagaagguauauauagaaauguauauauguguaacuugcuugaauuuaauuuaucauauauauauaucuuaaucaguguuauaaauaaguauaaauucacccuuuuuuuuuuuuugagauggagucuugcucuguugcccaggcugaaguacagugacacgaucucagcucacugcaaccucagucuccuggguucaagcaauucuccuaccucagccucccaaguagcugggauuacaggcgcccgcuaccaugcccagcuaauuuuugcauuuuuaguagagauggaguuucaucacguuggccaggcuggucuugaacuccugaccucaggugauccgcccaccucggccucccaaagugcugggaguacaggcaugagccaucgcgccuggccaaaaauucacucuuaagagcaauuuaccugaauuaacuaggaugauaaaauccucuuaguuuauaucuguguuuuguucuuucccaguuuguuagaaauuuguuuuagaacaaacuuuuugcauacauuuguauuagaagauaaucuuuaauuucaauuuuuuaagugaacuuauuuauuaaaauauaacauacacacagaaaaggcaacaaacuguggguguacagcucauuaaacuuucacaaauuaagcacgaccauguaaccauugcccagaucaagaaauagaauauuuccagcauuacagaguccucuuucaugcccuucuaguccuuuacccuuucccucauaaauaaccauuaucuguacuucuaacaccauugguuaauuuuuccuguaggaaaaaccauuuuuaauuuuugcacauuauuucuuuggauaaaugcagaaggugugacuaacaucuucagacuguauuuuacgucucucuguaaauuuuaugacuuaauaguaauuugacucaggaucuaauugucugcuucuggauauaauguaaacuaacuuucagagguugaagucacuuuaguucauauacaaauagaaaauccauuuaagcugaaauugcagagccucuucuuugaggaaauuugcaggugaaaagggguccagaguuuuuaacauuagccaugguaauugaaagguaacuuagauuuugacugcauucgucugugcaauacauuuagaugaaaauuuagcugcacaaaugauguugauauuauaugacacuaucaucguuauuggcuagucuccauuuccaaggauucuaaaguacuuuccaguuacaauucucauuccuggacacauuucuauaaaauaaauuuuuuauuuucacuuuauagagauuguuugaugaaucugaaggaucauauaccuugaaaguuugaugaauaucccugauuuguuuauuuguguuuuagacaagguauugaaauggaaaaagucaugcaggaauugggaaaaucacugacagaucaagauguaaauucacuggcugcucagcauuuugaaucccagcaaguaagugaaauacagugacuuuuagguaugcaguugcauuuucuuuuguuuuuuuguuuguuuguuuuuguuaaaaaaauuaaccaguugguauacuguuucuuuuaggaccuagaaaauaaauggucgaaugaauuaaaacaaucaacugccauccaaaaacaagaguaucaagaauggguaauaaaacuucaccaagaccuaaaaaaccccaacaacagcucccuuagguauuaacuauguauuguucuuauucauauaguaguccauuguuaguaauguuuauauuuacuacaaaguuaaaccuuuuagcuguaugucuuuuuaauuugcuagugaaaguucaagacaauuuuaugcugugcuuuuaccaccuuuugcauuauaggcuuuauguggauuauuuggggggcaaugguuauugguuaguuugaaauagaacuuuaguuuuauguucuagauacauacaccuaaauacuuaaauacuaucuuuauuucuuuaguuuccacuccaugcaguaaacauugguugaaugccaaacacucucuaagcagaaaaacaaacaaaaaaaaccccugccuauauggagcuuauauucuagaaagagagacugaucuauaaauaaaauaauacugcauagagugguaugugcaguaacagaagcauguagaagguacagaaauagcauggaggauuucucauaaauuauaacuuguauggcaucucuuggccuagauaaauuguauuucacauauucccuuagagcuugaccauaccuauguuauuuccuggcuauguaucuguuauguuugagaauuaauauuuuucaaauccuaaaguauauucaguuggaaauauacugaguacgguauaauaauccuauuuccagcauaugccaguguaugcuauaaauauuuuuaaauagcauuuuauuuguauaaugucagucucaugucuuuuuuuuuuuucguuguguacccaguuccuugccaaguguuuagcucuugacacuagcacauaagacaugcucaguaaaaauuuaugggaugaauggauggacagauggauagguuauuguuaaagucuuuaccugacaucucuaucaucucuuaucuaaauauuacaguuuuucauuugccuuacuguuuuccccaaacuguucguugcagccugcuaugaaccauucuacaucccuuauuuuccaacgagccuuuuaaaaauaacaauaggaaaaaaaucagggugcaucauaugugaagcuuucuauaaaugaauguguauauugagccaaaauguaaaauauauacuguauauuguagucagaaacauugaaagccacugauuuaaggaagcugugaaagcccuuugcugugaaaguuaucccuuuaugaucaugcuacugcacuccagccuggguaacaagagugagaaacucuuaaaaaaaaaaaaguuaucucuuacuuugcugcuagaguuucagaaauucaaucuuuagaaucaauuucuuuuuuuuuaaauuuuuuuauuauacuuuaaguucuaggguacaugugcacaacgugcagguuuguuacauauguauacaugcaccauguuggugugcugcacccauuaacuugucauuuacauuagguguaucuccuaaugcuaucccuucccccucccccaaccccacgacggguccuggugugugauguuccccgcccuguguccaaguguucucauuguucaauucucaccuaugagugagaacaugcgguguuugguuuuuuguccuugugauaguuggcugagaaugaugguuuccagcuucauccauaucccuacaaaggacaugaacucauccuuuuuuauggcugcguaguauuccaugguguauaugugccacauuuucuuaauccagucuaucauugauggacauuuggguugguuccaagucuuugcuauggugaauagugccgcaauaaacguacaugugcaugugucuuuauagcacaugauuuauaauccuuuggguauauacccaguaaugggauggccgggucaaaugguauuucuaguucuagauccuugaggaauagccacacugucuuccacaaugguugaacuaguuuacagucccaccaacaguguaaaaguguagaaucaauuucauuuguguaaauauuggccuguagcugaugcugcuuuuaaaaaucaaguauuccuaggaaauaauguuuuuauugugacuuuguuacuuugcuuuucuuuuugauagauguuucuuugggcaggagagaucucuuuucaacacaacuauauauggaacccuuauaugugauugauaaaagugguauuuuaaaauuuauuuuugcuuuauuuuucuuuaaagucaggucaguugaggaauaaauuacauaaaguuaaaauucuucucuuuuagguguacaguuugaugaauuuugacaaacuuagucauaaaaucaucaccacaaucaaaauacagaauuucccuuuuugguaguuuuauuucauuguaguuugauuuuucuagaauguaacauaaauggaaucaaacuguauguagcaauuuguaucuugcuucuuucauguggcauaauacuuuugagacucauuggaguuguuguguuuauuagugguucuuuuuauuacucaguacuauucuaucauccauuuguuuauccauuuacucagugauggacauguuggauauuuccagauuuuagcaauuauaaagcuguuguaaacuuucaugaacaggucuuguguagacauguguuuugauuucucuuucauaaauaugcaaucccucuccccuaggaaugggauugcuuggucauaugguaaguguacauuuaacuucagaagaaacugccagacuauuuuccaaagugacuguacaauuuugcguucccaccaccaauguaugaggguuccagguguuccauaucuucaucagcacucaauauugcuauuuagacauucuaguaaguuuugcagugauagcucguaauuuuacuuugcauuucccugaugccuaauuauguuaacauuuuuucaugugcuggaaaaaugugucuucuuauugaguugugagaguucuuuauauauucuggauacaaguccaucaucaaauaauguauuuuacaaauacuuucucccacucuguggcuugucguuucauuuucuuaauagugucagucagagagugaaguuuuucauuuuaguuaagugcaguuuaucaguuaaagacuuuauuucuucaaaguaguuuuagguucacagcaaaacugagaggaagguacuaagauuuaccgccugaccuacaaaugcauagucuuccccauuaucagcaucccccagcaagaugguaccuuuguuaugaucaagaacauauauugacaucauaaucauucaaaguccauaguuuauuuuagggcucacucuugccauuguauauucugucaguuuggacaaauguauaggacguguaucugcuauuauaguaccauacagaguaguuuuguuacucaaaaauccucugugcucugccaauuuaucuauuuuuaaaugguuucuaucuugccuaagauaccuuugccuaauggaagaucacaaagauuuuauccuguguuuuuucuucuagaaguuuuauuguuuuagguuucacauauaggucaugauauauauuguuucacacagauauauguauaugacauauauccaccaaccuauauauuuaugcauguauguuggucuauaguuuguuuguuuguuuguuuuucuuacaacgucuucauuugguuuuggugucagguuaaugggggcauuguaaaaugaguugaucuguggucaucggucugauacgauguuuugauuucuagaauuuccaauuguuuucgcucuuugcuaaaauuccuuguguguugucuaccuuuccacuagaucuuuuaacauguugguuauaguuuuuugaaagucccuuucuuuucgucccaauaucuggauccuuucuaaaucuguuucuguugauugcuuuaucucgacaguggguuggguuuuuuucuugcuuuucugguugucucuucuuuuuucuucuccuccccggccccgagacagagucuuucucugucucccaggcuggaguacaaugccuacaaugccgcgaucuuggcucauugcaaccuccaccuccugcguucaagcaauucuccugccucagccuccuaaguagcugggauuacaggcguaugccaccacaccuggcuaauuuuuguauuuuuaguagagacaguguuucaccauguuggccaggcuggucuugaacuccugaucucgugauucgcccaccucggccucccaaagugcugggauuacaggcaugagccaccgcacccagccuauuuuucuucuuuucuuuuuuuuaacugauuacuggauauuguggguauuagaagagacugagguuaauaguauuuauguccagaaaugaacaauauuaaugugaagguuguguacaucuuaucagcaguugagguagguuugguuuccuuuuuuuuccccuuugcguuagacuuuauuuauuagcuuauucacuggaacaaugcuuggagaaaucugaaaaugcauggcaaguuuguuagagaucuugcuuucauauaauuuguagacuuuauggcuuuauuuuuaaaaaacuuuuaauuuuuuuauuucaguagguuuuuggggaauaggugguguuugguuacacaaauaaguucuugaguggugauucuaagauuuuggugcauccaucacccgagcaauguacacuguacccaauguguagucuuuuaccccacuuuuaucccagcuugguuucgugucugucaguaccuucaauguaccaccggcuucauuuucuacuggugcuacuuugugcuuagaacggcacuuggggguccaggaggauuuuucucugucucucugcuccaucccuugcuuucagcagccuucgcaugccagagcugcagaguggagucugccuccauacuuuugcucugccucccagcaguaggcuuguuacuuguuacuugaaucuaggcucauaguuggggguccggaaggucacuuuguucaacucuucuccaucuuuguugucuuuguccacucccgguuuggucaagccucguguaucuugauucucagcauuucugccugugcccuugagaaggcucucuugucuccugcccucaguguuuucuggaaauaccugauggaggccaguggaaaagaguuugcaaguucaugugccuguggcuccgaccuauucuaacuugauaugcuagcccacuuggccuucaagaaucuguuaaaauuuuagcugcuuucuuuuuacccccuuguaugacagcauccuauuucagcuaugcuguaacaaagaugaaacuccuuauguguccugucuguccuuggagguauaugucacgguuuggaauucaguuuacuagguugccuuaugaucacaaaucuuugauggacuccagaaaaguaugauuuuguagaucagcaguccucugagccuuuuuggcaccgaggaccaguuucacagaagacaguuuuuuccaggagagcuggagaggguuuggggaugaaacuguuccacaaggagcacacaaccucgaucgcuugcaugcgcaguucacaauacaguucacgcuccuaugagaaccuaaugcugccgcugagcggaugggagguggagcucaggugguaaugcucacucgccugcugcucacuuccugcugugcggcccgguuccuaacaggccuguacggggaauugggguccccugcuguagauuaucuggcuagauuuaaauuuaccguauuuacuaaugaagucagucauugagucuaauggggcuguugggauuagccccaaaaauuuagucagggaaauggaugacucguacagacuuguaucauccucagcauauaccacuguuggaauugaacggugauacgguuauugcucuuuuguggaagucuucucaggaacuauaaagaggagagcaaaaagaaaggcaguuuagugggaggagaauguuggagguaaaaaagaaaacaaacaagaaaugguaaaaguaaaggguguguauacaucaaaaugaacuucaucuuuuuuauuaucuacuuuauuugacuuuaaauuuuuauugcuaucacuucaucuauuuucugauuuugccuagggcuagcccugguauaggauguauuauauauuuuaaaauacaaugugauuuuaaaguaauaaguuaaucgcuucauuuaaucauucucuuaggcugcuaaaaguguuaaauggcaauauauuaauugacauuauaaugauugaaaauaauaaucugcuuuauuuauugugaggaaaugaaagaacaagugggaauuuuagaaccuguuggugcuuaccugucuuacuugucaccauggauuaaggaugaguuuaggaaaaaauuaagcaagacuuucagcuguucaguuuucucucauuauaaagcuuuccuuuaagaaaaguuuuugacaaacauaaaaguauaucaauaauuuuauuacuuuuagugaggaaauuaaaguucagccaagucaguucagagaaucuguagaagcaauuggaaggauuuaugaggaacagagaaaguuagaagaaaguuuuaccauucacuuagguaaguguguuaauuuuuuugcaguuauaauuuauuguaacuucugaaacuauuuuuuaauuauuauuuuuuuaaaauaauagagaaaagguuucgcuauguugcccaggcuggucuugaaccccugggcucaagcaauccacccaccuuggccucccaaagugcuaggauuacaggcaugagucaccgugccugaccgcugcaacuuuuuuuauaugcuguaagagaaaaauuccuaacaugugaguagaguguaccuauguuauuuuuaauuccaaauuauguuuuacuuuaagaaagacuauauuuuauuggcuuuaaguuuuguauauuuauauaauguuuuuugcagauagauuaaacugaaaaagucauuaaaaugggaaguugcaaggcccauuuuuaauuauuuugugguacagauuuaucuggauucuugccauagagauuugcaucuuguuauacuggacuuucuguagcugcuuaaguaucuuuccuggacuauugccuacccccaggagcccaguugaagaccaugcauaauuugagauugcugagagcagauaugcuggacuucuguaagcauaaaagaaaucaucgaaguggugugaaacuucaucggcuccaaacagcucugucacuuuauucuacaucucucuguggccugguuuuacuaguagauaaucgaauuaauucauauagugguauuaaaagagguaaguuaacaucauacacauuuauuuuguuaaauuucauccuguaacaccauucuuacaaagaaaggaauuacagggaaaaugaaaaaaaauuuuaaucaccuugacauccaaguagaccaaacaaacauacccagccauaguuauuuuauuucaaacuguagcaucgauagagugcuucauauuuauuuuucuuaaaaugcuauuauaaauaauguuuuuauagaauucucauuacgagguaaaacaaaaagagcaaucacauguuuucaguuuagaagcaaauucuggcuuggugauuuuuagcucauccauuugucucucucucucucucucucucucucucugucuauauauauauauauauauauauuuuaauaaccuaccucuuaaauuugcuagguaaaauucuaccuucccucuuaguacaauucacuuuuuaugauuauuucuaaauuuguaaauauauaaaauguagaauauauaaaauauaugaaacguauacuuguuuuugaaagaagcuuaaauagaauuuauuuccccucauaaauauaagaaccuucuuauauuuuguagcaccuuuugggguggauuaugaugaaaguauuauuuaaagaagaccuggaauuacauuaacaaagaaaugucaauauaauuaacucuuuugaguguuagagagguuaagucucuaaucaaaacaaaauugcugugcccuaacuuaaggcauaauuauuuaaaagacaaguauaagaaaucuuauuaagaaaaauaaguauuauuuucuuuuucuacuaaaucucauuguaaguaaauacuaaauauuugauaguucgcauuuagaaguuuguaaauguuuugggucccuuagauuuugccacaguuugccaagaaugcacugacuuccauuucccccgaauugaagagcaauuagaaguuguccaacaggugguacuuuaugcuagaacccagcgcaggaguaaauugaaagaaucacuugguggguaaaacucacuuuuauuauauucugucuauaaucacuguaauaguauguggaucaguauuaagaucauauagaaaauuauguugguggaagauaggaaauuaaaaacaaaauuaagauuuuuuuaaguuuuuucuauuuagaaagaacaucaaaauguauuuuugguuuuuugggguuuuuuuuccuucaacuuuuacuuuaaguuccagggugcauguacaggaugcgcagguuuguuacauagguaaacgugugccauggcgguuugcugcacagaucaacccaucgccuagguauuaagcccaucgucuauuaccuauucuuccugauguucuucccuucuccuaacaagcccgaguguguguuguuccccacaaugcguccguguguucugaucauucagcucccauuuauaagugagagcaugugguguuuggucuucuguuccugcauuaguuugcugaggauaaugguuuccagcuccauccaugucccugcaaaggauaugaucucauucccuuuuauaccauguauuccaugauguauaugugccacauuuucuuuauccagucuaucauugaugggcauucagguugauuccacgucuuugcuauugugaauaguacugcgaagaccaugcgugugcauguaucuuuauauagaaugauuucuauuccuuuggauauauacccagaucuucagaagcuuggacucugugccuaauuuucuuuuuuaagaggaugauuuucuucaagguucugagugaaaacuauuguuaaauuucaguacuauaguuauacuugaaguaggcacucaguggaaaguuggugaucuuuugauccaaguucuauaucuuuaaaguggacguaauuauuacuacagaggggauuggaaacguagacuaaaagguagcacaaaauacacaccuuuuuaugucauaucuuugacugucuuaaguagcaugaagucaguuaaaugaauuauuuuugguucuuuuaaaaaaaaaucacuguauccuugaaugacugcuuuuucuauauuuauccauaacauaacauucuuucuauuuaggaaauuuacaggaaaaaauuuuuuaauuuauugagauguauuugauaauuaaagauuguauauauuugagguauacaauuugacgauucaauguacacagauauuguaaaauaauuacuucaaacgaauuagcauauuuauuaccucagauaguuaccacuuuucuguguccguggugagaacacuuaagaucuguccucuuaaugaauuucaaguauacacuagaauauuguuaaauauaaucacauugucauacauuagauuuccagaacuaaccaucuguguggcugaaacuuuguaccccuugaccaaaaucuccccauuuccccccgccccagcccugguaagcaccuucuacucuaucagugugaguucaacuauuuuagguuccauguauaagugagaugauauaauauuuguuuuucugugucuggcuuacuucacuuagcauccuccaggaugcuuaguguccuccaggucaauccauguuguuacaaauggcaggauuuucuuguuuaaggcugaauaauauuccuuugugugucuguuuguguauguguguacauuuagguguguuuuuaguaucuugauuauugugacuaaugccaaaaugaagucuuuaagaaacuaauuucauuuccuucggauauauacacuaaaguggaguugccggaucauaagauaguucuguuuuuaauuuuuuaagaaaccuccauccuggaaaugguuuuuaaagcuauugaaaaaguuaauggcaucuuucuucagaagcuuucuaucuacacauaggaagaggauuaagggaaggcagguaaaagaaaaauuucuggcucaaaucgcagaguaauucagcuguuuuuuaauugaaaaaugaaaguuuauuuuauucuuuauuuauuuauuauuauacuuuaaguuuuaggguacaugugcacaauguguagguuaguuacauauguauacaugugccaugcuggugugcugcacccacuaacucgucaucuagcauuaaguauauugguuucuuuguaaauuaaauugguaccauagguuuguuuaguuaggaccuaaauauuuuuuauuuuauuuuauuuuauuauacuuuaaguuuuaggguacaugugcacauugugcagguuaguuacauauguauacaugugccaugcuggcacgcugcacccacuaacucgucaucuagcauuagguauaucucccaaugcuaucccuccccccaccccaccacaguccccagagugugauauuccccuuccuguguccaugugaucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaaucuagucuaucacuguuggacauuuggguugguuccaagucuucguauugugaauaaugccgcaguaaacauacgugugcaugugucuuuauagcagcaugauuuauaguccuuuggguauauacccaguaaugggauggcugggucaaaugguauuucuaaguucuagauaccugaggaaucgccacacugacuuccacagugguugaacuaguuuacagucccaccaacaguguaaaaguguuccuauuucuccacauccucuccagcaccuguuguuuccugacuuuuuaaugauugccauuuuaacuggugugagaugguaucucauugugguuuugauuugcauuucucugauggccaguaaugaugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugugaaaauuuucucccauuuuguagguugccuguucacucugaugguaguuucuuuugcugugcagaagcucuuugguuuaauuagaucccauuugucaauuuuggcuuuuguugccauugcuuuugguguuuuggacaugaaguccuugcccaugccuauguccugaaugguaaugccuagguuuuuuucuaggguuuuuaugguuuuaggucuaacguuuaaaucuuuaauccaucuugaauugauuuuuauauaagguguaaggacgggauccaguuucagcuuucuacauauggcuagccaguuuucccagcaccauuuauuaaguagggaauccuuuccccauugcuuguuuuucucagguuugucaaagaucagauaauuguagauauguggcguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaagucauugguagcuugugaugcggauggcacugaaucuguaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcuuuguuuauaugcuggauuacauuuauugauuugcguauauugaaucagccuugcaucccagggaugaagcccacuugaucaugguggauaagcuuuuugaugugcugcuggauucguuuugccaguauuuuauugaggauuuuugcaucaauguucaucaaggauauuggucuaaaauuugcuuuuuugguugugucucugccuggcuuugguaucagaaugaugcuggccucauaaaaugaguuagggaggauucccucuuuuccuauugauuggaauaguuucagaaggaaugguaccaguuccuccuuguaccucugguagaauucggcugugaauccaucugguccuggacucuuuuugguugguaagcuauugauuauugccacaauuucagauccuguuauuggucuauucagagauucaacuucuuccugguuuagucuugggagaguguaugugucgaggaauuuauccauuucuucuagauuuucuaguuuauuugcguagagguguuuguaguauucucugaugguaguuuguauuucugugggaucgguggugauaucccauuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagguugucaauuuuggaucuuuccugcuuucucuugugggcauuuagugcuauaaauuucccucuacacacugcuuugaaugcgucccagagauucugguauguugugucuuuguucucguugguuucaaagaacauuuuuauuucugccuucauuuuguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuuccaacuauguggucaauuuuggaauaggugugguguggugcuaaaaaaauguauauucuguugauuugggguggagaguucuguagaugucuauuagguccacuuggugcagagcugaguucaguuccugcguauccuuguugacuuucugucucguugaucugucuaauguugacagugggguguuaaagucucccauuauuaaugugugggagucuaagucucuuuguaggucacucaggacuugcuuuaugaaucugggugcuccuguauugagugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcaccugagauggguuuccugaauacagcacacugaugggucuugacucuuuauccaauuugccagucugugucuuuuaauuggagaauuuaguccauuuaaaguuaauauuguuaugugugaauuugauccugucauuaugauguuagcuggugauuuugcucguuaguugaugcaguuucuuccuagucuugauggucuuuacauuuuggcaugauuuugcagcggcugguaccgguuguuccuuuccauguuuagcgcuuccuucaggagcucuuuuagggcaggccugguggugacaaaaucucucagcauuugcuugucuguaaaguauuuuauuucuccuucacuuacgaagcuuaguuuggcuggauaugaaauucuggguugaagauucuuuucuuuaagaauguugaauauuggcccccacucucuucuggcuuguaggguuucugccgagagaucugcuguuagucugaugggcuucccuuugaggguaacccgaccuuucucucuggcugcccuuaacauuuuuuccuucauuucaacuuuggugaaucugacaauuaugugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccccaucacuuucagguacaccaaucagacauagauuuggucuuuucacauagucucauauuucuuggaggcuuugcucauuucuuuuuauucuuuuuucucuaaacuucccuucuugcuucauuucauucauuucaucuuccauugcugauacccuuucuuccaguugaucgcaucggcuccugaggcuucugcauucuucacguagaucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucucucagcucgucaaagucauucuccauccagcuuuguuccauugcuggugaggaacugcguuccuuuggaggaggagagacgcucugcguuuuagaguuuccaguuuuucuguucuguuuuuuccccaucuuugugguuuuaucuacuuuuggucuuugaugauggugauguacagauggguuuuugguguggauguccuuucuguuuguuaguuuuccuucuaacagacaggacccucagcugcagauguguuggaauacccugccgugugaggugucaguguaccccugccggggggugccucccaguuaggcugcucgggggucaggggucagggacccacuugaggaggcagucugcccguucucagaucuccagccgcgugcugggagaaccagugcucucuucaaagcugucagacagggacauuuaagucugcagagguugcugcugucuuuuuguuugucugugcccugcccccagagguggagccuacagaggcaggcaggccuccuugagcuguggugggcucugcccaguuggagcuucccggcugcuuuguuuaccuaaucaagcccgggcaauggcgggcgccccucccccagccucgcugccgccuugcaguuggaucucagacugcugugcuagcaaucagcgagacuccgugggcguaggacccuccgagccaggugugggauauaaucucguggugcgccguuuuuuaagcgggucugaaaaacgcaauauucgggugggagugacucgauuuuccaggugcguccgucaccccuuucuuugacucagaaagggaacucccugaccccuugcgcuucccaagugaggcaaugccucgcccugcuucggcucgcgcacccacugaccugcgcccacugucuggcacucccuagugagaugaacccgguaccucagauggaaaugcagaaaucacccgucuucugcgucgcucaugcugggagcuguagaccggagcuguuccuauuuggccaucuuggcuccuccccccaggaccuaaauauuaggguaauagucauuucaaauauuuuuuaaguuguguuuuucuuauauuucauguaucauagauguaaaaucacaaacauccucuugucuggcuugaaugcauacacaguauuuuauuauuucuccuuuuuuuuuuugagacagagucucacucugucaucuaggcuggaaugcaguggcacgaucucagucccugcaaccucugccucuugggcucaagcaauucucgugccucagccuccugaguagcugggauuacagauguguaccaccgugccuggcuaauuuuuguauuuuuaauagagacgggguuuugccauguuggccagacuguucucaaacuccuggccucaugugaucugcccaccuuggccucccaaagugcugggauuacaggcaugagccacugcaccuggcaaguauuuaauuauuucuuauaaaaaccugauauuggugcccaggaaauaaaaugugguaagcuuuaaaauuggggcuguuuguaccuuuaaaucuguguuugguacuuuugaaugcuuuuuucuuucuuuucuuuguuugcaccugcuguguuuaaagaaaccauuguaguauuuuaggugcauauauuuucuguuguacaguagcagagagauauuauaucuuugcuugauauaaggaagaccuuucugaagggucuuuguucccaucucccaucuuccucucucccagaaauuacagaauucuuuccuuucucccguagcuagaauguggcuaucuagucauaacuugacuagcauaacuugacuaggguucacugcaguuucuuuaucuauucaauaaacuuguaaaaaauaguuuauauguuuuuaaucauuuuuuaaauagguaaaacacucucaaaauucacaauucaaacuguacaaaagagcauacagugaaagugucccuaacucuguucccagccauccaguuucccucuucagagguacccagugcuaucucacauguaccuuccagacagauguuuauguauguguaagcaaguguauguguguacuuauuuuccuuuuuuacauaaauggcagcuuucuacauaacacuauucuguacucugccuuuuucacugaguaauuuaucuuggaggucauuucguaucaguccauaaagaccauccucauacuuuuaugcuguugcauaguagucuguugcaggauauccuguuauuaaucagucuccuccuaauagacauuugaucuauugcuuauuuuuuguuacuauaaguaguaaugacuacuaauuguaaauaaccuugcauaugaauaauugugcaugugugugagcaguaagcauaucuacagaagagauuccuaaagauaauuccuggguuaaaggacacauacguuuauaauuuuccguaguauuggcgauuacucuguauaguauuucuaccaguuuauauucccacuaaagggagguuuugcuguggcaauauguguuauauauaacagagccagcugaguauuagaaaaucccuauagaaguauauccuaacaaaaccuuucagaaaaucucgguauacccucuuauucuucuaccaauuguuauuacuuuuaucaacccucgcaaaaagaacucauauccauauuacguaaaaauagcuuccuucuucucguacaaacuagcaauaaugugaucagaaacauuuuaaccuuauucuuaguagugacuaaaagcaugaagauugagaucaugacagguguggaaggaggaggaggauucuaaguauauuuaugagagauagaaagugugcagucaaugacaggaaguuuuuaaaccacauacggcuaaggcagugcguguauaucaugauuuuauuuuguucuuguucaagcaacuacuuugugguuucagugagucagugaugcaaguagguuuauaaaagacuuucuuaaagcugcauguuguuauagaaggacuuugugaaaauaccuucuccaucuuuuucugugcacgccuacauguguguucugcauguuuacauccugauaugcaauuacuuguuuauucuaagacauuccauuauuuuucuuacuaugguuguuauauuaacaucuucauauuucugugguccaugauaaaaagccaaaaauguuuauacacauuuauauacauuuaaaaaaaauaaaacuagccaucuucuuacuauuacuaaacaagguauugccaugaaaacauggaaagggaaauggacuaugaacuguucucucucguuuacuuaacagagauucuauuuguucauacuccaugugaacaagauuagaguccuucuuuauuguuccuuauaaucuaugcuacgauuagacaucuauucaaagccuaucaaaucacauggcucuauauuagaaacgauaauucauuaaauauggauucuagcaucaaagccuucuaucucucugacucuugauuuauaaaauaugugcauuuacaaaguacaguguuauaaaucaauuuaucaaagucacuggauaaaaauauuguuacuuuuauucagaucucuuuuaaaacuauaauauuuugauauuugcuguuuacuuguuugaaggucuguuuucaugugauuuucugaugcuaaaggccauuccaaaauagauuccaaaauaguuuuuaauuggaauaaauaugcaaucucuuaaagauagcuacuuugaaggcuaauauucaguuugcauuugugaguucugauggaauucuuauaaacuuuagaugucucuuuuauuaaaauauauauguaaaauaauuugcauucagucuuuauaauguauauucaaucauaauguuuauuuuauuuauucuucuaagaaauagcgugccuucaaaaaagaagaaaaacuguuaaauaucugaaaaaaaagcuguuucauuugaaacaguuucaccuaucuguuauaauuguauauagcgucagguaagaaauaaauuuuaggaauggggugaauauacagugauuccuggucccacuagccauuuauuuguagcccugaacaaguuauaucaacaacagugacucagauucuaaaaauaaagauggccacaccacaacuaucuaaugaaguuauuuuauaugugguuaacuuggugcccugaaccucccagaugaaaaauaggauacuggcaugucuaauauggguaauaccauaggacuuauaaucugaguaugugaauuaaagaccuggcuccacuacuuaucugugcaugcuugguuaaguuaguuaacccauccaagccucugucuccucauacauaaaauggacauaguaguaggacuuaccucccagggcugugguuauagagguuuuguaagaauuaaaugacaucauccauguaaagcauauagcagaaugccuggcacauagaugcccuuagugaauuuuugcuguuguugugauucuuuugggagcagucauaguaacauauucucauauguuguuauguucuuucauauugcauugucuuaugaauagauucuggaaaccaaaauggaggaaaugaugauaagacuaagaaugcugagaggaacuauuuaaauguuuuaccugguaaguauuucuuuuuauuuuaaauuacuguuuucuuauaccaaaagauguuuuauaaugcacaccauaggaauuuauguuuuaaaucuaugauuuuaguauaugucauuauaucacuuugaaacaacacuuuguaccuauauaauacacuuucacagacguuuuccaguguuaaacuuaauuauuuuguugguuuguuuugagacgaagccucguucugucgcccaggcuggagcacaguggugcgaucucaguucacugcaaccucugccacccggguucaagcgauucuccugccucagccuccugaguagcugggacuacaggcccacgccaccguacccggcuacuuuuuuuguauuuuuuguagagaugguauuucaccauguuggccgggcuggucuugaacuccugaccucaagugauccaccugcuucagccucccaaaguacugggauuacaagcgugagccaccaugcccggccuaaaaauuauuaauauuauacuaguacucacuuuuuucuagauccauaaaagaaaaauugcucaagaaguugcauaaguuuuaucauuguuugcuauugcaaauuuucucuuauacacuauuucuuagcuucuugagaaauaaaccaaaaaauuaguuuuacucugaaauauaaacuauacacuucucagccuuauagcuaaaaucaagugauauaugaacaguagugcacagagauauaaacaguugaacuuaaauauaaagaaaauggaucaucucauuuauuuuauuuucauuuccucuuacguuuuucugcuuuccauuuuucuccuuuauuauucuugaauauguuguuuaacaacugaaaauucagucucucaauccucuuucugauugaauucacucugaugacccuuaguguuuguaucacagaacauaacaaggacuauuuguacacuuuauacaauuuuuuaacuaaaugguacauuuuacaguuucagaaauagccaucucuugaugguuuuuuauucuccuuuaagguaauuuucucacauuuucuuccccagaucuuugacauguagaucacauuaaccuacacacgaaaccgccgucacucagugggaacacauuacauuuaaccuaagccaauauuguacccauugcugguauucaucuugucaggccccgucuguuagccuguggccaucagccucgaaauuuccucccaccuucaguuaucccaucuuaguggauaauguuagcaucaccacaugcuguuuccuccacuguguggaacaggagaccauccuccucuucaucuaaaaauaccuucagugaaggaucuauuguauuucucuucauggauccacaauuuaaaucauccagauuuuguggcuuucuuaaaauuugccaaucuuauuacuacucuggaagaacuaauaucuguuuuuuuuuaaacauaacucuuuguugcuauauguguuuccuuagucuuuuuuggaaaaagccuauagguuguuuaacaacuggaaguucagucucucaguccuguuucugauugaauucacucugaugacccuuaguaguguuuguaucacagaacauaacaaggacucucuuauuuguauacuuuaucucuguauuacaaccaaaucaggaggauguaucauaagucugagauagaaaaggaauauuaaaguauucaguuagagauaauagcaucuuaauuuccauuuaaaguauaccuacacaaccaggauguuuacaguagaugaaaaaaaucuaaaucaaaaauuaauuuaauuuuuaaauugcaaagaaaaacaguuuuauuuauauacuuguaagccagucauaguuuacuuaauaaugaucuaaguauuuacaguuuaugucaucuaauucucauaauaaccuuguaaggaaagcaaucagcauuauuuuucccaucucauacacuaaguaacagaggaucaauaaguugaauugauuugcccaagaucacucagccaaugugcuagaaaucacaucuucuuaacauccaaucugguccuuuuucuacuauaucauauuaauuugauuacuacugccagccccauggcccccauuuuauuaauggguaaaauuaggccaagaaacaagucauuuaaggucaaagaaagcagugccaauuuggggauuaggagcaccugacuuguucacuaagucauccugcuacacuccuggaucauggcccauaucucaagcuaugacuuccaucaucugaauuaucaguagcgguuuagaagguaauacacuucacugggccagaaggauauugucuuaucauauaguucacugaguuucugauaagcagucugugucuuuuguugccuuccuagaaaauuauaacuacacuauuccucacgaauuuucuuuuuuacugucacuuuauccaguuuauugugauauaucuguugcuguccuuucuuuaauuuccuucucuguuuaucuaauuccuuuaucuuguucaaguuaaaauaaaaaauaaaaagaccuuugccugggaccugucagaggcaucuguggauacagcugaugcacagcggcaacuagaaauguuaaccauagggcuaaaguauauuaaguauuuuaaguauacuguauguuuauaaguagauccuaagauaaugauguugcugcaagggcgagcagaauuugugagggcaaagguuaagaguggaagaguagagauacgcagaccuuuccuagaaggacuuaucagaauuuccagugagguguauguauugguaagaacauauccuuucuauguuuucuauuuuauuucuuuauauugauaggaacuacagaaaauacaagcugaugagauuuuucuuggcuuguagagcuacacagaaaaaagagugaugguaggaagcauggauuuuaauguuugagaaagacugcuccagcguucagccuuaaauacucauucauucaacaaauacuuaucgaguaccuucuacgugccaggugcuguucuacuugcuaaagauagaacauuuaacaaaauaaaaucccuauaauuauggcauguacacaguggucucuuuaacauaauauguacauaaaagaauuucagugcuaagaagaaaauaaaaccgaauaaggugaaagaguaaaggguggaggagaccacuaguacauaggauagucaaggaagaccuuucugaggaggugacuuuugaucugagaugugauugaugaaaagaagucagcccugugagaaucuuggagaagaguccuccaggcagcagcccugaauuggaaacaagcucugcauguuugaagaacuaaacaaaagcauauguaacuggagugaggaaagagugagacaagaugauguuggagagagacgcaggguccaagucaucuuggccuucuagacuagugguccccaacguuuuuggcaccagcaccagggaccaguuucauggaagacaguuuuccacagaccggggguuggggagguuugaggaugauugaagugcauuacauuuauuguguacuuuauuucuauuauuauuacauuucaauauuuaaugaaauaauuacacaagucacuguaauauagaaucagugggagcccugagcuuguuuuccugcaacuggaugaucccaucuaggggugaugggagacagugacagaucaucaggcauuagaaucucauaaggagcacgcaaccuagaucccucgcaugcacaguucacaauaggguucgugcuccugugagaaucuaaugcugccacugaucugacaggaggcggaacucaggcaguaaugugagcagugaggagcggcuguaaauacagaugaagcuucacuugcuugcuggcugcucaccucccacuaugcagcccgguuccuaacaggugauggacggugccaguccaugagggacccuuguucuagaccacgauaaagaguagggauuuuaaguaggggagagauauaauaugauauauauuuaagucauaacugcaugaagaauugguauguagguggacaaguagggaguaaggagaucgauuaagagaauguuacaaaaaccuaggugagaaauuacaguagcaugaacuggggugacaccaaugaaaguggaauacucagaugugggcuguucuggagauagaacugaaaauaguuggugguagauuggauuguggauggggugauaggcauugagggaaagcaaaggaauuaaggacaccuaucuuuguguccugggcaacuaacuggacagauuggucucauaaguugagaugaggaacagcagauuuagggcacguaaaaaacaaguaaccuuuuuuacauguuaaauuugacauuuuaggcugggcacgguggcccacgccuguaaucccagcacuuugggaggccaaggcgggcggaucaugaggucaggagauggaggccauccuagccaacauggugaaaccccaucucuacuaaaaauacaaaaauuagcugggcaugauggcacaugccuguaaucccagcuacucgagaggcugaggcaggagaauugcuugaaccagggagucggagguugcagugagccaagauggugccacugcacuccagcuuggugacagaguaagacuccaugucaaaauuaauuaauuaauuaauuaauuugacaucuugggcauguacaucaaaauaaagaugaguacucauuugauuuauuuacuacuugguggucacuucauaccaauuuaugaaccuauugcauaauuggcuauugucucuuauuuucauuaccuucucucugagaauugaagagcaguaaucacaguugcuuccugaauccaguaaauguuugggauacaccccuacuaguucaacacauugauugcccauuacacuuacuuauaaagcccauugaugaaugugacuuacuuaggcauuugguaaucaugauuguauuuauuguucacaggggaauuuuauauuacacggcauucuaaucucucagaaauccauguugcuuuccaucucuguguggaugaccaugugaaaucgggaaacaucacugcucgugauccugccauuaugggacuccgaaauauacucaaaguuugcuguacccaugacaucacaacaauaagcauuccucucuugcugguacaugauaugucagagguaagcagauagaaaaauccuguaauuuuaugauuuacauaaucauaauauugauuuaacccccaauauuauauaauaauccacuuuacauuuuuuuaaacuaauggauuuuugcaucuccgaucugguuaguagaaucgagugaaauauaauacaaauuggugaauaauccuuaaccauuuauguucagagagcuauagcauuguccuauaguaaauaaacuagaaaauccaaauaauacuuagcuuuggauaaggcaugugccccuacaccucuuucuccuccuuuuuuuccuccucuucccugucuuccuucuccccuacccccucuucuuaccccucuuucuucuuuuuggcuuaaguagcauuagauuuacauacacauagauuuggcuuaggcugccaugaaaauuagucugcauuuucugaguuugcauuaauagguauugggaagagaugcuagaugacaggaagaagccagccuuaguuuaacauuugucucaaggguuccuuuuagcuaauacaguucugcaauuaggauguagcaugaucauucuuccauuuuguuacggacuauaauuuaauuuuuaacagucuuuuuccaugaaugguuuuccucuuucuuccuucacccacauagaaacugguuagaaggcauacauuguagaaauaauauaaagacuaaaauucagcuuuacauagucuggagaaacaaaugagccucaagccaaacagguccagacaagucauaggagagccagugcucaacuuggugaugaagggcuacuaucagcaacucugugccugcuuauuuugaggaggcauuuuuuaaaaagcagaguuggcaccuguagucccagcuacucccaggacugaggcaggaagauuguuuuagcccagaguucaagaccagccugagcaacauggugaaacuguaucucuuaaauaaaucacugacugggaagcagagauugugauugucaggaaagaaguuugauuauugauuauaaauagcuauuuaccaaaagaaaaaugcuauauuguaaaggacaguguaaaagauuuuauguuuuacuuuuuagacuaagucccuacuuagauucauuauauuacaggggccucauuuuaaauuucauauccuguauaacagggcucccaaacugccaggccaagaaccugccacacagcaggaggugagcauugaagggcaagcauuacugccugagcucugccuccugucagaucagcagccacauuagacugucauaggagcgugaacccuauugugaacugcgugugcgagggagcuagguugcgugcuccuuuugagaaucuaaugccugaugaucugagguggaacaguuucauccugaaaccaucccugcuauccccacccucacccccaacuccagucuguggaaaaauugacuuccgugaaacugguuccuggugccaaaaagguuggggccugcugcuauauaaacacaaaaaaauaauucuuguccuuccgagacagggugauuuucagugauuucccauuuauaaucuaugcugguauaguuuuaccaggcacguuguuguuuugauuaggagaauccugguacuauccuaugaaagcuucaucagacuuacuaauuucucauuccauucacuucuguagccucagucauaccuaauaugguaucaagagagauggacaaacauuuuuuucccuacuguagcuuuauaaaguuuuaguuccaucaggaauuuuuagcuauuguuaaaucaucaucacuaacuagucuaucuauaaaagggucuuuggggaguaacaaaguuuaugaugaauuccuaccacaagaaauucauccaaacauuccugcagcuggacuccugguuagccaguuuauaaaaaugguuauauguaggugggaaacagccucaaaaacaguguuuccaaaagucacuaaguucagauuuucuuccagacaucugauacuacuagcauucccucucccacaauguuacaaaaguuacauguuuuaaauugggaaggccagcugcagaacauuaaguuuguuuccaaaguguccaauuuaauucacaaaaguauauugagcuaugauucucccauuuguuguauuuaaacauccauucaggucaagaaguuuacucuauaaacucagacaacacuacacaggauauagagguaauauuguuuuagcuuuggugcaagcaucccgaagcauuuucaggugucauuuuccucuucuaacagaauuguuagacacucaguuaccauguuuuagugugugcaagaaaaugaagaugacugaaacagcccauguccuaugucagauaaaagagcuauagaaauuaauugcaguuuaaaaagaauaaaggaaaaauaaccuaucagcaagaagaaagacguaucaguuuuaucucaauagaucuuugugaucugaagauacugucuuauuggagucagucuuauggaaugaggagcugcaagccaagaauacugaauucucaacuuccuuuuauuuuugcuguuaacuuguugaauaauuuggggcuuaccaaauuauuuaguuuuguaacuguugguuacuaaugaagauuuuguuguuuguuuuuaacuucuuuauuggaguauaacacacguauagaaagguacacauagguacgcagcucaacuuuucauagacugaacacccauauauaacauauaugcagaugaugaaauggaacaugaccagcacccagcagccaccucccuuuuagucaguuaaaccacacucccuccucaaggguagccacuguuuucaucucaaaaauuauggauuaguugggcuugcuuuugcuguuuaucuuauaucuggcuucuuucguucaauauuauguuugugagaucuauccauaauauugugcaugguuauagauuguucauuguuauuguuauauauuauugugugacuagaccacaguuauuuauacauucuacuauuuguggacauuuggguaguuucuccagauuuuuauuguuaugaguaguauugcuaugaacauuccaacagacaucuuuugacauuucuguugagaauuagcuugucaaaauacuuagggauagaauuguuaggucucaggguauauuuauguuuagcuuugguagauaugccaaauaguuuuucaaagugguuguaccuaugcuguuauauugaaugcgaaaaauaagaaauaaagccaaacuauuucucaucuucugcuaaggacugugaaacuuauuaacacaaguguuucaaguaccucagaggcacauacuugagaaguaaagaauaaucuuggauauuccccauuggagcauaaacucagauaauaauucuuauaucugaauuccaagacauacagugaagacuucaaaagaacauacuggcuaacucugcaguucagccuuacccuaaugagaggauucaaguugaguaacagugagcuuuagauagaaggcguugucucaguuauagucagaacugagauuucaauuucauuuucauagguuuagaaucuucuuugcacaugucaucuaaagugugacaguagggcccaauuuuuggccaguuauaaagucuauaguguuucaccugauccuuccagcuucauuggauuucucuaacagugcauucucacaggcauguuacuaagauuuagucacuuuuccauuauuuagaacuuaugaucaaaaacuuucuguacuguuaccuggcccacuauguugucuauaccaucuauuauaucauauauacuaagauuuguuuccagaagugagcuccuugugaaacugcugaccacaacucauggugacauugaauaagucauucuucucaugaccuuauugaauucuaaagcucacaguuuacuuuuucuaaguacccaaagccauucuuuuuaggugcugguuuuaaucagagacaaaaggacaggauuaaaaaaccuugcaagcaucuaucuuaagcuaacgguggagucucuauggaggcacauggaagauuugaaaacaacucagacguauguguguguguguuugugugcgugcacaugcauauacagguagcugucuaguuuccucuuagagucauacgcugcuaaguggcauuaaguuaaaguauacugaauaugagaguuuauaucaucugagaauuaaauuuauuuuuaaaauauguccgucacuucaaagauuugcuaggguccugucacaaauugguauuuugguauauucucuaaauagcauugaugaaauuuugucauuaauucauaccaaauucugaaaagugugaaguucuuaauuuguaucacaaauacuugcucuagaccaugcuauuaaucacacauauacacaaagcaagaaagcaggguauuaaugaggaaaacgugaugaccuuuggacaagugggacaacgaacuucauuacucuuccccuaccuacuuuuggucauaccauuuaacccaucccuauuuuaacuugcguuacaaucuuucauuauuaccauuaguauccuaauuuuaaugcauuggaauaauauguauucuauuuguggguauucaaaacuagcccuucaauaagcucuaugcuuacaguucacauuaguuguccuccugugacuaguggugcuuagacuugaccuuagccugaaauaauucaaggcuaaucauagaugucaguaaauucuggauuauaagaaaaguuacugucagaaaaugcuuuuuuauauuuaaaaaugagugcuucauuaaaacaguauaaauaguacuaauuccuugauucugauuacuaucauaguauuucaaaaaaugauugguuuuagaguaauauuuuaagaugauacaaauaguuauacaauaguauuuauuccuacauguggguucuugaauaaaauguuuaacguaagugaauaaguagguccuuaaugaaauuagaugccgugaaugagaaucagcagaaacaacugaacauaaaaacagaugcacaaagacuugaagcacuggaauuauaaaacacagaccauacaauaguugauuacuguguuuaaagaacugaagacaagcuugaaaugccuucaaguaaaaagauguuaugaaaagugaucuggcaacuauaaaacauugcugagagauauuuuaaaagaccuaaauaaauggaaauauaucccguacucauggauuggaacacucaauauugucaagauaauaguucuaaaauugaucuauagauuuaaaucucaauuggaauucuuauaagguaauuuugagauuuugacaagcuaauucuaaaauguauauggaaaugcacaggaccugaaacagccaaaacaauuuugaaaaagaacaaaguuaaagaacuuacacuaacuaauuucagaaccugcuaugaaguuacaguaaucagugcaaugugauauuggcaaaagaauagacuguggaucagaaaacagaauaaagcauccagacauaaauccauacauauauggucauuugaucuccagcaaagaugccaaggcaaugcagugggagaaaggauaaucuuuucaguguuguugaaacaacuggguauucguauagaaaagacaaucguaacccuuacauuauaucauauauaaaaauuaauuuaaaauggaucagaccuaaacaaaagagcuaauauuauaaugcuucuagaggaaaacauaaaagaaaauccugaugacaucagguuaagcagguuaaaauuuguuaggccacaaaggcauaagccauaaaagacgaacguaauaaauuauauuuuaaaauucaaaacuuuagcucaucaaaagaugcuauuaagaaaaugaaaauucaagccucaggcugucacauaagcaauucgcuguaccucucugagcaucuuuuuuuuuuaaauuuauaaagguuauuuuuguuagauuauuuauauuguaaaguuccauguaaacauaagacauuauuauuguaguuuuuagagccaucagcauugcuccguagcgguagacauuuauuuauuuauuuauuuuuugagacggaguccugcucuguuacccaggcuggaguacaguggcgugaucucagcucacugcaaccuccgucuugcagguucaagcaauucuccugccucauccucccaaguagcugggauuacaggcgcccaccaucaugcccagcuaauuuuuguauuuuuaguagagacgggguuucaccacguuggccaggcuggucucgaacuucugaccucagaugauccgccugccucggccucccaaagugcugggauuacaggugugagccaccacucccggccagcuguagacauuucuuagucaccucguucucucuguacaucaucuuuucacuaggaggaaguaauacaaaaaaaccaaacacuugucccuccaugcauguguguacuccauaagaccacuguagcucuuuuguagcagccuuugcaguuagaaggaaauacucuucuuucugugaacuuugaagccaaaguguuauaacuuaaaguggaauaucagaaaauucuagugaauuuuuagaagcuuccagaaccuaacccaagaggauucuuuacuuuuuagccaacuaaaaaacuagaccuuucuuuaaucaaucuuaaaacaaagugucuuggacacaaauuuaaaaguagcuuccuauuaaacccuauuucuggcuacagagaaagucacauucuuuuuaaauguccauggauaaaagcuaauucacucaaccuauguuuuugagcauguguauugcucaguauuauagaaggcauuguaaagguaauaagggugaauaaaaaguggcuucuaccuucagagagcacacaacuuaaucaagaagagaaagaauaaaucccauucuucugcccauuccucugcccuccuccccaaaaacgacaggauaaaaaugugagcauugagauaaaagaacaguaaaguacuuugggaguucagaaaauggagacauauuuguagcuggaaaaauaggaaauacuguauggaggagauggcaauuaagcuggacauugaaaaaugaagaucagguucaauagauggaauuaccgagaagggcauuguagguagaagaaacagauugaggaaaaauggagggaggugggugacaggcauugcagaccauguuuaggcaaaugugagcagauauacuugaaugaaaccuucauuuuuaaaaauuuaaaagucacagaagcuuaaaguagcuuuggcuuuaaaguauguagccuuaaauaguaaaagaaaggcuuacauauuaugugugagacaguaggaagcaauuguaaguucuuaaaacaggaguauaauaugaucagaaauguacuuaaaauagccaaaauuagugguuuagaggggaaacacuagaauucaggacacuagauaggaagccauagugguaacuagccuugaggucacaaagaccuucagagauaggugaagaacuggaauaauuugaugcuauaucagccccagggcagagggggggaaaugucaugaagaaaaggagugguccuaagguaugugaauuacaacaauagguaaacggcaauuagaauaagacugagaaaagguuugguaauuaauaaucauugaugaugucacguaaagaauuuucaguugagugaugggauggaagccuacuuacaaaagaugaaagacugaguaguugguaaggaagacauuauuugccuuuuuauucuuauucuugcacggguguccagugaguuuuucagaagcuacgugcugugugauaauauaacagauugaaugcagagacagauaucagaauccagauaucuucuguuaggcuaggccuuaaugagauuugcagaaauuuaaaacauuauuacacuuacuaaaauuuuuuuuguuuuagaaaauaguuauuuuucauuaaaauguuauuuauauuaacaugaauggguuuauuauuuuuaaauuaauguuuucuuaguuuuaauucugaaugcaauaaauaucaagagauauaaucuacauaaagaaaagcucauuggaauccucagugauuuaaaaaaaaauuuuuuuagagcaagggucucacucuguugcccagguggacuugaacucuuggacucaagcaauccuccugcuucaaccucucaaguagcugggacuacaaaugugcacuguugcaccaggcuaauauuuaagagugcaaaagauccugagacccgcaaaguuugagaaucacaauagugaaauaaucuacauguuuuauaguuauaauuaugaagauuuagggaaaaacaauucugguguuugugaagggggacagauuuuuaaauggcauacgcgcuaaucauacuguggaagauuaucaguguuuugguuauagacuaacagugacacuuacguccauauuugacugaagauuagaaaguaacauagaaaaaugaaugcauuuguuuuguuagguggcugggauggggcauuuguuuauuuccacucauuuguaauaauguauuauacaguaaaaacauuuuauugcuuaugcaaauauacagugcaauagaauuauucaugcuaacauugagaguaguagguagaguuccuaugucauuuauauuugucuuuagaauuauccagaaaaauuaaggauauauauauuuuuuaacuguauuuagggggcuaacuaaauuaguuuguauuccacaaguauagucuaacagcuggaagaagcugcaugccuaaaaacuagaggaaauccaguugggauuagcaaacaguuaccuaaaucuguucacaacauggauagucaacacuauagauaaagaucugacuuuauuuuuuauacaaaguucuaucaaaaacauaucuuauguuuuguuucuguuuuuaggaaaugacuauacccuggugcuuaaggagagcggaacuuguguucaagugugucaaaggugagcauaaucuucucucugacaaccaccaccuguauuuccucccaaacauugaaaguagagcaacccagaagagagaaugugaaagauaccccuguaaucuagugccucaguuagauaguuuagcaagcaaauauuucauaauagacuuuuuuaguuuuauuuuucuagucacaaaauaagucuccagccccuuugaaauacaaggcuauuuggacauuauuuacauuuuguucugcugccagcuugcuauuaccuuuauucucuuaaaaagaaaaaaaauagagccacauauuuauuaacuuuuaauaaacuaucuuggcuucauuguauggagacuaaauuugauuugagaaaucauaaauaagagcauguugacaaaacucuguuaaaccucucuggcaugaagaauuaggaauugcaaacauuuaucuguccuuuagguguagccuauccuacgagcaaauggcuaccuaaaaagucaagacaugaagccccacagugaaaauucaguuaauuucaguaagugacugguagguuugaaggccagaacuugucaugcagcaacaucuguuuuucuauuuuagguuucaugauggaaauggcuucaugggauggaggaauuucuaggacagugcaauuucuaguaccacagguauguuaucugaauagaucucaccccaauuuaaucucuuuuauuagauuucucacagauacagcuaggcauccugcccuaaaaucccaaaaacaacacaaaaggcuaaucgcuuucuguuuuuuaaggagagaaguauuuggaugugauaaaggcacuuaguguauugucaaagauauuagcaucuaccacucaagggauuuguuacuuaaccccugaacaaaacuugacucaucauuccuuuguuuuucuccacauuuguauuauauagauuauaaaggguucuuaaauaaggacauuagcagauaaugauucuguauucugugaagaacuuagcaaaauuagugguuuuuuauuacugauuacacuaguguuaucuagagguuuuucuauuacucaaacguauuauuugacagaaaugacauaaguucucagaagauggagccggaaaaccagcccuuguccauggccaugcaguuacaucggccaugaaagauaauuuucaccuacugcacucacauauuccuaguagaacuagguccauauuuuaaaauacuucuaaaauuauuuuuaaaaucaaugaugauuuaacaagugcaauuauuauuuuuucgucuuacagaguauuucugaagaaauguuuuaucaacuuaguaacaugcuuccccagaucuuccgaguaucaucaacacucacucugacauccaagcacuaaacccuuauagauugacaugcuggcagaagaugauuguuaaacucuccaggaacuugugcuaugcugggaaucugucaagcaaaagaugcccagaaagagaacuugcagcucaauccacaaaucaagauacaugugugugaaaccauuccaaaaauuuauauacugcacaaacuggugaucaaccccuaacuuaaacacuuaaagucucuuuaugaauuucucuuuuuuucuucucuguguuaccugugaauauuaguaaucuaaaacuuuuuauuuaucacacauggacacuugggaaaggaaacuugauuauauuuacauggaggcauuugacuuuuucaagaggcuugacucgucucaggugcaauccuuaauuaaacauacaaacaaaauuuuccuuuuacuuucuuugccaaaacaaaauguaaaagcacugaaauauacauugcaaguacaaauuuccugugaaaaucuuuuuauagaaacacaaauguauaagacaaaugugcuuguucuuuuaaauucuccuguuucagaaucucuuuuuaaucuacuccuaaggauguacaaguuagagucagaagacguuuuggauuuuuucccucucucucauccucccgcugugcccuugcacuugcauauuaauaacauuucauggacugggaaauaguguucuuuuuugcaagcuugaugucaaguuagucuaaaccagcaccuggcaguauuuuagugcucaucaacauugugacaaucacacaaggaagaucauuucuacauuucuguccucccugcguucucagcuugcuuaaccauuccucuaccucuugcauuuuuuugcggauaaauguauccccauuucugcuucucuguuuccccuccuuuuccauuguuuuuccuuaugguacuacuuucucaggugcuacauaucauauauuugucccaucuauaacauauuuaaaugcuauaaguaguaacuccauuaaacaaaggcauuuacaaaagcacacagguguuuagaaaagcaauaguuucaucaauuccaaguuauguggauauuguaacuggccacaagaaugaaauggagggcauuuggugucauaagauggcaugucuugaugacaagaaacaaaacgcccuucauuaauaugccucaguguaauaacuauuauagaaacuguuggcaagcagagugcuuuccuauaacagaaugugucuuaauuuucuacucgagggaaagguuuguccagguaacaacacuaaagacaacccuaagaacacccacuccagcaguauguccauuagacacuaaaacucuccaaauuauuugucagggagccuggcgauucugccaagaaggcagguguuuugcccuuagagccuauacaguucucuuggagaaauugucuuucaggcaccacuguuaaucacugagacugauucuaaugcaaagcagggaagacagaggcagaaaccaggagagugguagaucagugcagcccagauaucggaauggaggagcaaaguuucauucacggauguuuguugaaugcugcugcccaacucuuccuuugucaccucuaggcuauuccacuaaguuacuuauaaacugguggcuuuaacugagggcuguguaaagguacuauuuggcaugugaagucaggauaaauuuaucgaauguccguuuuccacaugcaacuguguuacagaaguaguaaaauuggaagaaucauguuuaugguguuaccacugauggaaacacacaaacaccaagcuaauaauaaauauauaacuuaaaaagcuaauuauaugcacugaaauggugggaauuuuagugaugcaguaauugaggagucuggaguuuuguauuuggaccaagaauuaugagaugaggaucuuuuucugaguguucuaaagggcuucuugagggggagugguuuaaagcacuucaugaaugaugug

SEQ ID NO: 14910 - RNA, 311 nt, Homo sapiens
cuugcaagugugcucuuugugaaauuccaccauggcauacaguggccagggccagaaagugcagaagguuauggugcagcccaucaaccucaucuucagauacuuacaaaauagaucgcagauucagguguggcucuaugagcaagugaauaugcagauagaaggcuguaucauugguuuugaugaguauaugaaccuuguauuagaugaugcagaagagauucauucgaaaacaaagucaagaaaacaacugggucggaucaugcuaaaaggagauaauauuacucugcuacaaagugucuccaacuaga

SEQ ID NO: 14911 - RNA, 32857 nt, Homo sapiens
aauuuaggucaaggugaguuuauuguccaaauagcauaaccuaauugcauucaaaaccauuuucaaauccaucuuuaaacuagucagaaaacagguuauuauuuuuuuaaaucacuuaacacugaacagauaagaccucuuaaaaggcagcugacuauaucaugucaccaucauagccaauacaacauuuuugccauacuuccuaaaaaccuuuucgcauacacugaucaugcuacuuaucagcacuuucuaacauccugaccaaacagacacccacaccucuuauagaguacacugugagagaauaacauggacuugauauggcaucacacuuguuuuaaagcaaaaaaaaaaagaaaaagaaaagaaaaaaaaaaguccaagacaagaaacuacauaacugagagagaggagagagagagagaucugagguacaugauauaagggugaugaacauaauggaaaaaauccaauggcccgaugauuugcuggggauguaagaguuggccagcaguuaagaacuaaaccaauuaaaaauaaaaauagaaacuuuguuuuucaaggacaggcaccugucaaaagacauuggauacuguaauggcuacagucaguaaggcacuuuauuuccccaaaguaggcugcaggcgaagggaugcaggcugcagcuacagcaugcacguacacauuugcugauggcuucucaaaaccugagccgagaauagggucugauagcccagccaaguuuaaaagcagacacacacgaauguaguaucguugugccugaaaugaccauucuggguuguuuagaauccagaaucaucaaaagccaugugguaugaggaaguaauaaauauccucuugaaucuucuuacccuauuuugcacaaauggauggcugcaugaacagcucuuguaaauugcucugaguccacaccaauagaaaccugcacucauucuauagcuacagaggguuuguuggcuuaaggggacuuuaucaucucagcauuaauuucccuuuuaaagcuauucucaagguuggacugucucagagauaaacaaagaggaauccuuuuggcuuagaagccaacuggcuuacucagacuuccuccccuuccuaccuccaauucccacacuaccaauauuaucuucuugaacuagaaaaucaauuauuuacaugacauaaggugcaagucuauuucuucucccagcccuguccccuguggcccauggagagaaaauuccccugcccucuuggagagagucaucugauccugccuuauguucuuaaccuuucagucccagagcucccagggcacagucuggagaggcccuagaggugcuagacugcagggaagcgcagcuccgucugaagaguugccaauccugcuagcaaugggaugcagcgugaugcugucaggguugucuucuccucuggcuuugucacuuaagccaugugugccccugaccuggcugauaagaggcagaacagagccuccaguacagagcacauagaccaaggaugacccaguaguaaggcaugcugugcucuccagugggguccugaggcaguucaaaauaaggccuccuggaagaacagccccuucuucaaggagcucgccucucagcacgcaugggguguucugcggagggaacugcccuuggcuuucuccugcaggcuucuuggcuguuauggacccgcauggaguuuaauuaugcuuagcauauauuuuuggcauacuaggauuucuucccccuaggauuuggccaaaagaggggaaggaucaaaauuuggcaggcugggggaacaacucggcccccacugauggagaaaaaaacaaacagauggaaguaaagacgagauagaaacacaacaagguagaaaaagaccaggauaauuuggaaccccuuuagugggagguaagaaaaagaagagaaagaacaacaacaacaaaaagagcaaguucaaauccaagggggagagcuccucuggaacaaaacuccuaccaaagagacuaagagcuaaggagagggcaaaauccaggauuccuucuuguguuuaagcaggagcaggcagaaaagccuaacaacccccgacuuucccaucggcagccccacacccaucaucacacaaggccccaaggaugggaaagagaaaagcuagaaggacccaggggccucgggacuacaggaagaguggaaaguuacagacuguaaauagagucggguaggcuugugcccuuccuuauuuguccgguucuuucauuugcugcuucuguuuaagcucaagggucagucaccaugaaaugaauuugcaccucgguuucucuuuaggcuccaagauucccaagaacuccaggguucccgcuuuccccauuccgugggacuccuuggggcccaggagagugugcugagcaaagcuggcucuugagaaaacucuggcuagcuuacuugcuggcugcuccacuucccucuccaaaacuucagaauucaccacccauugucccaccagaaauccccuagaauuuuagggucaugcuaacucacaaaguccugaacccuucuaaacacacuucccaagagacugacucaucuggaauuucaccucuguagagaagcagccucuucaccucccuucaacuaucaucccauacuuaucugaccuauuuuucuuauccugccaauucagugugauugaaaacccgaccguuuaguaccgcucagcagagggccugggcuugcauagugcuugccugcgcaguuugagacagaggagggagaaggaagcaccauaaacgcugcuugcugcagguucaucuacucgcagauucagaccuaggaaaccugcagagaugauccuaaacacaagguguccaugccaggggaggggaaagacggaggggaaaaacuucaagaugaaagggcccuuugcagaugaagccccgcuuuugaaaaagcuccaagaugaggaucuccaaacagccugguggaauucuuuuuagucuguuuccugacaccugguaccuaagugcaaauuacgacaucugagccuaccgcauaaauguuuguacugaacgucugccuugaaggggagggaggaucccuugguucaauguauuuuuuccaucaugaugaggauaccagggucuaacugggagcccgauggccuccaugaccaaaaaggucccugggagugagaccgcccugccuuccaccugagagggagucagcccugcucacacugcuucuguauuccucaugcgaaugggcucccaagcagaaacuguacgguugugagguauuaugaaaacaaaagcgugaaucauugccuuuuguaguuauugauuuuguccaguaaaccugagguaaagaauacuccgucuuugaagaaugugaucagaggaaaaaaaaaaaaccaaaaaaccaaaaaagaaaaaaaaaaacaaccaugaauaugcuaccagaagaaaacaaacuacggaagggcuuuuccaguacgaagaacucauaucucaaccaucuacuucaggacuuggaauuuaagcaguaaaauaauauauuauaaaaauguuuauaaaauagcagcacacucugugaaacauuacagcuagguacugucaacgugaauaaggauggaugacuuuagcuucuuagcagcgcaaaaaaaaaaaaaaaccaaacugaacaaaacaaaauuaaaaaaaugagagacccuuagauuguuuuccgucuucaacccucauacuaugaaacaaggcagaaucuguguauaaaauaauucuucaaauagcccuguucugauuuuucuuuuuuacuuaaaaaggcaaauauuuuaacaaauagcuucauuaccugucaauuacaauugugcaaaaaaaaaaaaaaaaguuguugcuccaaccucuuugcuaacugaaugccucuaagaaguggagaggaagaaaaauucaaguacgcugaauacaacuuugcaauaaaauuaacaacaacaauaaaaaaaaaaaaacggaaaagggaacaaaaugccacacccugauguucagccaucuaucuuugcaccagcaauaacuuuucuuuccauguccaaaggagaaguauagagaugggaauuaagauccuucugugccaucagaaugguaacagauuuuaguuuacaggcuugucugaggaauguugugaugggaaugucagcaggaaggggugucucuugaguccugguaggaacaccagaacuguguaccaaagaacgccagauaccagaagcgaagaguaacccagacugggggcaggaagggagggggcaaaagagaagaggggaggaguauucagcaugacuugcauaaaccaucccaucuaucgcucgggaacaauuuuucaaagugcuuuucgaauggaaugguuuauaacaaugcuaaacugugaaccagacaugccaaucagcaccaaaaauuaguuuuuuucuaagaagaaaugccaaggccacauuacccuuuuaaauacaauaacagaaaagacuccauucuggaucccacccuuggucuccaucugccuccguuucaugugaguuuugguuauggcccauagcuacauuuccccauuagauagcaauaugguggugucugcaaugaacugcauuuggaagaagaagcaggaugucacagaacaugaaacccaggagccaaucaccuguguccaacuggcaaaauaaaacaucuuuuuuuagguagcagcuacuguagacagcaagaggacauuaauguagagauccaacuacacuccugacuuaguaacagguggcugagagcaaaggugcuucuccaucccaaaugguucaaucauguugagagauuguuuuguacuccuuccccaucaugucccuccuuauuucaauuccuucuugaguucauugcuuugcaaucuaaucaugccauaaauggcguacacaguuccuugaaauuauacuacaaggggguguaugugcuagcucauaacaugaaaaaaaaaagucuccucuaauuuguucccauauugcaggcauacauauucucuaacuacucugcagguuuuccuguaagcauuuuacuauuacuuuuacauaaucaaacaauaacuguucgcauauacaagggauucccuuaugcuguacuucaaauaggcaccaaaugcuuuuuauuauuccguuuucguaggaccuuuuucucucacuucuaaaagaucuuuaaauaugaucuaggugggggcagaauuuuuuuuuuaaguuucacccuaaaacacaaagaacaaaaacaaccagaaagaagaagagaccagauuauggacgcgucucucucuuucggcccaacuggcauccucacaggucgauaucccgcacgucuguaggggugcuggcuugguccaguucauccuccgacuuggauccgucacguugguccugacgguacugcugcaggcuauugaggagcaccgccucaaucugcuccuggcaagcuuugagacaauccuagaacaaugguccagaccagaguuguuaguaagaggaacaggacauagagcauccuacggagaaaacaugcguaauuuagcuugcauaagucugugcuaguuuccaguagaaauaaaugugaaguaaaggagggauguucuuaaagugccaaggaaccucacuacuccaggugggguccaugggcuggcagcaucagcaucaccugcgagcuuguuggaaccgcagaaucucagucaacccaggccgagcuauucagaaccugccuuuuaguggagcccaggugauuggcauucugagaagcacuggccuaaaugauggucacuuauggaugccugguaaucaaggggccgaccagaugcuuucugccuggggaagcugggaaguggcagagaaaaggggaaggcuacuagaagugcuaugacauuagcaaacucagcccgagaacuagauaagaaggaagccaaugaaccaacguacugacccucacauaaacuguaaauacuuuuucucacucugucccccaggcuggagugcacuggcacaaucucggcucacugcaaccuccaccuuccggguucaagcgauucuccugccucagccucccaaguagcugggacuacaggcacccgccaccgcgccuggcuaauuuuuguauuuuuaguacagacaggguuucaccauauuggccaggcuggccucgaacuccugaccuugugauccgcccgcaucggccucccaaagugcugggauuacaggcaugagccaccgcgccucacuguaaauacuuaaaaaaaaaaauccccaacuuuuucugcuucuuuaccauuuccuuaacucucauaaagauauaaugcagaaugucuacaacauucuggaaccuugagccauccaauuugggaauaagcaagaauaugcagccuugcuuuaguaucagucuauauuguagggguaauugacagugugucugccccaggcaggagcuucucuuaggcagaugacaugcaaugcaaugacaagucauggguaucacuagacagggaccguugcuggugcuaguaagagggugcaaaccguagacuugcuucuaacgggcauuuucuagccucucuccucugcaaaggugccuuugugcacucucuuaagaagcacauacauaaggcaaauauguuaaauugaaccucccugugucuuuucauaguuuaauauaaacuucccuuuuguuucuuuuacugugcaauucuccccacccagagguuucuauuuugccaagcccaaaagcauucucuuuauuucccaaagaucuaaaacacagcuggccaggcauauuggcucaugccuguaaucccagcacucugggaggcugaggcgggaagcugaaaccaggaguucgauaccagccuggacaacacagcaagcucccgaucuuuaaaaacaaacauauaaauaaacaaaauaaagcuggaacuaaccacuaaggaacaaaauuuccauaccccuaaauuuuccuuuccuaucucucaucuaucccacauuucaaacuacagcuuucaaugaaaacuaagauuaggaacaaccacagacuaaaggccaaaggcagagacgaaauaucaccuggaacaaugaaaugaggaagggugguaucugcugcccacccacuauacuugcagguggcaccuaaguuauuuaacuuuucugaucucaguuuccccacaaaauaaucagaguaaagggcaacugagaugauacugauauaugugcagugcuaaguggagcucaauaaaugaucgugauuauguauaacaauaaacugguccuggaaccuaaagaauucagauuucuuugaaaugagguauagauucgcauuuagucaagacuaaugaagcgugugucaagauccugacaaucuuuagucaagacugugugucugggaagagugcugaacaugacagacgugacgcagcagcaggagucuccgugccacccugaacgaggcugaaauggagucgggcgcuggccucugggacuugcuaacaccucucagacguuccuguggcaucuccugguuacaucccuuacccuuacccuguccgaccuguugagcugaaugaaugacgauaaaucacauggggcucaccugccucaucccuguucggcucuuccccaaguucuucccucaaggaccauguggcagcauuauccucauagguuaucacucacuaggugcgaaaaguuaagguauaauguuucuuuucuuuucuguuuuuuuuuuuuuuuuuuuuuuuuuuugagacagaguguugcucugucgcccaggcuggagugcaauggcacaaucuuggcucacugcaaccuccaccucucggguucaagcaauucuccuuccucagccucccgagcagcugggauuauaggcacgugccaccacgcccagcugauuuuuguauuuauaguugagaugggauuucaccagauuggccaggcuggucuugaacuccugaccucagguaucugcccgccuuggccucccgaaguacugggauuacaggcauaagccacugagcccggccugaaaguauaauguuucuaggggcacuugcauuucaguagauguuugaaaaccuuaaauccuaauaaucuaaaaaauuuaauacuaaauauagaaucaaaaugaauguggggguuaaggcacaaagugacaacggucagaacugcuguggaaugucccuuaggcagguucuacaucagagaggaauggcaagucucauaccaucaguuuuucuucuaagcugggauagacauggacagcccuuucuccacuugagcaccgugugaaggaguucacuuaaaugccagaaucaucguggugugagaugcucacuccacgguacaugggcaggagcugagacccagaacagcagcuucaaccccacauuccagccauccuccgucacccccugugcucacucacugagugaaacguuggaccuaacagucuaaauugauauuuucuucuuucucuguuuuuuuguuuuguuuuuuuucuugcaaagaagaauccauugaauccaggaaguucacguguaauguuccuccacuguacagggacuugagaagcugcugaaggggauguuuacaauuuuuuuuuuuuuuuccccaagaggcagagggacuaaaucggaguaucuccauaccauagaggcagugacuauauacuuguucccaacugaauaccuguccauggaagacaaauccuacccaaagcauaaggccuaagagcuuuuguuaucuaaaagagauggcaggauucucggcugacugagggaacuugcgugugugugcgugugcacacgaggcgugguagacaauagcucugaaccauuacauuaaaaaagaaaugcccguuaggcguagcgaugcgguuccuuuaaagaggguuucgcauggcacagcccuuggugaauacuuuccaagucgcaguuccuguggaagaccuugcuccucaacaaaaucccucucgccucccggccgauccugccuugcucuccuuccucacgggcucuauucuggcccccggcaaggucaucuggguuaauguaucuuuuaccgcaauaauauggccaacuugggacuccauggccaucggugaauuaaccauugccagccaugccagcaugacccuccacauagggagaccaggcuccagaaagcgaaagaacucgguuucaggccaugcgcgucuucccuuuggaguucccaguguccccacuuuuucugcuaucagcccucccuuccagcagccugagaccuuaaaggaacaguucugagaaaacccuacagggaggacugggaugucuggcugucacuucuacuggacuuucagagccacgggacuugaggugacaugugcgugcacaguaguguuuuauguaaguuccagccaagagugggugcccaggugucccacauaaaacagaggaagguuucauagauagacaaaacugcauacucucucuuuagucacauuuuaauuucaauccaaaucaucacugacuugacuacggccagcuuuuguuuuguuuuuugagacggagucucacugucacucaggcuggagugcaauggugcgaucucggcucacugcaaccuccaccuccuggguucaagcaauucuccugucucagcaucccaaguagcugggauuacaggugcacgccaucacccccagcugauuuuuguauuuuuaauagagacaggguuucaccagauuggucaggcuggucucgaacuccugaccucagaugauccacccgccuuggccucccaaagugcuaggauuacagacaugagccaccacacccagccuggccagcucuugacugaugaccccucugacuggaagauaaaaggaugaccaaggcagguacacuccaugaaugaagaauucugaacucccuuccccacccucuucuagacuuaccuugugguaaggcaggacgcuaacccucucugcagucuccaccuaaccuuccuucagguuccacuuccacgaaacuugacaaugaucagcuugacuuucgacuacacaaaucccucauucuaguucagcaagacuaaaagggcaaaagccugucuuguauaaaugauguugaacgcuacucucugaugguggaaagagaacuuggccucucccuuccaugagacagagcucaugccuugcauaugaauaccuuuguuuagcauggcaggggcccuuuuuggacuugggaagggcauauaaauucugugugcuggugggaagugaaggcagaggagauggugcaguggugcugauaccugcaacuggacaugccaacuccacaucgcccgggucuugcccaaagcaggagggcaggagaaugcaugggauugggguggggguagagaugagggcagccaccuggagagaggaagaccuccaccuuaaauccaaccagguugcuucuauuagaggaucaagcugagagaagaguggaguuagugcuuccaaaggggcuggauuauaagaagacauacacaaauaaucacagacuuggagaauuuggagguccaaagggccucuggaaaucaaauagccaaaugcccucguuucccagcuagggaauggagcguggagaguugacguggcuugucccagugacaucuggcugaaagcucagacuggcuuuagaaagggcaagccuccaauuucagaacuccuuuuuccuauauaccuugacuucuaagcucuaaguaaagacauacagaccagagaaucuccaagaaaaagagacagagcccaaguggcuggaaaaacacgaaagcgccucuaaucaaaagguguuacacgcaugucaaguguggcggcucuaggacaucagcuuuccugcagccuccaaagcaccagccauuguguuaagaugccccaaauuaagcugauuaaaagggaagccauaaugcucgucugucagccuggacaggugguacccuaccgcgcuggcggucgggcagaccuccaacuucuaugaugauaggcccccucccuugcccccuucccuccuggcugcccccgcccccaagccuggagcccucacagcaguguuugugaucuucagcucguuacaagggccucugacuuccucugcuugcuggcucgagcuccgcgcccugcacccuccucugccuccaugaaugggcugacggaacuccuaccauuagcccucaguguaacugcaccaccucauugucaccacacacgcacugcacucaacagggggacaaagggcugaaugagccccagacccgcggccaacucaggcagagacaacuuaggaaacuaucucauucuuccuuucuucacaggcuguuuggcuuauuuccuugcauaccaaaugaggcccacagaaaaaugaggcaggagagggaggcaucagcccccgauucuauuccaccuccccacccccagcuuccagcaacacuucacaagguuccugaccacaggcccugaagaguccacagaagacagaaucuguaacaguggaggcuugaaaaugacauguggggcgaggguggcggcacuuccagcuacggagcagaaacacacaaugcuaaaccccaugaaucacacacauguggucgaaacugagacuucuuccacggcgccuccaccucccugcuuuuuaauagcucauugauaaccaggaccguaaaaugccaggaugacccuaaggaagggauauccuggaaucuucucugggcaauauuuaagaaugugucuagggacagggacgagaguugaaacacucccuauuggguacuguguacacugucugggugacggguucgacugaagcccaaaccucagcaucacacgauauauccacguaacaaaccgcacauggauccccugaaucuaaaguuuuguuuuuugcuuuuuguuuuuaaagaaugugacaaagaguuuugaugugacuuagacaaaaaaggauaaauauaaggaacagaugacuagagucuuucuucuguuaaguaucuugcaauaacuucacaacaccuuuauggccugugagccuccauuccauuuuuuaguuagugaauuugugcaacugugucauaugaaaaugaagccacuucauuuaaccuacucuaagauaagguuggggaaaacucagaaggcucggaaggcccugacacagaauugaaguuaaagaaaagacacagcuuuucaaaggacauggacagaccagugaaucggaaacccacuggaaacccaucugccugccuuuguccuuugcuccuuccuuccucuucccuuccucucuuaagcaucacucccaaugacucugccaggggcucuggauaaagagcugaggaaaagcugggccuuauucaagagguucuauagacaaggaagcagugagaucaaugcuggcacgcagcccgacuagugugcagaggggauggaagaggaccccgauucagcccaaggaagcagggccauggucaccggggacccaggccaguggcacccuccccucucaaaccuacccaggcacuggacacccccaauagacguccccccuacagccaaacugccucucuggcuguuuuuagcaacucuuacgauuggaaggaaaaaguauuuaaaauauaccacucucugagacguuuauucccuauaaaacugucaggccccucacucagcuuucucuuuggaaugaagcguucugguuuauuuuggcaaccagacggagcaacaaaggccgacuuucucagagccgcaugcgucccucauaucaaagcuaucugcuccuggccaaugaaccacagagacucgccuggccaucucacaagaaucagggggacccucuuuccacagcucgauccccgacaacccacgaccuaacccccaaaguaacagagagcauugcaagcuugaagaaaucagaaacagcaagguguguaggagcugacauauaacuucaggggcucugggggaaacugucagcucuuccugauucccguuugucaaugcacuagggccagggggcaaaaugugguccuguguauuucacuuuuccagggaagagcucaacaucaaccuaugggcauuucauagcguggcccgagaauguuucagacauacauacauacauauauauauauccauuuauguauguguguguauauacauauauacacacacacauuuuacuaucauaaauacacauaaugucaaauuucccuuuucagccacuuuuaaauguacaguggcauuaaguacauucacacugcuguguggccaucagaacucuccaucuacagaauuguuuucaucaucccaaacugaaacuccguacgcauuaaacacuaacuccccauccucuccucuccccagacuccugggaaccucuauucuacuuucugucucuacgaauuugacuauuccagguaccugguauaaguggaaucauacaguauuugucuuuuugugucuggcucguuucacuuaacauaguauuuucaagguucgcccauguuauaacauggaucggaauuucauuucuuuuuaagguugaauaauauuccauugcgugcccauacauuuuguuucucuacucuaagaacaguuucuaucaccaaguuuucucugcugggaggccggcauucuacguuaggccugaugagcuccuucuuuuggguugauuuccuacugcauuuaggguucguaacacguuacguagcacaccuuuguuuacguucuuaauuugcuaggguuuugcacgcuuuacucuugcuucaucauacaacugcuaaguuccuugaaggcaggaaucucauccucuauuucccagaugccaccauccaccccaacuucuagcaacaacugggccuucaguaaagacuuccagaaacgaaugaaggaaauacaccacuucgugacucgugaaaugguaaacagagcucaggaagcacaacucaccucccuccaaacacuaauguguucuaaauucuaguccuuuuauuuuucuucccucugagcgucagcuuuucagagaacacaggcugauggaugggaggagauuuagcacuuggaaaggugcauaaacacacacacacacacacacacacacagccuagcccagagcugcuugaaccuuuccacuaaaaacauuuucagggagagcgaaccagccuccggggugccagagguaagccuggaacuuccugagggcucagauuuuucuuugaaaaaguguuaugaauuguacauuucaccgcguucacucuugguuuuuaaauaugaacauguucaacccagguccaccggugugaaugaggcacacacaggcagccccaguuaggaaacacggcgugugcccauuauagaaaugagguaucaacuugaccaacaguuaggauuuauaggaggacaccccuaaaccagcuucguacccacuucauauccauuuaacagaguuggccagcugacuuaaauggacuggcuacguaguaucagaaaaaggcaaacaguuuccccagaugagaugacggacugacuugccugcggucucgaaaagccaagagacucagcagcaacucccaggagggaaauuuccaccacuguccaugugagaucaguaacgggggacaaagggaggugggaaaaggcuggagccgguaggguggucagcccaucagagcaggucuaucaacaucgggggaaaagguuacaaugccugggggcaggaggagggggguggccgcuuccaacuccugucacugacauuuuugucuccaggcauugaggaagggcuugucuuaaacuggcugagaguccuauuuguaaggcagccuuaauuggagacauucagaaaaggaggaaagcguaccauuucuauaaacguuaagucccguccacgauuuuccucuggaggauuagaaaagcauucuucaugcugcacuggagggagguuuucagucuguguucuggaguccucguuuaaaaagcguauguuuggagcccgcauuuuaaaaccauaucuacgaacuaucucagaggaggaccccggauuugcuccgucagcaucucccugcgccauuucucugagcugggaacaaaugccagggaaaauccaggugggcgggcgaggaggccggcgagcugcagccgugggcucucugagguuuaaccugucccguaucccucgugcaggccucagccauaggccuauaaaccacaugaucccuuaacucaauaaaagcccgcagagggcaucugaauccccccggaccauccagagggugucaucgugaagugcccagcauucuucagccucuccauggugaugcaugagggcucagggccaacaccccucucucagguugacuuuaaaccccaggguuuuuuuucaaaccaaaagaucccaggagcggcaacaaggguggagugggaaguuuccagggggcagucggagccuggggguucuagccccagcucagccacugcccaccccgcuccuggcugguuacuucagucccuguccugcccguggaaaacgaaggaauggccucucugaccucuuggcaccauccugucucggacgggcuaggacugcagcuuccugcugauugaauucagaggcucacuugacccuggucucucucaaaaccuuucuucucaggagcuccaaauucuggcaacaggaaguuaacagccucugggccguccacagggcacacagaauggggaagcuccguagcuaauaauaguuucuugaguuuguauggcacuuugucuuuugaaagcacuuuguaauccauuacugcauugaacaaaagggaagagagagcggggaggggucgagagguuugccagggacggacaccguucucacaguggggcaccucuugugugucugcuccauccacugcagcugaguccuggcucuccuuucuccucugugcgccuuacagccucagcgugugaaagcagacacggcagcucuucgcugccgggcagaggcagccuggcagcguguacaaauauggcaaugaagcaacaauucagacccacugagaagcccacgccauaaaggaacaucgguaaacagcccucccacccccacccccuucaucugcuugcugaguuuucuuccguauuuucccgugcacagcuuuucagaaccuuaagagggggugucaccugcugaacuuugcacucccuuggaugucgaucuuaggaaacaaaccagaaaaauaccucugacacaacauaaucaaauccgucgucuccuucccugagcugagaagagacaucuggacuuagccaagaaggugguggccaccuaccacgucuguguuggugaucuuagccagcagcucagucagggcaucacaagugagcgagcucacuuccucauccugcuggagcccacagauggcugcucccacacuuccaguugcgaucaucgacgguggguacauggcaaacuuaaagucugcaaggaaugagaggcagaaggucagggcacagaacgaauuuggauccuggagcucccgagacugcagagacucagaaacaggacggcagcaggucagcggcgcgagugaccccgugcccuacaggcauguccucccucgaguucuuucacaaggagccuguguuuauuugccaucaccauggcuguuccagauuaaacgaaggagacugaggcagggaaggaagacagcuuaucuaagcgcacacaaugaaugcacagaggauucaagguccccaauccccagaucccagucauauuaagcaugucugaguuaacauucuugacccugguggggggagcaaggugagcgagucauagucuccucuagaggugauggugggaacagagcagagaaugccugagaccagugcagacaagguaccccaugggccaugcaagcaggacagaccaggggcuccagaugugagaaggagggaaaguacaaggagaugggagaaacgggcaaaaucuaugcauaaugcuaauucagaugggaucuuguuauagucucuggacaggcauugaggauuaauaugacccccacccaaaaaaaaaaaaaaaagguuugaucuaaaaaaggaaaugagagaagcagcaaugcagggagugggcgagugggggcugaguuccacccaguucccaaccucuggcccaacagcaagaacccucagaacauuagggcagaggauucuaacccuaacauagggcucuaacuaagcacugaagauuaaucauugcauccgaaucagaugggugacucgguuucgauguuaugacucaugagacugaaggccccauuuuauugcuaagagaaaaaaaugugacuugcuacagggaagugcagaaugaggauaauaaaucagaggggcuugaaccccguccacugccaugcuagagggcuccucuuggaagaccagcccccuuguguuccuccgagcacuccuucagaggggcuggguggccaugauccagcagcugcuugguccaucgaggggaaauaaagacagccaacuucuccuguuacagcugcugacagcuaccaaugaccaccacaugcaguacgcuacacauuacguccuguuuaauuuacccaucagccacagaagaugcacacgagcgucacccuaaugguaugggugagaacccugagacuuuugagaguuuaaguugccccugcucguguugacagauauuaggguggguauaguugcagccaucacgcuagugacgguccuggagugcagcaagucuuccaaagcguacucuuucucguuuuagcauugcucuagugagcuuacuguguguagacauggaaggggcacgugggggcaggagacacagcauacagggaaccgugggucacccuucaacuuacagcaaaaacaaucagguuaaaucuacaaaaaccagccccucuccuauuuccccuuccuccuguacacacucuauuacaaacacacuuucuacagcagcucuuuuaauggucagcccauugccccagcaucaaguuagcagcauuguuagacaccguggaucccugagccaagcacagcccuccccucccaucaugaacgcagagcaaaccuggccaucugccugucuccuuggcuuuuucuccauugcccucucaccaucuccaccucuugagggacguauauaauggugcugcgcccacgccugcuguccacccgccccuccuacgccuucucugucgccaugaacagugugacaaagccagccucccugccucuugcucugcuguaggucucuuccacaugggucacaggagaguguuucucugcccaauaaccucguuagcuccccccugugacauucauaacacaagcggggcagccggcccauggcccugggcccacaaaggcccgggugggagcaucugccagggaagaggcaggcaaguauccccggcccucccuucccucugccauaggccucagaccgggaagcacaccucacacaugcccaucucugcugucccacugcuagcaaaaccaacucuuauuauuggcauacgaaugaacuucuggaagccagcaggcauagggggaacaggugcaccgguugcacagggagacucuaccucccuuuuuguuuuacuaagaagauuuucaggggaguccucuuggggacacuguccaaucccacagaauuggggagcacuaugugcaugaacuugacugccucucagcagcucagaguggcaccaaaggagcaguguguucccacagccagaggagagacgccgcuggagacgaggacggcggccgugcugcccucuguugcccgcuacacagaagacgagcaucuuccucgggaucccugagcaugccccaccucuccuccagguuagucaaauacugaggcaacaucagcccuccagcuagguccagacgugggacugugggcaagucacuuccucuuuccaagggcuugguuucccauuugucuaauaacggguugggugagauaaguguuuuucuaacuucuagcugcaacucauuaaugggucaugaaaugcauuugugggucgugaccagcacuuucuguuguuguucuccuuuaaccaaauagaguaggauagaaaguaucaggcucaccguaugucguuaagaguaaauauuguucggagaaacuuuuguaucaguuugauauacuuguacaaguauccugaguuguguuauaaaauguguuucuuccuacauggcuuaggucaagaguuuaaagauaguaagcaggauaaccucccaggugccuuacaggucuacuuugcucuuacuugaggaucuggaaugggaaugacucccaaggagaagaacaaugaggagacaauagaauggaucacggugucuaccagccggcaaauucacaaagcagcccucuccacagagcggcgcuacuuccccguggcaccagggcugccccaggaccacucucaaggacaucccccucucuacugguaggggauacugaacagagagaaaaacaaaaaaaucaaacaucauuucaucugugcacuagcuuccuagcuguaauuagccaacccccacccucaacuguggaaagcuccaccuacccaaugcagccauuccuggaaaccaucagcuuugucgcuaugacaggauggagaaauggucacaauauccacucagaagaaggaagcggaaaaccaaauugcaugcaugcaugcgacgaugaagauuacaaccauggguaaauacauacauauaugccuauggaugaacuggaaggaugcacggaaaauaaaagcuguucuguuaggugggagaaacacagaugaguuuguaaaauuuguacguaauauuauuuuaacaaauaaaaaccagguacaaauuucucagcagucuguuaagucucuugaucaaaaaugccaacaagcaauaugcuggugcagaaggcacgcucaggggugagggugugcccucgccaucguuaauugcccaccuggagaggugagaugcuggugacuuccugagauccuuccuccugcagcagagagagaggcaaugaaccgaucagcgauccauucugaucgacucaugacaaugugcuccucccuguuccaggcagcauggaggacuccccccaaaacguacaauauucagacuucuuaaggcugggcaucaaugcauuagauaguagaggauggugugcuauaauggcuaggucuguacuacuauauggauaacuucugaagaaacuucucaaagaaagggggcucuugaaggcugggcgcaguggcucacaguguaauccuagcacuuugggaggccgaggugggcagaugaccugagguccgaaguucgagaccagucuggccaacacggugaaacccugucuguacuaaaaauacaaaaauuagccaggcaugguggcacgcgccuguaaucccagcuauucuggaggcuugggcaagagaaucacuugaacccgggaguuggagguugcagugagcagagauugugccaugcacuccagccugggugacagagcaagacugucucaaaaaaaaaaaagaaaaagaaaagaaaaaaaaaaagaaaggaggcucuugagugaagaggagcauuugagacacuucucagaagacucuucagggagaugggaaggauuuggagaguagacucaaaaagcuccaagcuggaacguggagugcacggagcuugggcagccuccacuccugccccaguccccaccagacccaggagggccuuucuccagguugcugcaucuggagaucugaagagagcaggagcagccacacgccuugccaugggcaacagaggccgucccagggccuagggcuccagcuccccuccaaccaaagcagaccucuggagaacacagcucacugguucagaguauuagcucuggaaucagaaggagguggaaucuccaucccaccaccuaccaagugugugaagaugagcaaguuaccugaccucucugaguuuucauuuucugaucugcaaauaaugacaacagcaauacccacguuguagugcuguucugaggauucacuuaaaauaauccuuguaaaagcacagugccugguucaagguaagcaaugaaugucagccagcauccuccccaaccugccccuccucugcucucacuccuaguacuuccugcaggacugugguggggaguuccgacuggagaugcucuccagcgucuggagggaugaggagaaaggcgcccagcaucccuggauugcaggcagaugcagggagcaggccaagcaggccaggaagaaugagggcucugugcuuccuggagaaucugucacuauccaguuguguaugugucccagaaaugacaucaucgaguccccaaagccuccugcugcuuugcagaacugggagaaagugcagccccacaggggaaugaaaagaaccccaugaacacucagcgaauggaagagagaaguuggcaacucuaacccagcacauuccacaauucauugagaugcaguucacccgagccaaggaacgaugcccagauaaccaggaacacccgacauucccgccucccuccuggcaaaaugguggaggcaaaggacacaccuuaggggaaucccagcuggacccacaggcgccaggggcagcucugcugugggcugcaugcuugcuuaugacggcggugaugauggugagguauuaauaaaaaggagcuugaaauucaucuguuucaaacaucuccuuuuacaggugaaucaaugaagucuugggagaugaagugaucuggcugaugucacucacugugaguguugggccugggauccggaugagacuuugagacucuggaugcagagcucuucguaacuuacuggaagcugaccagcuccucaaagucaccucccauauaccacucaggaggacagggcagccuuucacgucggaagugggagaagagccccaaagguggcgcucuggcucaggaaucaaaggaauugggucccagccgcagccccggcaccagcaagcacaaaaggcuuauccucccaaggaugcccugggagccucugggggucccgcugggcucccucaccugggcaugggcccugagaagugcuccauuucaucaacuugguaucugcacuucuugguaggauuuuaccaaauaaagaguucagagcuaaguaaguuuaaaaccacggaauacaugguccugcccaguacauuuagcacccaucauuuuggcuaugguggccgaggucuuggggugcaggggugauggcuuugcuucuguucaccaauagggggagagagauacgcacucugacgcugaagaagaaagggaaggccaggucaggcuuuccccaucucucuucuccaaccugcagucagguggaaguucaaagggccagaaccagaguguucacaggccagggacgucacugggcacgcaccucaucugccacccccauaagaggaccagcauacccuguccuuguggggcagggcugccauggcaagggaaugcccaugcaacugcaaggccugcugggaggagcuggggagggggcugguuggagggcgaugagcagccugcuacccauucaucuuacagccagagggaagagcgauggcaagcaccacacugccuggcugcuuguccccacagggcaugcuaacgacucccccucagucccaugaccucgcggcuucagggguagcucagagacuugcagauggaaagacggguuuccauucuuccuucccagcacccaucaaggcgaaaucucccacucuagaucaagggccaagucaucgaacuucucugggccaccacugucucccucucacuuggcgauggaaucugagggaacaccuguagguaaagccagggaaggggcuaggacagcacaauggguucuagucaacaauggggcucuggccuuggcguggggaggccuggggguggcuaccguguguggcacaaauaccaaggugcagcaucuuagggugggcuucuagugaagaaagaggggaugugggugccuggagagggagggugagcaccucccccuacccggugccagguguaaacucaaugccauuggcucugcuagacuaacuggaaucauccaccgagcaugguaucacaucucaacaaucucccagugccagagugcgaacccaggucaucuccaauggccuucuuuccucgcuugcagaccuggguguucuaucagcagagcggcaaccagggaagcuauggcucaguucugcuuccccaguuuuggaaacuccaggaacaggaaugcuaggagcuguagucaggaagaucccccgcccaacccacccaugccugcacugcccaggaccugcugcagagggauaccagcagcuugcggcccuugcucuuccagaagccauuuuaggcugagcagggaaggaaggagggcuccucuccgccuugccaccaucuuaauccagagccccauaaagcaagaccgccacuucgccacacuuacgcggccccucuauguucuccugcucucccuuccccuuucacacacaaauacgcuccccacacacugcagaaccacugccagcucuuucacaaccagcuuuucccaucaaauagcugcacggccugaggguuggcggccaucucucgggacccccacccuccacccacuguggaccuccgagacccuggccgcagguguuucaucagcuccaggacggaacauccaggacugcgagaaaaggagggaagugugcgauuugaggagcaggugagggcaacagcucggguuggggaaucugcaucuccuaccucugccucucagucacucugugcccgcuacuggccagaguccuggguccuugcccauucaucacacccuggccccacaaugcacaaucgccucuccauggaagguguuuccuucaagaaaagcggccuucgguguuuguacugugaggccgacuguuguaaaacuccacgcagccaggauucuaugugacucagucaguugcacaaacccaagugcagaugagggaaagcaacuucuuucgauacaggccccuccuuuccagacccaggaaacugccgaggaccuaccugugcucugcccugucaacgccugaggcuuagugccuagcacaccauuuucaugugguuuggggguguccuuuccuagucccugaccaaagcuaguucaaggcccccaaaacacagucuuuauaacugccucuguaucccucugggccucuguccucagucucugaaucccaggcucccuacucuggccccggagcuggcagccagcccaaagaucugggcaagaaggccacgggugggggaugggauccccgguuuucgagaaugggucuagacggaaucuggggaucugcccacaccccgguaacuccacccagcaccccuaccccaaucagagaucagagaggaggaaggggcaguuagaccccaaaagaucuguuagucaagagacaguguugagcagagcucuggcuaucaacagcugggcagugggggaguuuagggucgggggucagcuguccuugggccagagagaaagaacuggcugaccccucccccacagugaaucaugaugagagaggaaggagacagccgagccugggagacaaaaugacaggucacuggaggacugaccucucgggcccgggccagacagcagaagggaaggaagccagagugaccacuauccaaaaggcagcagggguccacagggguccuaagaaccgcccccagggcugcaggaaggauaacggacucucccaccaaggggcacagggcgcaugugcacgccaugaggccuggccugcauccaggagaacaggacuacagaaaaccagcaaggggaaaccugugcccuagaugaacaggcagggggccgggaggacuccacacucaagccugcaagugcagaacacacagguccugcuagaaacacguaagggcagccagaaaaggaaagccaucauauccacuuuagucggaacaguuaaaaucagggugaaaaucggagaugguagcauuuucacaauuagugaagguccaaccuacacuucgguuuacaaagcacguccacgugcaucaccucuuucugauuuuaauuuuccuagcugcucugaaaaggcuguaggaugauguaucaauaggcuuguuuuggagaugaagaagcucggguucagagagguuaagcagccaauuaaaggucacucacugauaugcagcaaagccugacuuuuugacugugagcacagggcauaugcacuacaucguacguuauauaaucauccguuccguagaacucaccaguaacauguaacaacauccugaaaaaaguuaccacgugaguccaccuagcgauuuaacuacucuuggcaaauuugaggugaagcacaccgaaaggucuucccaagugaucagcuuuuuaccuaagguuucugauugucaaaacaugaacuccugacaucucucccuuggaugaguaagguuccagggucucugccauggccacuaccaagaaaaaaaaaaacaaaaaaccaguagacacuggccaaggcuguuuaauaagacaacagcaaaccacugccuuugguuuauuaggaaacuacaaaacaaaugggccaguaggaaugauguaucaauugugggauccacgugguaggcggaauugcaacguuaaaggcugcggccaaaaucaaaacaccuccacaugaacugagggcaucagaacccagcgcucagaaaguaaagccucaccgaaagccaaccagguucccucccgcgcccaguggggcaaacagcuagagaagcaaacagcuagaaggccauaaaugcccuacaguaaaaaaaaaaaaaaaagaauuucuuuggucucccuuaccacuaaucaaggcaggcagcauauuuaucuugacguuguuccuuuaaccuguauuugcccccaucccccucgagauuuccucuugggcuuaucuccaagccauccuuuuccuuaaaagauuaaagauuugaacacaaccagugagcaguauauguaaucuucaaagagcacuuuagccaucauaaagaauauuuuaacaggcacuaauuuuuuuugccuuaaccacaccuguccucauaaaccauuuaugaguuuagcagagaaagcgaauauauaaagcucagauaaagaaaaagcaacccaggaaugaaacuucagacuuuagacuacucaagaccaccccuccuccaaacuccugaacuaaaaugaaaguuccuacggccuuuugccucuccccggacaucucccaaaagagcucccccaucucccuccccggcucaagccucaucuuaccgguggcacacagagcaaugaaggucugagcaugcuugcggaucagagacagcuucucccgcugcuggggcagcuugcgcaagaugugcucaaugaagucaugaggagugacagcugccagguuccacuucaacuuccccagcaccaccaguucccacuccuggaggggaaggcaggaagagaagaggagaaucuaaauuccacaggcugaccugguguagggggcuggggguugggcuccagaccaguuuuaaggccgcucauuaggacguggcugcuagauuguaaggcgggcccauuugucaaugugccccugaagcuuugaaguuguugacagcucuucuuaugcuucaaaugucaggcuccacugaaaauaaugagagcccagguagcuguugccaagauucuauuuucuucuacuucguuuccacuccagcuccccuuacccccucccaacccugacuugcaggcaauacugcuucccgcccacccagaaagcugaaccuacaaugagauacggccaaggucauuguggcccuuucaugguaauuuauuguauaugucucuaucaccgaauuaauagucuuuuuaaucuucauggaaaaaugaugcacacagauaaagcucaaaauaagguuccuuggcccaacuccuuggcaaccaauuagcuugcuuuuacuuagugccaaaaagugccuuuaucucucugcugcucaaacuccccuuuuacauaucaggcagaaauucuggggaugugacacucagcccuuuccccuaaauguuucacaggccauugucaucaugacuaaaggaccacauggucauuagcaaccucauuuugcagauggaggugaucuggggcaaggugagggugccugcucagugucacagcaucccucagugcaaguguggggaccacacaacccugucucuugggucucucaccagcaacccaccugaaaaagaaccuuguuucccucuuucacugagauacuuacgggaaacugugcucaaagggaaacgguccaaaauaaaacauuaaaaauaucguaugugcuaccagaaaauaugccuauccacugagcugucaucagaagaaugagaggcagggccuguuugccaaugcacccucucucccauucaccuggagaaccuggaaucucuuucauuugcuaaaccagcaaccagagcaccagucccacagcuguggggcugggggugauucccuuucccucccaggccucagccuucucauuuguaaaauaggacucuuccaaaucccaacuucugggauaaagggaauaggaaaaagccaaguuuguuuguagcaauauauugcuuggcuaguccuggaaagauuuggguguccugaagaacaucucaauucaccauccucucgaaacaaaugaaccauaugaagaugauuuuuccugcucucucaugagaaaaacaaauugguucccaauucuaacaauguuuucuucauaagcuuuaaaaucugccuuggcuuucuguguacagccgggguaaagcaccccaauaaacuacuaaaccaccaucaucuucaaagauggcuugaaaugccagcccuuccucuucacaggguaaugcgaguacgaaccacuggucuugcaccguuauuaaaggaagcagaucucccagaagaaagcaccuuucuaggccucucggaccaaaccagaagcagcuaaaaccuggcagcgguucaaaggugaagucauucaggccccucuccacauucucggcaauuccucccccaaccuugugcaugucuuccacuagauggcagcagagccccagaaaggaaggcuccucacaaagagcucaguucaagaagccagccucagcccuguggacuuugugcgggcccuaccagugaggagggggaggggcgggaaggagggggugcuuuucugaacagugcaaagaggggugugcaaaccaccgaaggugggccuuggagccgcuauuccaugcgguacagcugcaauauggucgucuuauaugucaagcugcagggaaaaggaguuagaucaggugggaaaaagguucccugguagaaaagcagagauaagacaggaucccugggguuguacagaggucacagucccacuggagguaggaacccaggccucggacuccuucagugaaaggccacauuuugacuuugcucaaaagucaaugaacugauauuuagugaacagcuauuauguguugguaucuugagacuuuguagauauagagggcauuaccuuugaacuccaaguuuuuaggagacaccacagccacauaccuaucaugugaacacguucucagacuauuuuuggaaauuuggaauuuaauuaaaauauuaucacuguuaauuaaaauauuccaugcguccccuacacacaugcauacacaauugcaaaugagucucaccaacccaaaucuccaugaggaucuuauucacagauguagccucagugcugggcacggagccugggcacauaguaggaacacacaaaaaauaaacagugguuuccuauuaaaugagcuaucgcccauaaguggguaaauucuauugguggggucauucuggaucccaagaauuugcucuggcaguggugauagaaggcauauuguuggccaggggaaagcgggaaucgcagaaaggaagggaggaaggggccggucauuaccagcagcuccugaggcuugauggaguugucgguguaaaugcacagcuucuccgcggucagcgggcuggucucuuugaguuuggaggccaggaacaugcagacagcacccaggaguugcagaugggacuucggagucgggaccccagccaagaaacgguccagguaauucauggccagagggaagaccucuucuucgcacuucuguuccucacagaccuauaaugggagugggaaaggguuggggggcggggguggagagcauagcaucagcaaaagagaaaaagaauaaaaaagcguaaucuaucgaaacaaaaaaaauuaauuuuuuuuugugggagggggaggggaccagaaugcgugauaagaauaaagaacaaagaugaggaaacuggagugaaucagaauagcccaucagugcuuugguauucccagggauccuauaaaagggggugaacuacagcuccaaaacggggagucggagaagugcgcagcagccgcggcagcuccgcgacgcucccuuuggcuacuccuucgcgcacucuaacucacucacucuuuuuuggauuucgucaucuuuucaaaaaaucaauaaaaauauucuggaggcuccggggguccacuucuuggucucauccggauccccagauccuccucuaucauucccgacaauuggaaaaaaugucugggggggucccugcggcccaggggccgcuuuugggggggcgggugaggagagguggggaagagagggggagggaggagaggaggaagagcgccgcagccucggcagcuggagucggagcagggggggaugguuucaaaaaauaauuaaaaaucgaggaaauauccuagaaaagcccuuuuggcgugaaaaccccaaagaagagccaggcuucccgaaacagagguuucgggugccagaaaggucuguauuccgaccccuggggcuuuggaucccgggaggaaacuugaaggggugagcgccgcggcgggaguguccggcugcggcccacaaggacagaaacuagggaacgcggugacgagcgaggggaaagacgggagcagagagcccuggaaagaggcacggggggcucccaccucuccuucaggggugacccgguauccccccuacacacacccccucccccccuuccuaccccacccaaaucuccgcaccgaggaagcuggaaaaccaaacuguaaguaaucuucgugagguggggggugggggagagggcacgauuagaagugggguggccgggauaauggggugcgaggguaagcgggcgacguuucccagccuuuccaaagggaguuugcaaagcaacauggcgaaaccacggcagguccagagcugugcauacgugggcacacggcucgcugggcaaagacuuggagugaggggcaagaagcgguucuuuuggguuccccugaaacacgcguuucuucaaugggacuuccggggcucccgaauuccccguuucucuccuucucccuccucccuccaccuccccggugaagugccagcgcggagucgcgaccacaggcggggaccugaggccaagacgaauuugcucuggccuuuugggggggguugccuuucuacucggggucccgauuucaggccccgacucucuuccuggccgcagcgcaagcagccgcggcggcuucgcaaaagacaggucgcgaggggggugggaagaagaggcagccacaugcaggaacacgcgcgcgggaugcuccccuacccccgcccaggacagccucgcuucucccagauuuuccuccccccucugccuccccaguuuaucuggagaggaacagaaauaaagccacgcgucucgccagaaggcgcgcgguaaacucccgcacaggagccgggaggccggcgcggggauugcccucucccagguuuagggcuccggccggggacccgagcauccggagggguccuggcuccuggcgagcgccaccccccgaccuaccuccagcauccagguggccaccauucugcgcauguaggguuggauguccuucugcacgcacuugaaguaggagcacugcggaagguagcgcuccucgauggugagcagguucugcaggacgcggucgucucggagcagguugcggucccgcacggcccugcggaccggguccaccucguggcacagcagcuccauggccagcccggcggccccucucccuccugcuuuccccggccuggaaaaagguuuuucuguuuuuguuuuuuggaaggggaggggagagcguuccccugaccuccuuccuuuggcuaaauaggggguuuucgggggagaggugagggcagagagagaagguggagcagaagggaggcgaggauuggguggugggcgagcagagccucggggcugccucacucgcaccgguccuccccuuaaaacuggucucgcucuccccugcucgcucuucuccgcucugaagcggugacgcaagcuggcugggcaguuagcucuccucccucuccccgcgcuccccgcucugguuccuccuccccuuuccuccccucccgguccuccccuccuccuuucaaucucucccucccucccuccuuuuccccucucguuauuaaggagaacagcagcuggcccgacccaacuucaaacgcggucccccgccaccccccaccccucucccuccauccagcccugcaugccaggggccccggacagggcaacccacaaaaaacuaccgacuccuauuucugcccucuaauuucacucauucuguagguguagcacgccaaaauacgacccuccaacuuuggcuucuucaaaacggauccuaauccuccugcccuuguauuuaagauccaggaauguaggguagauuaucugaagauggggugaccucagacaauuuagaaauaggucccuuaagugaaaaauaagggagggggugauuuuagaaaauagcaaccucgcauacccagagauaaaggucaugucccugaagucuguguuccugauaacuucgaagcuguuucgaaagccccgauuaaagggaccagaacaacgucccuucugccccccccugcagagugugugcagaggaagaagagggagggagagguggguauuaggaaggaaggggggugcuucucuggagggauagaaugugauccucgagcagaaaccaucguguuucugggggcucuucgggcgccguggggcgacgcggugcagcgucuagggccgccgcaggccgggggcagggcucccagcgguucccccgcggccagcggccacgcaggaaaaacccgcuuccucgccccugcaucugcugacaagccgcccgaggugucugcgcugagcguggccacaccgaugcagcuuucuaggaaauggcccgggagggggagggggcgagugagggauuagguccggcucccccucgcucccccugcgcaaacaccaccaccccuuccuuuccccggaggcaugaggccuccacgcucgguccuucgcccgcauccucgccgaccccuccgguuucgcgccucacucgccaggcuuucucccugggagccgacugcggugaagucgccgccagcacggucggcccugacacgugcucuaacgcaugcuugagucaaggcugucuuuacaggagauacgaucugguggcguuucuucaccuccuuccucccgucaccccccacccccaccgcgcccuuuggugua

SEQ ID NO: 14912 - RNA, 32857 nt, Homo sapiens
uacaccaaagggcgcgguggggguggggggugacgggaggaaggaggugaagaaacgccaccagaucguaucuccuguaaagacagccuugacucaagcaugcguuagagcacgugucagggccgaccgugcuggcggcgacuucaccgcagucggcucccagggagaaagccuggcgagugaggcgcgaaaccggaggggucggcgaggaugcgggcgaaggaccgagcguggaggccucaugccuccggggaaaggaagggguggugguguuugcgcagggggagcgagggggagccggaccuaaucccucacucgcccccucccccucccgggccauuuccuagaaagcugcaucgguguggccacgcucagcgcagacaccucgggcggcuugucagcagaugcaggggcgaggaagcggguuuuuccugcguggccgcuggccgcgggggaaccgcugggagcccugcccccggccugcggcggcccuagacgcugcaccgcgucgccccacggcgcccgaagagcccccagaaacacgaugguuucugcucgaggaucacauucuaucccuccagagaagcaccccccuuccuuccuaauacccaccucucccucccucuucuuccucugcacacacucugcaggggggggcagaagggacguuguucuggucccuuuaaucggggcuuucgaaacagcuucgaaguuaucaggaacacagacuucagggacaugaccuuuaucucuggguaugcgagguugcuauuuucuaaaaucacccccucccuuauuuuucacuuaagggaccuauuucuaaauugucugaggucaccccaucuucagauaaucuacccuacauuccuggaucuuaaauacaagggcaggaggauuaggauccguuuugaagaagccaaaguuggagggucguauuuuggcgugcuacaccuacagaaugagugaaauuagagggcagaaauaggagucgguaguuuuuuguggguugcccuguccggggccccuggcaugcagggcuggauggagggagaggggugggggguggcgggggaccgcguuugaaguugggucgggccagcugcuguucuccuuaauaacgagaggggaaaaggagggagggagggagagauugaaaggaggaggggaggaccgggaggggaggaaaggggaggaggaaccagagcggggagcgcggggagagggaggagagcuaacugcccagccagcuugcgucaccgcuucagagcggagaagagcgagcaggggagagcgagaccaguuuuaaggggaggaccggugcgagugaggcagccccgaggcucugcucgcccaccacccaauccucgccucccuucugcuccaccuucucucucugcccucaccucucccccgaaaacccccuauuuagccaaaggaaggaggucaggggaacgcucuccccuccccuuccaaaaaacaaaaacagaaaaaccuuuuuccaggccggggaaagcaggagggagaggggccgccgggcuggccauggagcugcugugccacgagguggacccgguccgcagggccgugcgggaccgcaaccugcuccgagacgaccgcguccugcagaaccugcucaccaucgaggagcgcuaccuuccgcagugcuccuacuucaagugcgugcagaaggacauccaacccuacaugcgcagaaugguggccaccuggaugcuggagguaggucgggggguggcgcucgccaggagccaggaccccuccggaugcucggguccccggccggagcccuaaaccugggagagggcaauccccgcgccggccucccggcuccugugcgggaguuuaccgcgcgccuucuggcgagacgcguggcuuuauuucuguuccucuccagauaaacuggggaggcagaggggggaggaaaaucugggagaagcgaggcuguccugggcggggguaggggagcaucccgcgcgcguguuccugcauguggcugccucuucuucccaccccccucgcgaccugucuuuugcgaagccgccgcggcugcuugcgcugcggccaggaagagagucggggccugaaaucgggaccccgaguagaaaggcaaccccccccaaaaggccagagcaaauucgucuuggccucagguccccgccuguggucgcgacuccgcgcuggcacuucaccggggagguggagggaggagggagaaggagagaaacggggaauucgggagccccggaagucccauugaagaaacgcguguuucaggggaacccaaaagaaccgcuucuugccccucacuccaagucuuugcccagcgagccgugugcccacguaugcacagcucuggaccugccgugguuucgccauguugcuuugcaaacucccuuuggaaaggcugggaaacgucgcccgcuuacccucgcaccccauuaucccggccaccccacuucuaaucgugcccucucccccaccccccaccucacgaagauuacuuacaguuugguuuuccagcuuccucggugcggagauuugggugggguaggaagggggggaggggguguguguaggggggauaccgggucaccccugaaggagaggugggagccccccgugccucuuuccagggcucucugcucccgucuuuccccucgcucgucaccgcguucccuaguuucuguccuugugggccgcagccggacacucccgccgcggcgcucaccccuucaaguuuccucccgggauccaaagccccaggggucggaauacagaccuuucuggcacccgaaaccucuguuucgggaagccuggcucuucuuugggguuuucacgccaaaagggcuuuucuaggauauuuccucgauuuuuaauuauuuuuugaaaccaucccccccugcuccgacuccagcugccgaggcugcggcgcucuuccuccucuccucccucccccucucuuccccaccucuccucacccgcccccccaaaagcggccccugggccgcagggacccccccagacauuuuuuccaauugucgggaaugauagaggaggaucuggggauccggaugagaccaagaaguggacccccggagccuccagaauauuuuuauugauuuuuugaaaagaugacgaaauccaaaaaagagugagugaguuagagugcgcgaaggaguagccaaagggagcgucgcggagcugccgcggcugcugcgcacuucuccgacuccccguuuuggagcuguaguucacccccuuuuauaggaucccugggaauaccaaagcacugaugggcuauucugauucacuccaguuuccucaucuuuguucuuuauucuuaucacgcauucugguccccucccccucccacaaaaaaaaauuaauuuuuuuuguuucgauagauuacgcuuuuuuauucuuuuucucuuuugcugaugcuaugcucuccacccccgccccccaacccuuucccacucccauuauaggucugugaggaacagaagugcgaagaagaggucuucccucuggccaugaauuaccuggaccguuucuuggcuggggucccgacuccgaagucccaucugcaacuccugggugcugucugcauguuccuggccuccaaacucaaagagaccagcccgcugaccgcggagaagcugugcauuuacaccgacaacuccaucaagccucaggagcugcugguaaugaccggccccuuccucccuuccuuucugcgauucccgcuuuccccuggccaacaauaugccuucuaucaccacugccagagcaaauucuugggauccagaaugaccccaccaauagaauuuacccacuuaugggcgauagcucauuuaauaggaaaccacuguuuauuuuuuguguguuccuacuaugugcccaggcuccgugcccagcacugaggcuacaucugugaauaagauccucauggagauuuggguuggugagacucauuugcaauuguguaugcauguguguaggggacgcauggaauauuuuaauuaacagugauaauauuuuaauuaaauuccaaauuuccaaaaauagucugagaacguguucacaugauagguauguggcuguggugucuccuaaaaacuuggaguucaaagguaaugcccucuauaucuacaaagucucaagauaccaacacauaauagcuguucacuaaauaucaguucauugacuuuugagcaaagucaaaauguggccuuucacugaaggaguccgaggccuggguuccuaccuccagugggacugugaccucuguacaaccccagggauccugucuuaucucugcuuuucuaccagggaaccuuuuucccaccugaucuaacuccuuuucccugcagcuugacauauaagacgaccauauugcagcuguaccgcauggaauagcggcuccaaggcccaccuucggugguuugcacaccccucuuugcacuguucagaaaagcacccccuccuucccgccccucccccuccucacugguagggcccgcacaaaguccacagggcugaggcuggcuucuugaacugagcucuuugugaggagccuuccuuucuggggcucugcugccaucuaguggaagacaugcacaagguugggggaggaauugccgagaauguggagaggggccugaaugacuucaccuuugaaccgcugccagguuuuagcugcuucugguuugguccgagaggccuagaaaggugcuuucuucugggagaucugcuuccuuuaauaacggugcaagaccagugguucguacucgcauuacccugugaagaggaagggcuggcauuucaagccaucuuugaagaugauggugguuuaguaguuuauuggggugcuuuaccccggcuguacacagaaagccaaggcagauuuuaaagcuuaugaagaaaacauuguuagaauugggaaccaauuuguuuuucucaugagagagcaggaaaaaucaucuucauaugguucauuuguuucgagaggauggugaauugagauguucuucaggacacccaaaucuuuccaggacuagccaagcaauauauugcuacaaacaaacuuggcuuuuuccuauucccuuuaucccagaaguugggauuuggaagaguccuauuuuacaaaugagaaggcugaggccugggagggaaagggaaucacccccagccccacagcugugggacuggugcucugguugcugguuuagcaaaugaaagagauuccagguucuccaggugaaugggagagagggugcauuggcaaacaggcccugccucucauucuucugaugacagcucaguggauaggcauauuuucugguagcacauacgauauuuuuaauguuuuauuuuggaccguuucccuuugagcacaguuucccguaaguaucucagugaaagagggaaacaagguucuuuuucagguggguugcuggugagagacccaagagacaggguugugugguccccacacuugcacugagggaugcugugacacugagcaggcacccucaccuugccccagaucaccuccaucugcaaaaugagguugcuaaugaccaugugguccuuuagucaugaugacaauggccugugaaacauuuaggggaaagggcugagugucacauccccagaauuucugccugauauguaaaaggggaguuugagcagcagagagauaaaggcacuuuuuggcacuaaguaaaagcaagcuaauugguugccaaggaguugggccaaggaaccuuauuuugagcuuuaucugugugcaucauuuuuccaugaagauuaaaaagacuauuaauucggugauagagacauauacaauaaauuaccaugaaagggccacaaugaccuuggccguaucucauuguagguucagcuuucugggugggcgggaagcaguauugccugcaagucaggguugggaggggguaaggggagcuggaguggaaacgaaguagaagaaaauagaaucuuggcaacagcuaccugggcucucauuauuuucaguggagccugacauuugaagcauaagaagagcugucaacaacuucaaagcuucaggggcacauugacaaaugggcccgccuuacaaucuagcagccacguccuaaugagcggccuuaaaacuggucuggagcccaacccccagcccccuacaccaggucagccuguggaauuuagauucuccucuucucuuccugccuuccccuccaggagugggaacugguggugcuggggaaguugaaguggaaccuggcagcugucacuccucaugacuucauugagcacaucuugcgcaagcugccccagcagcgggagaagcugucucugauccgcaagcaugcucagaccuucauugcucugugugccaccgguaagaugaggcuugagccggggagggagaugggggagcucuuuugggagauguccggggagaggcaaaaggccguaggaacuuucauuuuaguucaggaguuuggaggagggguggucuugaguagucuaaagucugaaguuucauuccuggguugcuuuuucuuuaucugagcuuuauauauucgcuuucucugcuaaacucauaaaugguuuaugaggacaggugugguuaaggcaaaaaaaauuagugccuguuaaaauauucuuuaugauggcuaaagugcucuuugaagauuacauauacugcucacugguuguguucaaaucuuuaaucuuuuaaggaaaaggauggcuuggagauaagcccaagaggaaaucucgagggggaugggggcaaauacagguuaaaggaacaacgucaagauaaauaugcugccugccuugauuagugguaagggagaccaaagaaauucuuuuuuuuuuuuuuuuacuguagggcauuuauggccuucuagcuguuugcuucucuagcuguuugccccacugggcgcgggagggaaccugguuggcuuucggugaggcuuuacuuucugagcgcuggguucugaugcccucaguucauguggagguguuuugauuuuggccgcagccuuuaacguugcaauuccgccuaccacguggaucccacaauugauacaucauuccuacuggcccauuuguuuuguaguuuccuaauaaaccaaaggcagugguuugcuguugucuuauuaaacagccuuggccagugucuacugguuuuuuguuuuuuuuuuucuugguaguggccauggcagagacccuggaaccuuacucauccaagggagagaugucaggaguucauguuuugacaaucagaaaccuuagguaaaaagcugaucacuugggaagaccuuucggugugcuucaccucaaauuugccaagaguaguuaaaucgcuagguggacucacgugguaacuuuuuucaggauguuguuacauguuacuggugaguucuacggaacggaugauuauauaacguacgauguagugcauaugcccugugcucacagucaaaaagucaggcuuugcugcauaucagugagugaccuuuaauuggcugcuuaaccucucugaacccgagcuucuucaucuccaaaacaagccuauugauacaucauccuacagccuuuucagagcagcuaggaaaauuaaaaucagaaagaggugaugcacguggacgugcuuuguaaaccgaaguguagguuggaccuucacuaauugugaaaaugcuaccaucuccgauuuucacccugauuuuaacuguuccgacuaaaguggauaugauggcuuuccuuuucuggcugcccuuacguguuucuagcaggaccuguguguucugcacuugcaggcuugaguguggaguccucccggcccccugccuguucaucuagggcacagguuuccccuugcugguuuucuguaguccuguucuccuggaugcaggccaggccucauggcgugcacaugcgcccugugccccuuggugggagaguccguuauccuuccugcagcccugggggcgguucuuaggaccccuguggaccccugcugccuuuuggauaguggucacucuggcuuccuucccuucugcugucuggcccgggcccgagaggucaguccuccagugaccugucauuuugucucccaggcucggcugucuccuuccucucucaucaugauucacugugggggaggggucagccaguucuuucucucuggcccaaggacagcugacccccgacccuaaacucccccacugcccagcuguugauagccagagcucugcucaacacugucucuugacuaacagaucuuuuggggucuaacugccccuuccuccucucugaucucugauugggguaggggugcuggguggaguuaccggggugugggcagauccccagauuccgucuagacccauucucgaaaaccggggaucccaucccccacccguggccuucuugcccagaucuuugggcuggcugccagcuccggggccagaguagggagccugggauucagagacugaggacagaggcccagagggauacagaggcaguuauaaagacuguguuuugggggccuugaacuagcuuuggucagggacuaggaaaggacacccccaaaccacaugaaaauggugugcuaggcacuaagccucaggcguugacagggcagagcacagguagguccucggcaguuuccugggucuggaaaggaggggccuguaucgaaagaaguugcuuucccucaucugcacuuggguuugugcaacugacugagucacauagaauccuggcugcguggaguuuuacaacagucggccucacaguacaaacaccgaaggccgcuuuucuugaaggaaacaccuuccauggagaggcgauugugcauuguggggccagggugugaugaaugggcaaggacccaggacucuggccaguagcgggcacagagugacugagaggcagagguaggagaugcagauuccccaacccgagcuguugcccucaccugcuccucaaaucgcacacuucccuccuuuucucgcaguccuggauguuccguccuggagcugaugaaacaccugcggccagggucucggagguccacaguggguggagggugggggucccgagagauggccgccaacccucaggccgugcagcuauuugaugggaaaagcugguugugaaagagcuggcagugguucugcaguguguggggagcguauuugugugugaaaggggaagggagagcaggagaacauagaggggccgcguaaguguggcgaaguggcggucuugcuuuauggggcucuggauuaagaugguggcaaggcggagaggagcccuccuuccuucccugcucagccuaaaauggcuucuggaagagcaagggccgcaagcugcugguaucccucugcagcagguccugggcagugcaggcauggguggguugggcgggggaucuuccugacuacagcuccuagcauuccuguuccuggaguuuccaaaacuggggaagcagaacugagccauagcuucccugguugccgcucugcugauagaacacccaggucugcaagcgaggaaagaaggccauuggagaugaccuggguucgcacucuggcacugggagauuguugagaugugauaccaugcucgguggaugauuccaguuagucuagcagagccaauggcauugaguuuacaccuggcaccggguagggggaggugcucacccucccucuccaggcacccacauccccucuuucuucacuagaagcccacccuaagaugcugcaccuugguauuugugccacacacgguagccacccccaggccuccccacgccaaggccagagccccauuguugacuagaacccauugugcuguccuagccccuucccuggcuuuaccuacagguguucccucagauuccaucgccaagugagagggagacagugguggcccagagaaguucgaugacuuggcccuugaucuagagugggagauuucgccuugaugggugcugggaaggaagaauggaaacccgucuuuccaucugcaagucucugagcuaccccugaagccgcgaggucaugggacugagggggagucguuagcaugcccuguggggacaagcagccaggcaguguggugcuugccaucgcucuucccucuggcuguaagaugaauggguagcaggcugcucaucgcccuccaaccagcccccuccccagcuccucccagcaggccuugcaguugcaugggcauucccuugccauggcagcccugccccacaaggacaggguaugcugguccucuuauggggguggcagaugaggugcgugcccagugacgucccuggccugugaacacucugguucuggcccuuugaacuuccaccugacugcagguuggagaagagagauggggaaagccugaccuggccuucccuuucuucuucagcgucagagugcguaucucucucccccuauuggugaacagaagcaaagccaucaccccugcaccccaagaccucggccaccauagccaaaaugaugggugcuaaauguacugggcaggaccauguauuccgugguuuuaaacuuacuuagcucugaacucuuuauuugguaaaauccuaccaagaagugcagauaccaaguugaugaaauggagcacuucucagggcccaugcccaggugagggagcccagcgggacccccagaggcucccagggcauccuugggaggauaagccuuuugugcuugcuggugccggggcugcggcugggacccaauuccuuugauuccugagccagagcgccaccuuuggggcucuucucccacuuccgacgugaaaggcugcccuguccuccugagugguauaugggaggugacuuugaggagcuggucagcuuccaguaaguuacgaagagcucugcauccagagucucaaagucucauccggaucccaggcccaacacucacagugagugacaucagccagaucacuucaucucccaagacuucauugauucaccuguaaaaggagauguuugaaacagaugaauuucaagcuccuuuuuauuaauaccucaccaucaucaccgccgucauaagcaagcaugcagcccacagcagagcugccccuggcgccuguggguccagcugggauuccccuaagguguguccuuugccuccaccauuuugccaggagggaggcgggaaugucggguguuccugguuaucugggcaucguuccuuggcucgggugaacugcaucucaaugaauuguggaaugugcuggguuagaguugccaacuucucucuuccauucgcugaguguucaugggguucuuuucauuccccuguggggcugcacuuucucccaguucugcaaagcagcaggaggcuuuggggacucgaugaugucauuucugggacacauacacaacuggauagugacagauucuccaggaagcacagagcccucauucuuccuggccugcuuggccugcucccugcaucugccugcaauccagggaugcugggcgccuuucuccucaucccuccagacgcuggagagcaucuccagucggaacuccccaccacaguccugcaggaaguacuaggagugagagcagaggaggggcagguuggggaggaugcuggcugacauucauugcuuaccuugaaccaggcacugugcuuuuacaaggauuauuuuaagugaauccucagaacagcacuacaacguggguauugcuguugucauuauuugcagaucagaaaaugaaaacucagagaggucagguaacuugcucaucuucacacacuugguagguggugggauggagauuccaccuccuucugauuccagagcuaauacucugaaccagugagcuguguucuccagaggucugcuuugguuggaggggagcuggagcccuaggcccugggacggccucuguugcccauggcaaggcguguggcugcuccugcucucuucagaucuccagaugcagcaaccuggagaaaggcccuccugggucugguggggacuggggcaggaguggaggcugcccaagcuccgugcacuccacguuccagcuuggagcuuuuugagucuacucuccaaauccuucccaucucccugaagagucuucugagaagugucucaaaugcuccucuucacucaagagccuccuuucuuuuuuuuuuucuuuucuuuuucuuuuuuuuuuuugagacagucuugcucugucacccaggcuggagugcauggcacaaucucugcucacugcaaccuccaacucccggguucaagugauucucuugcccaagccuccagaauagcugggauuacaggcgcgugccaccaugccuggcuaauuuuuguauuuuuaguacagacaggguuucaccguguuggccagacuggucucgaacuucggaccucaggucaucugcccaccucggccucccaaagugcuaggauuacacugugagccacugcgcccagccuucaagagcccccuuucuuugagaaguuucuucagaaguuauccauauaguaguacagaccuagccauuauagcacaccauccucuacuaucuaaugcauugaugcccagccuuaagaagucugaauauuguacguuuuggggggaguccuccaugcugccuggaacagggaggagcacauugucaugagucgaucagaauggaucgcugaucgguucauugccucucucucugcugcaggaggaaggaucucaggaagucaccagcaucucaccucuccaggugggcaauuaacgauggcgagggcacacccucaccccugagcgugccuucugcaccagcauauugcuuguuggcauuuuugaucaagagacuuaacagacugcugagaaauuuguaccugguuuuuauuuguuaaaauaauauuacguacaaauuuuacaaacucaucuguguuucucccaccuaacagaacagcuuuuauuuuccgugcauccuuccaguucauccauaggcauauauguauguauuuacccaugguuguaaucuucaucgucgcaugcaugcaugcaauuugguuuuccgcuuccuucuucugaguggauauugugaccauuucuccauccugucauagcgacaaagcugaugguuuccaggaauggcugcauuggguagguggagcuuuccacaguugaggguggggguuggcuaauuacagcuaggaagcuagugcacagaugaaaugauguuugauuuuuuuguuuuucucucuguucaguauccccuaccaguagagagggggauguccuugagagugguccuggggcagcccuggugccacggggaaguagcgccgcucuguggagagggcugcuuugugaauuugccggcugguagacaccgugauccauucuauugucuccucauuguucuucuccuugggagucauucccauuccagauccucaaguaagagcaaaguagaccuguaaggcaccugggagguuauccugcuuacuaucuuuaaacucuugaccuaagccauguaggaagaaacacauuuuauaacacaacucaggauacuuguacaaguauaucaaacugauacaaaaguuucuccgaacaauauuuacucuuaacgacauacggugagccugauacuuucuauccuacucuauuugguuaaaggagaacaacaacagaaagugcuggucacgacccacaaaugcauuucaugacccauuaaugaguugcagcuagaaguuagaaaaacacuuaucucacccaacccguuauuagacaaaugggaaaccaagcccuuggaaagaggaagugacuugcccacagucccacgucuggaccuagcuggagggcugauguugccucaguauuugacuaaccuggaggagagguggggcaugcucagggaucccgaggaagaugcucgucuucuguguagcgggcaacagagggcagcacggccgccguccucgucuccagcggcgucucuccucuggcugugggaacacacugcuccuuuggugccacucugagcugcugagaggcagucaaguucaugcacauagugcuccccaauucugugggauuggacaguguccccaagaggacuccccugaaaaucuucuuaguaaaacaaaaagggagguagagucucccugugcaaccggugcaccuguucccccuaugccugcuggcuuccagaaguucauucguaugccaauaauaagaguugguuuugcuagcagugggacagcagagaugggcaugugugaggugugcuucccggucugaggccuauggcagagggaagggagggccggggauacuugccugccucuucccuggcagaugcucccacccgggccuuugugggcccagggccaugggccggcugccccgcuuguguuaugaaugucacaggggggagcuaacgagguuauugggcagagaaacacucuccugugacccauguggaagagaccuacagcagagcaagaggcagggaggcuggcuuugucacacuguucauggcgacagagaaggcguaggaggggcggguggacagcaggcgugggcgcagcaccauuauauacgucccucaagagguggagauggugagagggcaauggagaaaaagccaaggagacaggcagauggccagguuugcucugcguucaugaugggaggggagggcugugcuuggcucagggauccacggugucuaacaaugcugcuaacuugaugcuggggcaaugggcugaccauuaaaagagcugcuguagaaaguguguuuguaauagaguguguacaggaggaaggggaaauaggagaggggcugguuuuuguagauuuaaccugauuguuuuugcuguaaguugaagggugacccacgguucccuguaugcugugucuccugcccccacgugccccuuccaugucuacacacaguaagcucacuagagcaaugcuaaaacgagaaagaguacgcuuuggaagacuugcugcacuccaggaccgucacuagcgugauggcugcaacuauacccacccuaauaucugucaacacgagcaggggcaacuuaaacucucaaaagucucaggguucucacccauaccauuagggugacgcucgugugcaucuucuguggcugauggguaaauuaaacaggacguaauguguagcguacugcaugugguggucauugguagcugucagcagcuguaacaggagaaguuggcugucuuuauuuccccucgauggaccaagcagcugcuggaucauggccacccagccccucugaaggagugcucggaggaacacaagggggcuggucuuccaagaggagcccucuagcauggcaguggacgggguucaagccccucugauuuauuauccucauucugcacuucccuguagcaagucacauuuuuuucucuuagcaauaaaauggggccuucagucucaugagucauaacaucgaaaccgagucacccaucugauucggaugcaaugauuaaucuucagugcuuaguuagagcccuauguuaggguuagaauccucugcccuaauguucugaggguucuugcuguugggccagagguugggaacuggguggaacucagcccccacucgcccacucccugcauugcugcuucucucauuuccuuuuuuagaucaaaccuuuuuuuuuuuuuuuugggugggggucauauuaauccucaaugccuguccagagacuauaacaagaucccaucugaauuagcauuaugcauagauuuugcccguuucucccaucuccuuguacuuucccuccuucucacaucuggagccccuggucuguccugcuugcauggcccaugggguaccuugucugcacuggucucaggcauucucugcucuguucccaccaucaccucuagaggagacuaugacucgcucaccuugcuccccccaccagggucaagaauguuaacucagacaugcuuaauaugacugggaucuggggauuggggaccuugaauccucugugcauucauugugugcgcuuagauaagcugucuuccuucccugccucagucuccuucguuuaaucuggaacagccauggugauggcaaauaaacacaggcuccuugugaaagaacucgagggaggacaugccuguagggcacggggucacucgcgccgcugaccugcugccguccuguuucugagucucugcagucucgggagcuccaggauccaaauucguucugugcccugaccuucugccucucauuccuugcagacuuuaaguuugccauguacccaccgucgaugaucgcaacuggaagugugggagcagccaucugugggcuccagcaggaugaggaagugagcucgcucacuugugaugcccugacugagcugcuggcuaagaucaccaacacagacgugguagguggccaccaccuucuuggcuaaguccagaugucucuucucagcucagggaaggagacgacggauuugauuauguugugucagagguauuuuucugguuuguuuccuaagaucgacauccaagggagugcaaaguucagcaggugacacccccucuuaagguucugaaaagcugugcacgggaaaauacggaagaaaacucagcaagcagaugaagggggugggggugggagggcuguuuaccgauguuccuuuauggcgugggcuucucagugggucugaauuguugcuucauugccauauuuguacacgcugccaggcugccucugcccggcagcgaagagcugccgugucugcuuucacacgcugaggcuguaaggcgcacagaggagaaaggagagccaggacucagcugcaguggauggagcagacacacaagaggugccccacugugagaacgguguccgucccuggcaaaccucucgaccccuccccgcucucucuucccuuuuguucaaugcaguaauggauuacaaagugcuuucaaaagacaaagugccauacaaacucaagaaacuauuauuagcuacggagcuuccccauucugugugcccuguggacggcccagaggcuguuaacuuccuguugccagaauuuggagcuccugagaagaaagguuuugagagagaccagggucaagugagccucugaauucaaucagcaggaagcugcaguccuagcccguccgagacaggauggugccaagaggucagagaggccauuccuucguuuuccacgggcaggacagggacugaaguaaccagccaggagcggggugggcaguggcugagcuggggcuagaacccccaggcuccgacugcccccuggaaacuucccacuccacccuuguugccgcuccugggaucuuuugguuugaaaaaaaacccugggguuuaaagucaaccugagagagggguguuggcccugagcccucaugcaucaccauggagaggcugaagaaugcugggcacuucacgaugacacccucuggaugguccggggggauucagaugcccucugcgggcuuuuauugaguuaagggaucaugugguuuauaggccuauggcugaggccugcacgagggauacgggacagguuaaaccucagagagcccacggcugcagcucgccggccuccucgcccgcccaccuggauuuucccuggcauuuguucccagcucagagaaauggcgcagggagaugcugacggagcaaauccgggguccuccucugagauaguucguagauaugguuuuaaaaugcgggcuccaaacauacgcuuuuuaaacgaggacuccagaacacagacugaaaaccucccuccagugcagcaugaagaaugcuuuucuaauccuccagaggaaaaucguggacgggacuuaacguuuauagaaaugguacgcuuuccuccuuuucugaaugucuccaauuaaggcugccuuacaaauaggacucucagccaguuuaagacaagcccuuccucaaugccuggagacaaaaaugucagugacaggaguuggaagcggccaccccccuccuccugcccccaggcauuguaaccuuuucccccgauguugauagaccugcucugaugggcugaccacccuaccggcuccagccuuuucccaccucccuuugucccccguuacugaucucacauggacagugguggaaauuucccuccugggaguugcugcugagucucuuggcuuuucgagaccgcaggcaagucaguccgucaucucaucuggggaaacuguuugccuuuuucugauacuacguagccaguccauuuaagucagcuggccaacucuguuaaauggauaugaaguggguacgaagcugguuuagggguguccuccuauaaauccuaacuguuggucaaguugauaccucauuucuauaaugggcacacgccguguuuccuaacuggggcugccugugugugccucauucacaccgguggaccuggguugaacauguucauauuuaaaaaccaagagugaacgcggugaaauguacaauucauaacacuuuuucaaagaaaaaucugagcccucaggaaguuccaggcuuaccucuggcaccccggaggcugguucgcucucccugaaaauguuuuuaguggaaagguucaagcagcucugggcuaggcuguguguguguguguguguguguguguuuaugcaccuuuccaagugcuaaaucuccucccauccaucagccuguguucucugaaaagcugacgcucagagggaagaaaaauaaaaggacuagaauuuagaacacauuaguguuuggagggaggugaguugugcuuccugagcucuguuuaccauuucacgagucacgaagugguguauuuccuucauucguuucuggaagucuuuacugaaggcccaguuguugcuagaaguugggguggaugguggcaucugggaaauagaggaugagauuccugccuucaaggaacuuagcaguuguaugaugaagcaagaguaaagcgugcaaaacccuagcaaauuaagaacguaaacaaaggugugcuacguaacguguuacgaacccuaaaugcaguaggaaaucaacccaaaagaaggagcucaucaggccuaacguagaaugccggccucccagcagagaaaacuuggugauagaaacuguucuuagaguagagaaacaaaauguaugggcacgcaauggaauauuauucaaccuuaaaaagaaaugaaauuccgauccauguuauaacaugggcgaaccuugaaaauacuauguuaagugaaacgagccagacacaaaaagacaaauacuguaugauuccacuuauaccagguaccuggaauagucaaauucguagagacagaaaguagaauagagguucccaggagucuggggagaggagaggauggggaguuaguguuuaaugcguacggaguuucaguuugggaugaugaaaacaauucuguagauggagaguucugauggccacacagcagugugaauguacuuaaugccacuguacauuuaaaaguggcugaaaagggaaauuugacauuauguguauuuaugauaguaaaauguguguguguauauauguauauacacacacauacauaaauggauauauauauauguauguauguaugucugaaacauucucgggccacgcuaugaaaugcccauagguugauguugagcucuucccuggaaaagugaaauacacaggaccacauuuugcccccuggcccuagugcauugacaaacgggaaucaggaagagcugacaguuucccccagagccccugaaguuauaugucagcuccuacacaccuugcuguuucugauuucuucaagcuugcaaugcucucuguuacuuuggggguuaggucguggguugucggggaucgagcuguggaaagagggucccccugauucuugugagauggccaggcgagucucugugguucauuggccaggagcagauagcuuugauaugagggacgcaugcggcucugagaaagucggccuuuguugcuccgucugguugccaaaauaaaccagaacgcuucauuccaaagagaaagcugagugaggggccugacaguuuuauagggaauaaacgucucagagagugguauauuuuaaauacuuuuuccuuccaaucguaagaguugcuaaaaacagccagagaggcaguuuggcuguaggggggacgucuauuggggguguccagugccuggguagguuugagaggggagggugccacuggccuggguccccggugaccauggcccugcuuccuugggcugaaucgggguccucuuccauccccucugcacacuagucgggcugcgugccagcauugaucucacugcuuccuugucuauagaaccucuugaauaaggcccagcuuuuccucagcucuuuauccagagccccuggcagagucauugggagugaugcuuaagagaggaagggaagaggaaggaaggagcaaaggacaaaggcaggcagauggguuuccaguggguuuccgauucacuggucuguccauguccuuugaaaagcugugucuuuucuuuaacuucaauucugugucagggccuuccgagccuucugaguuuuccccaaccuuaucuuagaguagguuaaaugaaguggcuucauuuucauaugacacaguugcacaaauucacuaacuaaaaaauggaauggaggcucacaggccauaaagguguugugaaguuauugcaagauacuuaacagaagaaagacucuagucaucuguuccuuauauuuauccuuuuuugucuaagucacaucaaaacucuuugucacauucuuuaaaaacaaaaagcaaaaaacaaaacuuuagauucaggggauccaugugcgguuuguuacguggauauaucgugugaugcugagguuugggcuucagucgaacccgucacccagacaguguacacaguacccaauagggaguguuucaacucucgucccugucccuagacacauucuuaaauauugcccagagaagauuccaggauaucccuuccuuagggucauccuggcauuuuacgguccugguuaucaaugagcuauuaaaaagcagggagguggaggcgccguggaagaagucucaguuucgaccacaugugugugauucaugggguuuagcauuguguguuucugcuccguagcuggaagugccgccacccucgccccacaugucauuuucaagccuccacuguuacagauucugucuucuguggacucuucagggccuguggucaggaaccuugugaaguguugcuggaagcuggggguggggagguggaauagaaucgggggcugaugccucccucuccugccucauuuuucugugggccucauuugguaugcaaggaaauaagccaaacagccugugaagaaaggaagaaugagauaguuuccuaaguugucucugccugaguuggccgcgggucuggggcucauucagcccuuugucccccuguugagugcagugcguguguggugacaaugagguggugcaguuacacugagggcuaaugguaggaguuccgucagcccauucauggaggcagaggagggugcagggcgcggagcucgagccagcaagcagaggaagucagaggcccuuguaacgagcugaagaucacaaacacugcugugagggcuccaggcuugggggcgggggcagccaggagggaagggggcaagggagggggccuaucaucauagaaguuggaggucugcccgaccgccagcgcgguaggguaccaccuguccaggcugacagacgagcauuauggcuucccuuuuaaucagcuuaauuuggggcaucuuaacacaauggcuggugcuuuggaggcugcaggaaagcugauguccuagagccgccacacuugacaugcguguaacaccuuuugauuagaggcgcuuucguguuuuuccagccacuugggcucugucucuuuuucuuggagauucucuggucuguaugucuuuacuuagagcuuagaagucaagguauauaggaaaaaggaguucugaaauuggaggcuugcccuuucuaaagccagucugagcuuucagccagaugucacugggacaagccacgucaacucuccacgcuccauucccuagcugggaaacgagggcauuuggcuauuugauuuccagaggcccuuuggaccuccaaauucuccaagucugugauuauuuguguaugucuucuuauaauccagccccuuuggaagcacuaacuccacucuucucucagcuugauccucuaauagaagcaaccugguuggauuuaagguggaggucuuccucucuccagguggcugcccucaucucuacccccaccccaaucccaugcauucuccugcccuccugcuuugggcaagacccgggcgauguggaguuggcauguccaguugcagguaucagcaccacugcaccaucuccucugccuucacuucccaccagcacacagaauuuauaugcccuucccaaguccaaaaagggccccugccaugcuaaacaaagguauucauaugcaaggcaugagcucugucucauggaagggagaggccaaguucucuuuccaccaucagagaguagcguucaacaucauuuauacaagacaggcuuuugcccuuuuagucuugcugaacuagaaugagggauuuguguagucgaaagucaagcugaucauugucaaguuucguggaaguggaaccugaaggaagguuagguggagacugcagagaggguuagcguccugccuuaccacaagguaagucuagaagaggguggggaagggaguucagaauucuucauucauggaguguaccugccuuggucauccuuuuaucuuccagucagaggggucaucagucaagagcuggccaggcugggugugguggcucaugucuguaauccuagcacuuugggaggccaaggcggguggaucaucugaggucaggaguucgagaccagccugaccaaucuggugaaacccugucucuauuaaaaauacaaaaaucagcugggggugauggcgugcaccuguaaucccagcuacuugggaugcugagacaggagaauugcuugaacccaggagguggagguugcagugagccgagaucgcaccauugcacuccagccugagugacagugagacuccgucucaaaaaacaaaacaaaagcuggccguagucaagucagugaugauuuggauugaaauuaaaaugugacuaaagagagaguaugcaguuuugucuaucuaugaaaccuuccucuguuuuaugugggacaccugggcacccacucuuggcuggaacuuacauaaaacacuacugugcacgcacaugucaccucaagucccguggcucugaaaguccaguagaagugacagccagacaucccaguccucccuguaggguuuucucagaacuguuccuuuaaggucucaggcugcuggaagggagggcugauagcagaaaaaguggggacacugggaacuccaaagggaagacgcgcauggccugaaaccgaguucuuucgcuuucuggagccuggucucccuauguggagggucaugcuggcauggcuggcaaugguuaauucaccgauggccauggagucccaaguuggccauauuauugcgguaaaagauacauuaacccagaugaccuugccgggggccagaauagagcccgugaggaaggagagcaaggcaggaucggccgggaggcgagagggauuuuguugaggagcaaggucuuccacaggaacugcgacuuggaaaguauucaccaagggcugugccaugcgaaacccucuuuaaaggaaccgcaucgcuacgccuaacgggcauuucuuuuuuaauguaaugguucagagcuauugucuaccacgccucgugugcacacgcacacacacgcaaguucccucagucagccgagaauccugccaucucuuuuagauaacaaaagcucuuaggccuuaugcuuuggguaggauuugucuuccauggacagguauucaguugggaacaaguauauagucacugccucuaugguauggagauacuccgauuuagucccucugccucuuggggaaaaaaaaaaaaaaauuguaaacauccccuucagcagcuucucaagucccuguacaguggaggaacauuacacgugaacuuccuggauucaauggauucuucuuugcaagaaaaaaaacaaaacaaaaaaacagagaaagaagaaaauaucaauuuagacuguuagguccaacguuucacucagugagugagcacagggggugacggaggauggcuggaaugugggguugaagcugcuguucugggucucagcuccugcccauguaccguggagugagcaucucacaccacgaugauucuggcauuuaagugaacuccuucacacggugcucaaguggagaaagggcuguccaugucuaucccagcuuagaagaaaaacugaugguaugagacuugccauuccucucugauguagaaccugccuaagggacauuccacagcaguucugaccguugucacuuugugccuuaacccccacauucauuuugauucuauauuuaguauuaaauuuuuuagauuauuaggauuuaagguuuucaaacaucuacugaaaugcaagugccccuagaaacauuauacuuucaggccgggcucaguggcuuaugccuguaaucccaguacuucgggaggccaaggcgggcagauaccugaggucaggaguucaagaccagccuggccaaucuggugaaaucccaucucaacuauaaauacaaaaaucagcugggcgugguggcacgugccuauaaucccagcugcucgggaggcugaggaaggagaauugcuugaacccgagagguggagguugcagugagccaagauugugccauugcacuccagccugggcgacagagcaacacucugucucaaaaaaaaaaaaaaaaaaaaaaaaaaacagaaaagaaaagaaacauuauaccuuaacuuuucgcaccuagugagugauaaccuaugaggauaaugcugccacaugguccuugagggaagaacuuggggaagagccgaacagggaugaggcaggugagccccaugugauuuaucgucauucauucagcucaacaggucggacaggguaaggguaagggauguaaccaggagaugccacaggaacgucugagagguguuagcaagucccagaggccagcgcccgacuccauuucagccucguucaggguggcacggagacuccugcugcugcgucacgucugucauguucagcacucuucccagacacacagucuugacuaaagauugucaggaucuugacacacgcuucauuagucuugacuaaaugcgaaucuauaccucauuucaaagaaaucugaauucuuuagguuccaggaccaguuuauuguuauacauaaucacgaucauuuauugagcuccacuuagcacugcacauauaucaguaucaucucaguugcccuuuacucugauuauuuuguggggaaacugagaucagaaaaguuaaauaacuuaggugccaccugcaaguauagugggugggcagcagauaccacccuuccucauuucauuguuccaggugauauuucgucucugccuuuggccuuuagucugugguuguuccuaaucuuaguuuucauugaaagcuguaguuugaaaugugggauagaugagagauaggaaaggaaaauuuagggguauggaaauuuuguuccuuagugguuaguuccagcuuuauuuuguuuauuuauauguuuguuuuuaaagaucgggagcuugcuguguuguccaggcugguaucgaacuccugguuucagcuucccgccucagccucccagagugcugggauuacaggcaugagccaauaugccuggccagcuguguuuuagaucuuugggaaauaaagagaaugcuuuugggcuuggcaaaauagaaaccucuggguggggagaauugcacaguaaaagaaacaaaagggaaguuuauauuaaacuaugaaaagacacagggagguucaauuuaacauauuugccuuauguaugugcuucuuaagagagugcacaaaggcaccuuugcagaggagagaggcuagaaaaugcccguuagaagcaagucuacgguuugcacccucuuacuagcaccagcaacggucccugucuagugauacccaugacuugucauugcauugcaugucaucugccuaagagaagcuccugccuggggcagacacacugucaauuaccccuacaauauagacugauacuaaagcaaggcugcauauucuugcuuauucccaaauuggauggcucaagguuccagaauguuguagacauucugcauuauaucuuuaugagaguuaaggaaaugguaaagaagcagaaaaaguuggggauuuuuuuuuuuaaguauuuacagugaggcgcgguggcucaugccuguaaucccagcacuuugggaggccgaugcgggcggaucacaaggucaggaguucgaggccagccuggccaauauggugaaacccugucuguacuaaaaauacaaaaauuagccaggcgcgguggcgggugccuguagucccagcuacuugggaggcugaggcaggagaaucgcuugaacccggaagguggagguugcagugagccgagauugugccagugcacuccagccugggggacagagugagaaaaaguauuuacaguuuaugugagggucaguacguugguucauuggcuuccuucuuaucuaguucucgggcugaguuugcuaaugucauagcacuucuaguagccuuccccuuuucucugccacuucccagcuuccccaggcagaaagcaucuggucggccccuugauuaccaggcauccauaagugaccaucauuuaggccagugcuucucagaaugccaaucaccugggcuccacuaaaaggcagguucugaauagcucggccuggguugacugagauucugcgguuccaacaagcucgcaggugaugcugaugcugccagcccauggaccccaccuggaguagugagguuccuuggcacuuuaagaacaucccuccuuuacuucacauuuauuucuacuggaaacuagcacagacuuaugcaagcuaaauuacgcauguuuucuccguaggaugcucuauguccuguuccucuuacuaacaacucuggucuggaccauuguucuaggauugucucaaagcuugccaggagcagauugaggcggugcuccucaauagccugcagcaguaccgucaggaccaacgugacggauccaagucggaggaugaacuggaccaagccagcaccccuacagacgugcgggauaucgaccugugaggaugccaguugggccgaaagagagagacgcguccauaaucuggucucuucuucuuucugguuguuuuuguucuuuguguuuuagggugaaacuuaaaaaaaaaauucugcccccaccuagaucauauuuaaagaucuuuuagaagugagagaaaaagguccuacgaaaacggaauaauaaaaagcauuuggugccuauuugaaguacagcauaagggaaucccuuguauaugcgaacaguuauuguuugauuauguaaaaguaauaguaaaaugcuuacaggaaaaccugcagaguaguuagagaauauguaugccugcaauaugggaacaaauuagaggagacuuuuuuuuuucauguuaugagcuagcacauacacccccuuguaguauaauuucaaggaacuguguacgccauuuauggcaugauuagauugcaaagcaaugaacucaagaaggaauugaaauaaggagggacaugauggggaaggaguacaaaacaaucucucaacaugauugaaccauuugggauggagaagcaccuuugcucucagccaccuguuacuaagucaggaguguaguuggaucucuacauuaauguccucuugcugucuacaguagcugcuaccuaaaaaaagauguuuuauuuugccaguuggacacaggugauuggcuccuggguuucauguucugugacauccugcuucuucuuccaaaugcaguucauugcagacaccaccauauugcuaucuaauggggaaauguagcuaugggccauaaccaaaacucacaugaaacggaggcagauggagaccaagggugggauccagaauggagucuuuucuguuauuguauuuaaaaggguaauguggccuuggcauuucuucuuagaaaaaaacuaauuuuuggugcugauuggcaugucugguucacaguuuagcauuguuauaaaccauuccauucgaaaagcacuuugaaaaauuguucccgagcgauagaugggaugguuuaugcaagucaugcugaauacuccuccccucuucucuuuugcccccucccuuccugcccccagucuggguuacucuucgcuucugguaucuggcguucuuugguacacaguucugguguuccuaccaggacucaagagacaccccuuccugcugacauucccaucacaacauuccucagacaagccuguaaacuaaaaucuguuaccauucugauggcacagaaggaucuuaauucccaucucuauacuucuccuuuggacauggaaagaaaaguuauugcuggugcaaagauagauggcugaacaucaggguguggcauuuuguucccuuuuccguuuuuuuuuuuuuauuguuguuguuaauuuuauugcaaaguuguauucagcguacuugaauuuuucuuccucuccacuucuuagaggcauucaguuagcaaagagguuggagcaacaacuuuuuuuuuuuuuuuugcacaauuguaauugacagguaaugaagcuauuuguuaaaauauuugccuuuuuaaguaaaaaagaaaaaucagaacagggcuauuugaagaauuauuuuauacacagauucugccuuguuucauaguaugaggguugaagacggaaaacaaucuaagggucucucauuuuuuuaauuuuguuuuguucaguuugguuuuuuuuuuuuuuugcgcugcuaagaagcuaaagucauccauccuuauucacguugacaguaccuagcuguaauguuucacagagugugcugcuauuuuauaaacauuuuuauaauauauuauuuuacugcuuaaauuccaaguccugaaguagaugguugagauaugaguucuucguacuggaaaagcccuuccguaguuuguuuucuucugguagcauauucaugguuguuuuuuuuuuucuuuuuugguuuuuugguuuuuuuuuuuuccucugaucacauucuucaaagacggaguauucuuuaccucagguuuacuggacaaaaucaauaacuacaaaaggcaaugauucacgcuuuuguuuucauaauaccucacaaccguacaguuucugcuugggagcccauucgcaugaggaauacagaagcagugugagcagggcugacucccucucagguggaaggcagggcggucucacucccagggaccuuuuuggucauggaggccaucgggcucccaguuagacccugguauccucaucaugauggaaaaaauacauugaaccaagggauccucccuccccuucaaggcagacguucaguacaaacauuuaugcgguaggcucagaugucguaauuugcacuuagguaccaggugucaggaaacagacuaaaaagaauuccaccaggcuguuuggagauccucaucuuggagcuuuuucaaaagcggggcuucaucugcaaagggcccuuucaucuugaaguuuuuccccuccgucuuuccccuccccuggcauggacaccuuguguuuaggaucaucucugcagguuuccuaggucugaaucugcgaguagaugaaccugcagcaagcagcguuuauggugcuuccuucucccuccucugucucaaacugcgcaggcaagcacuaugcaagcccaggcccucugcugagcgguacuaaacggucggguuuucaaucacacugaauuggcaggauaagaaaaauaggucagauaaguaugggaugauaguugaagggaggugaagaggcugcuucucuacagaggugaaauuccagaugagucagucucuugggaaguguguuuagaaggguucaggacuuugugaguuagcaugacccuaaaauucuaggggauuucuggugggacaauggguggugaauucugaaguuuuggagagggaaguggagcagccagcaaguaagcuagccagaguuuucucaagagccagcuuugcucagcacacucuccugggccccaaggagucccacggaauggggaaagcgggaacccuggaguucuugggaaucuuggagccuaaagagaaaccgaggugcaaauucauuucauggugacugacccuugagcuuaaacagaagcagcaaaugaaagaaccggacaaauaaggaagggcacaagccuacccgacucuauuuacagucuguaacuuuccacucuuccuguagucccgaggccccuggguccuucuagcuuuucucuuucccauccuuggggccuugugugaugauggguguggggcugccgaugggaaagucggggguuguuaggcuuuucugccugcuccugcuuaaacacaagaaggaauccuggauuuugcccucuccuuagcucuuagucucuuugguaggaguuuuguuccagaggagcucucccccuuggauuugaacuugcucuuuuuguuguuguuguucuuucucuucuuuuucuuaccucccacuaaagggguuccaaauuauccuggucuuuuucuaccuuguuguguuucuaucucgucuuuacuuccaucuguuuguuuuuuucuccaucagugggggccgaguuguucccccagccugccaaauuuugauccuuccccucuuuuggccaaauccuagggggaagaaauccuaguaugccaaaaauauaugcuaagcauaauuaaacuccaugcggguccauaacagccaagaagccugcaggagaaagccaagggcaguucccuccgcagaacaccccaugcgugcugagaggcgagcuccuugaagaaggggcuguucuuccaggaggccuuauuuugaacugccucaggaccccacuggagagcacagcaugccuuacuacugggucauccuuggucuaugugcucuguacuggaggcucuguucugccucuuaucagccaggucaggggcacacauggcuuaagugacaaagccagaggagaagacaacccugacagcaucacgcugcaucccauugcuagcaggauuggcaacucuucagacggagcugcgcuucccugcagucuagcaccucuagggccucuccagacugugcccugggagcucugggacugaaagguuaagaacauaaggcaggaucagaugacucucuccaagagggcaggggaauuuucucuccaugggccacaggggacagggcugggagaagaaauagacuugcaccuuaugucauguaaauaauugauuuucuaguucaagaagauaauauugguagugugggaauuggagguaggaaggggaggaagucugaguaagccaguuggcuucuaagccaaaaggauuccucuuuguuuaucucugagacaguccaaccuugagaauagcuuuaaaagggaaauuaaugcugagaugauaaaguccccuuaagccaacaaacccucuguagcuauagaaugagugcagguuucuauugguguggacucagagcaauuuacaagagcuguucaugcagccauccauuugugcaaaauaggguaagaagauucaagaggauauuuauuacuuccucauaccacauggcuuuugaugauucuggauucuaaacaacccagaauggucauuucaggcacaacgauacuacauucgugugugucugcuuuuaaacuuggcugggcuaucagacccuauucucggcucagguuuugagaagccaucagcaaauguguacgugcaugcuguagcugcagccugcaucccuucgccugcagccuacuuuggggaaauaaagugccuuacugacuguagccauuacaguauccaaugucuuuugacaggugccuguccuugaaaaacaaaguuucuauuuuuauuuuuaauugguuuaguucuuaacugcuggccaacucuuacauccccagcaaaucaucgggccauuggauuuuuuccauuauguucaucacccuuauaucauguaccucagaucucucucucucuccucucucucaguuauguaguuucuugucuuggacuuuuuuuuuucuuuucuuuuucuuuuuuuuuuugcuuuaaaacaagugugaugccauaucaaguccauguuauucucucacaguguacucuauaagaggugugggugucuguuuggucaggauguuagaaagugcugauaaguagcaugaucaguguaugcgaaaagguuuuuaggaaguauggcaaaaauguuguauuggcuaugauggugacaugauauagucagcugccuuuuaagaggucuuaucuguucaguguuaagugauuuaaaaaaauaauaaccuguuuucugacuaguuuaaagauggauuugaaaaugguuuugaaugcaauuagguuaugcuauuuggacaauaaacucaccuugaccuaaauu

SEQ ID NO: 14913 - RNA, 3422 nt, Homo sapiens
aagugucauugugagacuucugccgcccacguccucaaagggcccagcacguggcucagucugcaccuagaccggggcaauuaguaguuccuuuuuccugucaugaagggcagcccaaacaucaaagguccccauguuguuacccuaucaacugguuuagaccacgaggcugacugaaggcagaggcaaccaagaagcacuuuuguaugugaauaaaaaacaaguauggaaugugggccgggcagguggcucacgccuguaaucccagcgcuuugggaggccgaggcagguagaucacgaggucaggagaucgagacuauccuggcuaacguggugaaaccccaucucuacuaaaaauacaaaaaaauuagcagggcgugguggugggcacccguagccacagcuacucgggaggcugaggcaggagaauggcgugaaccugggaggaggagcuugcagugagccgagaucgcgccacuguacuccagccugggcgacagagcaagacucucucucaaaaacaaaacaaaacaaaacaaauaaaacaaguauggaauguggaaagagcagagcccuggccuaaaccucaggagaacuaaguucuagcccuggaggcgcuaggaacuggcugugugaccuuagucagguuacccagccucucugauucuuagagcugucugcuguaaaaugaacagggcagauaaugacagucuccgaggcccuccauuucugaccuucugugaugagaauguuguucacugguugcuaucuacaugaaugaagauuugcggggcauggauaauacaaaacaauggugagcuaacuuuaauguuuucuauuuuacuuuguuugccuuuggaauguaaccagagcacacauucagacacucacaaacuuccuuccuucccugcccccuuucccugcuccucuguuuggcccuccuggccagggguggggguggaagaaugugagguuggcuggaaaggccgagaggaugcaggaagguuucugguugggggcacggagguugugggggaggggugcuccagggaccugagaaucgauuagcuauaagaucauuuuaaucccuuccgcuauccagaaaggugggagauugugaauagcacauuccucacgcgaaauaccguauauccuugccuaugagaagccccgggaaaaauaguaguguguuuaaaugaugagccucaaggaaaaucaucagagaaguccuccuucuugucaauuguauauuucaguuuuccuuuccagccaagauagggccccugcaaaaucacgauuccuagggcagucgucaugcuuguggggguggagacugggaagagagacaggaccuucauggggaaauaaaugugcuauuuuucuauuuuuacuccaccuuggcuuggaaaauaggauacuuuucuuuugcugcagcaucucauaugugagcauauacgguaauggaggcauuccagaguccagcugauagccaaucaggaauuggggccuuucugcauuuuucccuuuaagaaaaaguuuuggguccucucaggagcagcaaaucaacugcagucugcagaguuaccauccccucccccaccucccacccaccaucauggggacggggcguucguguuaguuaggucaaccuggguccucuuccuagggacagccccgugaaacacaaagucuuagguuuugaaaguagggugcuggggaugggagagagaggcuggcaggggcugguggcugaccagcuggggccauugcuuggggugagggugguuggagggagaaagaaggaagagagagaacuccgggaugacaugcagcuauggaugcucgcgugggugugcauauacgugugugugcgugcgugugucuccccacaggacuggaccaguagcaggcugguggaaagcaugagcagcuccauucaggaaggggaagcagcagcuguuuccccaggagacagugucugggagcagcugcaagcugggaagagccugauggcaagggagcugccgacuguaggauagacaaggagagccaggcugggugcuaccaucuggcugggcuguggggcucuagcuuguagcuggccagccucagcuuucucuccugcuugugaaaccugggccuuaacucuccuguccuucccuccuccuuagccuugacuggacucugccacucugccugcucuaucacuauggccuccgcucagcuuccaggcuugcuucucguuucucucuuuaacguuucuaauguuggugacucgccacuuccaguugcccuccuguuucuucuucacuucuccuucauuucuuaguucuccuuucguucagggcuaggcagaccugaaaggcagugggaaaaucgaacagcacacuggaaagaggccaucuguccccuguccucugggcauacuccuuggucugaguacuggauauacucagacucuucccuuaauacuuccuuuaaaugguggacucuuauccagaugaggaaacugagauuacaggagguaaaauaaaguagcucccaacucaagcacucaccaaacauucaccaagcaucuggcaaguguuggaaucagagcuugugaagguaagugugcucugucccuaaucuaugcuaccuccagaacucaugcccucagugugauccccuacucaucaguaacauuauuuaggaacuucuuagaaaugcagacucucaggccccaccucagccggcugaaucagagacacugggagugguggugcccggagaucugcauuccucccaccccugcccacaggugauucccaugcucacuaacguuugaaagcauggcccuagacaagugaccucacugggccuuccuugcuggaggacaguccucugggccacguaagcuugagcuccauuuuccagcuccaagguuccuguuucaaggaugucaccacagaaggcaguggaguauuuacccgcagcaggccuggguguaacuccccuuuucagggggagugaccugggcccuuaugacccuuugcuuggccuucugagaauaagggugaucaaucguggcucauuuuacucccuguuccuucuuucacuugaucauuuucagcauuuccuuuuuuuucccccuuuggcaaaaguuuucagaguuuuucucagacaugugguuugaagaauuucaagccuagaagacacagcgcaaggaagagaguuucuaugcucugaacacaggauaacagauaauacagcaggagagacuuggguuagaucaucaguucaguaguagaacugggaaccccgcgucagggagacccucuccgguccagggguuuguaugacguggaggcacagacaauuuggugaugggccuuugugggcaaacaguccagggaugaggcuggggcuuuaggcgacuuaca

SEQ ID NO: 14914 - RNA, 1043 nt, Homo sapiens
gcaguacauugagcuccauagagacagcgccggggcaagugagagccggacgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaaguugguuguagcgcaguuuuuuuucuugucuauaaagcauuuaaccccccuguacacaauucacucuuuuuaaagaaaaaaauugaaauguaaggcgguguaagauuuguuuuuaaacuguacagugucuuuuuuuguauaguuaacacacuaccgaaugugucuuuagauagcccuguccuggugguauuuucaauagccacuaacuuugccugguacaguauggggguuguaaauuggcauggaaauuuaaagcagguucuuguuggugcacagcacaaauuaguuauauauggggaugguag

SEQ ID NO: 14915 - RNA, 1691 nt, Homo sapiens
auucuuuaagccucuaauucuaagggacagugaugauuggaggacaacuggacaagaauaucuggagacaaaaacaccugcagaggaagaagaucccuaaguuacagaagauccaaaacaagaaccccacacuguaaggaggucuaucucuaacucacagguucuugagaggccuggacuggaggaaagcuguguugaugguugggaugagacccuuggggaggguuacaauuacaaagguuauccagcuuugugagaugcugcagaagaagugaguuuccuauuacuggaaaggcucaguuagauuaauuguuggcguaaaugauguagaggccccacaaacgccagaagguugagcaagcccucugagguuccaccugccuugugcugggacucuguaauucugucuccugucaacucugagcccaugcuggaaccccagaaggugaagacuguaccauacuucaucuccaggggccaaccaacacuuccuuuugcugcugcccaaaaucccaggccccuagaaucaggaagcagcauuuuaacugcggaccaugcugccugggaaaucucaggcucuagcuuguuccaauggucguugcugcugaaaggggcgacauauuaugugguuuucuccuccuccucccaggggaccucacacauggccaggguucacauauggccacagcacacugcagugaauccacgacuccucgagaaucaggccagagccaugauccaucaccaccucauggcagcuaccccagcaguguucuuagugucuucugggccagaugggagccaagccaaggcugcagcagccagcuaccuggcugagccuccaggcagccccacaccugggccguucuccuacacaaaagccucugugguccuauuccucccuaacccaaggcccaauauuuuuaaacugcauuccaaagaacaacucgcugagugccaccaauaccugcaaagcaauaugaggugggauuuuucuuuugccauuaaaaccagaauguuauuucuuccuugcucugauaaugucugauuaaaucaauucacugcgguuuugugcuggauaugauacuauuugcuuuaacaauaucugggaggcauuuucuuaguauaauacuucugcauuuauagcuuaauccugcuguuuuauucuaaaaaguugaauacucuuguuaccuaccuuucucuaaggaugagaaagacccaaaagauucuguugugcugccacaacagaauuagcuuuuucuacuggguggacguuguauacucuacuccuuuccuccuuuuuaaaucuuucauuaaggcucaccuuuuuaugggaaaucucucuggaaucccugaaagccaacuggaagccauucagucuuuccagugcaauaacuuaauacauauuuuuuucuguuaacuuuauaugacuaugggccaagcaagugcuaaguauucuggacuaaaaggugaagagacuuaucucugcacuggugacccuuaucuuccaggaagaguugguuaaaugacuaacucuaauauacuaacuguuauaauagauuuagguaccaucgggggucuuaugcauugguucucauagguuaaauauauauauauaauauaaucaauggcuuacagucagguaggcccugcaagaaguaucuacugauauggaccgggagacccuggag

SEQ ID NO: 14916 - RNA, 2470 nt, Homo sapiens
uucagacccacaccuugcugugugaccuggacaaguucagcaaccuuucugagccauccuuccgugaucuguaaaauggggguaaccauguaacuaaugccuggggcugcuguggggauuggugggugugcuccacgggaagcacacagcacagcacccgguccgcaguggguacuuggccuguggucacucuccugaugauaccaggcucccucucccgucugcgaggcccuaggcagaaagaagcacagcacaggagacaguucucauacuugccugcaggguuuccaucccuggagacgaaagcccuucccucuguaaaugacagcuguguuggaaauaaauggauaccuggaagauccaagaaauggaaaccacucuucucuugcugugugauuuuaaaaugucacuuaaccaugauaguuuuuuuuuuccuguggaauaacuugagugguccuuaaccccacuuuauugagacuugagguugagagguacgcugggauaaacauggguuuuuguuucuccauaggugaauaagccacagaguagauugugucugguaagaugaggacucuggcuggcuucuccagcaaccuggcccccugcuuuaaggacuauggucugucgccaucacugcguaugucugagcagcccguuaauuugaauauauuuuguagucaagaauugauagacagguagaaauuuuauuugcauguaaaaauacauaauacauacaaugagucaaagaacaauuuuuuuucaauaaucugcgauuugugucauucauguauugacauggaucauugagagcuaugggguuaugcugacuuacagcccaguagccuguauugcugagaaauucauugacuuccccaucaagcucugccuccugacaagugaugaggaaaucgagugaugacuacuuauaauggcugcuuggcuacuacuauugaggcugcuggagccaaauggggcucuuaaaaaauggcaccucuuucgaccucuggaaaagcuaaacuagagcccagugcuggaaugaacacaguaauuaacauuacuuacaggccuccuuuguaaaccccugaacugauggcaggcugacuucccuucccaucaguuuuacagugggaaggagggggcguucugcucuucagccuuuauuuuggccaucagaguugaauuuugauuugagaugccucugaccagucuuugcugucauuuggaggugguuagcaucauaauccacaucaugaaugaaauggcaaacagaaggaggaugcgggguuugucucaggcaaaucucuuaaagaggaggaaacaggcccagaaaaguuaaaugacuuuccuaaggccaccuggcugcuaaaugacagagcugggacuaguagugcacaggcacgcugaccccugcugucaugcucuuucuccuucuuacucugugucucugucugcuaugguuaaauacggucuuuuaggacgagcugaagaaaaggaaacucaccuguguuaacaauacuaugucccaggaacugugccagaugcuucaucugcauuggcucauuuuguccucacaaccccuuagccaggcagugaucaccauuaagcuguuuguacacagauggagagguuaacuuacuguucuguaagaccacaaagcucuuucuccuaggcucuguuaaacgccuccuucaucucacuuacuuccucucucagccucccucacacuuugaagcacgcuuugauaggcuccauugggagguuuuaaauggcaaggcuuccuuagguugagggcaauggguaagucacuuauuacaggcaagucugaauacagaaaauguugguuuaaaagggagucaaacaagaccuucuggggaguggggagugugguuucugagggagugggcuucuacuaggcacugguaugggcagggguggcaggcugcuaucaauccaggcucuccugcaggcacaaccucuggaaggaaaggaaagagagggugcaccucaggccugaguguccuuugugguaguucuaccuaagagacagguaacugaugccaauuaagaaaaucuuaaguuuuucggaucacaguacuucuugguaacaugaaauccaugcucuguugcccagcaauuggaagugaucuguucucuguaaagaccucucggaaagaaugccccaggucucagcaucucucaugagccuuuccccaggcauuggaagacucuugcuauagaaacacauuuaaaacaggauuacgucuuuuauuucauggaucuuccuccucaagugcgugauccagggcgauguuggguaggaaagggaaagauaauuagauuugcaccuucugauuguuccagcuacagucuuagaaauuacaauuucaugaggaacuggcaauggauauuaagguaauaucacuuugggggaaacuaucauaugaaaauaaaagcuucuguucauaagggu

SEQ ID NO: 14917 - RNA, 1114 nt, Homo sapiens
ugggaagagaggacaucuguccagucucaaucaggacagaccaccgugcgacacccaggaggcucucggauggggcgcgccugcgcccucagaacgugugggaaggagggggcguggacaggacacgggaccuugccaggccuggugucugaggacaggagccugggagaggcggguggagcgugaagcaggcuggaggugccccugcacgggagguggcguuugcuaaccaaucgagcuggaaaugccagggcaggggggccccacggugcuguggcagagcuagagggguccuuagacuuuucacugaugagcaguuguugguuuuuucuuucucccuuccucccgcucucugcuggcacgcgaggcuuccccuuccaccccauguggguauucccacaacagguucugcacaccccaguuauuucacagacauuccugcuagaaacugucagacaaauaccucucuaguucggaugcugcucacuuucccccuugcuucuggaaggggaagcaguccuuagguuuugcugugcugggacaguggcaggggacccacaggggugaggacccacgguccuccccgccagccuugcucagcuguggguugcccugcugggaaggagggaaucacguccaccugggucccaagaucuucgccuccuucccuggggccacggacaucagcaguggguuggguggcgauuauaucaucugugaucccaaggagaagaaauacagaaaacccaagagaggucagacuggcucuuguuaccggagccacgggaagaaagcagccggagucacgcacgugcagagcugggcaugggagagaaacgggcuggggagugaggccaggagugggauucagcugcagcagggcgcccccuccaaacugcagcuggucuggcuuacuguuuugccguucaaaaaggucgcgaauccgugggacugagcacggggaccucacccgcuagccagcgucugcugcacuugaucagguggggccuuggugggcggcugccuuuccuauacaguuugucuugucacccugguuucccacuggggccaggucucuucuccagccuccaccugccugucugauccaagagcu

SEQ ID NO: 14918 - RNA, 652 nt, Homo sapiens
uuucuuuucuuuucuuuuuuuuugcauccaaaaucauuuuaauaagagaguaggauccaggguuaguuuuuguagccucagcuggcccgucagccucuggcgcgcucgaacuuccggcccuuggaguggacguaggguuugguguggcugugcgggguucccggggccuugccaaaaugcccguacaccuuucggcccuugagaggaccggagagcaggacggugcugcagcccuugcgggaguccacggccagcuggucgaaaagugaggaucuugcccccugcccugaggacgcggcugcgggccagguuggucacacucagcacacacaccuucaguuugggcaccuccugaacccgcacgucaucuguuaugcuccccacaaucacggccguuuuguuuucccggacaggaagcuucacucuucuggaucaucugggaaagggacagagguggccgguugguacgacucauaaacaaccucuucagcacaaccugguugaauguggagucgguucgucuggccagaaaacugcacagcuugaccaacagccucagguagauauccuggcucuugggcuccuugcgccgaaccuuucgguccuuguuguggcagaugucagcucccaugauggcgucuccugcucggcc

SEQ ID NO: 14919 - RNA, 11796 nt, Homo sapiens
cuugguuuucuuaucuguaaauaggguuauuaaaguuauaccuucuuuguaggaugguugcaaggauucaguuucacucaugugaugcugucaguacagugcuaggcuuacuccauaaaugcuugaguuagugauuauuguuggcugcaggcguaagaaucuacuacuuuugaaauaccaagaggacccagacacaaaccacaaacacagggcugugaugugagguaagcccaguaagaaagcaguuacacagggacuuuuuuaaaaaagagauggucucacucucuugcccaggcuggcgugcaguggcacagucacaguucucugcauccuuggugucuugggcucaagggauacucacacugggagacuuguacaccccaauuuuaauccuggcuccagcaucagcuguguuguaugacuuggugaaaauuuucacacagaaauacaucuuccaccauuauacauuucuucuggaaggaacuauacaggcauguggcuaagcagacaaccacaucgcuguugggaaaggacuggagagcucacaguaggagagagggaugagggcagacacgggcucuggccuggagccaggauuaucuggaggcagcucagcaugacuggcuugugcugccuggcuucucccagggccccaucaugccauaggaguuaagggucaaagcauaguuagaaaaaaagcacaagccuuuuccuguuaaggcugagaaggaagcuggacgugaacacucugcuuuacucuuaaccuuaaucauguaaguuaucugacaggaggaggucagugacaccaggaguuuuaccuuguuaacaaaccaaaaugcagauaccucugccagaucagagguaggcagaagaccaauuccaacuucaaaaugaacaugcauggugucccagucuucuagaucuuuauacuuucgucuuccuaagugucagggaagaaaaccagaggcacuaaaacugccagguugcuggagggagggagugcugggaaccuugggcgaagccauagacacaaaucccagcggcagccugugcagugcucaggaagccaugcaugguggggcugcuuccugcccaacuauggcaucuacaugagaugcucacuuauuuaagcucaacuggaacuaagugggugaccccuugauugugcuacuacccauuauguacccacccauacccaccacuccaaggcugaacagaaaggguugucugacacccagguuuuauuguuuccacuuuauugcucaagcauggaacuugaggcaagccuggaccuucagcaacgugcagagaagaggcugaggggauuuugggacacaaccuggccgagaggggaaacugacaggggaaauaccagaacagggaacaggggguggucaccaugacaccagaagacaucaucagccacaccgucgggggugaggaagggaacagagagaagaaauggcauagcagugguuuuucccaugucccuagcacccacauggaggccacauuuggaaauggacugggagagggaaaggaugaggaaaacggcugcccaggagucucccucuccacccuggguucuuaucagaccucaucccuaccacuugccucuucuacccuuagaaaauggaccuaacagagggagcaaaauaaauuaacauucugaugaauauauauggauggacauauguucaugugcaauggaggaagggaagaggggcugacaccagcuaaaaugauuccccaccucaaucccccagccuacaccuuucccccuuccccuaaagccaccauccaaccagauagaaaaauaaaggucuaauucacucaaaauucuucaguuuuuacaaaacuaacaggguggaguggggagacuggggggcaggcagccgcaggaguagggcugguggagaggggcuaugcuucugucuccaccugagacuggcucccugccguguugcucuucugcuccuccuucaucucugugucagugggauggucuccugaggaagccucugccuuggccugcaaggaagaugaacagcaaacgggcugacuucccaagugaaaaaacacacacuuaauuuccagcagaauuacacagauacacccauucuccuacaucuguccuaaagcuauaccuguauaggccaagccugguggcuuaugccuguaaucccagcacuuugggaggcugagguggucagauugcuugagcccagaaguuugagaucagccugggcaacauggugaaaccucaucucaacaaaaauuacaaaaauuaccugggcgugguggcaugcaccuguagucccagcuacucgggaggcugagacaagaggaucacuugagcccuggaggcagagguuacagugaacugagacugugccacugcacuccagccugggcggcagggcaagagacacugucucaaacaaaacaaaacagaacacuuguauauguacaaauuaugaacucaugagguuauucacugcaaugcuguucuaagcagcacugucccguaugguagccacuacuguaaguggcuaguucaaacucguguuuuuagugcaaaauauacauuggauuuugaagaugguuugaaaaauacacaaaugcaacuaaaauuuaauuccauuuguuuuucaccuuuuuaacaugguuaccagaaaauuuugaauuacaugugguugauacuguauuucuacuggacagugcugguuuagaacacuguuuaagacuggcugggugugguggcucacaccuguaaucccaccacuuugggaggcaggggugggcagaucacuaaagucaggaguucgagagccuggucaacaugaugaaacuucgucuguacuaaaaauacaaaaauuagccgggugugguggcgggcgccuguaaucccagcuacucgggaggccgaggcaggagaaucgcuugaacccaggagguggaguuugcagugagccaagaucaugccauugcacuccagccugggcaacaagaacgaaacucugucucagaaaaagaaaaaaaauaaaaccacuggaagacuaaaaagggacugauugacuaagacaagccauauccauacaauggaauacaauguaagccuaagaaagaauguaaaaguucuuuaaauacggauguaaaauaagccuccagcuacuauuacgugaaaaaagcauaguaugcgccaaaucauagguggagcacguugccuguguuaggggaaagggaggaagcaacaggaacgucugccugugccuugacgcaauacacuggaccauccaagacccugaaggggcagcugcuucuggugggggaggcagacuugacuguauacuuugguacaguuugaauuuaacuaaguguauuauuuauuuaaucacacacaaaaagcaucucgcuuuucuuuuuuugagaugggguuucauuuugucacucaggcuggggugcaguggugccauccuaagucacugaggucucuaccuacuggguucaagugauccucccacuuuggcucugcaaagugcugggauugcaggugugagccacggcgccuggcccacaagaaaacauaaaucgggaauuacacucagggcaaccaacccaacuucuggggcuuguggguagguuucccgcacugaucacagaacacuggccccaacagcaggaacacgugcuccuuaaugcuccagggaaaaggcaacuucugguuuccgggauuggcacagacaaccaaaggcacaaagagcccacaguagccagguuaaguggagggaugcuauuccaacuguuccccaccccaauccucaccuuguucuccuccucagccagccucucaaacauauuggcauagagcuucuucucccgggcaagcugccuucggauccgcugcuggcacacagccagcugggucuuggcggcuuuguuguugggguagagcugcaggaccuucuggaaaucagcccgugccaguucaaagucauucacggccaggugggccucuccccggcggaagaggcccuucucguuguugcuguccaguucuagggccuaaagaaugcagagaggaagccacauugugggagcucagggcuuguagcucaucuggccuagacuggguuccaaagguaccccucaggaggaugaggaggaaugcaaguggcuggcugcaccccaggaagaacaaggccugaggcauuaaauggaacaauccagggaccucauuuaauccaacaggcagagagggaagacagcaggucuuuggaugaaauaaagacuucagacauuaacauucacuuuagaauaaagcaaguagguaagcggagaggcuaagaaccaagguggaagaaaacucuuuaugugauucuucccauuccguguccuccuccuucuugccaacugcuucccaccaaagcuaagguucuugcuaugaauacuugcauccgugccuuuggucuguaaccucagagcucccacugauccacccugcuaucccugcccuagucaccaaggggaaguuucagacaugcuggcagcucacccaacucugccugugaaugcugcuuccaugaccucugagggggccucaccuuguuacagcuuucaauggcagcagagaaggccuguaguuucagaugacacauggccagguugaggugagaggccagucgaagggccugugcuuucugugcuuccucauuggaaaaacuagacucauauuccagccaagacacgaucuucuuauacuguaguaaagcuugcuuguauuuaccuuccuggaaugggagagaggcucaggcaccuggcacaguuucagugguacuaggcucuuauacccugcagacaucagugacacauggccacaagagguuccugcucccacccuucccacuggcaaggccagcaagcucacauauaugaagugaagauggcaggugccaaccuguccacuucuuggcagaaaaugaucucagucaccaagggaaggggaggcucagagcaacucuuccugggaguguccuuaggacaaugacuguuggcucaccuugaaguacacagugccccgcucuuucacuauggugcucuguuccagcuucucuucugaauucaucucccaagacuccuuggccugccacaccccaggagagaaacaaaguugucagcuaccccagagucacguacaggguggaacuugacuuuagaugggaagacccugagcaaacuuaccuuuucaaaacucuugagguguaauucauauuucagcucagcauuuggugggauuuggaacuuuuccuucccaacacugccaaaagcauagcuggaggggugaaaaacacuauguaucaucuuggcaacacuuaaccugcuccaggcugaaaaggcuuccuguccauuuccuggaaaguaccuucccaucccuugagacuugguucaaauguuuggcaaaucuucccuggccucuucacacugucagauggucccucagcauccuucauacccuucuaauaacuuacagccaggcagcagugugauuacuaauuuaaauagcaccucacuaaacaaugagcuagaauuagaaggcagaaacaauguucuauuagucucugaagcccuauaggaauuuucagcagugccuggcauguaguagcuguuucaguaaugacugaaaugaauuaaugggagaggaaaaucuugauggcagaggagagaaucuguagcaacuaugacugaaaagacugggcuuagauccaaggagauguagacaauugggccauacuucuaaguacacugaggauaucauaaugguguauguuugguguggccagaguuaaaaaggauacaaacagcugguucuacaauucauuuuauaucuuugaucuugguuugccugccugccuacccuacgaagugcccaccccucaccugggcuugagguacacgauggaauguucuccuuucuccaugcgcugaauggcccucuccagaccauaaggcagauccagguucucccccucgccaaucucaaagcggagcucccgcuggucaaagagcuuguccuuguaguacccuuccagugcaacuggcaugaaagagaggcaguguaccagaguuguaagagggcaggugacugaggaaggaugccaucagccucccugcaucacccccaucaucccaagauucuccuguguucucaaaucuggagugauaugaagagaauaugguccaaccccucauuuuauggacaagaagauaggcucggagaacggaagugucuugcccaaagccacacaaggccuaaauaucagaaugagaauugaaagcccagacuguacugucucacccuccacgauagcacccucauugggcuuagcauagccuucaccgcgagucuguauucugcgaaugauuccgccaucuuccucuuccgucagaucuucucccuuaaacucaaacaacuccaccugugggacaagaugugacacaauuccuucccaugcuaacucaugggcagugaaacacaaucuuucucauccgagagagucccuacuaacugccaggccggaucugaccacaagggcagucacaaggaguuggguagaguggcacuuuuuuucaguucuugggagcugcccuaaucucaacuuugguagaggugggcagacuacauagauuucaguuaagcugaggagagcaaucuauuugcuaccugcucuacuaacacggacauaucaggacgcgucccagauaauccuaauucacacuaccugauaagcccaaccugguagguauuagaaaugauuacccaacaucucucagcaguuucucaguauucaagggcccacggauuggcucaaccauuuucagauugaacaaugucaaguucuaucuccucagugaagccuuuucucagcccuugacccacaggggagcuacugcucccucuucuggucucuagagcaccaauauucuguacugccauuuauaacgggacauaguuucugacaucccgacuccuuucaguauucuucuggguaccgcucuggagauaaagaugccuuaacccugaccaugcuuugagucuggagaggggcuugugccugccucuucccacccgaagcuucuauuacuuccauuacuagcagcagcagagcccucugcauuucuccucccauaaggccagacccucagccuuggcuacauugucuccaagaagcaggaagggcuggagggcagccaggcauugggcugagauaaggccuggcucuuagccuggaucucagugaccaaacacucaccucaaauacaagcguggcauuggggggaaucuuuggaggacugccugcugaaccguaggcauauucugguuugcaggugauguggcacaccucccccaccuucaugguggcuauggcaaugucccaagccuugaugaccuccccugcagguacagaagcaaacaggaccgccuuagcaggguucugauucugggcucaaacagugcuccugaagaguuacugcaccacacucauggggaagcuggacauccuuuagaaaugggaccagaaggugagguaccugguuguauuaagugcuaccaggucuaagaacuguaaaagaucacgugacccugaacaaaagaguuuaagaugcaagacaguccaccuuugaagggggaguaagguguugggaggugaugaggagaaggggagacagagaucaauauaguuacagaacgguagaaaaaaaaaaaaaagagugaccgaaagaguuaacagacugugauaaaccauuccucccugagcuugguccugagaaaaugguuucugcuugugacagcuuguguccaccucgaaccuauccuaccagcccacugaccacgccuaccuuuucccaggucaaaggagaauuuguccuugcgauccagacuggagucaaacuuugugccaucuaauagccagccaguguaguggacaaagacucgguccccaaucaugggcaucucuguaccugugcccucucucuugaugaccugggaggaagggggagaaagugaguaccccaggguuuggggcagaaaggggcaccagcacugccugcaagccuccagagggaacauaaagggacuucucuguguucauccuccucugccuacuugucccuccagauucaguuacuagcagcuuggcuuaugagucaacuaaccuucuugucuuucuugaggugcagcaagacuugguuugaaaaaggagacaaaaggcugagagaucugaguucaaguuuccgcuguaugguaaguuuuuaaaauucuccacacuuuauuuguaaagcagugaugauaaucccuaucuccuacaguuguuggaagauuagaccaguaaaagguugaauaauagauuauuauuauaaucggcaaagggggaaguauuuaugccacacuuccuccuucuuccuucaugccaguggucgucagacuaaggucugguuuggagacaggagagcgagaggaguaugagugaagagaauagaaacaguucaaaacagguaaggaagaaaccagguuauaggugaacccggaggcucuccaugggaccuuaaacucugacuugggagcugaguauuccucugguaguuaguccagggcuggaguauuucccagaaacguaaaggcuucuuuagcgccaccugguaggugugugguuacccuccaagggaaagcuuccacgaagaauagacaggggcuuugaggaguagaaagguaaaagggaaggaaugauggaucaaaggggaaaugagcuuuccuggaauaacaaucucguagaaaacggcaggacgcuggagcgagaaggggaagucacaugccacaggagagccgcuggagcagacgcuugagguccccaauaaucuggugcaaagacagaugcacuucuggaccagguaaaggcccccugaggugggugccgcacacgcggagcucagcggugggaagccaggaugaggacgcagcagcggauggggagaaggcauaagacgcaggcugggaauucaccaucucugauucucccuggaaccugcuccgacccaaggcagguuguccuggcccaggucaagaugcccuccccgcagcuccccaggcuauuuguagucgagcggucacucggcggcaggcuccacagcagagcgccuccuccccgccccacaccccgcagcccuggcuccgggaggcggcggaggggggaggggacuacagcucccggcaugccccgcgcccggccuccccggggccgagggagggggcgccgcgcggcgaguggggaccucgcugggucccggcgucggcaggggaccccgggagggcgccggaacccugucgcgccugcgucgcacaaaggccgaagggccaggaaagcacuguggggagucgcuccccguccuggcccguguuccaccgcccgggugggcgagcccuggcaccgccaccaacgaggcggcccgcggcuggcagcuccgcuggggccgcgaggucgggggcggcguggcgugggaggcccggccuggccccgggcugcggcucgggugcccgcggcggucgccucgccccgccccucuccgccgccccgcgcgcgccggggugggcacugcaaucccgacccccugcccgggcccgggcgcugccggcuggggagccuggggccucggcccgcgcaccuaggccgccccccugccgagcgcauggccggccucggugccuuaaacgacgcagcccgguccgggacggcgaugccaccggcccccggcgggacggccgcgaggcugcaaaggcggccgccucgacccgugcccggccgcgggcuccgggcgcggcggaagggcggcccgcggggccccggguuccgacgccuccgcaggccccgccgccccucaccuucagcacgccuucguccuguuuggggcugauguccacucccuccaugggcagcggcgccgacugcgccccgcucucggucgccuucaucuccucggcugucaucuccgcgcggcgcgccguuuauccgggagcuggugccggcgcgagcgcacucugggccgcgggcgggggcgcuaccugcggggcgugcgggaggccgggcgcggcggcacugacugcggaccgcgaggaggcuugagcaccucugcacgcggcgcgagagcugggguaggugggucaggagcggcucggggagcgauuggucccgccccgccgcgagggaggggcugggaggagcgggagcgcagacagagggggcggggugcagaacuuucuagagacggcgggacugagccgguucgggcucagugcugcgggcgcuucggaauuuuuuuuucuuuuuuuuuuuuugguucuugccuccuucuggcugccugcccccucccccuucuccugggacccucggacucgggaucuccccggcggccucccuuggcccuuccucccucccucccauccccgcccgcuucccugucuaaccggauucuuccagauucuucucgaucgaucucccgacaucacuccaccaguccgcugcgccugcggcgggguguggggagcgcaggcugcgggauggcaguggcggcgcccccuccccgggaccggccgucaccacgggcggcguggccucucugcuaugacccgcguagacccuucccuacuugggggaaagagggcaagggcgugcgcggggagcggggagugaguggacagcgcugccccgcugcagagagccggggaaagcgaccucgauuuccccagauccgagaagccccggccaggcagcgaugccucgcucagcgccugcagaugcugcgagcagcgggguuggcaaggcauggcccgcccagcucggaacucagauggggcacacacucaggggacccuucccggcgguaauaaaacugccguuuccgcgaaugcuuacaaagauggguuccccucacgaaaaaagucacucgguuuuccuaaaggcccacagaaggaguauuuucuucucaauguuugcuucccgaguguuuuucgacaggcuguggagcgcgcaggugccggugucaccuaagcuauggucgugggaccuagagagccaucuagagaggggccugguuuugcucagcaccuaaccccaguuuagcauagugccuggugagugaugucccaauaguuacuggcugcaugaauuuuccuuuuuuaaauuucuuuuuccaagucuuggcugauuuuuuuuucuuuuuuuuuuuuuuuugagacagggucuugcucugucgcccaggcugcagugcgguggugcgaucuuggcucucuguagccgggacuacaggcguccgccaccacgccgacuaauuuuuguauuuuuaguagagacgggguuucgccauguugcccaggcuggucucgaacaucuggucucaaaugauccgcccgccucggccucccaaaguucucggauuacaggcgugagccacugcgcccagccugaauuuuuauuccaauaauaacuguauuuuuggacuucccguuaugugcccggcacugugcgauuggacgccauuagucucaucaaacuaaauugaaagcuuuuuagagaugaacuuucagcgucauaaugugaugauuuauuguagucccugccgacggaacuugaaagggaugcagaagaaaaagcccuucgcuucagcaauuuacagcccaaaugaguugagccauaaugaagacgucucuuuagguggcuggagacagcuucagaggauacgggg

SEQ ID NO: 14920 - RNA, 735 nt, Homo sapiens
uuuuccacauacaaaaaaacuuuauuuacacagucuuggauucugaaucuccaguacuuccagggucucuugaucaaauggggcagcagcaggcagggaagcaaacacaggggccaguccagauuaucuuacucaagaacaccaccaagaagggaaggccuaauucagucuuggucuggacuacaucuccccgcacuuugagaucaccacaguaguuugggcuuauuguuggggccugugggaacauucugaaucuuucucaucacuagaaguccaucagugauuuuuccaaacauuacaugcuucccauccagccaaucacacuuagagcaggugauaaagaacugacagccauuuguacugggaccgcuguuugccguggaaagcaggccuggagcugagugucuaaguuuaaaauuuucgucugcgaaugucuccugguaaauacuggcgacuccaguaccaucuccauuaacaaaaucuccacccuaaaucaugaaauccuuuaugacccuguggaaagugcuuccuuuguauccuauuggaaccccaucuuuucugaauucucuagugcagaacuacccaaaguucucggucgucuuaggcacaacgucugcagagagcucgaucuuugugcggccaacuuccugacugccauugcugacaucaaagaacaccaugggguuagcagggcuugaaguugccaccaccauggcucugacccggaaacggaag

SEQ ID NO: 14921 - RNA, 735 nt, Homo sapiens
cuuccguuuccgggucagagccauggugguggcaacuucaagcccugcuaaccccaugguguucuuugaugucagcaauggcagucaggaaguuggccgcacaaagaucgagcucucugcagacguugugccuaagacgaccgagaacuuuggguaguucugcacuagagaauucagaaaagaugggguuccaauaggauacaaaggaagcacuuuccacagggucauaaaggauuucaugauuuaggguggagauuuuguuaauggagaugguacuggagucgccaguauuuaccaggagacauucgcagacgaaaauuuuaaacuuagacacucagcuccaggccugcuuuccacggcaaacagcggucccaguacaaauggcugucaguucuuuaucaccugcucuaagugugauuggcuggaugggaagcauguaauguuuggaaaaaucacugauggacuucuagugaugagaaagauucagaauguucccacaggccccaacaauaagcccaaacuacuguggugaucucaaagugcggggagauguaguccagaccaagacugaauuaggccuucccuucuuggugguguucuugaguaagauaaucuggacuggccccuguguuugcuucccugccugcugcugccccauuugaucaagagacccuggaaguacuggagauucagaauccaagacuguguaaauaaaguuuuuuuguauguggaaaa

SEQ ID NO: 14922 - RNA, 546 nt, Homo sapiens
uccuccaguaauucaccaaaaugacaaacacagagggaaagaagagaggcacccgauguguguucucuaggccuuuuaaaaacauagagcuguuucuuuggccacaugcauaggaaucgauaagaaaggugauauuacagacaucaagggaauggauacuguuuaaaaaggaauguccugcaaguauuuccauggcaaaacuggaagagucuacaauguuacccagcaugccauucauuggcauugcuauaaacaaacaagcuaagggcaagauucuugccaagggaauuaauguguguauugagcacauuaagcacuguaagaccugggauagcuuccugaaaugcgugaagaaaaugauaagaaaaagaaggacgccaaagagaaagguaccuggguucaagugaaguaccagccugcuccaccuagagaagcacacuuugagagcuaguggaauggagccuagccugcuggaaccuauucccuauggauucauggcauaauaggguaaugaauaaauaacgucugggcugugaaagaaagaaa

SEQ ID NO: 14923 - RNA, 30098 nt, Homo sapiens
ugguuuucuaccuuuaauuggggauacaaaaggcaccucucccaguacaagaggaucaaccaagaggugagccccagugcuguggugcccggccagaaggaacagaggaaggauggagggcaaggcagcggaggggcaguggggccccagcauccccugaagccucaccugcagccuggggcugaugagaucucgcccacugcgcgcagaguugcagcuucguaccugggccgccgcagcuccucagggggccuccacaccuccacacccuacccucaguggccagccaaagccauggggccccaugcagcagagcagggaagggacaagaggcucggcagaauuuccacuguggccagccuccagccaggccucgacuggcagugugggcucugaagggcuccuuggggcaugggcccggagcaggguaucacucagugaaggagagucacacugggucaagcagccagccagccagccagccuguccuggggccuccacuucucagcaaagucucauggucagcuggggugggaaaggaggcagagcagccagaucccacugcagcgcagaccugucccccaguucaucccacugccuccacacccccagccacagcuggggcagcuccgucuucaaagaggaggaaaaggggguaacaagccacccccaaagcagccuuaacaccagaggagggagggaggucccagccuaagggugugagagcaguggggaccugggcugcagggugccagaccccacacucauaaggcaaacagcaugucaucaucuuucuccugggucuucuuccggggcgcugggccagaugggggacccgggggccccucagcugaggggcuggagagguugggcaaucgguccgcggcuuuggcccguucuuccaggaauuugucaaauucuagaggaaggggagagggugaggguaggcccugaggccagagcccuggggaaaggagagggcgggcaggggcggggacuacuaccuucgcuggugacccccuuaggcucuuccgcaucauuacccugggaagguagaaggaaaggaggcagagguuagccgggcccccaguacggucagccuggggcaguggugcugcagcucgggccccgcugaaccucagcacugggucccagcucaggcucugcacgcccccaccacccaggucccaggaccuggaccugggcuccucccugagccguaggaccuuccuuggguggcaccugacuuccugagccuuguguuuuccuucuguaaaaugggggcggggugggggcugaagcuaacuuggaggguugcugggaagcugaaaugggauaacacacagcacgccaagcccagcaccuggugcccagugggaccuugaugagugcugguuccuuuccuuggagggucacaaggggugggugguccucaccccugggggggaaaggcugacauccagaggcugagggccauucaugcuaacacugcaaacuagggagggggugaggcuucugccaccagacagaaagccugaguccuuggucuguggcuuaguccugggcagaaauggucucuucaccugcagaaggcggcuucugggccugaagugcccaugugggccuuggugcccagagacgggguggcagaugcugcgguaggagcccuggacggagaagcugagucuggcccugccccuucugcucccugggaggguggcagggcuugggguccccaugacuggcacccgcccuccuccuccugggugcuuccccuuagaggacagcugcuuaucggucuucugaucuguaaacaggguggugauggguucccucugcaaguggcuggagucuucugagcuacugcagguaagagccuggcgcuguuaugcuuccucgguuagccucucuagccuggccugaugucccuaaggugggcugacacccacugggaccucaccuugggagcaggcucugggaagcagccgagaggcuacugugcccaggacuucucuggggggcgugccaaacacaaggugggcagguggcaggagauggggacuuuaagugugccccucugcucucagggugcuauaugcuauauaagucuacccuggccccaugggucauuucuuggugagaacaacggguccuccugcugugugggugaggagugggccccaacauaccacgucaguggacagccacugcucgauguccuccaugaggcaggccugggugacugggaucuggaaggaagggcagaggguaaggcagugcccuaggugacaagguggaagacgugccagcucagcacccugcagcuggguggcccugggcagccucccaccccagccucagcugccuagcugcccggacccaccacugggcccgcugugccaggcugugggugauggaggugcagagccaggagacuaagcaggggaccaggcucccagcagcuggagcagggccaggggucagagggagcuccuuccccuugaagagaagaaccccaguuccgacacacccuucggguaggauucuaggcuggaggaggggcuuugggcaauggccuggggcaggggcuaugcugcaggugcucaggagcaucugacaaaagacacgccaagcccagggucagaccccaggcauuuucuccagccgugaaggcugggauggggacaugguuagugggccagggguccccagguuccauccccuggugucucugcagacgcagauuucaugauagaagggggcauagcagggccugagagcagaggcgcgaaguuaaccagacaaggccagguggguagacccagaggggcggugcuacagauggggacauuucacuuucggccacaaagacaugggcugugccacgauggcucccacacaggggcaggaguuggaggcuuuccucucuaacggcuucugcaggggcagacuccaguuggaggucaugggcacagacuucagagugagaaagagcuggaccuagcucaccccuuaacacagugugacucugaguggguuacuuaacuucucugcgccugauuucccucguccuuagggugaggcuagcagcaguacuuaccguccagguggcugugaggaugaaaugggaugucaaaagcuuagcacagggccuggcauggaggagaugcucaagaaaccaauaggccaguuccuauuuacuauuaaucaguaauggcacuaauagcacuaguuacuagugagcuacuuuggaaaagacagacagagucuuuccccaaccaggccaguuugguuuccaagcucugucacccagcaccugaggaccccccaggcaggagcagagcccagagagaaggcaggagccgacuucccagcagcaguggcaacagcaagugcccagcugugcacaccggcuccgucucccgcuccgcuauccccaucgccucuuagcugccagacgggcuaccuuguccuugcccgagacucaagagcaggaaccgggcacagaggagcugcggaagcugggcuggccgggccaacccggaaacagccugagcccuggggucccgcaagacccucagcugccccuccuugcuccucugggccuucuccugggucccacucccuuggagagcagcacggugccccacgcccaugccuggcaggagcccugcgagcacccccagcuuuccggguggccgggccuggccccugcucaccaugccuugucucaccauccagucacugaggcuuuucccgcagccgccucccaucugggugagagagagucacgcugauggcggagggacggcagcgccagggccacuggagggcgcggcuucuaacaggggugcgccuuucgggucaggaggccugcugccacuuugggaggcguguguguguagggguguguguagguguguaaggguguguauguagguguaugaguguagguguguguguagguguaugaguguagguuuguauguguagguguagguuguguagguauagauguaugugguguguguaggugguguguguagaugugugugguguguguaggggugugugugcagguguguagguguaugaguguguaggggugguauaugcagggguguguauguagguguaugaauguagguguguauguguagguguagguguggguagguguaggugugugguguguguagguguguauguguagguguagggguguguguguaggugugguggguguagaugugugugugguguguguguagguguaugaguguguaggugugguguguguaaggguguguguagguguaugaguauaggugugguguguguagguguggguguagaugugugugugguguguguagggguguguguagguguaugaguguaggugugguguguguaggugugugugguggguguagaugugugugugguguguguagguguaugaguguguaggugugauguguguagggguguguguagguguaugaauguguguguguaggugugugugguggguguagauaugugugugugguguguguagggcuguguguguagguuuaugaguggagguguguguggaggugugugguggguguagaugugugugguguguguguggggguguguagguguauggguguguaggugugguguguagggcuguguguguagguguaugaguggagguguguggaggugugugugguggguguagaugugugugugguguguguagggguguguguguaggcguaugaguggaggugugguguguguaggugugguguguggaggugugugugguggguguagauguguguguguggugugugugggugugugugguguauggguguguaggugugguguguguagggcuguguguagguguaugaguggaggugugguguguggaggugugugugguggguguagaugugugugugguguggggguguguagguguaugaguguguaggugugguguguguagggguguguguagguguaugaguggagguaugacguguggaggugugugugguggguguagaugugugugugguguguguagggguguguguaggugcaugaguguguaggugugguguguguguaggggugucuguguagguguaugaguguagguguguguggaggugugugugguggguguagaugugugugugguguguguguaggucuauggguggaggugugguguguggaggugugugugguggauguggcggcugguguagagggaugaggcagguauugugguacccaccggggggugagccacaacagcucugggaugccagcgcccuggguaggcugaggcagagcugacagcaaacuaaacaaagcuucucaacucucuccacaaggaucccagaggcugggccucagcaaccccaggauagcagggcaggcggcugucagauggucugggggcucccaguagggucugacaggcacccagguuuuagaaacaucaguuuauccaaccuucucacauucauccauggcacacaugcaguuuccuagggccccagaguggagggagacgagaguccugcucccagcccgucacccugugccuggcugguucacccuacucagaccagcauggggccuggcacauggcacagggcacacagcaggcaugucagggagugaaggaacuaaaaccuggcacacagcaugcaauaccaccucgucacacgacuugugaguccugcucugaaucccagggcgcaaaccugggcugcgcacaauuggcacuugauucuguuucuuuuuuuuugagauacagucuuacuauguugcccaggcuggagugcagugguacagucauagcucacgauaaccucaaacuccuggguuuaagugauccucccgcuucagccucccaaguagcuggcacuacagguaccugccaccgcgccugguuuugaugcuguuuuguacucugcucuugggaaucauguucucacgguuuagugggugaaggccuuaccaccagccaaacuccagcaccccaggagcaggcauuugcucacagaguuuuaagaaaucauacccugauuuggcagaaguggcuuaaaucucccagguuaucggagauaaaucagugauaaccgguuuaucagcuucucuuugcugccaguggaguuguguggugcguuuccucccugugggcgggcugcaagguagugugggagccaggacaccugggcucuaguuuuagucacgccugaauugcugugugccccuagggaagugaacccugucucugggcugcagcaggagcagauuggcugggauugcugcccacugggugguggagucaaccucugaccacgagaggccagguggccugagaggggagcuccuacagcaggcucgcgguguguugguuccgaugaaucccgacacacuggaagccugaggcugaggagggagacacacaccuccacucacucuccuuugcaccuuagggcuuuucacagcucuaagguuaccagcauggcuuagaagccaggcagaacaauaccuacgagacccuaggcaggguaucucccuguccucagccucaguuuucucaucuguaaaugggaugaggacauggcgguacugcgaagcguaagugccguaauaccguagugugugccaggcaccauaccgaggacaguacaccugugguuucacuuaagcucuuccuggaacucaguuuucucaucuguaaaacgggauaauaacauacccuaaggguuucugugaugacucacuaagagaggggaugcaaagugcuuagugcaggccuggcccggagcacaggcucagcaaaugauggcuuacacccgaaaaaggacuggagucucugacuggugugugcgguggaugugacacgggugugcaaugugcugugcuugguggcaggucacacaccacacaugggagguacuggauucucuuguugcccacugggugguagagucaaccucuguccacgagaggcccagauggcccaccccagcguccuccaccuugcccuguucugacuugggaauggcuccugagaugcugggagacccaggagcggagagagugcccuugggggucacgaagacuuugcccacaguggacuggccuggacgguuuccacaacucgucccucccugcuuuccuucuuuucuugagacagggucuuacuccauugcccaggcuggagugucguagugcaaucucagcucaccacaaccuccaccuccugugcucaagcgauccucccaccucagccuccugaguagcugggacuaaaggugugcgccaccaugcccggauaauuuuuaaauauuuuguagagaugggguuuccccauguugcccagguuggucuugaacuccugaccucaagugaucugcccaccucggccuccuaaagugcugggauuccaggugugagccacugugcccggcccucccugcuuuccuagcuccauccugaucuuucagauuggaagucaagucccuccugugcucaagacuuccccgcggccuccaccucacuuaggaugcaaucugcagcgcuccuagccgcgcugagguccucuggucccugcuauauacccauagagcuucacuuccuacccccaaccccaugcuagccucagaaguccccaugcugccuugagccuccucuagccuccucggccccagguccaccacccucacucccccggacucccuggacucccagguccggcuguuucuaacugucucccaugggaccugcucugucugcucacuugcuggagcagaaauucucacacugccugaaaagcauccagauacacguugacaugcaugagagaauggugcuuggaggucuugccaaagcgugugggggucacccacaaaaugugcucggugcuggacaaguggcugucacucaacacacagucaaggaacuaaacggaauucaaagagcacccucgcauuucuccccgcugcuuuaggguccgcucuuuuuuuuuuuuuugagacggagucucgcucugucgcccagguuggagugcaguggcgggaucucggcucacugcaagcuccgccuccuggguucacgccauucuccugccucagccucccaaguagcugggacuacaggcgcccgccaccacgcccggcuaauuuuuuguauuuuuaguagagacgggguuucaccguuuuagccgggauggucucgaucuccugaccucgugauccgcccgccucggccucccaaagugcugggauuacaggcgugagccacugcgccuggccaggguccgcucuuuuauuccucucugcccacacuccugcagauuaaaagucucuagagaggcagagaggaauacuauugaacgggcucuaacuccauguaaagcucccuaaauauauccucucacacuucuauuauaaacaaguauaggugcuaggauaagccccaauguacagauaaagagacugagggucagaaaggccagucauuugcuuaaggacacauagcugguaacugguagagcuggaaugugaagcccgggccacuggucuccaguuucuuucuuuuuuuuuugagauggagucuugcucugucaccuaggcuggagugcaguagcacaaucucugcucccugcaacuuccaccaucuggguucaagcgauucuccugcuuuagccucccgaguagcugggauuacaggcaugugccaccacgcccagcuaauuuuuguauuuuuaguagauacgggguuucaccauguuggccaggcuggucuugaacuccugaccucaggugauccacccgccucagccucccgaagugcugggauuacaggugugagccaccacgcccggccuggucuccaguuucaagucaggcucaggucugaauccuugcuugugggcuugggcaaauggccuggccucucuagcaguuuccauagcuauaaacugggaauaaccacacuagccaaaaagaaccgaccugacggccaaacgaggaagggccuguggacgugcugggccagugcuuggcccacaacggcacccagugggugagcauucccucaccuccuucaggagggccccaggguggcaggauggccccucugcuuaccgcgccagugcucugcugccgggcguccagggcuccagccaggccgucuguugcuuggggggcuucguauuuuacccugaaagagagaccaccaagccauuggaugcugcccuuaccgauggcugaugcaagaacggagcgggcuggggggcacagauugacggcucccauccuccaggccugccuggaaaugguaaaaagggucucauuuccugccucuggaaauuaggaucugacaagugaccuacaugacagacagcagcaaaggcuggagagguuagggaggguguugcuggccaaagacugagaccaagaccaccaauggcuaugaccaggauuggccaaacucaggagacugauaaauagcuccagugcccguaggcucauggagaauucccagcagacccuuucuugagcagaucuuguuuccuauuuuauagacugugguuguguaugaggucguauuugaaugggggauuccauucugcugcugaaaacacaucuauaaacugcugggugaggugccaucuugucuugcacuggcucaccagcacaaagaugacucugcccccaccuugucucagcagcaugggagguggcuugguuacagcucuucuaaauguccucuggggggugccagccagcuaggcaggguggggaggcaggaacugggagggcacgcaaggcugaugggcugggagcggcagaggcugaccccacaguugcugggcagaugaggagaggcaaggaaggguauguugugugugagguuaagucuccuggggagcaagagaauaaccugagugagaggagaagcuggcuaaggaggagaggcggcuauggugucuuucccagcugccgcagugggggugcccagggcagguguuggggacccagcccuguugcagggaaagagcccuguuauucucgcccugaacugccggcagacaggacuucagcacuggcucagugcagcuuugaggcaaagaaguaagccacagaauucuggucacaaagggaaaggccugcgauuccuguuaggaacaaggccaccugacacgcuagugaagcggggcuggucuaacuguaggcuucaggaacugggacugcaucacauuuaacucuugcaauaccagcuugcuuucugaggaauggaguaggcuggcacugaaaggggcuucuugaauaugacccccaguucccacgcagucauuuugaagagugcugcugucuguuccuucccaccaggggcagaguuugcugguggagugugaccacuagcuggggcauucccugguuacacggcucccauccauggcaagugggccagugacuacggcagggcccugcuggagccaaccuuaaagccaguggcgggggagguggggcgucagguugcugacuucugacccagagaaggccugcuaauugagggucuggaggugcuuguugcugucucuaagacaugcuuggcgcauugugggcaaggcugaagaagccaugcccagccccagaacacgcagaaacccaugauuucccuucacucaaaacaacuaucugggccaggugcaguggcugaaaucccagcacuuugggaggccaaggcgcgcggaucacgaggucaggagaucgagaccaugcuggcuaacauggugaaaccccgucucuacuaaaaauacaaaaaauuagccaggugugguggugggcgccuguaguccccagcuacucgggaggcugaggcaggagaauggcgugaacccaggagguggagcuugcacucugcaagcgccacugcacuccagccugagagacagagcgagacuccggcucaaaaaaaaaaaaaaaagaacuaucugcccuuccuaagcuuagcuccucgccaccccugcccacacauggcccugaagcccagcugucccugaaggccaugccuguggugguggagggccaagcacuucccuggaggaagcccgcaccuccugcacuggguggugaccccugggcuagggccugcugcccccugcccagugcaggaggguggagggucacuccuuagguggucccaguggggcuggugggcaggggcugcaccugggccacuggggugacacuugucuaagugcuccuuguagagaaggccucuguguacagcagcacugacgaagaugcggacaaagcgggggaaggacaccccugccuuugugaaggccuagccgaggcgucucugcuguggcucgcccagaagcccugcuacuccuuggcauugaguggauaggacuggcugcaggaaggcugugacggugccagcuguggucaaggcuggagcagaaacagcggcugauaaggagcugguuucccugccagccagggcagagcugguugcaggcuggugugaaguggggagccaggcagguacagggaggagcgggcuggacaccaagcuggcagaaaaggccagucaggugaccagagcuggaagauccaccagaagcauuuaagggggccagccaggcaggagaacaaagggaagacgaaauggaugcucagguccacgccugaccuugcuggauguuuucugccaggguggaaaccaagcccuggggagggccugcaggagaaccaauggccugagaaggugcaugaugucauuucagcugugcucagcugaaggcaguuucaaagaugaaaaucugauaagaaaaaagauccuuccugugcucccuccugcucauguuagaauaaaaucaacugccucucuguagcccagugggccccaccacccucucagcauccugcccccuucccugugugaagagcaucuuucccagcugcugugcgggagccagggcaccucucucccgcccugccucugagacuuugcacaugcuguuccuagugccugaaauggccuuccuaucacccagcaccugguccagcucugaguacccuccgcagaguugcaugcucccuccucuguguccacagagccuggugcccccuccaggacagcacuuagcccuucacagcggugguccuggugcaugucacucucccaugagacugcaggcccuagaggacaaguuccuugugugcuuuucccugucccccggagccugcuccccagaggaaggacagcgcaacagcauaccucagccaggcuggugaccagggcaggcgccaggguucuccaguauggccagcaguguugccugcuggggccucuguggaugggcgugucuggcugcaagucccaucacacucauuagcuugccuuugcaggguagccucggcagcaccccuaacuccauggcaacagcugcuggucccaggguaccugggcuuaaaaguacagacucugcccagacuaaagaaagauacagcuaacagccagggcagcccuaaggaccuagcaggcuacagccuggaccuggauuuguggguguggagagguuaucccugggcucucuggaggcccauugacaaaguuccaaaagacaccagaaugaccucuaaggagcugaguggggucagugggaagaucccauaaucuagaacuuuccuuagcuauaagaauccuggcugcccacagcucagcccugggggucacagugggcaaaaggcugaagaaaacaucaagcagacuguuccucuuacaagccuguacggggccaguucucccgcaggucccggcaaggggucagacccugguggacacacucaggccacgugccuaugcugcugaaaguacccccugaaaaugcacggugcacagggaagggcagagccccagcucuggggcaaggcugacagaaccugcuuaaucuucucuggaaauuaacgguggcuauggaacaacagaaaaagacuugacuugaaagucccugaggauuuaucaggaaacuucccugcuccuggagggcuuacuaugcgguacacagugcagggaggggggcgggggguggagacacuguguuuuggaaccagacagcccuaggcuccuaaccuagugcugccaaauauuagcuccuugaccuggggcaaaugagccugccccucucugugccucaguuucccccucugaucagacuauguaagauucuggcauacagugggucauuaggcucccccucccccacccagcauggccuguggggagcgcagucugucaacugaccacagggcucccaggccaugcuggacugacuuaggggauacuaagggcgugcuuacuaagcaggguccgugugcccuuccucauggugugccaccauaaaaccggguuccagaaccccgagagccacccgaacugcaggggaccagggcagggccaggccacucacucuuuccguuggucagccagugagcugccccgugucagcgcaaacaugucaaacucaucuuccagucgaccagaggccuccagagacugcaggccagcucucacacugcuggagcccaggucugcagggacagaaaggccacgugaaagacccauccacaagcuugugugugagcugcugcugagcuaccugcugccagacccagggcuuggugcuggggaaguggcacgugugggugggggaaugcgcgaggcaggccaccugcugcuggcuguggggccuugggcaagcggcuuccucuucccagcuuuaguuuacucaccccucuuggggcugcugugagcguuagagaacagucaaaacgcuauccauugauucugcuggggaaguggcugggcaggaggacaguaaucagauggguagucgauuuuuucaaaaaguauagcauuagugaugcaaaauggggugcuaaugauuuccuagggcuuggcaugaagcagacaguaaauuauauuaaaaccuaucacagugauaacagugacaauggccaacuacucagccagagugcaaccugggccuggcauggucuaagcgcuucucauacacgagcucccuacuccuguuaaagaggaggaaagagaggcucaggagguuuaaggaacuugcccaagcucacgcagaugauugaagccauggagaauucaguguagagggccaauccuaggaugguaggauuucugagauccaaggcggcucaggacuuguggggcugccaggggcagugaccccgagugccccaccuugcagcaagauucagccugggaccccagcaaggugggguccagacugacacucugcuguggguauauaacaagggcaccccgaaaaucugcaggggugcccacaguaccauaauguacccucagcuggagcccuccaaaccacacuuacucauuccugccagcugggaugagagguugccgguggcugcugggucagggcccaugucgaucaggucagcugccggcucggccucacuuggggccuggugggaagggagaugcccugaucauccccgcugucugcagcuucguuccuuucugccccaagcacuguggcuugcaggcuuugcccagggaucugucaccagggccccaggagcuaggacugggcaucagggaauuuccuuccuccccucuggcuccagcucaacuggacucccugggagguuggggagacccuggggcaucaggugguggcacagccuuauuuaccuuaaagggacagggacauaaaaaguuagaaggggauuucucuaugggccuggauaagacagcaccacccuguccaguuuacuaggggagggaggugagaauggcacuccuucuucccaugaacagggccugaucuagucacagaaaagaagacuuuuaccuugguggucuggccuguucggaaccguucaaaccuacaagacagaaaagacacgaguuauggagacagacugagacaggcccccacacacggccaggcagagcuuuucaaacugugggucucaacaucaacacgguggguuaugaucagggugaugacacgucuggugugcccuggacagauccaguucaugccugcugucccuggguaacuagcagugcuccucuuucccuugcaaaagugucccaauuuggaugaucaauuauaaggcaaccuuagucaugaguagcaugaaacaaauaaacaggaauagguuagaacagcaaagaaaauaggaaugcauggcacgcaguaaagguaaggacugucuuaugaaacuuguuucaauuacauauuuguguguguguauguguguguguguguguguguuagugcucucuucagugcuguaagaaagauacauguaucucuaaucuuguuuuauggagcuacuuaggggccggugugauagaucgagaagacuuuaguguggggucuguucaagucguggccuugucacuuaucacaugaccucggguaaauuauguuccuucugaacuuuagucugcuugucuaguaucuguaggcaccugccucccugaagugcugaagcccaaauuaggacauggguauaagugacugcgagcuugaaagcacagucagauauuaagccuaaugacuguggauaucugaggguaccagcugcuaccagauggggccccucagucaccucacagcccauaccccaaaauggcagggaagaggccuuucauuccacugggccaacgagcaggagaagcuaggcagacgugaccugcaggguaccccccacuuuccacugauuuagaaucaaucagugagugucuuuugauggagaaagacacaaaaaaugaacaaggggcuggaggaggcuggaauaacucaugucaguuaucagacacccuggacugcuaagcgcuuuacagacacuguuucauggacucucacuuaugccacaagccucauuuuacagauacagaggaggugugaugggcacacaauuucugcagacccagcaauccuucuccuucucuuuccuuuuuuuuuuugagauggagucuugcucugucgccuaggcuggagugcaguggugcgaucucggcucauugcaaccucugccuccuggguucaagcaauucuccugccucagccucccaaguaagcugggauuacaggcacccaccaccaccuccggcuaauuuuuuuguauuuuuuaguagagacgggguuucaccauguuggccuggcugguugcaaacuccuggccucaagugauccucccggcucagccucccaaagugcuaggauuacaggugugagccacugcgcccagcccuucuccuucuuuuguaauagcaccuaaguacucuuuagaggaacugcuccucccccauuucacaucaucccgguggggcugccaucaaagggcccucucccauaccccagcugguaggcacaaugaagcucagccaauccaagucucucuuggggaugugacucuugaacagaaugauacaaggugggcaggugggugugguggcucaugccuguaauaccaaugcuuucggaggccaaggagggaggacugcuugaggccaagaguuugagacuagccugggcaacacagugagaccccugucucugcaaaaagaaaaaaaaaaaaagaaaagaaaauuagcugggugugguggugcaugccuguagucccggcuaccuggcaggcugaggugggaggacugcuugagcccaggagguugaggcugcagugagcugugaucaugccacuauacuccagccugggugacagagcaagaucgugccucaaaaaaaaaaaaaaaaaaaagguggacagguguuuguggacaaguguuugagcugauguauuuauugauggcagcacccuggggagaugguccaggaauuucugcuccugagacaucugagcugcccugggauccaucuuucuuguucuguugggagacaucaguuucacuuuucucuggauucugaaagcuacccauuuaauaaagauuauuauccuaacaaauucuuuuucugccuaaguuagccagaaauguuuuguguagcuugcagcagugaagucacuugucuaaggccccagaaccaggaagugguggagugggcgaggacacaccaggccagucugguugcagggccgugcucucagcugugaccugugaccaucucccagggcuggacuugggcacaggcagcagcgcuaacccuggaaaggagauacagggcggcuggaaggaggggcccucauaaacauccuggaagaagacagcugagggcacaggcccuuaggagccugccuuguguuugagaggaggacgagagaaggcucagauggcaugagaccaggagaacagggaggaagggaagggagaggguuggggcaguaggccagaggccaggggaggugcuggggcuaccguucauggcgcaggaacacauuguugagauugucauugacgaugagcagcuccucugucagcugcucauuggcgaucugagggaugagcuccaggacccgcugcugcauggcucggcacgugcgguugagcuccugccaggaaaggaagugaggcaaccacagucacaugacucagagugaggccgucucuuuuuuuuuuugugagacggagcucugucgcccaggcuggagugcaguggugcgaucuuggcucacugcaagcuguguccuggguucaugccauucuccugccucagccucccaaguagcugggacuacaggcgucugccaccacgccuggcuaauuuuuuuuuuuguaguuuuaguagagacgggguuucgccauauuagccaggguggucucgaucuccugaccucacgaucugccugccucggccucccaaagugcugggauuacaggcgugagccaccgcgccuggccaagugaggccaucucuaaugcacgggccuccagccccugcacaagccuuggaggagggugaggugcccaaacuggacuucaagguuccacggaacagcuuuuuggguucuacaaacaugaacuugaacuucacuuccaaguguuagaugcuaaaauuuaauccacaggaaaccaucaacauguccaacugugcugccgguuuaacuuggcuucgugcagauuccagaauaaagguugugccaccaucuuugcuuagucaaaaaaaaacugagucugcaaagggggcuggcugaacaaaccacaacuucuggggguaugcugugauuuuugcaaccaaagcauacagaaugaacuagaugacugcaaccauuagccacaaaccucgauuucgaguuuuugccucacuuuucucacugccugauuuuuugucuuuuuaaacaaacuuuuagcuuuggaauaauuuuagauuuacagaagagaugcaaagauaguaccacaaguucccauauacccuugacccuggcuuccccuuagucuggcauuugucaaaacugguaaacuaccauuaaacauuaaaacugguaaaauacuauuaacuaaacugcggacuuuauucagguuucacuaguuuuuccucuaauguccuuuguuuguucuaggauccuacacugcauuuaguuaucacgucaccgacuuuuaaccacuaggugucauauuuaaacuuaugaaaaauaaaaaaaauggcuacacccgguggcucgugccuauaaucccagcacuuggggaggccgaggcggguggaucaccugaggucaggaguucaagaccagccuggccaacaaggugaaacccugugucuacuaauaauacaaaaauuagccgggcauggugguguaugccuauaaucccagcugcuuggaaggcugaggcaggagaauagcuugaacccaagaggcagaggcugcggugagccgagaucgcgccacugcacuccagccugggugacagagcaagacuccgucucaaaaaaaauaaaaaaauaaaaaaccauagccauauggguuuucauuuuuaagauuggucaauuauuucuucagguaccugccaccaggugaagguuccugggucacggcaggugccuggguccugagguccagggagcugcccggcauugccgacuguggccucacgccagcacgccuuucuccuggaggcaacgcugaggcucggcacugcccaguguuuauuuuggcugucauguggacccuguccccugcccccuccaaggucaggccuccgggauuuccucaucgcccuuagcacggggacagggcgggugccuuucaacauccugugggcuccccuccugcucuuaugaccaagcacacgguggcuuugcuucugcuucccugcuggccccucucaagagcagaagagcagcacuuggagccaggcccccggguucaaaucgcagcucugcuacuuaccagccauauaacccuggacguguuaucugaucucccuaugccuauuuccugaccuggaaaauggggguggucaggauuacgugagcgaugugaaccaaguguccacauauagcccgggacacgggaagugcccagugcaugggagcugucccugcauccaccuugcucagccuucugaguccccagacugcucacaucucauggccuuggcuuggggcgugcgaggcugccugcgcagucuucucucuuucggagcccuuacuggguuucaaguuuguguauucacuggacucugaggcuacuccuuuucuccccacccugcaccaccaagugaggaccccugcagagucagcucggucaggcacacagacacgguggcgaggaagacacagcgcugcccucaaggagccugaggccugguggacgagcaguaggaacucgaacaguuacacgaagcgcucugucuccucauggauucuggugacuccugggccuuggggauuccuagcucucuuggugccucuaugacuggccuccauggggagggugcuuuuugccaaauucagugucccuucugcuccagugacccccaaucugggcuggggccgugggaauaccaugugacacccgggagcaggaaccacuagcuccaccugccuuggcuccccaagaucaguggcuggcgcaucucaaggcuggcaccacccucucacaccugccugcugagucucggauucugaaugguguaaaucucaccuuccagcuuuuucucaggaccccuuacugggugcuuuacucuguaccaggcacaagccugcguguuuuucaugcaauaccuuauuuaacucacaucaaacuugugccaugaaggcuauuguuagagcaaucuuacagaugaggaaacugaggccaggggggcuacuuuguucaaaccagaaagugguagagcugcgaucugauuccaaucugauggcguccaaagucccuggugguaacauguccccaacugugaccaaggaguauggaguaagccaugaagacugucaugaggauugggaaagaaugcaugugggcagcugggcaggagucaucugagccccaggggguggugccaccugcucaccugcagcagcuccaggucugcgggcucggccugggugggcaccagcuccgucagcaucuccgacaucacccucacguucccacucaccaucuccagcucacugcgcagcuucccaaucugaaacacacaguugaucguggugagagaagccaggguucuggggcccauguuacucacagcgacagaacccaguaccaccaacccugggugcagcaccagggagccgaccucccagcagccucucuaggcagccucccuccuggcucccaaagugacagcucugcacuagaggccugccccaccccuucuacagaccccucacagaggcgcuaccaaccguuaccaucuccacaccggaaugagccaccacguguggcuggaagacuccagcaucuccugggucuaacacagcagcuaacaaggcccuggaggguggcuccccacaaggcggggagggacgcugcaggcccucucucucucucccacuagaggacugggauucugcccucucucucuccuccuagaggacugggauuccgcccucucuccuagaagacugggaucccccccucucucuccuccuagaggacugggaucccacccucucuccuccuagaggacugggaucccgccgucucucuccuccuagaggacugggaucccgcccucucuccuccuagaggacugggauuccguccucucucucuccuccuagaggacugggauuccacccucucucuccuccuaguggacugggcuucugcccucuuucuccuccuaguggacugggauuuuguccuguuucuggucuauuuuggugucccaggcucaucuaaggauaguccuugcccuguaccccaccuugaauaugaaacucagauuuagcacuuguuccaagggaugugggcagguuuucaauggucaaaggguuccaaggaguugggcuuggggaaacauuuucaauaaagcugcagucuccucaaagagguuagcuugugaaaggccauugguauaaggaucuuaugcugugggaccuuguaggguguuuaaugcccucaugcacacugggaaugccugggaaaagaucagucugaaagcuucuaagauuuauuugacugaagaaccuuuuuauguuuugagaaaugcugguacauucuaaaucauguggcugaguuauaguugauuucagagugucacuauauacauucaugauugugacagcagcuaccauuuauagacuaccuaauaagugccaagcauugaacauauauugcuaacuuaauuuuuuaccaugguagacaucaauaucccugcuuuuauagaugaagaaauggaguguagagacuaguaguauauccacuaugguucacugacaccuuccaaaaccugcaaaauguuugaucuauuuggcuuacuuaaugaacacucuugguaugagugaguggaaaaacuacugaucacaaaccccauguauccaaaucagaugggacuuaauuacagaggagucugggaguaacaucacugcacaccugaugucuuaacaugucccaagagacaaaaggggacucucgaauuaaacaaagauuaguuuuguuuagcaagcaccuucuugcauuggaaguaauuagcgucuuaauccacacagaugcuagacuucagaaaauugguuaaaaucauaacugaguuagacaaucacaaggugguuuuacaauuuuuuacacaccuuuaacccacucagaaaaaaaaagugcagcucgcugucagcacucauuuaauuuuacauaaacaugcucuuugaggcugaaguaaaccugacugauuuucaacaugaaaauaaaacauaaaaacuguucuuggaguuauuucuaaacagaacuugucuccaauccuaacguaacagaaauguauaugagguuacauuaggauuagagacaagaguauucuuggggcaaacgggcagugcguuaauaauuuuguccaguuagcaaaauuuucuaguaauaucuguaacucugaggggugauuucauaacuugcuaugagaaaacaaaucauggaaguuucucuucaaauagguuagggugagaaugaguucaaaugauacaaaaagugggcaguggggacgcuuauugggaaaguuaagcuucacuuuucuuuccaucacacauccgugucuaacucaccagcacacucagcagcuccaccuuuacgcuccgcggaugugaugggccugauguguguacaacaccuuuaacgugggugucuccacagugugcaggccucugcccccaccccagcagccaaaagucuagaaugacaagcccccagcucuacgagcuggucauggcuguagaagucacucagcagauacagcagccauggcacuccacaagcagcucauggcccagugggccaugaggaggaaggaagugacaugcccagggugccaccugcucugagguggguaauccuucaaagcuagucagagggcugggaaaaccuguccccuagaaucucauacuaagccucaaaccuucuuggcugggugugguggcucaugccuguaaucccagcacuuuaggaggccaagacgaguagaucacuugagcucaggaguucgagacuagccuggccaacaugaugaaacuccaucucuacuaaaaauacaaaaaauuagcugggcaugguggcucaugccuguagucccagcuacucaggaggcugaggcaggagaauugcuugaaccugggagagagagguugcagugagccuagauggugccacugcacuccagccugggugacagagcaagacuguuucagaacaaacaaaaaagcuucagaccuucuugagacuucaugggaagcagcaugguacaauguacauauguuuuuuauuuuuugcacagauguuugaaaacuuuucaggcagaaccucucuucaaaugaagccuuuuuuuuuuuuuuuuuuuuuuuugaaacaggucucucuauguugcccagccuggucucaaacuccugggcucaagccauccuccugccugaaccuuugagaagcuaagaucacagacgcacgugaccaugcccagcucaaaugaaagcugugaguguguaagaaaccacacagguggagcuggccugaaggggcugcguacaggacaccucuccauggugcuguuggagggccccgcagaaaacacagguuggaaaauggccaagguacagggcagugccugccaggagucagacagacgugagcuuggaucccaacugucucugaugacugugugcucugggcaagugaauggaccucucugagucucaucgcucaaacaggaagaaccacacauacccugugggcugcugugaggaagaaguggaggcuccguggaugguaaauucugacagggggcccucccugacguguguggcccaccugccuggaccugacgguucugaccccaggcucguuuaccuguuccgggguuggugcuaugggcgugucaccggagaguaugggcggggcgggcagaggggcagcaugcuggccagaguccucuugcuggcuggagucagugcccacagaauccuguccugauugugucucugaguugaacacggucuagugggaggaaaacaggaucagugagggcuccugggaacaucaagagcccaggaagucaggggccagccuggugaugucucuggggaugaguccugccucccuucccuugguucccgguacggcaguucucucacccucugggguguguggaugggugacagcauguccaggucagucauggggaacuccaggccuuuccuccgcagguccucauagauggugaccacaccugucagaucgggcgagcugcggaacgcgucagcccaggacugagaggggacaaggggacacagccgguaaccacagcucaccugugagccugcccaccuggcacucagacagagaacagacauucuuucccugcuuuuuuuuuuuuuuuaacuacaucugcccugcccacuccacagcaaagcacgcaguuggcaagccucccuccccacagaacaucccaccagccgacaaccgagacgccccgaaaugagaagcggagccugggacaaacacgauggccucgacucuccacugggcaggaagcuccugcacugacagcucuuccuggccgugcccugcccuguccuggcacucaccuggaugagguugagcacuuugucaugcacgaugguggguggguuguucuugggcaggaugguccucaccagcacacucuccacgaaguccuggcuggccaccagcacguggaagcggugcccgcaguucuugacacagguuucuaagaccuggagggccgagaggugccgucgagcaccuuggucagaggagaggaggugcucagaacccccacccucguggcuccuccugugucccagagaggaggcccgggagaggagaugggacuuccuggagugagacccuugaauguggaggacugggacaaugccaggacugggggacuuguuuacuggagggcacggccuagggugggcagagguauggugugugggcuggacuuccuucccugacuggcgucagugcacgcagaaucccaaugcugucucugagcuaaacauggucuagagagaaggggcucuccaagaggaaaucaaggagcaucugagaugucaaucgacuggugagccuguggcccagggaaaaggcacugaacuucccuccccacucuccacuucccacugcaggaauugccuuugcuuuuugcuuaagccaauucaccuggauauaaaugcugcuuguggaggagggugggacagcauuuauaucuuccccagccaaacccaugcugacggcuaggaggcccacgugugucuggccgcccugagaucugggcugguucaguggugugggcaagacuguucucagccacugguauuuauuuuacauucauuugccagagcaccaaagugccgagcagcacccaacucagucagccggccucccugcccccgcggaggccuggguuuacugagcuucaaugucacccacagguccuuuggcccaggcucucccugccagugguucuggagugauguaagcgucuguucccaugcugggggauuggggagaaccuuuccaaauggccucuugccauucugcauccgccugcaguguagacaggacagugcguugccuacagaccuuuccagcucucaaaugaggagcucagaggaggcugggaguccugcugggucugaggggaggugacuuucaguggaccguaguccugccacaggacagacagauggggcacucacugugagagccagcaucaccucguggaaguucuuauuccccacgauucucuucuuuacugcucggagggcaucuuugggacuaaggaggacaagaaaaagggugggcuuaggaauagagcccccuuaccuaacaccagagacccuggagaguuggaacaguucuuauuggcccauccucccugugccccaccuguuuuguguauccagccagguucugaucacaucagaaucuuccuagcccauugcuuagcagggacucacaaccuguggccccuggaccuccagcagcagagucacuuugagaaaagaugagagcguuuuguuaaaagugcagaaccuggccgggcgcgguggcucaugccuguaaucccaggacuuugggaggcugaggcagguggaucacuugaggccaggaguucaagaccagccuggccaacauggugaaacccugucucuacuaaaaauacaaaaauuugccgggcguggugguaugacccuguaaucccagcuacuugggagguugaggcgggagaaucgcuugaacccaggaggcagagguugcagugagccgagauuacgccacuguacuccagccugggcaacagagugagagccgagauugcgccacuguacuccagccugggcgacagagugagacccugucucaaaaaaacaaaggacauucaaaaaaaaaaagcagaacccuagguccccacccuagaccaccugaaccaaauucucagggaguggggccccugaaucugaaugcuucucaugcuccccaaggguuucuuaugcaugcucaaguuuaagaacaaauaaccuggaggcauaauguuuucauuacaaaaauagagauggggucuugcuauguugcccaggcuggucucaaacuccugggcucaaaugauucucccaccucggccucccaauauguugugauuacaggcaugagucccugagcccagcuagcauaguguucugaugccccguccuggccagcugcucuaucuguccauuuacccuuccauucaaguuuuuuuuuuuuuuccuucugagacagagucucacucugucgcccaggcuggagugcaguggugcaaucacagcucgcuguagcccggaacuccugggcucaagugauccuccugccucagccucccaaaacgcugagacuaccagugugagccaccaugucuggcccauucaacucuuauuaagcacccaauauguauguagcaccaugcuaggugcuggggacacaguggcaaacaagaccauauggcccugccuccuccccaccuugcggggagauccaaagaagagcaaggaauaagcagguccuggaaaaagagcagaggugaggauggggguggucagaaaagaccuccgaggggguggucuuguaguugggccuugaaagaugggaaggaccaccuggggggagugggggcagagcaguuugggucaaggucagagccuggaccaaggucuugggugcagaggagcuugaugccuuggaggaacuaagaggaggccacacugagugugggggaggucggggagggcugaagaagccuaggggucacgguguugggaggccccuggaagcuggggugccagccugcucucccuguccccucugugauucccaccauccuccacccucggcccuauacagguauacucagugcugcccugacugcucuugucuaaaagccuuugugcagggcccccacuugcacccugaaggcuccugaccuccacauccaugaggugaagccucagcuaaaauccaccccuuccacaacacuuucccagguccuccagucucccuggccuguucugccaugccacauugaacugggggcccacccuggguagagaagaagcuugcuauagggcagggaugguguucucuuuggacagcuucccuuccuagagcccaucacacuacugaagcacaaguaacauuucucagccuggccaguggccacugggacccauccggcugucugccuggcugucagugcugaccccauccaggacuaaggcaggagagccuggaacccuggcacugguucucagcaggagugaaggcagaggcaaggcuuccuagggacagagccugccugggggcuagagcuauggaggcggucaggccugcgguggaagggacacgguggggaaagggaugguggcccaccaagggggguccuggcccagaagccugagagcaguuuccaacccuugccucccugggcagccccucgcccgucccuggcuccuggucuuggccuggccacugacccacgggcuacuucagcgcuuuauagugacuucuuuccaccucuucuaggguggccuagacacaagggaaucagaaucauucccuggcauguuccgccaugcgccacugaccugggggcccacccugggagagaagaagccuccuagagcgcagggacagcguccuuguuggacgccuucucucccuagagggaagcacugggaaucggaaguucuggccuugccacugcugugggcccaugauguccgguacucugcugggagcacaaaguguaugacaaggaggccacaacccagugggggagacacuuuagcaacgaggcuaaguuuaggugccaugcuuggugaggucaagggucaugccugccuuugaucacugcugggucccuagugccuccuguguugccuggaacacacaaagugcucaaauaaauagcaaugcaccugaccgacgccgagccuguuccucccauguuuauaagggacaugggggcuugcuguccccaaggauacugcagugacuugcagcugcgacguccaugaagcucccaggccugucuagaggcuuggugagguuuucugccuccugcuuucuuucuucugaccucugcccaccacuccuucccucacccucacucucaugaguccuuggcaagaucagggagcagggcugaggaagacaccggcagguuccuggcagccacugcccucuccugacugggccuugacugugugacucagaugcccacagccucccuccagcucagagcugggcacucccugcccuccaccugcauccagccugcgccucuccacgcaaagcccucccgggcugagaggaacccugcacuggccgcgggagagcuggaugaucccagugagaacuggagagggaaaggaggguccacacugauuucucaggauggaggccucgucuggcagcacuuccugcugcccacggcucccacaccucugcccagccuucgcuggguuuuccugagaggacagggacccucgcauccccuuucugcucccuccagggacucgggcuuauugcuggaaggaucuaacagagcaccuucgaggacaaagaccuagagagguaaagugacuuccgaaggucacacggcuggucagugacaacgagucagacauuggaggccaagaccccaauccuucccccacaccaugugccuuggcagggcuccuuggcacugagcaagacgauaccgugaccccaacaccagaaacgcccggcaaacgccagugcuguucaggcucacgguucagcuucacuuucccugccauccuugugaucucccuuacccuccaggcugguuucaaaucuuaaggaaauggaagucuguuuuugcucgcagaaaagccggagucucucuaguacacacucccgccugcagaaugcagauggcgcuuggggucaacuucugauuaagagucuccagcuugccucauccuaggcagaugcugcacacaaggcugggcuuccagauccguguggaaucugggcugccacuaagagaggcggggugggguggcagcccccaggggccagcugugaauuccuaccuuggauggggcucagguacuaggggcucagauggccucugcagccaagcggguugggucagacuugguggcuauggcagcaauggggcuggggcaggggcucccuggaagggugcaggagugugcugcguggugggauggccgucucugcccccaaccucuccuuggggggcccuuacccuuccuccgucucguugaugaugucgcagaucuccauguugagggcccaguccucgcucugcagggagccaucuguggcuuucuc

SEQ ID NO: 14924 - RNA, 13566 nt, Homo sapiens
ccagcacccaggcugaacucuguaccauuuggaagaauggaagcugaugcaucuguugacauguuuuccaaaguccuggagcaucagcugcuucagacuaccaaacugguggaagaacauuuggauucugaaauucaaaaacuggaucagauggaugaggaugaauuggaacgccuuaaagaaaagagacuccaggcacuaaggaaagcucaacagcagaaacaaguaaccucucugcccugcuuucugaaauugcuauaacaguaugcgccuaacaacuuauauauacaugugcuguaguaguuacauuucguucuuuguguuuaggguuuuuaaaauucagaauaccuauuacuguuaaaaauuugcccagaaaaaaauauguuuuaaagacauucaaaauuagcccaaucucuauauuaauccacagucgaguaaaagaaagaucugcccaagaucguuuuucugagcuuggauuuguuugguugaauggagggcuagggagucauugguuuccauuucagguaauauuaaagccgauuuagcuauuuucaaagcaaacgagauaagacagaugagauaagagcaauuaagucaauuuauguugaaaaauguauuucaggcauuuccaaugaaauaauuauguggcauauucaaaagaaugcaugcuuuguaacaaagguggccacagcucuaucguuguugccucuuagaauguuuguguagaauaaacgcagaguuguaaacucugacugaaaccaguggauuaaauucuguaaauugaaauuuuuuuuucugcuuuuugagauggagucucgcugugacacccuggcuggaguacaguggugucaucucaacucacugcaaccuccgcuucccggcuucaagcaauuauucugccucagccacccgaguagcugggacuacaggcgcacaccaccaugccuggcuaaguuuuguauuuuuaguagagaugggguuucgccauguuggcuaggcugcccuugaacuucugaccucaagugauccgcccaccuuagccugccaaagugaugggauuacaagcgugagcuaccgcaccuggccaaauugaauuuugauuaaaacauuuuuuccacuggguuacauggaaauacuuuaucaccaacucugguuccuuuucaguugacugugacuuaaacaugaggcuuaacuuuucugaagaaauagggaguuuugaccgggcauggugguucacaucuguaaucccaacacuuugggaguccaaggugagcggacaaccugaggucgggaguucaauaccagccuggccaacauggugaaacccugucucuacaaaaaauacaaaaauuagccaggugugguggcgcacaccuguagucccagcuacucaggaggcugaggcaggagaaucucuugaacccgggagguggagguugccgugagucgagauugugcuacugcacuccagccuggaugauagagcaagacccaguucccccacaaaaaaagagaaggaguuuuguuuguauugcuguagcaucacuuugauauguuuacacccucauguuuagaagaguuacuacaaaaggaaauaaucuuuuauaagugaguccaaauuuuuauauuuugaguuucuaaaauagaguacguuauauggcuuuuaccuguacccuaccguauuuuaaaaaauaggcugcuuuucuuuuucuuuucuuucuuuuuuuuuuuuuuuuugagagggagucucacucuguugcccauccugccuugaccucucaaguagcugggauuacaggugccugccaccaugcccagcugauuuuuguacuuuaguagagaugggguuucaucauguuggucaggcuggucucaaauuccgaccucaaaugauccgccugccucagccucccaaagugcugggauuacaggugugagccaccccacaccaggcccaauuggcuucuuuucauaguauagggcugauaauuaguaugcaaaggacggauuauuggaauuuaagguaauauauguuuagguucugccacaaacucauauuucauagucacauuuaaguacuaauugcuaaugugcaacuaaaaauaauuauuuguaacuaggauauuuuuguagagagacugaauucaccugauuugcagugaugaacauacguuaaauaaugucuuaaaggaacuuuuuggcaguucaaaacaguggucugaauauaauuaaaaccaacuaaggcagacuggcuauaagccuuuuuuauuauuaauguauaaaucaauuuaaaaugaauuugucaucgaguaauucagagggucuuauuuuagaacuuucacugcauuuuaguaggucuuuuauuaaaauauuuucuggaaauagucaagaaaccuagugauuuguauagauauucuuuuuauaagagauuauacaguaauuagauuaugcaguaauuuugauuuucugauccacgaggguauuggggagaucauuguaugcauugacuuacagucggcacuuaauagaccuaggugaaucuauauucuucugucagccaagcacccuccuacuguuaacuagagcuggcacacuuagguagggagcagaauagagggauaagguaagaaauaggaguuaagcagaggcuugggugacagccacugacagccaggugcugcccagcugccaugccucagguaggcccauccugcuugauucuguucugcagauaccuuaggagcacaugcuguccaaaaggggcuaugcuaagagcacagggguguagugaaugugucaggagaggcccugagcauugguagagguuuggaaugggcacauccucccucaaaggagcccaggacagguucgggucuucagccucuugguuaaauaccugagaauaaauaaugaaaagaaauagcagcuuuuuuuuuuuuuuuuuuuuuuuuuuuuugagauaagagucuugcucuguugccccggcuggagugcaguggcacaaucucggcucacugcaaccuccaccucccaggaucaagcaauucuucugccucagccucccaaguagcugggauuacagacgccugccaccaugcccggcuaauuuuuguauuuuuaguagaggugggguuucgccauguuggccaggcuggucuugaacuccugaccucaggugauccgcccaccucagccucccaaagugcuaguauuacaggcgugagccacugcgcccggccuagaaauagcagcuuuuuaaaagacaaauacuuuuuuuuuugagacagggucuugcucugucacccaggcuggagugcaguggugugaucuuggcucacugcaaccuccgccuucggaguucaagcaauuauugugccucagcccccgaggagcugggauuacaggugugugccaacacaccuggcuaauuuucauauuuuuuguagagacaggguuucgccguguugcccaggcuguucucaaacuccuguccucaagugauccaccugccucagccucccaaagugcugagauuacaggugugagccacugcguccagccuaacaaauacuuuuuaagggcacauaucauugguaaguugugaaagcagucaugaaaugucauaugucauuagggaauuguauuugagaguuaaacuguguguagaaauuucacauaagaaaauaucaggguauccugcaagugucagcucgauguaaauggaugugauuuugacaccgcagucaucaauauagucugggccacguucacugacguccagaggaggaagggagauggcccuccuggcucuuugguuggaccccuucuggaggcuggauucagaccucugucacauuuuaagaagacauuggugaauuagaguguguuuaguugauauccuggaagaguaggaacucuagaaaucuuuucauaugagaacaguuaaaaggaacuggaaguguucaguguggagaagggaaaacuuaggcaauaugugauguuugaagggcccacgugggaaagagauuaaaacuuuaaucuuuauccaagcuggaauccacagaccagaauuauggauauauugcaguucagugugagaugaccuuucuaacaauuagugcagguauagagacuuuuuaagcauuuauaaagugguuaucaaaagcagacagggcucuugagcuucagagcugcaguauccuccuuuucuccccaagacgaauuggguuuaucucauaagcauuauuuuuauuuuuauuuauuuuugagacagagucucacucuguugcccaggcaguggcgugaucucagcucacugcaaccucugccuccuggguucaagcaauucuccugccucagccucccaaguagcugggauuacaggcgccuaccaccacagcuagguaauuucuuguauuuuuuuuuuuuuuuuaaguagagacgggguuucaccauguuggcgaggcuagucuggaacuccugaccucaggugauccagccgccucagccucccaaggugcugggauuacaggcaucagccacugcacccagccucaugagcauuauuuuuaaaagacuuguaguaacuuggaucaaaugcuucugguuuuaguaguuuaagaguacauggauagaguuaaguggauauuuacauucugagucucucaagucuaaauuuuuauuuugaaaguucugagaaaauagauguuuuaagcuacaaagacagguaauugucuugaacccaggccaugcuguggagacguucacuguccguagacuaguuuugcauugacaguagaaacaggaaaguaaauugcuaaaaaacauucauuuuucuuugacuucagccaggcacaguggcucaugccuauaaccccagcacuuuuggaggacaaggugggaggauugcuugaaccgaggaguuugacaccagccugggcgauauaguaaaaaccccgucucuaccaaaaaaaaaaaaaaaaaaugccaggcgugguguggcaugcgccaguggucccaauuccuugggagacugacguaggaggaucucuugagcccaggagguuugaggcugcagugagcuaugaucaugccaccacacuccauccugggcaacuuuagcaagacccauucucaaaaaaaaaauaaauaaauaacacuuuugggccgggcgcgguggcucacaccuauaaucccagcacuuugggaagccgaggcaggcggaucacaaggucaagagaucgagaccauccuggccaacauggugaaaacccaucucugcuaaaaauacaaaaaguagcuggacauacuggugcccgccuguagucccagcuacucgggaggcugaagcaggagaauugcuugaacccaggaggcggagguugcagugagccaagaucgcgccacugcccuccagccuggugacagagcaagacuccgucucaaaaaaaaaaaacaaaaacaaacaaaaaaaaaacuuuuuuuuuuaauugacuucauuacaaaauacgauggugauuuggacacuuaaaaugucaagugguucugaaagagauaucucacauguguaauguuuugccucucuccaaauuaggaauggcuuucuaaaggacauggggaauacagagaaaucccuagugaaagagacuuuuuucaagaagucaaggagagugaaaaugugguuugccauuucuacagagacuccacauucagguaacuuuguuuccaucugugacuuuuucuaaaaaaacacagugaauuguuuggcuggagauauacuggcuuacuagagaaaugaagaaaacuaaaagaaaaaacuuccuaaguuguuucauuguacucucucauauguuauuuaguauuaaguuaagcaggcaggggcccagugacucaagccugcaaucucagcacuuugggaggccaagugggggguggaucacuugaggucaggaguucaagaccagccuggccaacauggcgaaacccugccucuacuaaaacuacaaaauuagccgggugugguggcagguaccuguagucucagcuacuggggaggcugaggugggagaauugcuugaacccaggagacagagguugcagugagcggagaucgcgacacugcacuucagcucgagcgauagagugagacuccaucucaaaaaagaaagaaaaaaaaaguuaauuguuauuuuaaagaguaacuuaaagaacaguuacaugcaaaaguauaaaugaauauuacugaaagucaauauucccauauaaauggcuuauauuuuugaauuguauuuucacuagcuaacuaaaaacaucuuagaaauguacacuuaaaauucuuaucaccaugacaguaauuauuucccucuaguauugugauguagccaugauauugggaacgggcaacagcuguugagagucaguguuccuucaguuccuccuugaaggaacuagcaacugugguggggagaugguggcuuggccaaaccuuucaccagagcagaguugggacugccagucuuggcuagaaggagaagugauuuuucuuagaccacccuaggucuccaaauuucucuaaggaagcagaucucuuauaaaauguuaauaccuccucagaagaggucacaucguaaaccaaaggacccaagccuuugugguuuuuugugcacagauuugauuaguugccaacacuuaaaaaucgagagauaacuccuuuugaaaauauccacacuuagaauuuuucuuuaaaaaaucagaaaacuugcuaauagcauagcuggaacuaugauggcagucaucugcugacuggcaccugccuacccaggacagacaagcacugugcucuagagucucuggcacucacugugguuucagcccugcucucuuucucauuucuguggccuucuugccccuuugucuugaucucacaacccaacagcuucauuguuaguuaacaccuuucaagaauugauugccugguauucauugacuaagagaauaaaaaugaaacaaaauauugagauggugaaaucccuugugaggaacagugagagaagggauuaggcagguagaaagguaucagagaaaccucugcccuuaugguacacaaccaucucgcauuggcacacauuccucaaguugccaaccucugacaaauaugaugaggugauauauaaauauacuaguauguaaaauauuauuuguccacuuguuuuuuuuuuguuguuuuuuuuuguuuuugagacagagucuuacacugucacccaggcuagagugcaauggcaggaucuuggcucacuccaaccuccaccucccggguucaagugauucuccugccucagccucccgaguagccagggcuacagucacccaccacuacacccggcuaacuuuugucuuuuuaguagagacaggguuucuccagauuggccaggcuggucucaaacucuugaccucaggugaaccacccaccuuggccucccaaaguguugggauuacaaguaugagccacggcacccggccucacuuguuuuuuuuaugucuuucccaacuagauuguucguuuuguagaggcagcgcauuugccuguauugugaccuacuguucucugggaucauagcccuaaagcaacugccugacgcauaguagguggucaauaaauacauuugaugguguauaaacagugcaucaccaggaguacucaccuucaaacagaacugaaaaaucaaaaucauccagugaacuuuauauauuagcaaaguuccuagcacauaguaggcaggaugcuuucauguauauuaucccuagaacauucacaauaaucuucagaggcacuuauuauuauuccuguauuucauguauggaaaccaagauuuggagaaauugacucaccuaguaucacucagauacuaaaugauaaaaaaaagagagagauuggaacccauguuuuaagccuauugcuauuuuuuuaauuuuuaacuuuuguggguaguaguagguaaauaugggguacaugagauauuuuaacacaggcaugcaguguuuaauaaucacaucaggguaaauggaauauccaucaccucaagcuuuuauccuuuguguuauaaacaaucuaauuaugcucuuuuaguuauuuuuaaacauacguaaaggccuauagcuauuuauaccaugacuguuguuuuggauuuuuaaaaauugauugacggguugggcgccauggcucaugccuguaaucccaguacuuugggaggcugaggcagguggaucaugaggucaggagaucaaggccauccuggccaacauggugaaaacccaucucuacuaaaauacaaaaaguuagcugggcaugguggcucgugccuguagucccaguugugcaggaggcugaggcaggggaauugcuugaaccugggaggcggagguugcauugagcugagaucgugccacugcacuccagccuggcaacagagcaagacacucugucuugcucuuuaaauacaaauuaaaauuagccaggcaauggugcgggugccuguaauccuagcuucuuaggaggcugagccaggagaauugcuugaacccaggagguggagguugcagugagcagaggucgugccacugcacucuagccugggcgacagagcgagacuccaucucaaaaaaaaaauacguuccuuacugcaguuaaaguauggaguugauuuauuuacaaauuuucaggaacauauuucucauauaaagguugauuuaucauuuguuuugagcuuuauuuaaaaaccauuuauuaauuuguucucucuuaccauuuuucacugaaaucucguuacugaacuacaugaguaacauaugaaaaaacauauccggggaaaaagugaugaggcaccaagguuacacauaacuuauguuagagccaaacuuaguucaggaaaaacuacaucaagugcacaaaaagcuuacugguaaaaauaaccaugaaguauuuugugugugagucaucuagagguaguucucaagcuuuauuugagcauaagaacagcuguauguuucccaacuccacugccagagaauuuugauucaucuggauauuuuaaaaguugacggcaggcugggugugguagcucacaccucuaaucccagcacuuugggaggcugaggcagguggauugcuugaggucagcaguucaagaccagccuagucaacauggugaaaccccaucgcuacuaaaaauacaaaaauuagccgggcgugguggcaggugccuguaaucccagcuacucgggaggcugaggaaggagaaucgauugaacccaggaggcagagauuacagugagccgagaucgcgccacugcacugcagccugggugacagagugagaguccaacucaaaaaagaugaauaaauaaaaguugaucauaaugaacaccugggguuaagaaccaccggucuaaaagauuguuacaauagucuguuuuagaaacacucgugaauuggccaguugaaaaugaauuuuuugagacagagucuuacucugucgccuagccuggagugcagugguguaaucuuagcucacuguaacccccaccucccagguucaagugauucucgugccucagccuccuguguagcugggauuucaggugcccaucaugacgcccagcuaauuuuuguauuuuuaguagagaugggguuucaccauauugaccaggcuggucuugaacucuuggccucaagugaucugcccgccucagccucccaaaguguugggauuacaggcgugagccacugcaucaggccagaaaauaaauuuuaauguaaagaagaugucacuuuuuuuguuuguugagauggagucucacuauguugcccagguuggaguacaacggcacaguuucggcucacugcagccuccaccucccagguucaagugauucuccugccucagccucccaaguagcugggacuacaggcaugcaccaccacacccagcuaauuuuuguauuuuuaguagagacaggguuucaccguguuggcuaagcuggucucaaacuacugacuucaagugauccgccugccucagccucccaaagugccaagauuacagaugugagccaccgcaccuggccaagaaaaucucacuucuguuuccgucuucauuggaagauggcuuaauaaaaguuacuacugguaggcugggugcaguggcucacgcuuguaauccuagcacuucgggaggccgaggcaggcggaucacaaggucaggagaucaagaccauccuggcuaacacagugaaaccccgucucuacuaaaaauacaaaaaauuagccgggcaugguggcaggcgccuguagucccagcuacuugggaggcugaggcaggagaauggcaugaaccagggaggcggagcuugcagugagccgagcuugugccacugcacuccagccugggggacagggcaauacgccaccuccaaaaaaauaaaaaauaaaaaaguuacuacugguauuuuuuaauuuccuagaagcauaauggccacauuuauuuaaauauuauuaguaacccuuagccuuaaugugcuucuuacugacagcguugcauauuuaggaguaagaaguuuuuccucgguaaugcuguucaguuuuucuucaugacuuccaaauauggcaccaugugugcacuucugauucuuguaagucucuuccgaguuuugucaaguuucaguuuguuccucuucaaguuuccuguguaggagauaggacaacuuccuuuaugacuuaaagcauauauuuaauauuuuaaaagagaauaucauuaaugcaaaucugacuuucuagaaucuuauaggcuguuuucccaucucguaaucaggcagcuaaccucugaucuggaagugaggucaucugacacaaguuuaaguuggcugccauguuaugagagucaacagaaaaacuacauaauuagauuucccuugaugauauuuauuuugaaaaaagcgaucugugguuuuagcuuauaauuuucuauguguggucacuuacagguguaaaauacuagacagacaucuggcaauauuguccaagaaacaccucgagaccaaauuuuugaagcugaauguggaaaaagcaccuuuccuuugugagagacugcauaucaaagucauucccacacuagcacugcuaaaagaugggaaaacacaagauuauguuguuggguuuacugaccuaggaaauacagaugacuucaccacagaaacuuuagaauggaggcucgguucuucugacauucuuaauuacagguaacuuuuaacaaaagaagagauugauuuuaauucauauauaguugauauuuuuacaaaagauuuuuguauuguaacauuuauuuuaugaaauuaaggcauuuuggcugagauguggaaaguuucucaaaggaaaagcauguuuuuuugaaguguguaauauuagcgugauuuuacggcaaaaucagauuuacagauuaaacugauuuaauagguaaaacugagucucaccguacuccugacuauaaaaguuuucagcuuaacguauacuauugacacuaauuuuguauuaaucuggaaacuuaaaauggcaauccaguguugacuauuccccaauuuaagccagauugcucaaaugaauucugacuuaagugauucucuuugauaaaauaaaaauuaaaagcagacucuugcaaagaaaguuauauuuuaaaauacuagauuuuuaacauggauauuucuguuuuacuuauagaggcugaugaauagaaaaagguuucuaugccuagcuuacauugcuugcuaugaagaacaguuuuaguuugaaaacaaucuaaaauccaacuuccauuucuuuguccacuucuucagacaaauaauuuaucuaauuccacaaaucagagcauaucaucuugucuuuuuugccuuuucuugauuugcaaaaguaacagguaaaauugugcacuuaccauuccagagucauggugccuuucaggaaguagaagguucucucacguuuuucuuucucccccauuucccucccgucuuuucucugacucuccuagacaugccgaaaucauuccuauguuguagaaauugguuucauuuccuuaauauuaacauaaaauauuaauauuuauuaaauaaaguuauauauuuugaaguaauuuuaagccuuaaacaaauugcagccggguggggcacuuguguaaucucagaagauuacagacuuugagaggcugaggugggagaaucaguugaggccaggaguuugagaccaauuugggcaacauauagugagaugagaccucgucucuacaaaaaacuaguagaaacaacccccugcagacuaguacaacgaauccucauugacccuuugcccauauuacccaauuuuaaacauuuuauauuuguuuuaucauugucuuuauagauacuaugaaguauuuugggaaccauuugaguggaaauugugaauacagugucccuuuacuccuaaagacuuccauauauauuuucuaagaacaagaacauuuucuuacguagcgacaguacaauuauugaaacaggaauuauuguguaauuuaccgcucuuauuucaaguuuucucauugucccaauaauuguccuucauaccaaaaaugcagcacauuuaguuauuacgucuuuaguuaccauuguuauucuuugguucuuaagacugauguuuuugaagaguacaaacuguuuauuuuggagaacaucucccaguuuggguuugucuuaaauuuccucaagauuagauucagauuaucgauuuuugacgggcauauuauggaagugaugcaucauaucgggaggugugugaugguuucucucauuuccggugacaacugagcacuguguuaaccaaauguuaauccauaauuaaugauaaaaaggaaaauaggucuggugcaguggcucauaccuauaaucccagcacuuugggaugccaaagcaggaggauugcuugagccuaagaguucaagacaagccugggcaauguagugagaugucaucacuacaaaaaauguaaaaauuaacugagcaugguggcacacgccuguaguccaagcuacucgggaggcugaggugggaggaucgcuugagcccaggaacuggagguugcagugagcugugaucacaccacugcacaucagccugggccacagagugagacccugucucaaaaagaaaggaaaauaaaauugaucuaaaacauucaguaggacacaauaagguuuaaggcuauuaaccaucaauaucaauauaagcauuauaccucuucccugacaccagcauuuuaaagaaauuuuauucuauguuacaggaagaaaacaaagauagauuuuugugcaguuuaguauacuaguacuaaaucauaaagaauaaaaugcuuuuuuuuuuuuuuaaguggaaauuuaauggagccaccauuucagaaccaaaagaaauuuggaacaaacuucacaaagcuggaaaagaaaacuauccgaggaaagaaauaugauucagacucugaugaugauuaga

SEQ ID NO: 14925 - RNA, 4538 nt, Homo sapiens
auaggguuggguucugacgugaaggcuuuccccuuccaugggacacuuaaccagacacaggacacaacaccugaggugaaauuucaauggguauuaagucugggguagagcuucucucuccccaaaucuagcuuccaaagauguggagcugguggagcuguccauugguccacugcccuguuucuccugggugcugccucugccuccucauaucaccagcguccccacugccacuagucuguagggggauuccgggcuaggugcucuucccacucgacuucaaccaacuuauauagcuccaugguggccugggcaucuuccacagaggaauguccgcucuucccaaccugagcaagcaaggaagacaagagcaugaagagaaaagaaaccguuucuuccuucccaguguacucucuguacuccucuucccccugccuccgcuacacaguuucuucugcagucagcagccuacaaagacagaauucuggugggguccuacuccuuauguaauuucagggguucaacuccuaggaagucuuugccacugucuaccucaguccuuucuguggcaguauguauaagccauauuagguucuguagagauagaacauaccaggucaaagacaggucuucugagucuuccacuuucccuaguuccuuaacugcucuauaugugacauauguccccaucuuccugccagaugggccacccuuugcugaaauauagcguguaaaauacgagcgguccuugcauccacuacacggucucuuggaccaccacugcuaccugcuuucuuccuuaguuaggguuuuauaucuacuuaggacuuuuucccuuuuccaaagcacacuuugaaacauucuaugagguagacaacaggaauuauuauccuguguacagauggagcucuucccaucacagcagcccaccuggaucucuacaaccacaggacuucugagaucagagucuggcuaggggcaucaacgagagccauguccaagaugggggcgggggauguggggagaugcuaccuggauaucccgguuuagcagcuucuuggugagaugcuucagagacaugguggcauucuccgggcagucagccuuccgguugaggggggggauaugggaggugucacgggugagggacuuggggugaaaguacugaagggcuuugaagucguuguggauggcaugccccaccacuaucuucccugugaguaucuucaagaucuggaagaagugugggaagagaguggugagaaggaagacugaaguggaaccccugcauucugaaagcccaacaugaccaucaaucccuucuggauucuuucaccaacugccuaccucuccauccuugaaaugcucacucccacaaguuuucuuucuucuggaauccaccuuccucuuccacaggugauuuccaugguauacccuguuuggacucauacugccaguggcuccuuaccuucuuauugaucuccaccccaugacauuaauuugccuucaguccuaaaugacacucauguuugagauguccauguauuuaguucaguucuggcuugcuacaugaaguccuuuaacuauuaccauuauguuggccuuagacacauggcugggacccgggcuccagggaggcuaacaaaagcccaaaauuacaugcaauuagauguguauggguacuagaggaagagaaucuguggcuuucaucaaauucucagagucuacaaaccguaaaaaauuaagaaucacauauaaacuaaaguugcagaagcaaccuuauucacacuaguuuuggaaccaaguaaaauaaaaauaacuucucaauauuucaggaaacuguuuuuuuuuuuugagauggagucuugcucuguugcccaggcuggaguguacuggcgcgaucuuggcucacuacaaccuccgccucccggguucaagcguuucuccugccucagccucccaaguagcugggacuacuggcaccugccaccaugccuggcuaaguuuuguauuuuuaguagagacggaguuucaccauaugggccaggcuggucuugaacuccugaucuugugaucugcccgcuucaggcucccaaagugcugggauuacaggugugagccaccacaccuggccuucagguaacuuauuuuuuaaaagagaugaggucuugcuauuuuucccagguuggcuggccucaaacuccugggcucaagcaaugcucucaccucaaacuccugaguagcugggauuacagacacaugucaccacaccuagccauuucaggcucuugaaguaggaggacaugcuaccaaugaggacaaccgaagaacacaccacaggcucugaaggccauucccaaaugagguuccaaacagguuuucaacaaaagugacaguccugcauagccucccaaagggacccccucugaaggggcuaggcucaucuggacauaccuuagucucauaaccccagcuuggcacuggggaagugcuuuaugaugaaaaccagacguagucccgugaacuagauauuucguuacuccugacuucaccuacuuacuguccaccaccaccuucacuucuuauuaaccucgacauauagcccucaucaaagcugggcagauuugcugucucagacccgucccaucuucugccucuccuaugccuuugcuuggcugcgccccuuugugcacaagauguuuaacucuucuuuccgucuuuucuaaaauagucagucaccucaccucuaacgaaccuccuccaacugaccgcauauaaggcauuaugggaacagcguguccagagagggcagaguguggaccugaaacugcaaagacguggaccaagggcgcccucuggcggccuccugagaccagcaggucucuugcucucccuucacuuccucuuucaccccucccagcucacucuccuuuccguucaugccuugcgcuccauggccagcacagggcuaggagugagaugacaacccgaagugccggcccugugccguuuaugccguucacugguuaccuguuccaguuggacaauauauaccccagcuccuccugucaacuuucugcccucucuuaccaccaccacuuuccgcacuugccccaggcuacuuuuugcuugggacgagcucuccaccuuuccucucucaagcuuaggcuccaacucgcaagguuuuuccaaaucaagcccuuucuccugacacuggugucugcagcucugucuaguuucaucacuugcuguuauuuuucuaugcagauucccaguuccccagacccaauuuagaaccuaaaauaguuuuuuuguuuguuuuuuugagacaggaucucacucugucgcucaggcuggagugcaguggcaguggugugaucucagcucacugcagccucgaccuccugaguagcugggacuacaggcauguaccacacuuggcuaacuuuuuuguagaugaguuccgcuauguugcccagacagggcuugaguuccugggcuugagcgauucucccgccucagccucccaaagugcugggauuauaggcaagugccacugcgcccggcuaaaauagaucuugaccaaugaaguuugugacaccagcuaauuguaccuuccugacuuucacugcuucuuccaccgacagggggccuucuucaacaacugauagauucuccucccucccuccacaaacguuggugucuucccauagugauauccuuugcugaaaaaugauuuagaccucucuccauccaccucccugccaccaucaagccccaugcuucuuaccuggccucgagcaaucuugaaggguguggcauucaccaugugcugcuuccggauaccacuccaccugguucgguaguccacaauguggcaggggggaagaauguacucgucauaaagcacaucuccguuguaguugacaaugcuacaucgagccaaggaacuaacaugccccuuugguccugugcccaccaucucacagucaauugccaccaucuuccguggcaacuucugggaugcuccggagcauuuauucucugaaugagcuuggguggaguucuguggggcauucuucugaggaugguucuuuuuagaggauuucuucugggagcucuucuucugagagcggguuggguggcuauugaucuuuggaagggcacucuggaacucccccagcaaaucuacuuuagcagcaacagaaucagccuuuuuugaaggggcaggggucaaccaagacacugcagcuuucuuguccaggggcuguccugacccauugcuggaagcagcugucuucuuuuuugggaaggaaggggucuuccaagugccaucgaccguaggaguuuccccuuucuuugaagguucagagugcaacuuaggcgccuugcuaggggguugguucuuuuuacucagaaagccucuccguucuaagagccuccgcuucuugacaaaauuucggugcuuggcauuuccuucuaaugccuuuuugggaggagguuccccaaaauccagauugagcaguaaaguagacaua

SEQ ID NO: 14926 - RNA, 1791 nt, Homo sapiens
ucuucuacuagcauuccaggcagcgcuuucuagucacgugagggauaccuaaccacuggaacuaaauaagaugugggggaacaacugaggucaucaccuaaauugcuugauacucucuuuuccagaagacgagcccccuuucugaguuuauggcagaaagugaaucccucccucccucccuuccuuucuuuuucuguaagacgguguuucgcucuuguugcccaggcuggagugcgacgccgugaucuccgcucgccgcaaccuccgccucccggguuagagcgguucuccugccucagccuccagaguagcugggauuacagccaugcgccaccacgcccagcuaauuuuguauuuuuaguagagacaggguuucuccauguuggucaggcuggucucgaacuccugaccucaggugauccgcccgccucggccuccugggauuacaggcgugagccaccgcgcccggcuagaaagugaaucauuucuauauuugauuguacgugaagcccucgguaguccuuacugacaucaugucuccuuuagacuuugauuacacuccguguccuucaucugacuccucucuucagauuccugagucacgcucuguuuauguugcuguucaggagcgaacugcggcaccgcccaaacacugugacgccagcgcgggaggagggccgcgggaggggcagcggaacgcgcagagggcacggugcaagcacgggacagcucugcauuggccaaagggaucccaggaggccuggcccucuuuucuccugaggcuggaucccaaccagcaggaaaaggcuggauuuucgccuuuuguauuuguuuuggggcccaaccaagaaaaacaguggagggggaauaaaacauguuuaaaucuuuuuuuugucuuaaaaccaucuuuaauuucacagucacaaaauaaaacauaacucgaauguuuugauguuugcagugacaucgauugugaaaaagguuagccagaaaggaaacgcagugagacagagcgcucggccacccccugcccugggcgccuggcgcauggggggcggggcggggcucgcggggugacgucacagcccgacgcgccacccagcuguuuuugugcucccagcucuagcgaaaagccgccgguauuucuccaucuggcucuccucuaccuccaggcaggcucacccgagauccccgccccgaacccccccugcacacucggcccagcgcuguugcccccggagcggacguuucugcagcuauucugagcacaccuugacgucggcugagggagcgggacagggucagcggcgaaggaggcaggccccgcgcggggaucucggaagcccugcggugcaucaugaaguuccaguacaaggaggaccaucccuuugaguaucggaaaaaggaaggagaaaagauccggaagaaauauccggacaggguccccgugaguguagaggagcggaggggaugggaggggaagggcccgcgggggcgggggcggguagucgagauggcuucccuggggcgcccaggcggcucuggagaagggagguuccgagaauuacuuaauccugaacgcccuucagugccagagccaauggacguccagacuguagagcuuuuaaaaccccguaugccugggccccgaaccccacuucagggcugacggcguuuugggggccgagccgccgucuucagugacucagcaacccacacacggucucagcagcugagaccguguguggguugcggugcacaaaauagggccccugugggcgagacugguua

SEQ ID NO: 14927 - RNA, 10639 nt, Homo sapiens
ucgcggggugacgucacagcccgacgcgccacccagcuguuuuugugcucccagcucuagcgaaaagccgccgguauuucuccaucuggcucuccucuaccuccaggcaggcucacccgagauccccgccccgaacccccccugcacacucggcccagcgcuguugcccccggagcggacguuucugcagcuauucugagcacaccuugacgucggcugagggagcgggacagggucagcggcgaaggaggcaggccccgcgcggggaucucggaagcccugcggugcaucaugaaguuccaguacaaggaggaccaucccuuugaguaucggaaaaaggaaggagaaaagauccggaagaaauauccggacaggguccccgugaguguagaggagcggaggggaugggaggggaagggcccgcgggggcgggggcggguagucgagauggcuucccuggggcgcccaggcggcucuggagaagggagguuccgagaauuacuuaauccugaacgcccuucagugccagagccaauggacguccagacuguagagcuuuuaaaaccccguaugccugggccccgaaccccacuucagggcugacggcguuuugggggccgagccgccgucuucagugacucagcaacccacacacggucucagcagcugagaccguguguggguugcggugcacaaaauagggccccugugggcgagacugguuagaucggggccauggauuggcugccuuuaagaacgcagggacauugugcugugcggugagguuugcgcaaacccagucgauuucugccuuggcugguucuccuuuaaugaaguugacuuuggcucucauaucauuggucuugggacgaaaagguucagaagcuauucaguaauuuucuugcauuacaggggguuaggggagcacaagacaguccuggccuggaaaacaaggucacguucucugcccaacagcccucuugccucaucguucuaggcuccggggcuuguguggggacagccagccuccucguguugauuucugaucaccugguaccuggucgcgauaaggcaggacugagacguuuuuucuccguuuuggacaccggcuuaaguaguuaaaacuaccgcaggcagugaguaggaacagaaaaguauuagguaucuuucagcauccgggcguuuuccccauuacccccucccccgcccacuugccugguguuucucuaaugcaggcugcgcagccgaauuggagggcagaauauggcuuaagugguagggggaccagcagcuguuggauuuuggaaauggaggagcggagauuuuaaaauugugcucuuuaucuucagguaggaacauuaguauuacgugucacauaaugguaaaauaauugcuguuaucugaugucuuuucuugacucacagccacucuggguuucuucucuaauccuuaccuaacguucgugguuuuauagcuaccagaagccaccagggccuuagcccagcaguagaaaccucuuguaacccuuuuccuuuaaaaagaaaaaaaagucauuagggcucuucauuccccaggaauuacaaaaagguuuucagcuuauagaggggugagcuaaucccuuacucgggaaaggauccuuuacaaauuacuuuccugguuucuggaccuuggauaccugaaaauuuugcccaguucuggugauaccaaucuuuugagcaaugauauuuaaaaaauacaaucaaguuuuauugauaguuuacccuagcgguauuauaaguacucagucuguaaucauugacuuacuuccuuacacgauuacccguucuacagauggaguauucaaagcacaaagaaaugcaguaacuuccuaaagguuucacauugcugaucugugguugagcuggaauuccaacccugucugaaggacuguggagcucucggguaucuuaaccuccaugccauauuguuucucaguuucuaauauaguuguauuaaccagaauuaaugacgugcuguggacuuuacacuguuaaguauuggaaauagauaaauauuuaugugcauucacucugaauauuuuagagcauucuguucuuuuccugcucauaguuugguguuaaauguuuuacuccugugauaauuuuuaagccauuaagccugucacucagauuucagcuuuccuaggguuauguuuuaaccaguggugagcugcucccaaggugaccagucugugaccuucuuucuaguuaugacgcagguuccuugauuugguucuaguucugggaauucauugcauccuugggcagaacucuuaaucgugcugugcuagagugucuuguuuacagaaaagaggguuagaguaaugauuccugaagcccauuccagcuugaccauugguguuauuaaagcaauggcguacccugacugcucgcauaaccagaacuuagccccaccaauauuucuucagagccagcguugaaaagaagaggugugcuugugccuucagagaggaaggguuggugggaucuugaaauuaucuucaaagauacaacauaucaaaaaaacuguuaggaacagauugucuauuuuaaaaauucauaacccuacugaguauuagucacauuuuacaaaugaggaaaacugagacccaaagaggcaaagcaucuagcccaggggucuaccauagugaggaguagagcugggauuccuggaaacuuaaccuugguacugggaaaccaauauuuuaaugauuaccccucccccuucucuuccucuccaaaccccucccuucccuccagguauugcccucugcuuuaucacuuucuuuaucugucuuccuuugugguuuuuaucucuuacugcuagguguccgaguuccuuuggggcacaaugcuagccucuuucugccuuuuccuuuuaauuccuggcuuacguuacccuauuucaguuuuuauuuuuaaauuuaaaaugugaucaugucccucuggucuuccugguucaggauuuuuucuacaagaacacaaaacaacuuuuuguuuuguuuuguuuuuguuuuuguuguuuuuuuuuuuacuaauuuuaauuuguuccuuuuaauuuaaaaaguucaaacucccccccaaguuaauuauguuagauaauucuuuauaauuuaugaagcauuuuccuguaaaauguuauuuauuacucacauucacaucauaucaauaccaugacuuuguuaaagacguguuagaaaguuuucuuuucaagcugggcacgguggcucacaccuguaaucgcaguacuuccggaggcugaggcggguggagcacuugaggucaggaguucgaaaccagccuggcaucauggugaaaccccaucucuacuaaaaaauacaaaaauuagccgggcgugguggcaugcgccuguaaucccugcuacuccggaggcugaggcaggagaaucgcuugagcccaggagguggagguugcagugauccgagaucaggccacugcacgccagcccgggcgacacaugugacacucgaccucaaaaaaaaaaguuacuggaauacugaagcugagagagagguuacgugaccuguugaagaucacacagccacuagaaguacucauacaguuuuuuuuuuuucugcgucuucacuuuuuuuucugcauuucccauauguucuaacuaaaaugacuauauuuucuuuucuuuuuuuuuuuuuuuuuuugagaccgaguuuugcucuuguugcccaggcuggaguguaguggcacgaucuuggcucaccgcaaccucugccucccagguucaugcgauucuccugccucagccuuccugaguagcugggauuauaggcaugcaucacaaugccuggcuaauuuuguauuuuuaguagagaugggguuucucuauguuggucaggcuggucucgaacucccgaccucagaugauccgcccgccucgaccucccaaagugcugggauuacaggcaugagccauugcgcccggcaaugauuauauuuucuaaacuaaaagucuaaagcucaugauuuuacaauagauauuuucuguuugguaaguuuuaguguauuaaaaauaucuuuuaaauuuugauaaaucuaguacagaaauacaugauuuuuuuacaacuugaacuauagaaguauauaacguagacauaaaucccuuaaaauccuaacaaucgaaagccuaaagcucaugauuuuauaacagauauuuucuguuugggaaguuuuaguguauaaaaaaaucuuuuauauuuuuauagaucuaguacagaaauacaugaucuuuauuagaaguauauaauguggacauugaaaaucccuuaaaguccuaacauaaucaauaucuauaaauggcuuguugugcugacaucauauuauaggauaucauugucagacuuguuuuaacacuguuucuuuuccauuuaauaauguuugaacaaucuuuacaguucuuggaaauuuugacaaagauuuaaaccacguuauugguaccuuuaauaaaugguauuuaugagaaauaauaacuuacaggugaucaggaccauaugagaaaacccaguuuucuugaugcucuaauuaaauaccagaagguggccaggcacgguagcucacaucuguaaucccagcacuuugggaggccaaggcaggcagaucacuugaagucaggaguuugagaccagccugcccaacauggugaaaccgcaucucucuuaaaaauacaaauacuuagccaggcguuguggcaugugccuguaaucccaguuacucaggaggcugaggcaggagaauugcuugaauccgggagguggagauugcagugagcugagagggagccauugcacuccagccuuggugacagugagacuucaucucaaagauaaauaauaaauaaauaaauaccaauagguauauguccuauaguagaucuuacagguaaccuguaauuacuuaaaaucaaaguucuuuuuacuuuucaucauauacaaucucuaguuuauuuuuauuuuaguaaugcagcuauaaccucaugaagccuauuuuuuuuguauaauuuuauaagggguggggggauaagaaaugaaacagguguccugggccuagacagauucauuuccaguaguaacuaggcaacucuaggguguagaaggaaaaauacuagauugccuucuguaguuuucauuccuacucuccuccucuucuuccaggugauuguagagaaggcuccaaaagccagggugccugaucuggacaagaggaaguaccuagugcccucugaccuuacugguaaugcucuuugccuucccugacccuuccuccggugaaaaaacucucuagauccucauuacaugcaugagauugugagauugagaggcaguacauacuugaaggaagugagugggaugcucuggaguuaucugauuaaaaaaugacucaggcugggcgcccuggcucacgccuguaaucccagcacuuugggagacugaggcggguggaucaugaggucagaucgagaccauccuggcuaacacagugaaaccccguuucuacuaaaaaaaauacaaaaaauuagcugggcuugguggcgggugccuguagucccagcuacuugggaggcugaggcagaagaauggugugaacccgggaggcagagcuugcagugagccgagaucaugccacugcacuccacccugggcaacagagcgagacucggucucaaaaacaagaagacucaauaguucuuucccaucaccaugucuuguuggauuuugacacagcaaagcauaagacauugaaagaaaggaucagaugcccauuauuuaaaccacuuuuauuuuaauuaauuaauuaauuaauuaauauuauuauuugagauggaguuucacucuuguagcccaggcuggagugcaguggcaucaucuuggcucacugcaaccuccgucuccuggauucaagcgauucuccugccucagccugccgaguagcugggauugcaggcaccugccaccauacccggcuacuuuuuuugguauuuuuaguagagacaggguuucaccauguuggccaggcuggucuugaacugcugaacucaggugauccacccgccuuggccucccaaauugcugggauuacaggcgugagccaccaugccccaccuaaaccaauuuuaaaauucagcuuuggcugggggugguggcucacgccuguaaucccagcacuuugggacggggaugugggcagaucaccugaggucaggaguuugagaccaggcuggccaacauggugaaaccaugucuucauuaaaaauacaaaaauuagcuggguguguuguugggcaccuguaaucccagcuacucaggaggccaaggcuggagaauggcuugaaccugggaggcagagguugcagugagccgagaucgcaccacugcacuccaggcugagugacacagugagacuccgccucaaaaaaacaaaaaacaaaaaaaaaaaaccccaaaauucggcuuuguuaauugugauaucaauuuguuccaaaaagaaaaccagucuggcuucuugagaggauuauauuuuagaguuuccugauuaaauacaucuucuuaagcuacauuuuuuuaaacuaaguuuuguagauuuuguuugagauuauaagacauauauucauuguugggugugguggcucaugccuguaaucccagcacuuugggaggcugaggcggguggaucacaaggucaggaguuugagaccagccuggccaacguggugaaaccccgucucuacuaaaaauacaaaaguuagcugggcaugguggcgcgugccuguaaucccagcuacucgggaggcugaggcaggagaauugcuugaaccuggggagguggagauugcagugagccgagauuucgccauugcgcuuucagccugggugacagaguagaacucugucucggaaaaaaaaaaaauacauauauucagucuucaucgugauccuuaauggaauacacacugcauccaggacacacuggaaagauuuuguugauuugcuccagaguuaauagguuugaauaucagccaucuagaaaauuuucaguauucucaaguaaaggcaaagcauugaaccuuguuuaaugccccaacacugaggugacugacugugcuaagaugaccagaguccaguggaccccuuuccauugcuaaguuuuucuuagggagggucuggggauggaaagaguuucaagucagguuuagacagugaugggaauguuuuggucuggaugcacaugguauuccuucaacguaguccucaggcuuugaguggauaugcuaacaugaggucugagauugaauaagaggggaaaggaggaauaaauuccacuauggcaagucagggacugugugggcuuccgaguuucccuuuuuauuuugaaagcuccaggccgguauuuggcucuucucagaugguauauaaagcugguacugacucuaaggugaaaaaaugcaauugaauuuuuuuccaggacuuacccuucuacuaauuccuuguuuucuuacuuucuuuucugcccuuuucuucuuccaucauccaguuggccaguucuacuucuuaauccggaagagaauccaccugagaccugaggacgccuuauucuucuuugucaacaacaccaucccucccaccagugcuaccaugggccaacuguaugagguaaugguucugguugcacaauacuggaugccguccagugcagucuggcauccucuagcccuuguucuagaugcguugauaacacaucugagaaguggggcagaagguguuauuuauccggauccucuuacauauggcaguguaaggcucugagagauuagauaccucuuguuuuuuagggauuagccacucuacuagauuuaauccuucugaaaucuugucugacuauagucuugucugacuauaguguuuuaaugcuggacuguuuauugaaacagcaggaagugauuccugauagcaaaaguuccaaagcgucagcccaucgcaguuccugcuauucugguugguagcauguaauuuguaaugcauucagaauccaguucauuauuuuacucccauuuagcaacagauugagaaagcacguaauaguaaagccagcuccuucuaacucugaggccagccucugccaacugaaggauucuccccacagucagcuucuucuaugaacucugaaguuuuggcuuaagacaaccacauugauacuaaacaaggggaaacuuuucuuagaacaaaacuaaaacugugaaacagauuccacauuaucugggcacaaugaaucagauaaaaugaaauauaaaauuaaggcaaagucuguaaauggauucaugucuuaacagauaaacucaggaggaauaauuuuuaugugaugugguuuaauuggaagugucagaaucugaggaaacuauagugaaggacuuuauuauuacugaaaauauaaccugggauuauaacuauuguuuuuugcaguauuuugcauaagaugcuuccuucucauugugcuccguuaaugaauuacguaaacuucuaauaauccugaaucuuuuuuugcauagcauauauucccuguuaguauaugucccauuauauauccaucugugguaucuauguuccccuugcuaggagugagcucuuuaagagugaggacugugcccuagucaucuucauaucccugauaccuauguguaauauguuuucaaugaaggauuuuuguuugugaacucagagcucaaaguguaauuccaaccacuucucccuauccuuugcuccucuuuuaaauggggacuaaugauaccuuccauaccugcuuuacaagguugugugaggcucagcaucuuagagcuaaugaaugaauauguuuucuaaacuguugucuuaucucuuccccuaggacaaucaugaggaagacuauuuucuguauguggccuacagugaugagagugucuaugggaaaugagugguuggaagcccagcagaugggagcaccuggacuuggggguaggggaggggugugugugcgcgacauggggaaagaggguggcucccaccgcaaggagacagaaggugaagacaucuagaaacauuacaccacacacaccgucaucacauuuucacaugcucaauugauauuuuuugcugcuuccucggcccagggagaaagcaugucaggacagagcuguuggauuggcuuugauagaggaauggggaugauguaaguuuacaguauuccugggguuuaauuguugugcaguuucauagaugggucaggagguggacaaguuggggccagagaugauggcaguccagcagcaacucccugugcucccuucucuuugggcagagauucuauuuuugacauuugcacaagacagguagggaaaggggacuugugguaguggaccauaccuggggaccaaaagagacccacuguaauugaugcauuguggccccugaucuucccugucucacacuucuuuucucccaucccgguugcaaucucacucagacaucacaguaccaccccagggguggcaguagacaacaacccagaaauuuagacagggaucucuuaccuuuggaaaauagggguuaggcaugaaggugguugugauuaagaagaugguuuuguuauuaaauagcauuaaacuggaauugacaagaguguugagcaucccugucuaaccugcucuuucucuuuggugccccuuaucucaccccuuccuuggaauuuaauaagucucaggcauuuccaauuguagacuaaaaccacucuuagcaucuccucuaguauuuuccauguaucaggacagaggugucuuauguagggagggggcaaguaugaaguaagguaauuauauacuacucucauucaggauucuugcucccaugcugcugucccuucaggcucacaugcacaggaaugcuacaugauggccagcugcuucccuccuugguuaucauccacugcagcugcuaguuagaaagguuuggagggaugacuuuuaguaaaucauggggauuuuauugauuuauuuucacuuuugggauuuuguggggugggaguggggagcaggaauugcacucagacaugacauuucaauucaucucugcuaaugaaaaggguucuuucucuugggggaaaugugugugucaguucugucagcugcaaguucuuguauaaugaagucaaugccaucaggccaaggaaauaaaauaauugcuuaccuuaaaaauccacugaguucagcaauguugccuuuauuuuguauguauuagaauagaugauauguggacucucugaacaaaagaacuaaguggggaaagcuguuagugaugaauguucacauauggucagacccauauauguuuacucaguucuuuagugagcaggaguugcuguucaagggugaauguuaugcuggggcagugugccugcugcguugguggugugugugugugugugugugugugugugagagagagagagagcuuuuucuccuccaaagauaagugcaucgucacuguucuauguguuucugaaagcugaagguggaagacugccuacguagagguaaggggugg

SEQ ID NO: 14928 - RNA, 10639 nt, Homo sapiens
ccaccccuuaccucuacguaggcagucuuccaccuucagcuuucagaaacacauagaacagugacgaugcacuuaucuuuggaggagaaaaagcucucucucucucucacacacacacacacacacacacacacaccaccaacgcagcaggcacacugccccagcauaacauucacccuugaacagcaacuccugcucacuaaagaacugaguaaacauauaugggucugaccauaugugaacauucaucacuaacagcuuuccccacuuaguucuuuuguucagagaguccacauaucaucuauucuaauacauacaaaauaaaggcaacauugcugaacucaguggauuuuuaagguaagcaauuauuuuauuuccuuggccugauggcauugacuucauuauacaagaacuugcagcugacagaacugacacacacauuucccccaagagaaagaacccuuuucauuagcagagaugaauugaaaugucaugucugagugcaauuccugcuccccacucccaccccacaaaaucccaaaagugaaaauaaaucaauaaaauccccaugauuuacuaaaagucaucccuccaaaccuuucuaacuagcagcugcaguggaugauaaccaaggagggaagcagcuggccaucauguagcauuccugugcaugugagccugaagggacagcagcaugggagcaagaauccugaaugagaguaguauauaauuaccuuacuucauacuugcccccucccuacauaagacaccucuguccugauacauggaaaauacuagaggagaugcuaagagugguuuuagucuacaauuggaaaugccugagacuuauuaaauuccaaggaaggggugagauaaggggcaccaaagagaaagagcagguuagacagggaugcucaacacucuugucaauuccaguuuaaugcuauuuaauaacaaaaccaucuucuuaaucacaaccaccuucaugccuaaccccuauuuuccaaagguaagagaucccugucuaaauuucuggguuguugucuacugccaccccuggggugguacugugaugucugagugagauugcaaccgggaugggagaaaagaagugugagacagggaagaucaggggccacaaugcaucaauuacagugggucucuuuugguccccagguaugguccacuaccacaaguccccuuucccuaccugucuugugcaaaugucaaaaauagaaucucugcccaaagagaagggagcacagggaguugcugcuggacugccaucaucucuggccccaacuuguccaccuccugacccaucuaugaaacugcacaacaauuaaaccccaggaauacuguaaacuuacaucauccccauuccucuaucaaagccaauccaacagcucuguccugacaugcuuucucccugggccgaggaagcagcaaaaaauaucaauugagcaugugaaaaugugaugacggugugugugguguaauguuucuagaugucuucaccuucugucuccuugcggugggagccacccucuuuccccaugucgcgcacacacaccccuccccuacccccaaguccaggugcucccaucugcugggcuuccaaccacucauuucccauagacacucucaucacuguaggccacauacagaaaauagucuuccucaugauuguccuaggggaagagauaagacaacaguuuagaaaacauauucauucauuagcucuaagaugcugagccucacacaaccuuguaaagcagguauggaagguaucauuaguccccauuuaaaagaggagcaaaggauagggagaagugguuggaauuacacuuugagcucugaguucacaaacaaaaauccuucauugaaaacauauuacacauagguaucagggauaugaagaugacuagggcacaguccucacucuuaaagagcucacuccuagcaaggggaacauagauaccacagauggauauauaaugggacauauacuaacagggaauauaugcuaugcaaaaaaagauucaggauuauuagaaguuuacguaauucauuaacggagcacaaugagaaggaagcaucuuaugcaaaauacugcaaaaaacaauaguuauaaucccagguuauauuuucaguaauaauaaaguccuucacuauaguuuccucagauucugacacuuccaauuaaaccacaucacauaaaaauuauuccuccugaguuuaucuguuaagacaugaauccauuuacagacuuugccuuaauuuuauauuucauuuuaucugauucauugugcccagauaauguggaaucuguuucacaguuuuaguuuuguucuaagaaaaguuuccccuuguuuaguaucaaugugguugucuuaagccaaaacuucagaguucauagaagaagcugacuguggggagaauccuucaguuggcagaggcuggccucagaguuagaaggagcuggcuuuacuauuacgugcuuucucaaucuguugcuaaaugggaguaaaauaaugaacuggauucugaaugcauuacaaauuacaugcuaccaaccagaauagcaggaacugcgaugggcugacgcuuuggaacuuuugcuaucaggaaucacuuccugcuguuucaauaaacaguccagcauuaaaacacuauagucagacaagacuauagucagacaagauuucagaaggauuaaaucuaguagaguggcuaaucccuaaaaaacaagagguaucuaaucucucagagccuuacacugccauauguaagaggauccggauaaauaacaccuucugccccacuucucagauguguuaucaacgcaucuagaacaagggcuagaggaugccagacugcacuggacggcauccaguauugugcaaccagaaccauuaccucauacaguuggcccaugguagcacuggugggagggaugguguuguugacaaagaagaauaaggcguccucaggucucagguggauucucuuccggauuaagaaguagaacuggccaacuggaugauggaagaagaaaagggcagaaaagaaaguaagaaaacaaggaauuaguagaaggguaaguccuggaaaaaaauucaauugcauuuuuucaccuuagagucaguaccagcuuuauauaccaucugagaagagccaaauaccggccuggagcuuucaaaauaaaaagggaaacucggaagcccacacagucccugacuugccauaguggaauuuauuccuccuuuccccucuuauucaaucucagaccucauguuagcauauccacucaaagccugaggacuacguugaaggaauaccaugugcauccagaccaaaacauucccaucacugucuaaaccugacuugaaacucuuuccauccccagacccucccuaagaaaaacuuagcaauggaaagggguccacuggacucuggucaucuuagcacagucagucaccucaguguuggggcauuaaacaagguucaaugcuuugccuuuacuugagaauacugaaaauuuucuagauggcugauauucaaaccuauuaacucuggagcaaaucaacaaaaucuuuccaguguguccuggaugcaguguguauuccauuaaggaucacgaugaagacugaauauauguauuuuuuuuuuuuccgagacagaguucuacucugucacccaggcugaaagcgcaauggcgaaaucucggcucacugcaaucuccaccuccccagguucaagcaauucuccugccucagccucccgaguagcugggauuacaggcacgcgccaccaugcccagcuaacuuuuguauuuuuaguagagacgggguuucaccacguuggccaggcuggucucaaacuccugaccuugugauccacccgccucagccucccaaagugcugggauuacaggcaugagccaccacacccaacaaugaauauaugucuuauaaucucaaacaaaaucuacaaaacuuaguuuaaaaaaauguagcuuaagaagauguauuuaaucaggaaacucuaaaauauaauccucucaagaagccagacugguuuucuuuuuggaacaaauugauaucacaauuaacaaagccgaauuuugggguuuuuuuuuuuuguuuuuuguuuuuuugaggcggagucucacugugucacucagccuggagugcaguggugcgaucucggcucacugcaaccucugccucccagguucaagccauucuccagccuuggccuccugaguagcugggauuacaggugcccaacaacacacccagcuaauuuuuguauuuuuaaugaagacaugguuucaccauguuggccagccuggucucaaacuccugaccucaggugaucugcccacauccccgucccaaagugcugggauuacaggcgugagccaccacccccagccaaagcugaauuuuaaaauugguuuagguggggcaugguggcucacgccuguaaucccagcaauuugggaggccaaggcggguggaucaccugaguucagcaguucaagaccagccuggccaacauggugaaacccugucucuacuaaaaauaccaaaaaaaguagccggguaugguggcaggugccugcaaucccagcuacucggcaggcugaggcaggagaaucgcuugaauccaggagacggagguugcagugagccaagaugaugccacugcacuccagccugggcuacaagagugaaacuccaucucaaauaauaauauuaauuaauuaauuaauuaauuaaaauaaaagugguuuaaauaaugggcaucugauccuuucuuucaaugucuuaugcuuugcugugucaaaauccaacaagacauggugaugggaaagaacuauugagucuucuuguuuuugagaccgagucucgcucuguugcccaggguggagugcaguggcaugaucucggcucacugcaagcucugccucccggguucacaccauucuucugccucagccucccaaguagcugggacuacaggcacccgccaccaagcccagcuaauuuuuuguauuuuuuuuaguagaaacgggguuucacuguguuagccaggauggucucgaucugaccucaugauccacccgccucagucucccaaagugcugggauuacaggcgugagccagggcgcccagccugagucauuuuuuaaucagauaacuccagagcaucccacucacuuccuucaaguauguacugccucucaaucucacaaucucaugcauguaaugaggaucuagagaguuuuuucaccggaggaagggucagggaaggcaaagagcauuaccaguaaggucagagggcacuagguacuuccucuuguccagaucaggcacccuggcuuuuggagccuucucuacaaucaccuggaagaagaggaggagaguaggaaugaaaacuacagaaggcaaucuaguauuuuuccuucuacacccuagaguugccuaguuacuacuggaaaugaaucugucuaggcccaggacaccuguuucauuucuuauccccccaccccuuauaaaauuauacaaaaaaaauaggcuucaugagguuauagcugcauuacuaaaauaaaaauaaacuagagauuguauaugaugaaaaguaaaaagaacuuugauuuuaaguaauuacagguuaccuguaagaucuacuauaggacauauaccuauugguauuuauuuauuuauuauuuaucuuugagaugaagucucacugucaccaaggcuggagugcaauggcucccucucagcucacugcaaucuccaccucccggauucaagcaauucuccugccucagccuccugaguaacugggauuacaggcacaugccacaacgccuggcuaaguauuuguauuuuuaagagagaugcgguuucaccauguugggcaggcuggucucaaacuccugacuucaagugaucugccugccuuggccucccaaagugcugggauuacagaugugagcuaccgugccuggccaccuucugguauuuaauuagagcaucaagaaaacuggguuuucucauaugguccugaucaccuguaaguuauuauuucucauaaauaccauuuauuaaagguaccaauaacgugguuuaaaucuuugucaaaauuuccaagaacuguaaagauuguucaaacauuauuaaauggaaaagaaacaguguuaaaacaagucugacaaugauauccuauaauaugaugucagcacaacaagccauuuauagauauugauuauguuaggacuuuaagggauuuucaauguccacauuauauacuucuaauaaagaucauguauuucuguacuagaucuauaaaaauauaaaagauuuuuuuauacacuaaaacuucccaaacagaaaauaucuguuauaaaaucaugagcuuuaggcuuucgauuguuaggauuuuaagggauuuaugucuacguuauauacuucuauaguucaaguuguaaaaaaaucauguauuucuguacuagauuuaucaaaauuuaaaagauauuuuuaauacacuaaaacuuaccaaacagaaaauaucuauuguaaaaucaugagcuuuagacuuuuaguuuagaaaauauaaucauugccgggcgcaauggcucaugccuguaaucccagcacuuugggaggucgaggcgggcggaucaucugaggucgggaguucgagaccagccugaccaacauagagaaaccccaucucuacuaaaaauacaaaauuagccaggcauugugaugcaugccuauaaucccagcuacucaggaaggcugaggcaggagaaucgcaugaaccugggaggcagagguugcggugagccaagaucgugccacuacacuccagccugggcaacaagagcaaaacucggucucaaaaaaaaaaaaaaaaaaagaaaagaaaauauagucauuuuaguuagaacauaugggaaaugcagaaaaaaaagugaagacgcagaaaaaaaaaaaacuguaugaguacuucuaguggcugugugaucuucaacaggucacguaaccucucucucagcuucaguauuccaguaacuuuuuuuuuugaggucgagugucacaugugucgcccgggcuggcgugcaguggccugaucucggaucacugcaaccuccaccuccugggcucaagcgauucuccugccucagccuccggaguagcagggauuacaggcgcaugccaccacgcccggcuaauuuuuguauuuuuuaguagagaugggguuucaccaugaugccaggcugguuucgaacuccugaccucaagugcuccacccgccucagccuccggaaguacugcgauuacaggugugagccaccgugcccagcuugaaaagaaaacuuucuaacacgucuuuaacaaagucaugguauugauaugaugugaaugugaguaauaaauaacauuuuacaggaaaaugcuucauaaauuauaaagaauuaucuaacauaauuaacuugggggggaguuugaacuuuuuaaauuaaaaggaacaaauuaaaauuaguaaaaaaaaaaacaacaaaaacaaaaacaaaacaaaacaaaaaguuguuuuguguucuuguagaaaaaauccugaaccaggaagaccagagggacaugaucacauuuuaaauuuaaaaauaaaaacugaaauaggguaacguaagccaggaauuaaaaggaaaaggcagaaagaggcuagcauugugccccaaaggaacucggacaccuagcaguaagagauaaaaaccacaaaggaagacagauaaagaaagugauaaagcagagggcaauaccuggagggaagggagggguuuggagaggaagagaagggggagggguaaucauuaaaauauugguuucccaguaccaagguuaaguuuccaggaaucccagcucuacuccucacuaugguagaccccugggcuagaugcuuugccucuuugggucucaguuuuccucauuuguaaaaugugacuaauacucaguaggguuaugaauuuuuaaaauagacaaucuguuccuaacaguuuuuuugauauguuguaucuuugaagauaauuucaagaucccaccaacccuuccucucugaaggcacaagcacaccucuucuuuucaacgcuggcucugaagaaauauugguggggcuaaguucugguuaugcgagcagucaggguacgccauugcuuuaauaacaccaauggucaagcuggaaugggcuucaggaaucauuacucuaacccucuuuucuguaaacaagacacucuagcacagcacgauuaagaguucugcccaaggaugcaaugaauucccagaacuagaaccaaaucaaggaaccugcgucauaacuagaaagaaggucacagacuggucaccuugggagcagcucaccacugguuaaaacauaacccuaggaaagcugaaaucugagugacaggcuuaauggcuuaaaaauuaucacaggaguaaaacauuuaacaccaaacuaugagcaggaaaagaacagaaugcucuaaaauauucagagugaaugcacauaaauauuuaucuauuuccaauacuuaacaguguaaaguccacagcacgucauuaauucugguuaauacaacuauauuagaaacugagaaacaauauggcauggagguuaagauacccgagagcuccacaguccuucagacaggguuggaauuccagcucaaccacagaucagcaaugugaaaccuuuaggaaguuacugcauuucuuugugcuuugaauacuccaucuguagaacggguaaucguguaaggaaguaagucaaugauuacagacugaguacuuauaauaccgcuaggguaaacuaucaauaaaacuugauuguauuuuuuaaauaucauugcucaaaagauugguaucaccagaacugggcaaaauuuucagguauccaagguccagaaaccaggaaaguaauuuguaaaggauccuuucccgaguaagggauuagcucaccccucuauaagcugaaaaccuuuuuguaauuccuggggaaugaagagcccuaaugacuuuuuuuucuuuuuaaaggaaaaggguuacaagagguuucuacugcugggcuaaggcccugguggcuucugguagcuauaaaaccacgaacguuagguaaggauuagagaagaaacccagaguggcugugagucaagaaaagacaucagauaacagcaauuauuuuaccauuaugugacacguaauacuaauguuccuaccugaagauaaagagcacaauuuuaaaaucuccgcuccuccauuuccaaaauccaacagcugcuggucccccuaccacuuaagccauauucugcccuccaauucggcugcgcagccugcauuagagaaacaccaggcaagugggcgggggaggggguaauggggaaaacgcccggaugcugaaagauaccuaauacuuuucuguuccuacucacugccugcgguaguuuuaacuacuuaagccgguguccaaaacggagaaaaaacgucucaguccugccuuaucgcgaccagguaccaggugaucagaaaucaacacgaggaggcuggcuguccccacacaagccccggagccuagaacgaugaggcaagagggcuguugggcagagaacgugaccuuguuuuccaggccaggacugucuugugcuccccuaacccccuguaaugcaagaaaauuacugaauagcuucugaaccuuuucgucccaagaccaaugauaugagagccaaagucaacuucauuaaaggagaaccagccaaggcagaaaucgacuggguuugcgcaaaccucaccgcacagcacaaugucccugcguucuuaaaggcagccaauccauggccccgaucuaaccagucucgcccacaggggcccuauuuugugcaccgcaacccacacacggucucagcugcugagaccguguguggguugcugagucacugaagacggcggcucggcccccaaaacgccgucagcccugaagugggguucggggcccaggcauacgggguuuuaaaagcucuacagucuggacguccauuggcucuggcacugaagggcguucaggauuaaguaauucucggaaccucccuucuccagagccgccugggcgccccagggaagccaucucgacuacccgcccccgcccccgcgggcccuuccccucccauccccuccgcuccucuacacucacggggacccuguccggauauuucuuccggaucuuuucuccuuccuuuuuccgauacucaaagggaugguccuccuuguacuggaacuucaugaugcaccgcagggcuuccgagauccccgcgcggggccugccuccuucgccgcugacccugucccgcucccucagccgacgucaaggugugcucagaauagcugcagaaacguccgcuccgggggcaacagcgcugggccgagugugcaggggggguucggggcggggaucucgggugagccugccuggagguagaggagagccagauggagaaauaccggcggcuuuucgcuagagcugggagcacaaaaacagcuggguggcgcgucgggcugugacgucaccccgcga

SEQ ID NO: 14929 - RNA, 24315 nt, Homo sapiens
uaaacauucuguccucugaaggguaaaaauuuuauuuuugaggaauuucuuacugcacauuuucaaagagagucacauaagaaagcaaaaauguuauccuccccucauccuagaaauaaauaagaaggacauaaauuuuuuuuuuuuuuaaaucaugacacuuggagguuuagcaccagcauccaaaaugaacaaaaacggaaaaaaaagcauuuacuauauauuucagauuucuuugguugggguucuccccaugugguauuaauauuucuuguuucaauauauauauuaccaaaacaguaaaaaccaggaaaaaaaauagaaaccuagcgguugcugaaacuggagaggcuacucucuugucuuccgugcaggaauucccagguucucagcuugcuggaaaaauuuguugacauuuucuuuuuguaguuguuucuuaaagaauaacaguaaacauuccaauguccaaaucuugguuagucuuccacuuuauugcuuggauguuucuuugguguugguuaagguuguggccugcuuuuugcuuuauuucugaauggucauuaauucuuuaggucaccugggaaaaauuaaaaucaaacuuauaaagagugacaaaguaaccaugaguuaaagaauaaaaaggcagaaauuauaugcuuuucauauaauuagaaaaagaguacuucaaaugcucuaaauacaaucacaucuuguauagaucuguaagcuauauguuaauuaaauggaaacucucacuuuuuaauaaaguauuuuuauaaaccagaaaagucaguacauaagagcaaaaauuuuauaaaauuguauaaaagaaaauuaccauuacuaaugaacaauacucaaaaucauuuuaguggcugcacccuaucuccuaauaugaauauaucacaauuagcuauuuaccaaaugucagacagacuguaaauuguaaaaauauuuuuucccaauauuuaaaauuauuuccuuagaaacaauaccuagaaauaauguuacgccauaaaaggguauggccauuuuuauauuauuaauauguuacucugaaucagcuaauuccaaguuugaauagggaacuuauuucugugacaaacuguccaugcuacccaagauaaaacagaauauuguccucaaagugaaugcuuaccuaauuaauggcugauuaaaaucccacaucacuggauauaaaagcagauggccuuaagacacaagaacuuauaauaaucccaaaacuucauugaugaaauuuuaacaauuuuugaaaaauagcauugacacugaguuuacaaccucucucuuaacuaaaagcuaauggaaagggugauaaccaagaaguauaagaacuaaagucucaguuaaaaggguuauagguuaaaaaaaaacaaacccagaauuuauaauugaguugaucuuucuggcuauaauucuauguaaauaaaauguccaagaccuuuaaaagacagaaaaaaguagaaaaugacaagaaaauaacaagcuauccuuuuacgagagguuauucuuuaccauacccuauuguaaacacucccuguuauuucacuuaauaauccuugcaacgacccuaguaaauauaauuaguauccuaauuuuuaccaguagcagauaguacugagacagaggauaaacugcucaagaucacccagcaaaugagagguacaguagagccugcaauggguagauaaaccuuggcucuuauacacuaugcugcaccgccucaaaauaaauaaaguugauuaucaaagaaaaagggaaggaaaaaaaauccuuuaguuuauucuacuguuucugauuacuaaacagguucugaaacuguuucugauuacuaaaaccaggccuuuguuagggacuuuuagcaucaguuuuccuaagugguacuaguaguuaaaaaacugccugucuagaaaaaagaaguugaguaucaucaacucugucugaaugcuuauacccucaccaaagcuuaucaaaaugaggucaaucccagaaauauuuaaccaccaaaucacuuuuuccacagagucccaauagagacaagggguuggcacagaugaacugcagaacuaguuuagacuaauuuguacucuuguugagaaaccagugauacuaaaaagaaaauaccaacucaagacugggcugccccagcucuuaccugccgauggugaaggugccugaggagccugguguuacucagcacugcucugcuggguggguggagcaggguucucaguuggugcuucaccugccuuggccuaaaaugcaaaacaaagccauaaaucagauaaagucagaugacaguggaaaguucaagacugaaaguucuuaaaaguuugaauuuuccugugaaggaaaauuagcaugcaaaaauuuaacuacucuuaaguaugagucacaaauuaguaccauauucagucccuggcaucucuaccaaaacaaaacgaaaccaaaaccucacaaaaacaaaaaacaaaacaaaacaaaauuaguaccauauaagaacagcuuacaaaacggcaacuaaauaccacuacucuccauaaagucugauauacaacugcuuucaacucaugcuuagaggcagcuuccucuugauaaaugccucucuucuuugaagaaccccaaauguuuuagcucugaauccccauuaauaugggucauucuuucagagaauguuaacuggauucaaauauguggucuguguuauguacaaggcauacccuauauauauggaucuugagcaaaauguuuuuauauuuguuaagugucagguuucaugugauaaaaccacuuuuagaaugcuaaagucugacaugauuaaagacuaucuggcaacauccgcccugacugguuggauuuaccucuuugccaucuugugaaggagcguuaggaggacgcgggcgacgccgguaauuguagggacgccgguauccacggcgaacagacggcugguuuggaccacugguggcuugcugauuuucuuuaucuucagccucuccaacugcuggggcaggucgugggcgaggagguccccugcuguagggaacacagaagaaaauagaacaggugccaacaggacagggcuucuccagaaaauaagguuuuauuuauuuuuaaaaauuaaaaagucaagugaucagggccaggcaugauggcucaccccuguaaucccagcacuucaggaggcugaggcaggcggaucacuugaggucaggaguuugagaccagccuggccaacauggugaaacuccaucucuacuaaaaauacaaaaauuagccgggcgugguggcacaugccuguaaucccagcuaccugggaggcugaggcauaagaauugcuugaauccaugaggcagagguugcagcaacccgagauuggcacacuccagccugggugacagagggagacuccaucucaaaauuaaaaaaaaaaaaaagucaagugaugaguacuuauugcuagaauuauucgcaggucaaugcaacaaauggaauagagguuucacgaaaaaaaaaucuuaauuuuccaucauuuuccccuuucauuugaauacauauuuguaaggaacauacauauacugaacacauacucuguuccuaucaggcccuuugauaagcacuaagaauaggaaaauuaaaaaagaaaagaagaguagucugguaucugccuuccaugaacagaauuuagcagagacuaagggaauuaaacaugagaagaaacauuauuaugugccagagccugugcuagucgguuuuaaaauuaaauauuuaauuugaaugguaauucuguggaugagauuuauaacaagaaaaccaagagguuuacaugauaaaguauacggcugagcuauauaaaagugcugcuuuuauagguuaaaaaaggucaaauaugacuuuccaagaucacauauccagggacugacaaagcugagccucacacgcuacugaauccuuuuuguuccaguaagacauuucuaugccgucucuuuuauuuucaaagucccuaguacuuaaucauuagugauuaugccuaaagcuggagggaaccuugugaagaaaaaggauacgauccuuuuacaauuauauugguggaauccuuucccaauauaauauacuuuuuauccuucaauaaagccauacugacaaauuucaagguagcauaaacaucauucaggaagaaguuguagcuuuuccacuuaccacaaaggguaagauaaaagaaugggcaggcuuauauuauaaaaugcuucaaagggaucuuauggaaggagucuagccuaauucagucuuccaaaggaauaaagcacaaauagaauaacccagcguucacuaauauuaaccucaauggugguaauaauaucuaauacauagugaggccuuuacuuuaucagguaccacacuaauuaucuuagcugcauuaguaccuuuaauccccaacuauagaauaucucuuuguuuucagacagggucucacucuguugcgcaggcuggaaugcaguccaagaacauacaucuaaugaacuguagaguaggaagauaaauucaggcgauuugaucauacccugauuuaaccccucuacuggacugccucagugauuaacagucacuaucccaaauauccucugacacucaauucuuccuccaucugcagcauuaccacagaauugcccaccaauaauuuaucugauuuauuuugauaaaaauuaaguauuaauuuacaucuuauuauaauuccagaauacaaaaugacgcuuuggcgcagagauaacuaaaaauucuaguauuaaguaggugggaaaugucacaccaccaccugaaaacucuggcauguagucaaagcauucacaucuucuagauauauaauaaauccacaaaacggaaccacacaguccucauucuaccauugugcacacaaguccuuuaacuggccauuaguggaaaaugcgacauaccuacgguaccuugggcgguaaguuggauuucgaugaaccggucccugaaguugugcucccucugggacuccauccuucaucucuccaaucucaccagccuggagaggcaaugagagcugacagugagugucacagcacaggggauaagauacagugcauacagcuauguucagaauuuuuuuuagaaguaaaaaacaaaaugcuucauuacaaaauuaggcacucucaguugcaacacaaacuauuuaugaguaaaucuucgugaacgacugaaaaggaagacaaaccuagucugacuagaauacucauuugcuuagucccagagcaccuaacuuuauuuucgccuaucaauuuaacauuuugaaaucggauacauuucauucaucucuuuaaauaaaauacucuuuuauuuuucuuuacaacaaacuuacuuuaagccaguggaauaaaauuaacuuauuguacaacuuccaggggaaagaaagaacaacuuaaaaaaacaaaaaaacccaccaacaaugucugcaauucuugaccauacagccauaacucaacuuucuuuucuuuucucaaaacaucccuuccucccccuaagagccaaauacuguccuucauuauuucaucaagaaagagaaacagucagaagacaauuuccacguucucauuagcaaaucuacccagcucccuguauuuacauuagaauuuucuucucucccauuacccuggguaagugguccaaguucauaucugaaaccaacagccucucuauucucaucaacuagacacagcauguuaacgcuaucccuucacuauguuuucaccuuuucuaucauuuccauccaagcauauauacccagugaaauagcacccauccuuuucaauuuuuuaaaauuuugaaauaagcacaaaguuacagaaaaguuaaauguaauucucagaucccauucaaguuucaccauuuaucccaaugaugcccuuuauagcaaaaacaccguuuagaauuaugcacuaaaguaaguuauaucuuuuuguuuggagcaguuuuuuuuaauuuauuuauuugagauggagucucacucugucgccaggcuggagugcaguggcgcgaucucagcucacugcaaccucugccucccugguucaagcgauucuccugccucagccucgcaaguagcugggacuacaggcaugugccaccacucccagcuaauguuuuguauuuuuaguacagacgggguuucaucauguuggccaggauggucucaaucucuugaccucgugaucuacccaccucagacuuccaaagugcugggauuacaggcaugagccaccacguugguuuucaugacccugauacuucuuuaaagauuacaaaccaguuauuuuguaaaauaucccucaacuuggguuauugguguucacuaaugauuagauauuguuuuugcauccccagggggaugucacaaaagugacacugcauucuccucacugcauccugucagguggcauauaguuucaauuugugccauuacugauaauguucacuuugauaagugguuaaggugguaucugccaccagaguccuccacuguaaguugacucuuuccuucuuuguaauuaaugaguacuuugugaggaaguacuuacaaagugcauaaauauacuauucguuaucaaauuuuucaauauauugguuuauuuauuuauauuuguauggacucaugguuuucuauuuuuuucaaugaguuguaaucuguuacuaucauuacuggccaaugggaaccccuucaagcuggcucauauccuauugauguguuuccaacauucuuugaguacuucuucgcuuucuggcacaacaagauguuccaggcucauauuauacuuucucugucccagcucugaaaucagccauuucuccaaagggaauucuuuuuguuugagaauguuauuuaaaaacaaaaaauugggggacagguaugcucaaugcuguuacuaagauaucacggcuuucaggaccuuucaguagacagaaccauggaacacacacacacaauguuacacauauaugugugucuauguauguguguauauauauauguggguuuauggcaaacacacgugccuaccuugaucugcccauuuaauggcuuuagaaguuguuggugagguaacggguaagggagagaccagggguaacucugcauuguaaaaagcaaaucaaaucaagcaaaaaucuugcucugaucccuuaucuucuuccagcuacuaccccauuucuuuacagacauacauacuaaagaaaaaccaaacaccaugaccaccacuacagaaaccucaauggggaauaugucuccucuucccgcccuuugcuguuucuuaaguucauucuauuuaaacuuuugucuucaccaaaccacugaccuccaaguuaccaaaucuaauaaucaauucucagcuuaaucucuacuuaucaacaagcauuuaacacauuucuuucuugaaauacauucuccuuggcugcuccuucucacuguccuuugcuagacaauccucaucuuccuaaucuuuaaucguuggugugucccagaacuugauccuaggacccuauuuccaccuacacucacuuuauaguuaauaucauccugccccuacggcuuuaaacauccuguuuuauaacuccaaaucagccaggagcgguggcucacgccuguaaucccagcacuuugggaggccaaggcagguggaucacaaagucaggagauugagaccauccuggcuaacacagugaaaccucguuucuacuaaaaauacaaaaaauuagccaggcgugguggcgggugccuguagucccagcuacucaggaggcugaggcaggagaauggcaugaacccaggagauggagcuugcagugagccgagaucgugucacugcacuccagccugggugacagagugagacuccaucucaaaaaauaaauaaauaaauaaauaaauaaauaauuccaaauaauuauuugcaguuccauuucuccccuucagacucccauucacgccuuuccugggaccugauggacuugaucccuugcuccauuuaggucucuucucaaauacaacuuaaugaacucccaaaaauguugucaaccacuguaucuaagacuacaccuuccauccuccagccacuuucuaccucuucccucugcuuuauuucuucugccuacuuaacaccuccacuuguacgugaauuuaauaugagaaaaagaccuccaaagaauuuucaccuuucccuccaaacccaaucuuucuucaguauucccguauuuguuuaaaucaaaacugcagagguauuauuuacuccucauacaauauauuaccauuccucauacucuucacucaauccaucaugaaaugccaacaccucuauaugcuuaaaacauuuuccaaaucuaaccauuuaaucagaccuuccacugccagcuucucuaauacaacccauguucauuucucuacugaaaagauuauagcagcuguucucccugcuuuuauacucuuaccuccuguggucuagucccaacaaaacaguccaauaaucucuucaauguuucuuuucuguugagaucccuuuacuggcuucucaucacauuuacaguaggucaagucuuuacaguggucuaccagcaugucugaccuccccugagaucucaccucauacccucucccccuucauucacaucauccccaucacaugagccucucuuuaguuuccuaaguaagcucggccauuucuuccucagaaacuguugagucacaaaaaaagacugacagaaacagcaauuaacguguauaaaggaugagagucugccagaaagacuggaugacaagaacaaaaugaauuaaaauuaaguucuaccacuucuuguccauguaaaauaaaaguugcugauuuuuaaaaguaaucaaauuccuucauuugugacaacaacaaaaaauauggaaaccacugcuucccucaggcucuagagacaacuaaaguaagaaccgauuccaaauaucugucaccugguagaugccacaauguugcucccuucccuccaucauauaauuauuuucucaaagacaacaagcacauaguagcucagugaaugauucuacuuaauuuucaaaucuauagaacuauuuucuuuaaaaauggaaguuauucagucacuaauaaaucaugcuauauuauguccuuagugcauaaggcaaauaccacuggccuauauauuccuauuuuuuuuuucuauuaugcccaauaaauuucauagcguuguaauaguagaaaacguuggcgaagacuuuuauauuugaucucaauaauuuuuacuauccuagagauccaucuauauauuuuuaagagaacacacugacaaccuugaaguagcuuaguuauauggaugagagcuuuaggaauuuucuuuugaugcucuugacuggcuuaaccagacuacuuagucagagagcuaguagauauuauaaagauuauuaaaaaauaugguuuaaaggaucaagacaacuuuuacuucugacauggaauagguaggaaagucagccauucagucaauuaacuaaaugcaguuaaguuacaggaauaagcguacauguucaaaagcagcuuucgaucagcuucugcauaugauguuuuacguggcacuaaggaacgacuuugcucugaaacuucaauuccuaaggugaaauacauuuuauuucaaaagauaugaaaaagaaucaucaugcuuucagcaaacgugauauauguuguauaagccaaacacuaaggaggaguauuucaggaaagcacuauuaagacgcuaaaaauaagugcauauuacaaucucacugacuuuuccuguccuuguuuccuagaagcccagagugcugcccuaaagcuacuaugucucauguacccaaucucuccauauauguaagucuacuuguuauuuuuagcacauuugucaggggcagcuguugaagaguagaaggaaaaaaacaagaaagaacacagucaugcaugaugggacaggagaaggguagcaaagaacagacugaacauaauguucggucaaaacaucuagcggugaggggaaaaaaaagaaaccccaacgacacugaggagaaaaaaguuguggcuacugauaacaaaaaugaugaucuaucccuaguuuuccaaguucccuaggaacugcaaaauugauguaagguuuauuaagcacaaaacaaacucaaaacagcuguacuaauauucugcagugaaaaaggagaaucaauaaucaacaaccuccauucugguagguugccuuuaaaaaucagcacugucucauuuaaaaccaauacuuuaaaaauguuauuuaugcugcaggcaucucuuuugcuaaauccuuuauauuuaaucaucauaacccuauggugcaggcauuuaaugcccccacuuaauggaugaacuuaaucuaaaacuugguuuucucaaaaccucacaaauaaguagcagaaacaggauucaaauccagccugacuucagaguccaagcucuuacacauuccaccugucuuguuaccuuaauucuuuuguucuucuaucaacuagaaacuuuggccauaaggguucccuauuauaggcauggaucacgugguuuugcuuuuagaaguguuaccggaaugacugcuuugaaaaaacagacugaaggccuugccucagcuuuuguagcaucaggaagccauaagcaagguuucuggcagcugauguuggaggaggaggaggaagaggaggcagagaaggacggaagggugaggauugcugaagagaagucucaguugcaauuuuaccuguauucuguugggaugggguaagacccgugagcgacggucaaaggucugucccacgugguaaggcgggaaccgccgcugccgguacugagggcgauacugggggcggcgcagcugauuccgggccccagagaacugccuaucaguggcaggggggucaaauccuucacugcugccgcucccuuccuccuccuccuccccagcguacuagcgaagcaaagaaacagagauucagaagaaguuuuagcaaggaaagaaccaaagaacaccauuuaggaugaauaucaccaaaauaaaaucuccccaaagcaauauaauccuuuccauuauacagacaaaaugcauuuaacccagauuaucaugugauugccugggauaaacuacauuaagauuagaguagaucugugcagauaaaauaccaagaagcagaaaagcaagagcaaucaaucuacaaucaauuuaauagucaucucauuagaacucguaucagcuaaccaaccacccgaagaguaucugcaagguuuauaauuuuugcuccaucaaaugcgugucucccagcauuuaccauccacugaggcaaugucagggaaaagccaaaaaagaauacauuuuaugauguuaccaacauauuugacccaagugguauucuuccuacaagucuguaaaguguggaugggauuucugaaaacuuccagggggucagcgaggucaaacuauugccauaauauuacuaagaugcuauuugccuuucccaggcauucucucagaaguauaugguggggucucccaaaggcuacaaugacauguggucucucagcagacugaaugcagaaacagaugugagaauccagcuaucuucuauuaaaccauacaucagagaucugcaaaaguauaaagcaauaccacucuuuucaauuuaaauauuuuuuuuccauaaaaacuguuauuuucaugaacauauaguuauuuuuaaucaauuaacauuuuaaguuuauuuuacuuucuaauauaauauuaauauaaauaaacauugacaaaaacucuagaauccucaauaacauguaagcauauaaacagaucccaaaaucaggaaguuugagaaccacugaccuaaggcaugacucccuuuauauguuuaggaguaaagcuuuaaucauacuuugaugguaguaagcccuaauccuggagguuucuaaauaauagaucuuauuaauauucacaaaggaauuuaccgauucauuuuauauuuuucuucuauuuaaauuauaucauauacuaccauuuuacauuuuaaaaaaccaaacauccuacaaagacugugauuucaagucuuacuuuaaaggggauaugcaaaugucuuuaaugggaaguaacuaguuuuuaaaaaugaauaaauaaaaaaagcaaaauaaugacccauuacuuuuuuuuacaggaguguauuuaagcuuuggacccuuccagaacaaguccacaugugcaaccaaacucccccuccaaaaaagccucaacuagucuaacuucaaaaaaaaucaagucauucuacucuucauaaaaccucuaccaaagaugagauucacaauuauguaaacguuuauuugcacagaaaaugcuuaccaaaauauuaagugugagacaacauaaacuguuuuucuucuugggcuuaucuuccucuuuugcauuucacacaaucaaaucuuuaagaguuuuacaaagcauaauaauggcaccagcaaugcugaacacacucuuuugagagauacugaacaaguuguugggacuuagauauuacaacaaaaaagcucauuuauguauacuuuaagaguuuuaacaauuuuguuucuuaagcguuuuaacaauuuuguuucuaaauaucuuuuauaugcaugacuuuggaauuuucagguuuuggacaggaaaagucuuuaagaaaaauuuuucacugaauguuuuucuaccacuuuugcuuuugaauuaaccugggagucaaaauaaucacaguuagcgcucugugacucugaugaacuucaaagagaacaugauguaggaaaugcuacagcagcucauuccuagcuaucccccucauagcuuauuaaaaaccaaauaagauaagcaaaaacaaagaaacaagugggaaguccuaaggaaucugacagaauuaauuugggcaggaugugaugauggcagaauaaggaggaaaagcauuuagguaaacagaaagauauaaagcuaucaaaacauaaagauaggucauucucaaucugcagauauuuaauucugaugaguuuuucuuuggaugagacaggcagucacaauccugugcugacaaacauucggaguuuucuucaaugugccaauaccugguucuaauucuagaaacaccaagaaugauucaaaucuaguaaguuucucaugaccacaaauauacuggguccguuuugggugccuugagaauacuccuauaaacugagccucccaagaaagcuccagccagauuugugacaaacucuuuccccugcauugaaaccaaccuaaagaacuaaaaauccacagaaucacuuauugcuucuuuacuuugaaauaauggaaaaaugcuaugcuaaauaaaacagccucuuaaccaaggcaaauucguuaauaguucuguggccuguacuuuuauugccuguucacaaguuauuucucacucuuucaccaaccaaauuuugauuuucuuagaggucaacagugucggcaccaaagaaugaacaacaagguuaagucaaugauggaaauccauuccccuuugccagugaaugucugugacuagguucuggccagaaaaaagagccaaaugaagagaaaccuuguuaaaaaaaaccucagcacugucucccuuaagucuuccuguuaaaagauaauuaaaugucuauuacuuguagccaaauauauccuaacugauacaacuucugaauggcaagugucuaaugagaccagcggcucuggaaaaguucugagcgcuaaaauuuccccuuaagaguaccguguauacugcuccagugaugggugcaccaaaaucucagaaaucaccacuaaagaacuuauucauguaacuaaucaccaccgguuucccaaaaaccuauggaaaucaauaauacacauuuuaaaaaauaagauaaaaauuuccucuaaagaaaaaauaaaaaucacuuaaaucauuugucuccaggagaagacaaggcauuuaucugcuccaaguacauacacuuaauuccaugcaugaacaauuucucaaucacugguuaaguaacagagacaacguacauuccggggagggccacggcgccuuccauaguagccacgucuguaacggcgccgaucugcagcguaacgacucccuuccacaggaacuccauccgggccagucacauuggcagcuucugcacccugagaagaaaauaaaaagauggccucaaaauuaaaaagaauauacacuaacucaaaaaacagccuuggacugcuagaguauaagacuggcagaacauacuaagaauucccacugugauuuuaaaaacagaucuagguuuuaaacaaagugagcaagguacuucacauccugauuuaaacauauauggcuuguuugcucauacaaccugaguuuugcuuucuugucuaguaaugucaaucgcaaaagcaauguguaaccucuuuaaagaacauaaauuagcaaauauacaacugucaaaguagaagcaaugcuagaccaggaagaauauuccucaaugggaaagacuugagauacuguuauuuuccuagaauguguugaaaccuauguuagucuaggagguaccaagaggacaaucccuauucaugggcucauaugauucucuguccagcacaaagguacugagugaaacuucuccuauuuuggcagcaacaagaagaaagggucuuugaugaauaauauucuccacacauguaguccuucuuuagccuuuccuauuauccuugaaacagauuuagaauucuuauucucauauggacaaauggaaaauguuucaaaaauguuaaaaaaauguagaccaagaagauuucagagaguguauuucacacccuacaucacuuuguaaaacccugaguucugaaaacauacagaagaaaaaucaacccaaaacaauuuuuuaaaaauuggaugggauaucagagauccucacagaguggcaggugcuggugagugauuugaaaaucuaaaagacuuacaagauacccuggggaucacaccgguaaagauaaucacuuaaauuucugcauccaaugaaauaaauuguuuuucuuuuaaaacacaaugguuugagagccauuaggaacaugaccuauggaaugguauauguguauaugggaggagcacauacagggaguuaaccucucauccaguuaauuuauaauucagcugccaugauuagcugccauggcaguugugcuauauguaguuuuagcguguuuuuaaucuuacucaauauuguuuuacuaguaucuauaacagacuaaacacaaagcauaaagggcauuacagacacggaauuaaauauauaacaguauuaaaaacuucuguagcuagucuucaggaaaaucccuuaacuucuuggauucaguucacccggacgaagcuaucuuagggucuaucaggguaccuucagcuucccaaaauccaagccaaacagaaaacaaaaugauuaauauucaauuucgaucuccuuuuauugggauuaaaauauucuuuaccauguauuauuuguagguagaagugcuuacaagucagccugaaaacuuuacuuugauaaaagaaaucuuuugccccaaagcaguuuuucuuuucuuuuuuuuuuuuuaaaaaacggaaucuugcucugucccccaggcuggagugcaaugucucaguucacugcaaacuccaccucccagguucaaacgauucuccugccucagccuccugaguagccggaauuacaggagugcgaccacacucagauauuuuuguaauuuuaguagagacggguuucaccauguuggccaggcuggucuugaacuccugaccucaggagauccgccugccucagccucccaaaguacugggauuacaggugugggccaccacgcccagcugcaaagcacuuuuaauauauuguuaauacauaagauaguuaaauuuuaaucugcauuucgaaauacauaccuuugguauaaaaauauaaauuauuuuuaaauugagaaaucagcuuuucuuuccauaaucagaguugaucauuuauuaaauaagaaauuaaaguaucuuuauugcagaauguuuauaaugacaaugucaaaaauauuucugcuagcugggugugguggcucacaccuguaaucccaguacuuugggaggcugacacagguggaucaccuaaggucaggaguuucaagaccagccuggccaacauggugaaaccccgucucuacuaaaaauacaaaaauuagccgggcguggugguggaugccuguaaucccagcuauuagggagacugaggcagaggaaucacuugaaccuggaugguggaaguugcagugaaccaagaucgcgccacugcacuccagccugggcaagagggagaccccaucuuaaaaaaaaaaaaaauucuguuuaaaagucacuuccugcuauuguacaaaaauuccaaagucaugucaauucauaaggggcugauagauaauuuauugugcaacaguacuaugugccagcacuuugauacccaaccacaauuuccucucaccuucucuccuucaaccacaucaaacucuacaguuucuccaucuccuacacugcgcagauauuuccguggguuauucuucuugauggcagucuggaaagagaacagaaaauuuuauucgauguauauuucaauauuggccacagauuucacugcuuucaaguacaccagagugaacuugaagaaacuguugaccgauucuuauuuuuccaccauucucccacuaaguuggaucuccaacacaacaacaagaaagcacuauaaaacuauauuccacauuacuuccuugauuugugcuauucaucuugacagguggauuaaacagaacauguuuuuucuauaacugcagugugugcagugacuacacacuacuguuacaggcugaucaccugaucauaucagauguauuaauuaccucaaaccauuaagcuucagagauucucugaaucuccggaggaggaaaggaggcagugauaaagaaaaacaaauuaaaaugccaaggggauaaauauuucugacgaguaaacaaaauuaucucaagaaucagaacguauuaguaauaaucuggccuccccccucuccucccauuuugcagaugaguuaacacgaggcuaacaguuaaagugauuuaucugaagucacaaccguaacagccccagggaugaugggggaaguggaggagggggaauucauaucccuguacucuaccuauaugauauuuauucaacuuuucucccaucacacaauucaugucaacaaauccuacauucccugauaauacauuaaaagguuagugaagaugcuauucuucauuaaacaucuacaccuaaauaucugcuuaugaauaggugcugcucucucuuguuccaucaaugaaggcagaaaauaauuccugccaugcauuuccauuucuuuggcugguaucucuaaacaguuaaaggggcuugcguuucuauggaacuaggucaaccuuauuuuauaaagcgauuaagcauguguaauccagcccguccccuaacucugaguaggagggaaaagaaauagugagccaacagagcagagaccucacccauagaggaaaaaaggcaguucaggacaggcacgcagcaugaacauucagccauuccaaaaacagccccucccugccggcucgcucccuuuuuccuguuaaacugggcaagccucaacacauugaggugacucaccacacaaccucacgggggcuggaaucgggucauauacucacaggcuaauaaagccagccaccaauacagcaacuucugaggaccuugacucuagcagucuucagaauucuuacccuaaaaggucuauuaaccucaaaccuccaaguauuauaaacaacacuauuaugacccuaaaagucacuguaucugaacaaaauaaaucuacucaaauuaucuaaaugcaacugagauauauccagucaaguagaaauauaaacaauagaaaccacagcuagauaccacuaucuccaacuccuacggucacuccaauacacacacaaaccuaaacagaaggaaacaaaaacacagaaaaucagauguauucuggauuucugcacugcaagagaaugggcuggcauuaguaccugcugcucuaucuuccuuauuguuauacucugagaacgcauauuucagacaauucacugaaaacuaaauaaacaaaaagaacacuaaggauaguauuccuucucuuaaccuauuuuauaaaggaagucuaggacauauuaauaacagaauaaauaacauccuaggcuaauaaagcaaagaaaaacugaggcaccuauagcagagaagcuccauaucuuacccauuuccucuauuuccugcaaaucuaagggaauuugcagcuuuugaccuggacacguccuaacaugccucauuuaacaagagugagggcuacccugggaacuggaaguuuucucaucuuacuaucugcuucucugcgcuauuuacuucaauugagagcugcucugacagaggagcuuuaaccaauaccuacccaggcagaagccagauuggcuccaggcaaacacuaaggaggaaccacaucaggagaacaggaugcuaaaagggaaacagacuuuucuuuuuuuugcuaaggacucaaaggcuuuaaaaauuagaaaguggucuaaccaaauaucacuuuauacaacugcaaaaauaaaacuauuugaaaacaguuaauaugaugggguagaagaacuuauuugccaaucuuaaaauguggaacugaacuccuguugcaaaauaaaucacagaaagaguuuagauuaaaauaauaauccauaggacuuacuuuugggaaagggcugacagaagauuacacacccucuccucacauagcaaauguaguauuuauaaucccucuuaccugauguacaaauacaucuucuuuggugucauuucuguugaaagacaaaaagcucacaauuaaagguaguacguauguggaaaaacuuaaaagaaccuauguguuaugaauuuaacucccaaguccucaaaacacaacauauauuuucacuuauuuucuacacucaauucagacaccuaaaauccuuguuaaacauuucuaacuccacaggccacccaccuuccuccuccacauugccacagugcuuagauccaagcucacagacucaacauacagaaacaucccguuccucugucucuuucugaaucacaugguguguaaucagagccucagauuuuccucccagcaaaagcaaagcaagacaguuaaaaggacagggcacagcugugaacuaggcucuccuuacacugaaacuuaaaacagccccccacccccaccccaccaaaggagacaagaaauuggaggacuuuaagaaggggugggaaagcaaagaaaaugccgauaucaugugaaaaccucauaauacucccagcaucuuguaguuauguucucauuccuguacgguuaaaaguuaccacaguuuacaguuucuacauaggacuggaccagaagugaguuaaagauccagcucaaugacucacuaguugggugaccuuaggaaagcugcuuaaccaguguaagacuccguuucuccaucugugaaauuauggauauggucucauuuauccuaaggcccuucccauuucugauuuuaucucccccuccuuuucuuccuuaaugacuagauuuuaugaaauaaguuauuuauuaguguccuggaaauguauuuuaaguaauauuuaacaaccaguagcuuagaaaugagaauauuuacagugcuuagaaaccuaaaaaauuuauauaagccauuaaugaaggcuaagggauuuauaacuccuggugccacaauguaaguauaaacuuaaaacaugcaaauauacacacacacauaccgauuuauaaauccauauccauuucugacguugaaccauuugacagugccaaggacuuugguggcuaaaauaggauuaagcagauaaauuaguaucugaccuacagagagauauagcucauaucacuaagaucuugauaacauuagacaaagccuaaacauaccuaaagaaaccauuaaaagcuuaauuccaaaauacuuuagaaaaagaaaauggagcaagccaagaucucauaaggaaauacuuuucagaagacuaaaccuuucuuccuuauucaacuuuucaggaaacucgcaagauaaggagugguuauaagucuauacaauucuguaaucauuaaaauugagaaacacugaaggaaaaaaagaauguucaagaugaauguuccaaguuuuaaccuagacaaauuuuauaaguucaaaauaggagcuacaauaaaagagugaaagaccuuaacacaucacuuucauacuuggaaauauuaggcaaacuuuaaugagaaacaagguggcuccuuguuaacaggcaaucuacaaagacguaaagcaacuuguccagucgccaagugggagcucaucagaggagucaagaauaauuauagaacugcugcugucucaauccaguucuguacuuaccacucugagacgugauauaacaggucuuuucaaaucacaugaugaauuugggcuuguuucuuuguuuaccuugcucucuacaguuuugcgaaucaaacuuaagcauuuuuccauaaaaucccccucuuuaccauaaugguugucucuaccucaugagcaggaccacuucucuacaaugccugauuuuagcagaauugagagaaggaaucuaaacaaaauaaaacuucauguaacuuguauuuuguagguuuauauuuaucucaacuauuucaaauaugaucuuuggaaucaauuaugaaugacaaauucaguacuucuaggaaaugccccugucucaauucaggaagugcaaaaagcaauuauaaagacucaaugaaacaggaaaccugauaauagauuaccuuaaagaaaaaauaaagaaaaaagccucaguagagaaugaaaguaauuauuaacaucaauccauacugucuuuucauaagauacaaaguuuauaauuuccaaggauaaacaauaaggcuucacuuuuaaauucaaaacuaaaauaguaauuaagacuugcucuguuguaggcagggguaguucugaaguuugcuagacugauacacuugggaaaauacuuuagcucucuuuguugggggaaagaaaauccaaaacaaaaaaaacaugucuuuauaucuccaaaguuaugcagucuacacugaugaggcauucuccagcuuuaauuccaaagaucucucaucucuccaaaggagagaucaaacccaggccaucuuacguuugaggccacucugauuggagcagcaaggcaaaggagaaaaaaacaguugauguuuucgaugcaaauguacacaguagaggccuguuuuugauacauuauaugcauuuaagucaggcaauauuccaaauaauaugcguuuagugccucuuuucauuugcccaaaaaauuaauuaccugggaaaauauaaagacuggaacuguuuuuaauaucuagcauuguugaaggaauaaucuugauuaaaaugacaauacuaauaauaaaggaaaaagaugauaaauaauucucaggucuaaccucaauccaagcugaagguuauuuuuacucuccaauguaguuuaaaaaaguuucguaauuccgcaaauacuucuccaaggacuucuuaugaucaaauucauucccacgucuugcuuuaaaccauaaacccacuucauauacacuaaggggaaggguuggggaggaagaccauagauuuccauaacauuuaucagaaggaaaauuuuuuugcacucaugaaaacuauuuuuccuggccuaugugcuuauaaacucaagugaaggcccauuugcaaauacuagaacauauccauuuuagucagcauugugccuaguacaucuuaggcaucuauguguuugcuuggcaaaggaaaggggauggcaggacacacuagacagagacaaacaguguugaggugucacguagaaagggcuguccuucauuuuuagagagacgcaguaagaguggaaagauaaaaggcaucagacucaucaccagggaucugcagaggcaguugcuugaggaaauuaaccuucauuuaucuguuuccuucaucuuuaaagauaguaucugcuuucccaaucucagaacaguacaggauuaagugaaaaaccgcaaaagcuuucuacaaaauaagguaucauuaacaauguuauccuaacacugcuuuggagaacacaagguuuucucucucagacaucuggcagaaaguguuccaagaaauauuugcuagaaacaacaucacaauguacuacugacuagauuuaagcaacuuuuaguccagcaaaaucaggccuauuuuguuucuuaaccuacacagguuacaauuagcauguuguuugguagggacuuaguaaaagcccuagaaaaaaaaaacaagaaaauaguccucucaagguggggaauauugaauacacuucucucacauugcucccucaacuuucuucccaaaggggaaguagggcucagagagaugagacaaacaugccccaccccaaauagugaagaggucuccgaagcauccuacaccaucuguuaacguuccuguuuauaagagcgaacgauauggacacacacccuuuagggagguuauucaccacccaccugcuuugcaagcguuuaagaacucacacaggggcguuacuuacgaaaagaacgcuuguuaugugacuaaaccaacaaccaucacagaaacccuuuccauccacugcccccccaaaucucaacauuucaucuuccuguuucccuuccuacguuacaagugccaagguaacaauguuuugaacuaacgucauacccccacuuccgacaaaguuuuuucagcugcuacaccacgugcguucccacaguccgggaagagggaagcguguagccauugguggacacugaauggcuguuugcagccgugggcacagagagggggaggaagacgugggacuaagacccaaguuucccggagacgauugcaacaucucuuugcuggcauguggccaacaggagcauggcgucuuucccaugcccaugugggaagggcgucagggacagacaccugacccuuccuggcaagaagcuuuucuaucuuucccuccccgucuccuucuagcgcccuccucuuccccaaaggaaaugcucuccuuucccagaucccaagcaaggaccccaaagcgccaggcccacgugucgguccuuccccuacauccaucccuacccaagguccccucucccagacugccucuccuuucuucuccaaacgcaggcauuuuccaccacgcgaauccgcaacagugcccgucugggagacagaaguuaagaccuaaacuuucuggcccggaaccagaagggagaugcacacggccgccaggagcgcagggcgcagcgcgcucaccugggagcgccggcaagggaggcggccagcgcuggggacccggagaccccuggggacccggagaucccuggggacccugugcugucagcgucuccagcccgggugggagauguagcgcgagcugcccacacgugcuccgcggccggcugggcccgccccacuacggcagccccugcccucccuggccugacucaccgagaacuuuuuucuccgcgucuucgcugccggcggcgguggcuaaagaggcggcggccgcggugcccguggcugcgggggccgcguccccaccgggguuuccugcgacgugggcggcgggcgccggggccgcggccuggggcgcaccgcugcccaccgggcucuugggcgcgggguccuggggagccgcggcggccgccuccgucggagccugcgggaggguggugguggugguggugguggccucgcccgccucacucaugccuccuccuccucugcucucgcucaggcgccucgguggcgguuggucggcgguuagcgcggcugguggucgcggcggccggggcucgcucucggggaggccggggcggaucucgcggcgcaggcggcggcggccgagguggggucgcgcggcggaggcggcucgagcuucgugcugcgcgcucucucuugggcuccucgcucgaucuuacugccccaaaaauggccccgcacaaguuuuucuaggcggcgcaccggcccgggagggaagggcgggcgagg

SEQ ID NO: 14930 - RNA, 935 nt, Homo sapiens
cccaaggugucuaugugacucugagauuuuuccuuuucucacagcacuucaauugcugcaguacccucaaagaggcuugcuuuagcuugcuguuuccuagaauuaagauaaaugagugaccccagggauagauggcugugguugucauuccaaacauaagcagcaguuuguuuucucgcacaguaaaacaugauauuucuauggccaugccuauaaaauacaagauaaagaggaugaugaaagauaucaaaacuuucauugccuucacaugagcuucuguguuggagucucucaauccugucacauucgauugcaucugccuguugugucuccaaagggaaaugauuaaaaaaauacauguaauuagggauaguguaaagaagaaaaugacucccagauuuagcaaaaucuguuuaauaaaguauucacuuuuauacauguugagaucccagacugugucauucuucguuuuauaaucauuaagaaucuucgcaauguaugcaaaauuaaguaacgaugaaauaaguaagaauacuaucaugaagggaagaaccauauuuguucugcucuucaaccagagaaauauguaguuggaaaaauuugcuaucuucaggaaauagaagaugcugaggcugguggcaaaccacauacuugauugauuaccaauuacccaaaaguaacuaauauauucaauuagguuaccggaggcauauauauuuggagagaauaucuguauaaauccaucuguaauuauuauccauaucagaaaaauucuugaaauagcuaagccggugagaauaaagccaaucguagauaacuuauucuuggcacagucaaugcaguuuacaaguccaauaaauccauuccccaaaaccccaaacacugacucacuaacuacaacaaaaaugaagaugccuuccacuacacguagcaua

SEQ ID NO: 14931 - RNA, 556 nt, Homo sapiens
gucagggcuccugacuggugaccuguuuugaguagguuucuugcagauacuucuuaaaagcugugggguuuuuccaggguuuggcagcauguguguucaaggggcuaucaauguuggguucuccuaguaggcuggagauggagaguguucuggauggagagcagaaugguccugaugucauacagggcagaccacuuguccuucaggauguccaggcauauguuacccuggguguccacacugggauaguagcagggugugaggaauuucaccugggugcauuguaaggguagucacuggggaacucuagugagagcuuaugcuuauaccucaggucuucauauauuguggcagcugcuccauggauggccccuacccaugugaaaagguggucugauucagggaaggcagaaaugcccuugcugccacacauuaugagucaugagcuccuguuguuuugcccaugggacccccagcggcaccccagcuuggcucugcuccuuugugggaggcugcgaugcuagugguggcugggucgcaauuuugggaggccauc

SEQ ID NO: 14932 - RNA, 740 nt, Homo sapiens
uacuaaauuaacccauuuacucucuuuuccauaugucagcauaaaauaaaagcccaaauucaauaguuuuccuuuuuuucacauauauuuacuucuaaucuggcgcucuuagaaauagacaaguagaauaaacugauacauagugaauaaguaaaagccaagaaacaaguuuauuuuucagagaacuaguuuucugcagguuguugaaaacaccaaaaaaguugcucaauaaaucaauguuggcaacugauuuuuuggguuuucaaacucauacugauaaguuucuuauuuuuuuuugaaggauagucuuuuagacuauugauacagaaauuucacauccauugucuaauacaauccucauaauaaggcaagcguuauuaucucuuuuuaggagcugaaaaaauacaagauaauucagguuaaaugacuuauccaaaguugccauaaggagcagagacacacacagaaaacacaggcuacagcuuugaccccuaguccauuguucuuuccagcuuaaagggauuuccucaaugcagauguuagaucaccuagggaaugggugugggcauggcacugaguugaucagaagacccugaaaccuucugcagaugcagauacagagccugugcucagguaauaccuuuaccacuaggaccuaguuuuucuuccuccugcucuuuucugauccuuuuucuuuagucaauaucuaaaguuuagcaguaacacgaaagauauuacca

SEQ ID NO: 14933 - RNA, 2182 nt, Homo sapiens
aggcagaucucgcgugguuuggugauggccggcuaguaugaagguuuuccguggcguugagaucccacccgcccuuuuuuuuuuuuuuuuuuuuuuuuuuuuuuuuuuuugcugccccaguggauuaggauuagugcugcagucaaaugaaaaagaucaagacaaaaaauuaggcuaauauaacuagccgacaggcuagcggcauuucucuggggccgaggaauuccacgaagaagaucucugcgaggcccagaaggccgcacaacuacuucuucagaaacaaaauuuuuuaaaaaaguaaaaauagaggaagucagccaguuuaucaccuuggaaccagcguuuuguuuggcuuuuccgcuuuucacucuacgaaaaagcccauuggcggcuacccagguuaccguccuguugccauugcgccugcgcggcgguuuguuuaccaguccaggcgaagcgcugugucgcgguucucgccgccccgagcgccuugguuugcucccuugacguguaauucguaaugaaagucauguuuucauuugggaacacggaucggagguuuaaaacuggacaguuuaagugucaacuucagaccaaagaaaauaaugguagggaaaacacuggacacucagaaaucggugccgcgucagagcugucacggaagauguuucuaaugaaccugaggaaaacaauagcaccacccuaaccagaacuaaaaaguggcaagcagccacaguuaaugaaacucauagguggcauuuaguuacuuauuuagaauguaggccuaguuaugguaaaaaugcaaauaagaccaaaccuaagguccucuugcucgagcaaaccucaagcaaaaccuacaugauuuaagacugacucuugaagcgaaguaaaaaaaaaaaaaaaaaaaaaaaagcagccaugcaaaauuugaaacuuggagacgacucuagaagcauuaacccaagaaagcacaagccaacaaacaaauuuuugaaaugguuugaagagcucuucaaagucaguuucagguggcuuagaagaggauguugcuuauaaaaugagaucugauggaaacuuguuuuacagauaugacuggauucguuugaaaacaaaaaaaaaggcaggcaaagugacuuuuuaaaaaguauuuuuauggaaggauuucuaaugauacauuuuaaugugcucaaaaaacaaccuuaaauaacugguagauucagccaaaccuggaucauuguuaucuuagagcuggauaagagcauaaauguuaacaauuuggcaauuuuauuggacucuguuauguuuuugaauggugaauuugaagacuucaacuuguaacaagaaauuuucuaaaaggaaagugggauuuucaagacauaugaaauuaagcagagaauauguauggacaugugaacagauggaaccaaauuuugaaagcuuugcauguguccagcaucggucacagaaaauccuuuuaucucaagaaacuagccucuggauuuucucacguucaauaugauaaaacucaguaaauccagcagcuugaauaccuuuuaacacaaauuuguaccaaaaugagaaguaacuuuaaaauuccgcuccauuaucuagagguacucugacuugguuaagguaaggugaaaaucgguuuuccaagccaguauugaacuggcauuuucaucaugaagaaaaaaaaaaugcagauaaagugaauggguaucuuguucacuuuaaugauuaagacuaacucagaaagcuggcuuacuuugucaaggcaaacaaccaguauuaaacaaacugaauacucucauugcacauaaugagaaggcuugaaugaaaauuaaguaugggaguggaagagcugauaaagaacagugacuucuuugagacuccuaguucauuuacaugugaugaaaauuauaguguaagaauaguaaguugucaaauaaaacauuuuucuucacugaaaaaaaaucuuuggugaguaacagaaacugacugauggauugguaauuuagucugccccgugacucagaaaauauacuuaccaaaauuuccacugucaguagcugaaaaaguuaaucaugccauuucuuuagccaguauucugggcauacuccccugugauuacucugauacuguaaaguaaugaaaaaccugaugccaucuguauccacauauu

SEQ ID NO: 14934 - RNA, 5031 nt, Homo sapiens
ccgugucaaucauuuucuucuucgucagccucccuuccaccgccauauugggccacuaaaaaaagggggcucgucuuuucgggguguuuuucucccccuccccuguccccgcuugcucacggcucugcgacuccgacgccggcaagguuuggagagcggcuggguucgcgggacccgcgggcuugcacccgcccagacucggacgggcuuugccacccucuccgcuugccugguccccucuccucuccgcccucccgcucgccaguccauuugaucagcggagacucggcggccgggccggggcuuccccgcagccccugcgcgcuccuagagcucgggccguggcucgucggggucugugucuuuuggcuccgagggcagucgcugggcuuccgagagggguucgggcugcguaggggcgcuuuguuuuguucgguuuuguuuuuuugagagugcgagagaggcggucgugcagacccgggagaaagaugucaaacgugcgagugucuaacgggagcccuagccuggagcggauggacgccaggcaggcggagcaccccaagcccucggccugcaggaaccucuucggcccgguggaccacgaagaguuaacccgggacuuggagaagcacugcagagacauggaagaggcgagccagcgcaaguggaauuucgauuuucagaaucacaaaccccuagagggcaaguacgaguggcaagagguggagaagggcagcuugcccgaguucuacuacagacccccgcggccccccaaaggugccugcaaggugccggcgcaggagagccaggaugucagcgggagccgcccggcggcgccuuuaauuggggcuccggcuaacucugaggacacgcauuugguggacccaaagacugauccgucggacagccagacgggguuagcggagcaaugcgcaggaauaaggaagcgaccugcaaccgacgguaaugacccuuucccaaccauagaauguguuuggggccccgcuuugccugcuggaggguguuaaccuuagcuugcuuuucggcguauucugauuuagcuuugggagagcuaacuuuauuggucuuagguguucagugcuaccuggcccacugcuugucuguuugugacuuuuaagucagaaacuggagaugguaagauccgauaauuucccuaacuuaauacaucgcggucccucucacuagcaacuccuagguaugugacaaaguugggauguuuaucaacgguccgccuccuggcuagggaaagagcucuggggcggagaaugcacuuucuguuuuuugaaaacaaccucauuuugugcccuuaaaagccacuggggaugacggauccaggauuguggguggagguaguggguuuuucauccccugacuauggggccaacuucugccagccauuguuuuuucuaauaaagauuguguguucuuuuuaaaaauuuccccugcgcuuagauucuucuacucaaaacaaaagagccaacagaacagaagaaaauguuucagacgguuccccaaaugccgguucuguggagcagacgcccaagaagccuggccucagaagacgucaaacguaaacagcucgguggguugaucacuaaaggagcacgcacuggaacccggggccuucagaccucacgauaccugaucuuacugguugcuggcaaauuaaaagcuuaugggguuuuguuuuguuuauacuucgugaggucaaaaaaguagcaauggggaaggcuggggauacgguaauuccucagaguuucuaugcccagagauacuuucucuucaaacuguugaccagagcagcuacuuguaacccaggccccaucggguaggaaggucguuucccugugagucccacuaaaacguguugggagcaauagguucuuugcccauccgaacaagaacuaggguacucccucaguccgaauuaaugagaauuaauuuccuagagguucagcuugagucgguaacagauuuugagccauacauggaaaaauggcaaauacaugauuaaguuucaauuuugagggggaauguuugguagaaauugcucaucuuugguuaugcaagggauuagagaugugaauaggaugguauguuguguucuuugacauuuuaauaaacugucacuuucccuguugucuccuaaguuuggagagagaaggaaccaguauuugcaaaaaccaaauggaaagauaaaaaaguuacuaaaguuucuacagaauuucugguaacacugaaguugcaaagcagaaguuaaauuaacucuugucaguaagcaauccaggaacacgucagccaguguaugcuaauugugccguaacagggugauuuggauauuuguaggggaaauggguaguaaauaucaagacuggugaccguaggucagcccagcacaaaggaaguggagauuuuuccaugcacaagaaucugaucacuguaaauagcuaauuugaauaauucaguccccagauaaccaacauggguugguuauucauaauaaacuacauauuuuaauaguuuauuagcuuccuuuagaccaagacugugaccucuuuauuuucuaaagcacacacguaguuuagcauaugaggcgauaaaauauugauguuaacuuuuuaaauccccaguuauaaaaauuuuaaaauaacagggauuaaggugagauucagguuuguugugucuuuaaauuguauaugugacuucacauaucuuuuucagcgcuuauacaaaacggcacuauagaaccuccauuuuacagcaccauaugaagugggaaaauuaggugaaaauuuuccugaagcaaccuuaacaugcgcagcccuuguugguuugugacuuguggccuagcucaucagaugagccacgagaaucagaccuggauuuugaucuggcccuguucugacaugcaaugaggcauuuguaggauuuaguaauauugcuaguucaaagaauacuagaaauauuaguaagaaccuauucaaaaguauucaugaguauuuucugcauaugaaucaggaauuagaauauuuugaaaaugauguuaauaaaauuuuccucuggaaggccuuuauaauuuuuauucccaaucauuuuucaaauuuagaaaguuuaaucugucacaggagaaaaaaaauuaaaaauuuucaaaaauuuagaaaauuuuuacccguaaguauuacaguuuccuaauuauccuauuuauuucccacuugccuuugaccuagauuauuuagaguaggguuucucagccucugcacuaaugacauuuugggccgaauaauucuguuguaggaggcuguccuguguguuuuagauuguuuggaauuaucccuggccucucacacuagaugccagcaguauccuccucccccagugugacaaccuaaaaugucuccagacauugccaaauguucccuguggggcgggggcaacauugccuacuguuaagaacuacugcucuagaccaaagaacacagcacagaggaaaggaaaaaaaaauccaguuaagagaauguuagguggagaugacuauagucaucaaacuuuuuuccccaucaaguauuuccaagcuaacauagugacaaaauaauuccuguacucuacugguaacguuaaucuagugcucuuccuuuaauucuuccguuuuguuuucuuuugcagaauuaagaauauguuuccuuguuuaucagauacaucacugcuugaugaagcaaggaagauauacaugaaaauuuuaaaaauacauaucgcugacuucauggaauggacauccuguauaagcacugaaaaacaacaacacaauaacacuaaaauuuuaggcacucuuaaaugaucugccucuaaaagcguuggauguagcauuaugcaauuagguuuuuccuuauuugcuucauuguacuaccuguguauauaguuuuuaccuuuuauguagcacauaaacuuuggggaagggagggcaggguggggcugaggaacugacguggagcgggguaugaagagcuugcuuugauuuacagcaaguagauaaauauuugacuugcaugaagagaagcaauuuuggggaaggguuugaauuguuuucuuuaaagauguaaugucccuuucagagacagcugauacuucauuuaaaaaaaucacaaaaauuugaacacuggcuaaagauaauugcuauuuauuuuuacaagaaguuuauucucauuugggagaucuggugaucucccaagcuaucuaaaguuuguuagauagcugcauguggcuuuuuuaaaaaagcaacagaaaccuauccucacugcccuccccagucucucuuaaaguuggaauuuaccaguuaauuacucagcagaauggugaucacuccagguaguuuggggcaaaaauccgaggugcuugggaguuuugaauguuaagaauugaccaucugcuuuuauuaaauuuguugacaaaauuuucucauuuucuuuucacuucgggcuguguaaacacagucaaaauaauucuaaaucccucgauauuuuuaaagaucuguaaguaacuucacauuaaaaaaugaaauauuuuuuaauuuaaagcuuacucuguccauuuauccacaggaaaguguuauuuuucaaggaagguucauguagagaaaagcacacuuguaggauaagugaaauggauacuacaucuuuaaacaguauuucauugccuguguauggaaaaaccauuugaaguguaccuguguacauaacucuguaaaaacacugaaaaauuauacuaacuuauuuauguuaaaagauuuuuuuuaaucuagacaauauacaagccaaaguggcauguuuugugcauuuguaaaugcuguguuggguagaauagguuuuccccucuuuuguuaaauaauauggcuaugcuuaaaagguugcauacugagccaaguauaauuuuuuguaaugugugaaaaagaugccaauuauuguuacacauuaaguaaucaauaaagaaaacuuccauagcuauucauugagucaa

SEQ ID NO: 14935 - RNA, 1136 nt, Homo sapiens
cggcccgagguggggguuuugagucgguuaguggaggcagugggagcaggaugggcggagcuucuguuccaaaaauuuccccuaagugcgguugacagugugcaggcaggcgggggugcgcggggcggucagcgaucugcagcuucgcggggacagagauguaacccaacucguucacggauguuccgcgcgccgugucaccggcugcgggccagggguacucggaaggcgcgggcaggagccuggcgaggaugcaccuuccccugccuuggaaagguagaacuggggagugcgggaggguggagguggcccggaaaagaacaccucuucgcaaccaaaaaaaaaaaaaaaaaaaaaaaagaggaaauagaggaaaaauguguuauuucaaccgccacucagaacccaucauaauucagccagucggugucauuuuuauugaauuaaauuuuaaaaaaguuuucuuugauuuccagagcguuuuugcgggaggaauauguuaaaacaaacucaagauacgaaaugagacuuuugaagugccuuugauuucuggguacggaaauucuuuugauaaagcguguguacguuaagauuuaggaugacuuuuuuuuucuuuuuuguaauacaggucuaauggaaaugacauucuuuaugaauuagaacccaauuauguuuuaaaguuuauaauaagucaaaugauucucucagucccuauguccguauuagugaaauucuaucuccauauuagcgaaauuugcauagauacacaccuuuuucuuuuugucuuuuagucuugcugcaguguaucggacgaguuuaaccagauauccagcacuagccuucuaacaguuucuaacucaguggugacauuuuuuaguucuuaacucccccaauccuucuuagccuaacaaaccucuuaauuaagguccaugaaagaccauaaaccaaccugauuaugccuuuagcaaggcuguguucacuuaaucucuaaucccauaucauaaaaguccgcuagucacuccugaccuccaggaacccaccuaaccaggguggacacuauaagaaaacauguguuuuaauggaaugagaacuuuuuugaguugaagacacgcuagccucaggaagcagugagcuca

SEQ ID NO: 14936 - RNA, 1136 nt, Homo sapiens
ugagcucacugcuuccugaggcuagcgugucuucaacucaaaaaaguucucauuccauuaaaacacauguuuucuuauaguguccacccugguuagguggguuccuggaggucaggagugacuagcggacuuuuaugauaugggauuagagauuaagugaacacagccuugcuaaaggcauaaucagguugguuuauggucuuucauggaccuuaauuaagagguuuguuaggcuaagaaggauugggggaguuaagaacuaaaaaaugucaccacugaguuagaaacuguuagaaggcuagugcuggauaucugguuaaacucguccgauacacugcagcaagacuaaaagacaaaaagaaaaagguguguaucuaugcaaauuucgcuaauauggagauagaauuucacuaauacggacauagggacugagagaaucauuugacuuauuauaaacuuuaaaacauaauuggguucuaauucauaaagaaugucauuuccauuagaccuguauuacaaaaaagaaaaaaaaagucauccuaaaucuuaacguacacacgcuuuaucaaaagaauuuccguacccagaaaucaaaggcacuucaaaagucucauuucguaucuugaguuuguuuuaacauauuccucccgcaaaaacgcucuggaaaucaaagaaaacuuuuuuaaaauuuaauucaauaaaaaugacaccgacuggcugaauuaugauggguucugaguggcgguugaaauaacacauuuuuccucuauuuccucuuuuuuuuuuuuuuuuuuuuuuuugguugcgaagagguguucuuuuccgggccaccuccacccucccgcacuccccaguucuaccuuuccaaggcaggggaaggugcauccucgccaggcuccugcccgcgccuuccgaguaccccuggcccgcagccggugacacggcgcgcggaacauccgugaacgaguuggguuacaucucuguccccgcgaagcugcagaucgcugaccgccccgcgcacccccgccugccugcacacugucaaccgcacuuaggggaaauuuuuggaacagaagcuccgcccauccugcucccacugccuccacuaaccgacucaaaacccccaccucgggccg

SEQ ID NO: 14937 - RNA, 16623 nt, Homo sapiens
uuuauuguuucacauuaguuugaauaaagcacaagccaagaugguuuaaauaucauuugcagauguccaagcuucuuuacaauuacaggucaugggcaucaucaaccuaguccuugacuugcagcuaaaaaaggcaaaaggucugugugaagugacagaagagcacacccuacucaugucaugagcaaggaaucaaagucgaagaacaguaacagucuugacaucagcacuguaagaauuacucugcaguaaacuccaacccagaauggggaagaauacugaauuagcugagcacauucuggacacaauucugaccaauuucagucucaugaucucuguuggagcagguuucauucuccaauucucuuuuacagaacagcagaacucgagccuucauaaaagugauuaacggccuuuccgcuucuucauuuuuccuccagccaccuuguuccugacaccaauagcacccucugugucaucauuaucuccagcauccucucgcgagcguuucuucuuuucuccaugcucccuuaacuccugcaagaaaaaaagagaggaugggauugaaaaugaauuacuggcacugaagguuacucauucuaguccccucuccuuaagaucaaguaucaaguaacuugcugaugccugacauuagcaaaggaacaagacccaacuccaaauauacaaagauguuaaccuuauuaguaaucaaaacgugaacacuaaaguaagguuuuauuuucacauggcagauuggcaaagacuuaagagaaggguaauccccaguauuggccaagguguagaaaaauucacauauacucucauuuauagugcaaucugcuauagcuuuucuuggggcgggggacaauuuggcauucuguaugaauucaaauuuuaacuguguaugucccuuggcccaacaaguguacuucuaggaauuuauucuaaggaaguaaauaugcaaagcuguacaaaguaggguguuuaacacuguaccaaaguagaaagaaacuggaaaaaagcguaagcauccaugaauguaaguauuucauacacaugauggaauucuuuguagccauuaagaaacgaucacaugaaucuguauuuguugaaacagaaaaauguuaauccuauauaauuagauaaagucuaauuauggcuaaagaaagaaaaauagccaaauguuaucaaugguuuucuguggggaaugguuuaccuuuucacuuacuacuuuaauccuuucuguauuuuuugaauuuuuuucccaaugcacauguaauacuuuuacaaacaaaaaaaucccauguggacagaauaaaaaccaaaugugcaccucagcuacuccaaaaacaaacuaugggcaaaguuucuccaucccucagaccagaacuccagaaagcaggcagcacuuccaaugguuuuccucuagaaucuucucaucaccacuauuacuguuacuacuacuuacagggugaguaucccuuaucugaaaugcuugggaccagcaguguuucggacuucagauuuuuucuaauucuagaauauuugcagauacauaugagcuaucuuggggauggggcucaacucuaaacacaaaauucacuuguuucauauauaccuuauauaugaagguaauuuuacacaauauuuuuaauugucugaagguaauuuuacaucauauuuuuaauauuuuugugcauuaaaaacauuuugacugugucuugauagcaaccugucacacgaggucaggcauggaauuuuccacuugcggcaauccuuuucgcacucaaaaaauuuuggauugcugggcacaauggcucaagccuguaaucccagcacuuugggaggccgaggcggggggauuaccugaggucagaaguucgccugaccaaaauggagaaaccccaucucuacuaaaaauacaaaauuagcugggcaugguggcacaugccuguaaucgggaggcugaggcaggagaaucgcuugaacccgggaggcggagguuguggugagccgagauugcaccauucgcuccagccugggcaacaagagcaaaacuccaucucaaaaaaaaaaaaaaaaagaaaaaagaaaaguuuuggaucuugguuuuggauuucaaauuuuuggauuagguaugaucaaccccuacuaguaacuauguaguuuauauuggcuucucuggugcucauaaaaccccauaagguauucaggcaaguguuauucccaauuuacaggugagaaacugauucugauucugagaaaucaggcaaauuucccaagcucacacaguucacagcuggaucuucugaccucaagucugaugaacuaucucaccacgugcgacacaugaacaggugcugugaaugugugaaugucagaaugaggccaaaccuugauucaaccauuugguuguauggucuaaugcaaauuaccuaccaucucugcaccuuaguuugcucgucuuaaauuuggaauaaaauaauacccagcuucugcaguuuaguaugaggguuaauauaauaaaguggcacacaguuaacauuguuugcacagacacuggugagaaaagaaagaugcauaccauucgggcaaaccuuugggcuucagcgacgcguucugucagcaucauaaccucaucauccuguguuggaaaaccugguaguuucuucccaauuaaguguucuaugcgcuggaagaguuccacaucauaccugaggaaggaaaacugcacagcucugguugccugguaacgcaaaugccuguccauucccaaacuauuauuauaugauacaacgcaauaggaaccauagguuuaaacaauauugaacauauuauuucuuuucuaaauauggguuaagugcaaucucugugcauagcccauuagaaaaucacucaagggaggccaggcaugguggcuugcaccuguaaucccaacgcuuugggaggucaaagcaggagaaucacuugagaccaggaguuccagaccagccuggacaacacagugagaugccaucucuauaaaaaauuaaaaauuagccaaccgugguggcaugugccuguaaucccagccauucaggagacugagguaugaggacuacuugagcccaggaguuugaagcugcagugagcuaugaucaagucacugcacuccagccuggucaacagagugaaaccuugcugcuuaaaaaaagaaaaagaaacaaaaaucggccaggcagguggcuugugccuguaaucccagcacuaugagaggcuaaggcagguggaucgcuugagcucaggaguucaagaccagccuggccaacaugacaaaacccuaucucuacuaaaaauauuuuuuaaaaagccaggugugcuggcaugcaccuguggucccagcuacuugggaagcuauggugagguaggaggauugcuugagcccaggggguggaaggugcacuuagccaagacugcaccacugcacuccagccuaggcgacagagcgagacaaauacaaaaaaaaaaaggaaaggagggagggagaaaaucccucaagguauuuauucacagaacagccuuggguacauaaaaauuuguuucuuuaaaaaaaacaauuggaaauaguuauucuaauacuuucugaguugacacaaaggcaauugcucuccagcucuagguaccauucuacaugccaaauacuauacuagaucuuuuacauauauaaucuccaauuuucaccaaaacccugcuagauagguauuauuauucccaucuuucaacuccuucauccugguuuucaguaugaaagugauuaguguaguaaaugguagugucagguucucagccaguggcuugaaaguucugcucuuuucucuacauugcucggcccuaaagcugauuuacuuacugugugacaaaaguaauagccuuuccggagcgcccagcucuagcuguucgaccuacucgauggauguaauccuaaaacaaaaaggguaaauaaauucaaguuauauggauuauaaguuuaaaaaaaacuacauaugcaaaguccugcugcaaaaccuuugaaagaaaauagauucauuucguaacauggagaaaauaaauggccggggcaauuuguugagacaaaucuacuucaucuuuuuuguucuccuugcagcacaaaauugauccaaugcuuucccuucuuucacagacagauaaaucuacaaagcauaucuacauggucgcaggcugcaugguauuuuaaaaaacagcacuggaucucgaggcagagcuggauuacagcucugauccuucccaucugccaguuacacaauuaccugcaaaucacauaaccucucugaaccuugguuucuaucuagugaacaggaauagaaauacaugcccauauuacagaguuguuaugaaaaucaaaugagacagcaucuugucuacagcaguuaaauacaaagacaagagacacaacaguucucauccaggggugauucugccauccucaagggacacugguaaugucuggaaauauuucugauuaucacagguggaagacugugugaugcuguuaucuacuggguaaaggccaggaaugcuacuaggaauccuucaacucaaagaacaacccccacaacaaggaauucgaaagcuuaaaauguuaauagugccaaggcugagaaaccuugagauacacuaagcacuacaagcuguaggccgggcacgguggcucacgccuguaaucccagcacuuugggaggccgaggugggcagaucacgaggucaggagaucaagaccguccugacuaacacggugaaaccccaucucuacuaaaaauacuagccgggcgugguggugggcgccuguagucccagcuacucgggaggcugaggcaggagaauggcgugaacccaggaggcagagcaugcagugagccaagauugcgccacugcacuccagacugggugcagacuccaccucagaaaacucagagcgagacuccgccucaaaaaaacuacaagcugucauucucaagaaaugacagugacaagaucaguauguggcgcaccagccccuucuaugagcaucuaauaacucuccuuggcuaccucuuucauauguacuaauguuacauacacaggccugugcaagaugaugugaaugaacuaaccaagggcuuucuuguuuuuugauacuuaauuaaccaggaacaaaauaacugcuguaacuaaggaaagacagaagacaguccauuaagaaauacacuuuaggacuagaaagguaaguuagcaauaggacucaccuuggaauggguaggaaugucaaaguugacaaccacaucuacaugagguauguccaaaccucggcuggcaacgucaguugcuagaagaauggaacgggccuuggccuuaaacuuauuaagggauccuaggcgcuuacucugagguaaugaaaaagaaauguuggaaaacuuaaccuauguuuuggaauacaaaacacaaaauagacaaacacgagaacaaacagacauaaauuuuuuaaagguuuuucccccuaaguuuugaauggggcuucacaggucaaaacagaaauauggaagcaacaaaaaauuaaaaaaauauauaugauacaaaauaaggguaguuugacacgauagaaagguaacugggaaauaauuuauuaauguuuuuagaggccagagucauuauuaccacuagggcugaauaaaucaacucaacagcuugcaaaccagacagguacauaugaaauauucuaaugggagccucucgcuacccugaaaggagaaaguaaguaucuagagcaacacuucaaagcccauaaaauuacaacaauuauggaaacaggcaucggugcccuauggccuuauuguacaaaccuacuguuaggagguuuaucucgcucacgccaccagugcauggcugaugaugaugaugaauccuuaccugacucauuuguccauggagggggauggcagugaagccaagauuucgcaguagcaaagcuguucucuggguauuauuacaggugcugcagaauaucauaaaggaguuuccagccaauucauuuagaauauaaaccagguagguauccuaaguuacaaacccaaaacaauauaugucauugaaccugggagacaggauuggagaccuggcauauacauaagguaaagacuaagccuauagucgcuuuucaauuauccagaccuccagcugccagcuuugcauuccuuaaccagcauuaucaucucugugaaccacauauuccccacuuagccuuaaggcaggcaggagaucuguacucagcaaacaggagaaguccuuauaucaaagcacaaaaccaggggcuucauccuaaauaaaagccacauaauaagcagacaaaggaaaaauuaccucaaggauggggaugggaaggaauuauaugauuacaucaugaccucaguauugugauuuaauguguugugaauuccuggcaugucuggcuuaucggugauaauauaagcacgauaugcacucuaaagcaaacagacaggaugccaaucugcauuacagcucuuaccuaaucaagaguugacacauuuucagaugcuuuggugaaaagaagagggagaggcaggaaugaucaaaguaaacauuuuaccuugaauuuagagggaauaaaaauauaauauugcuguaauuuuucaacugucugguauuuagaggaaacggcacauuucacaggauucuucagagcugcucgcugaaguuuuugaaccugaaggaagaagauccagaauagcacacugaugccuaaacacucuuuauuuaugacaugguuuggcucuguguccucacccaaaucucauguugaauuguaauccccacaugucacgggagggaccuggugggagguuauuggaucacagaggugguuuuccccauugcgguucucaugauagugaguucucacaauuucucaugguuuuaaaguguggcacugcccccaccuccugccuugcuuccccuucaccuucugccauaauuguaaguuuccugaggucuucccagccauguggaacugugagucaauuaaaccucuuuucuguauaaauuaccuagucucagauaguucuuuauagcagugugaaaacggacuaaagcaauuuauuuuuccuuauuguuauuacuauuuacuuuauguaucaauucucauaaagaagaaacaaaaguccuagcaaauuucaccuucuuggucaugguggcagagaagaggaauguuuuccgaucucgaggaaucacuuugaggaucuugucaaccuaaagcacaaagaggaaaagaugccaauaugauauucagacuggaagagcugcaaauccucuagguagugaaggagguagacacuaacaaacuaaauauaucacugugaagauuugggacucgaaaauucaauuugauucagcuaaaguuuacugaauauuuacuaucugauacccuaccaaauacuauuaaaaaaaauaccuuucugagaaaagaacaguuuaaauuaguagaccagagcugauuuaagagaaaagucaagaaaaaguauuaaucaacuaaguaagcugggauuagugggucaucaaagaaaauaaagauauuucaggguguaugucaaggucuaaauuaaacgaaagggaaaagaaaauccgguuuugauauuucccauuucugaagucagagucagacuauauucuaaagauaaaagggugcugagaaacugcaauuugaagaauaucaagaaugaaacugauacuaaugcaauguucuacaugaaacaagugggcaaugaaccaaauuuugaaacaggaaccuugagaugcucuaagaggaggaaagaaauugagagcucaccucugucucaaaauccauauucaguauucggucggcuucauccaugaccaaguauuugagagcucucaaguugaaaccuuucguauuuuccaaguggucaaucagucgaccaggaguugcuaccaagaaagguugaggagaaacagugacauuucagaacaggacaaaaaaaaaacaaaacaaauaaacaaauaaaguuaucugccccaccccacagcucuccaccaaauuuaacuuaagaaauuaaaaaauuuaacaggguuacaaaaucuguuucucaaagucuuucuauccaacacugguagauuuucuccaauucaucacugccagugucuuuuaccuuugucaguuacucaccuauuauuauaugugguuuuuuugcaagggccaaagauugagacauugaaucaauuccaccuacaaucacagcuacagagaaaaaaagaacauagagacgagauccuuaauuuuuuccacaguccacugaacaucuuuuaaagccaaugccagauuucuacuuagauuuguucuucccuuacaauuaauacucuucccaaagcucaaauacaacauuagcucuuuaggucaauaaauuaugcuagcaauacuuuccuccauucuccuuccuccacacucauucuucacuugugauggcaaccuaggaucccuucccucucagacacuuaccacucugcacuccaauagaggaccccagggcuucaaacugcucugagaucugaaaggccagcucccgagucgggguaagaacuagggcaaacaaacgcugcggggucuccagcagugcguuuagaaugggcaaagcaaaggcgccugucuuuccagagccaguuucugcaagcccaaugauaucacgaccuaaaagaaaaagaaauucaacagccaaguaaucucuuugcgcuauuucuguguuuucuacaaugacacaaugcugggcacaaaguagacgcuuaauaaauaucugaugaacuggggagagaggaaaguugaauaaacagaaaagacauggccucucucuuagauaagcucaaaacccaguggugagacagacaaauauacaaaugcauuauaaugugauaagaguuuuaauauaagccccugcaaaauacagcgagaacacaaggaaaaguaacuacugcccagaagagucagaaaaggcuaacagaggugauaagugaguuaaaacuggaaguaagcaaagaagggaagaaaggauauuccuguaagaggaaagagaauuaaggcuuuagagaacauagcaugcuggcugggcaugguagcucacgccuguaaccccagcaguuugggaggccgagccaggcagaucaccugagguugggaguucgagaccagucugaccaacaaggaaaaacccugucucuacuaaaaauacaaaauuaggcgggcaugguggugcaugccuguaaucccagcuacucggaaggcugaggcaggaguauugcuugaacccgggaggcggagguugcggcagcggugagcggagaucgugccacugcacuccagccugggcaacaagagcgaaacuccaucucaaaaaauaaaaagaacauagcaugcauaguuaggcugagaaguacaauguggcuggaacacagaaguguuaagggagaaagagggaagaaugaggcuagaguuuugauguuuuccuauaagaaagaauuaaaggauuuuaaacagggaauaucaugaucaauauuacuguuuaggaagauaaacucuagaccugauggcauaaggaggagccaaggaacuuaacagugcaugccaguuacugcuccuucugagggaagaaugcucuaaguaauucuuuaagaacaggucaccacuguuugcuaucaccacucaagccacaacucauaagacuuggaaauuaacuccugaguugagaucacuaucuccgagcuggcuguagcccaugagguagcuaugcacuaccacaguggccagugagaaugcucccuauuaaaucaugaccccuacaguugcugccccuguucugacuguguaacugcugagaaguuuucuuuaccuagaagauaauccuacaauaaacaaaucucuuuucccugacauaaccugaacaugacuuacaaucagaaaugacuuaaaugaccagaacagggaaaacaaaggcuuaacugggacauuggauguaauucaggggagauaugaugguggccugaacugaggccaggaaugagcacaggaaugagauucagaaacuaacaaaaggaaaugugggugacucacacauuuuuaguacgggacacucaaaagccaaaaacugcaauauaggcaacagaaaaauuaguccuggugaggaaaauaaggacuuugguuuccacacagggaacuuggaacuuaagauuccuauaguaaacucaaagagauaugucuaaaaaccaguuggacauacuuguuuagagauaugucuaaaaaccaguugggcauaauuauuuggagguaugucuaaaaaccagcuggacauacuuguuuggagcucaggaaaaaaguggggguuagaacagacaugggagccaugaguauccuaccacugguacuuccucaggggcagaugcuucagaauaaucgaugagacuuacauauauauauaugcccggucccaugccuggaaauucugauucaguaggucuuggcugggaccuagaaaucucuauuuaaaaaaaaaaaaaaagcuccauagaugauucugaagaauacagacucacugaugcagacaggguuuaagcuugaggacugaaugagaaauguuauguaguauuucagaguaagaaaaaaggguaaagacagaaucaauauuguaaggcaaagggaaaagaaccagaagaagagacugagaaagaacagcuagaaagacagaagaaaaugcugucuugaaauuaaggaggaaggcagcuucaagaaagaagagugaucaguggcguucaaugucacugaucaaguagaacagaccuguaagauccaccucuuaaacauuaaucaguuaaaccaggaucugccaugccagaucagacaacagugugauaugguuuggcuguguccccacccaaucucaucuugagucguacucccauaauuuccacauguugugggaaggacccagugggagauaauuugaaucauggaggugguuuccccaauacuguucucaugguagugaauaaaucucaugagaucugaugguuuuaucagggguuucugcuuuugcaugucucucauuuucucuugccgccaccacguaauaagugccuuucgccuccugccaugauucuggggccuccacagccacacacagaacuguaaguccaauuaaaccucuuuuucuucccagucucgggugugucuguaucagcagugugaaaaaggacuaacauacaguguauccuagugaauucuauucuuuagccuucuuuucauuaacaucaguguuuuccauucaaaagcauaugcacagaugugaaauacaagucaaaccagacaaugggacugauuuuuuuuuuuuuuagacagagucuugcucugucacccaggcuggggugcaguggcgagaucucggcucacugcaagcuccgccuccuggguucaugccauuccccugccucagccucccgaguagcugggacuacaggugcccgucaccacgcccugcuaauuuuuuguauuuuuaguagagacgggguuucaccguguuagcugggauggucucgaucuccugaccucgugauccacccgccucggccucccaaaaugcuaggauuacaggcgugagccaccacgcccagccaauggacugauuuuuuuaaagauuacagacaaaugacaauccagggauaaaaugucucacucaucuacuuauuuuaauguucccaguggcaggguagguaacaaugaauugcaacagcaucuaccuaucugagaaauaaaggucagugcaagcaaaugauucccaaagcuuuuuauuccucaacuccuuggggauacugccgucccagccuguguaacacaauacaccuucgggaacagcaggcgggggaacuaggauuuguccuuuuuuugucaagggaaaucuuaacauuucagaagaaaggaguacauaagaaagauuuagggaaguaaaggagcugaagucgcuuaguucaugaagcaauaagcacugcucacugccuacagcugaggccugcacugcuuucaguuuuuuaguaagucccucacagcaacccucaguuugugaaacugauauauuuuucuacgucaucuccuuucuucaucucugaagaaaccgcuaagccuuuucaguguuuauaccuguagagaauauaccagaaugcauaaacuccauaagagcagaauagauuuugucauauagaccugccacauugcuggcaccgaacauaagcgcuugcuauauggcagccacuaauaaauuguuugaaauuccuugaggacaacuuuaagugaucucugaaacagacauaaauagauggugucucaauguguuacccaggcaggucucaaacuccuggucucaagcaauccucccaccucagccucccaaaguccucggauuacaagcaugaaccaccaugcccaucaaacaacuuuugaucucuugauaguaacaaacuuugaugcagguccauuaauagagguuuuuugagcuauaagauucuauguucaaauucaggcucuagcaauaauuaguuaggugaccuuagccaaaggacuuaacucccugagucucaauuuccucacuaauaaaauaauuauccguaacuaccauucagcauuguuauaagguuuaagaacagcggacaaucugggcucaguaacuuugcagaaacugaaaacgucaguagucccaaauucaaauuuagaaguuauuuucaccgaauaacaacagcaacaaaaacaaacagauuauuugaaucauuucuauagauucaaaugaagcauuuauaaacuauucauuagaaugagacaaacccaagaauaaggauaaagacauuucuauggugaucauuucugucaguuccuaguaaucuuccacugaccccucccuauucuuuucugcaucaaauuuaaacuuauggcugaaaacaucagaauaauuuuaggauuacugccagcuauuuugacuccuucucaccuacacuguagggcaagcuggaaaaguuaaaaugcaugaacgcuucuugcuauuuaaaaguaacacugggccgcugauaguucuuucccaccacuggccuuuauacgguccuuauccuccaaacuucucugcacaaguuugaaguguuuacuaaucccuccuugaaacaguuucccuucccuaauuugugugaaacuauacucucaugauuuucaacccucuauugaaucuuccaauuuuccucugucaucuuugccaaucuaauccauuuccaaucucagcuauaaccgcucuuuggauacaguguguauauccagcucuggccucucaaucaaguuccaaucccaggauuccaacuggguauuuuuuuccuuuuuuauugucccccaguuuuguuaauugacaaaaaauuauacuuaugguauacaaugcaaaguuuagauacauguauacuuugugaagugauuaaaucaagcucauuaacauaucugucaccucacauacuugucauuuuuguggggagaccauuuaagauccacucuccuagcaauuuucaaauacacaaaacauuauucacuguagucaccaugcuauucaauagaucuucagaacuuauccauccuggcuaacugaaaccguacccugagcaacauuuccccauuccccucccacaaggucaacucuaucucauugauauccaaaaucaauuacuuccaacugaacucaucuuuccugcauuuuucccccguuccuuuuuuguaucagugguacaccaauaauaugcccuaaacauacagccuagaaacuuagauuuuccccaccccuuccuugccuuccacuugcuuaacugguuguaaaaucauaaugauucuuuuuccaacauuuucuuuuucauucuaccaccacccuacccauuauugauugcaaaaaucauuacaaagaccuacuaauugguuucccagacucagucucuuguuucuaaugaucuuucacagcuaugagauuaaucuuccaagaguacaacucuaaauccuucaucuccaaaaaugccccacugccuaugaaacgaagaccaaauuccuugacccagcacucaaauccuucauaauccggccccaaucaccuuacuaaacuuuuucaccacucugcuaaguacuugcaaaucuccauacaugcccauguuuuccaguuggcuuuuuuucaugcuguucccuaugccuagaaaguccuccccucccaucauaucugaaugucuaaauccuucuaaagucaguguucaagguucagcucacaugucuucccaaccuccccagccaaaaauaaaaugaaauaaaucuucucuaauccauccuaauuagaaguaaucucuucucccucagugcacucugaauguaacuuucuuaggucccuguucaacuuguaauaaauuuauaauuaucucuuuaauagauuauagacucuuggagaggacagacuguuaaccuccagugccuuacauuuacaacaaauaguaacuauuuauggaaagagcaaauggaauuuuguagaguaagucuaaccccuuuuccacaugacagcucuucaaaucauuaaaucuuucaauuauuaucaauaauaaucacuacauuaauuacuaaugaguaauaauuauagcuuacauuaaucacuaauaauauaguaauacaguaauagcuacauuaauacuaacaauaauuagccacauuaccccucuuauaacaauugcuaugauuacauucacucucucugaggaucuuaauagauuucaguuaacuaagaccucugggccucuuuuaucacccacccuaauccuguaaaguugguacuuuaggaaucuaagagcaggacuuuacuucuacuccuauuaaaguucauccuguuacagccagaugugguggcucacaccuguaaucccagcacuuugggaggccaaggcagguagaucacuugaggucaggaguucgagaccagccuggccaacaugcugaaaccccaucucuacuaaaaauacaaaauuagccggacauggugaugcgccuguaauccauuacuugggaggcugaggcgggagaguugcuugaaccuggaaggcagagguugcagugagccaagaccgcaccacugcacuccagccugggcgacagagcgaaacucuaucucaaaaaaaacuccaucuuaaaaaaaagaucucaaaaagaaaaaaguucaucccauuaguuucaguuccaguagccaucaaucugcuuuaaccacuguuuuacaaaucugauaaacauggcucacagcaagaauucucaacuccucaagacacacauauguguuccaggcauccuucccuaagugugcgcccacugaugcauaaagucuaccaagauugucguuaauauacuuuaacuuuaaccuagggcuuccuuaaagucagcaucuguggcagagaacaaacccuuucagcuauuaagacagaaaguaagcucaguaaaauuggagaaugacauuuucaaauaccauuacccaaacuuuguaccuuuagugaccauauccuuauuucacuugaaguaugcaagcaacagcuuucaaaagggguaucuaauugagauaacuuuauauuaaaucuguacgaagucauacaaccuaccuuguaaggccaaaggaauagcuucaaucuggaucuugguggguuuuguccaucccaacuggucacaagcuucacacaacacaucugucacacccuuggaauucagaaaaauauaccuuagccaagaacagcacaccccuaccucccuccuacuuaacugacugucagacccaucauguacaaccauuguauuugauuuaaaagguauuuacugugcaucucagagccuacucuuuaacuauaccaugagacaguagcucaagacuuaacgaacacuuucugcucaccaaggccaaggccaggugcuuuacauguaucaucucauuuaaucgucacaacaauucugcgagguaaguacuuauuacuauccccaauuuacagauguggaaagagaaacacagagagguaacaacuuguccucaguaagagacugugucaaaauucaaaucugguugguucaucugacuccaaagcuccaguuauaaagagaccaauuccauuccccauauguacaaccuccuggaugcacauacaaacguugccacacuaaaguggcgaauagggcaaauagggggucucagggcccagcagcccucccaccacccaaacucagagcacguccgaaacccagcccucugaaauucuggggaaaacccaagcuaggccccaagaugcuuuuguacacuaucagagcgggaucuaagguaccuggggucucccugagccuagcaccagaguacauaaaagaagccagcgucauccauucucaccaggucuuuaaauguuuuaguuuccuccucuuccacaaucggcugggacgcuucggucggagaaucguguuccucgggugccgccaucuugugugaggucuccggaagugggucugcg

SEQ ID NO: 14938 - RNA, 47976 nt, Homo sapiens
cuuucccggucccagccccacgcaccgccgcucggaacuacacuucccggcagaacgcgggcgcgcgcacgcgcaccggggccucagccauggcgaccgugcuguccagggcgcucaagcugccggguaaggagucgcaugcuugcgaccacccaguccccgccgguguuggaauaaggggaggcgaggcucugggggcgaggccggucgggcccuggccucaacccagacucagcugcaggcgcccggugccgaggagggugcagucccuuggggcuggggucucugugccaccagagggcgagaggggcgcccagcggggcaggggucucgggcgcggggcgaacccggagacgcgcggggagagggcgccgagcagguguuacggcggggaaugucagaacgccggucgccgcugucccgaggggaggcuggcgagaggagcauccuucccgagcgccgcggacccagcaccgcagggacuccggcgccuucugucuuggcuggaccugggcgggggcggcgggacggcgaguggcccucuguggaucauccccuccaccuaacggcagcaacgacgcauccaugaggcaggugggacagguauuuacgucccuuccuaguuuacagaagagaaaaugagaguuauuuggcuaagugaauuguccaaggucucacaaguauugggaaagcucggccuugaacgucaggggucuuuucacucuaaauccugagcuuuugauuccacuuggucagucuccagcugccgagauuaagcaugggaaaugauuuggcaccuauaaguugaagauaauguauggaaucuucuuuaaggcagcauuaggggugaugacaacuuccagagcugauucaguacuucgggcagcagcuccaaguuuuuuuuccuuuuuuuuuuuuuuuccuccuaaaccuccagaguaggauuguacuguuagaaaguugauauuuaaauaaaaguauauuuauuccacccaaguaaauuuuaaacauuaggcuuuagaaaaauugauggcucuaccuagguaaguuuuaagcauuaagcuauaaacauuuauuugcugauaauuuguauuagagggaaaagcaguugcuuucauagcuaucucuagagagggcuauuuggguuuugguuggauagcuaguuugagcuugcagggggauuacaggguccuuguucucaaggagcuuccaguaugcuacccugaagcgaaccuugccauuuggaugacgcuagguuggauauuaauuugcguuucuguccccagacuucaugaccucagacagauuauuauuuuuuuuaauaugggcucauuggaacauuggaaggaacacugauagcaucugccuuggaaugugugcauaacacuggaauuaaaggagagacguggcccuuuaccugcaggauuaauuuuuuacuuuuuuacuuuguauauccuuaguguagaaugauguccucccagagggguaauaagaugucagacauuuagcuuuauuucuuuuuuuuuuuucuuuuagaguccuuuuuuaaaauuucaguguaggucauuguuauucucuaagaaugagaaugcaugaaaaucuugcuuuagcaacucuugaggucuuuuguguucuuaugccccaaggcugugguguuauuacucccuggaguauuaguuguaggaacugguugggguucccauaguccaguccaugggccuguuuggcaggcagcuuggcccugagcccugagguaugcuugaugcuuuuuuaggcccagauauaguaggcauguguucuuucaugugauguggguuuuaagaaaauguucacuugcgucuacggccauaccacccugaacgcgcccgaucucgucugaucucggaagcuaagcagggucgggccugguuaguacuuggaugggagaaaauguucacuugcguuuuuccuugucuccuucuugcccuuucuucuucccuccacccaaaauacuauuuuuaguuuuugcauuagguacaaguuguuuuuauauagcucuuuuuggcuccccuguaauugggguccugagacugcuguccuguuugggcuacuguguuauguuccuguaguuaacauccccacuguuuucuuuguuuguuuuuuuguuuguuuguuuguuuuuuugagacggaguuuugcucuucuugcccaggcuggagugcaauugugugaucucggcucaccgcaaccuccgccuccuggguucaagcaauucuccugccucaaccucccgaguagcugggauuacaggcaugcaccacaaugcccagcuaauuuuguauuuuuaguagagacaggguuucuccauguuggucaggcuggucuggaacucccgaccucaggugaucgccugccuuggccucccaaagugcugggauuacaggcaugagccacugcgucuggccccaacauccccacuguuuucaugugugaggaagucagguuggagugguggcugagagcaugagacaggcucggguucaaauccagucuuuaccuaauuaguuacuuaaucucuuuaagcuuuaguuuccucaucuguaacaauaacauuauuauggaacauucacucuaugccacacauucuacuacauauuuaccuccuaggguuaucugaaauaguaaaggagauggauguacuuaggaggucuaguaaccucugacauauguuaauuagucaguaaguguuagcuguugucaucagcagugugcucauuuaugaaugugauaccugaaggaaggcuugauguaauagugagcuauugacagaucucagcagucuuguuaugaaagagcaguuucgcuaagcucaagaaggaaagauguuuggcucacaugcauaaaaugagguuaauuaguagcagaaggccaauaugacauucauaaagccuguagggcagcuuaucuccuaaguauauauauauuuuuuuucuuaggccauuuuaaaguuugaaggucaaacacuggagggaauaucagagcaaaaugauuuuuuaugauuuauuuuguuuguguaacuuagucuuuauaugcccuuggguaaacuaacccaugauaugaauuauuuaccuuuaguugcaguagaguguauuguauaguauaugcacaguauaguguauacuauaguauaguauauguuauagaauaguguauguuuuaguauauuuccugaaaacguuuggguaugguauaguugcaucacuuuccuauuuguguuuuccucucuaccauuuuggaaauccuauuauauuuaagcagcaucuucagucuuccuaagaggaaaagcaauagcuguggaaagcgcauuuauaaugauuuguuaugaaaucagugcccucucccuuauucuuugaaaaccuuucauucauuaaaaauuugggugguggcugaaaguagcaaggaagcgagugagugcuaagugcccuaagcuuggaagcuggauuugacgccuggcuccucagccugaguaggacuuaaggcaaguugguggacuucuuuuaaggcaaguugguggacuucuuuuaaggcaaguugguggacgucuuuuacuucacgcucucuuauugucuuucuguaaauagauagaaaaaauauuauuaaagacuucucuaaucaaaacuugcagucuguaauccuuaagcggagguuuguuuuugcaguaucugaaaaaaaaauuaguauaaaaguauuuauuccucucaaaaggcuggccaagaacuggccccuagucuucugugauguaaagaaagcauaggaauaugauaacucagagcgcuugugugcuugucuuuauauuucggugaugucauggcugggucagaaugcuuggacaucaaauugcauguucuuucucugaggacuuuuuagauauugcuccgcuaucuuuuaauaguguauguuacuauggagaaaucuuugccugauuuuuguuccugucauuagugacuugauucuuuuuccuuuggccuggcugcuuauaggauuccuucuuuguccuugaaguccugugccuuuacuaggauauauuucaguauugauucuucugaaucaguuuuucuugggacucuguguacucauuauucugcaguuuuaggucuuuauuguaggaaguuuuuuuuggcaacucuuuaaaauacugcuuuugguucuuuucuguuuucuguuauccucuuuucuguuauccucuuuucuguuauccucuucggucaugcauauauuggcucaccuuuguugucaguaucuaucacguuguuucuagucuuuuuaaagccuugauuuuuuuuccacgggaucauauguagcccguacagacuuugaagccagacugguuuugaauuguuaccuaucacuugcuguuuaucugugggccaauguauuagucuguuuucacacugcugauaaagacauacuugagacgaggcaauuuauaaaagaaagagguuuaauggucuuacaguucugugugccuagggaggccucacaaucaugguggaagguaaaaggcacaucuuacaugguggcggcaagagagaaugagaaccaagcgaaacaggguuccccuuguaaaaccaucagaucucgugagacuuauucacuaccaugagaacaguacggaagaaacugcccccaugauucaguuaucucccacugggucccucccacaacacaugggaauuauggaaguacaauucaaguugagauuuggguggggacacagagccaaaccacauccgcuaauuacuuaaacuuccaagccucagcuuccucaucuugaaagugaagacaguaaugugucuaccucacauaguuguuaugaagauuuacugagauaagaauuuuuuuuugagacaaagucuuguucugucgcccaggcuggagugcaguggcauggucucgacucacucuaaccuccgccucccagguucaagcaauuuuaaugccucagccuccugaguagcugggguuacaggcgccugccaccacacguggcaaauuuuuguauuuucaguagagacggggucucgccacguuggccgggcuggucuugaaguccugaccucaagugaucugcucgccuuggccucccaaagugcugggauuacaggcgugagccagcaccccuggucugagauaagacauuaaaagggcuuggaagaguguaggauaaguguucagaacugccagcuguaguuauuuccauuacauuuugcuugauuuucacuagucuauucuuuuuaugucucugacucuguuuucagcaauaucuguuccuuuagcugauuccaauaaggauuucuuuucuaaaacugguuuguuauuuuuuccauuguuuuccugagugcuuauuucagagaagacgauuuuccuaaauuucucagacuccauggggaaguauauguucauuauuucuuccaucuuguggugugauuuguccagcauuuguuuuucagcuaauuguuuguuauguuucguuguuacuucuuucuugaauauuuguagagcuuugugguaucuuguggaaugaguacuaaacauggcuccuuucugauuauuacuuauauuuaaauggggcgguuguuugacagccuggcuauugccaaaggggugaucuagggccguuggaagcaagaauguaauccaggccuguuaagucagcuggcuccccaccagcacucuuccuguguggaugucucuauccuggcuaggaggaggcuuugcacaggacuguaggcugcugguuuggcauuuccuucauugacuuuguuuugccaguuaucaauuuauugcaucugaacuccaaauucaccuuuguugacugauuugugaaagugggucugagcccuuuuaaauaucaaguuuguccugccuuggauauugucucucaguccuaggggaccuuuuagaguucucuucucaucuuuauguuuacucuccugucauugcuuaguaauuuuuuuuauguuaaacuuguccucuuugaacuauuguuuggcuucuguauccugacugggcccagucagagugauuaugcccaguuacuuuucuaaccugccguccugacagugugcuuuuugugaagaugucagcuuguacuuuuccucauucgguccuacuuggauuugauucugugguguugaauggggcucauuggugcuucugugaccccagacuuugucuuuccaagcaagcaauuacugguuuggcuauauuuguggaacaagggagguaguauaacuuguugguuagaacaacaaauggacucugcagucagaugccuggguuugaauccuggcuuuucuuuuggcuaguugugugaucuuagucauuuuaccucuuuaauuuuauuuuucuuguugauaaaaugggggauaauaauaauaauaauaauaucuaccauauaagauugaugugaggauuaaaugaauuaacacaugcaaaaugcuuggaucagugccugggacaguaggcacucaauacacuuccaguugucaucaucgucaucaucuuauuguugucaugauuauuaauucugugaacucugcucauugcugaagaucugcaauauaugugcaauauauaucugcaagauguauuugccuacucuuacugagcuuucucaauugaguacaaguuucagugcauuuaguucauaaauugugguuugggaauguggcuguuuccuauuuuguguucuauuuuuauuuuucuguauuuguuuuccugguuuuagggaagacagugugacagaaaugcccacuuuugccaucauuaacuagaagcauguaaucuugcuaaacagaccaaucugacagcagcuuuuuucucaaagaaugcuucaaauuguuuuuauaaauuucuuacagauuuuauaaauuccuguagcauaugcuucucuuccucccugccugugauaguacauagcaugauaaaaaugaauuuccuuuaaacuguuuugcugggaaguguuuuauuaaugauuucacuuugacaaaggugcuguuuuuagccugauauguuuguugcaagguggagacugacuagcaagauugaauuugaugucgaugcuaaauuuuucacuuggugcuaaaaauccaauugcacaauuauaggguggcuuaagcauguguucaaaaugcuuggaaguuuuaauugaaucaguaggugaugugaaugccaagaaagcucucaagaucuuacguuauagaaauugaauuguuguuugcuaucuggaguagguaggaaauagcucugcccucccuuucucuggucagacuguaccugggauuguaucuaguuccaagaaccauauuuuaaaaagcacagacauaucacauuguguccagaggagaaugaccaggauguugaggacaccugaaacaaugcuucuuuaaguaauggguugaaagagguggagguguuuaaguuggagcugagaagagugggggagggcacugggagauacaauacuagcaccagugaugguaaugauaauaauagaagcuaaaauuuauuguguggcuauaagccaggcacuaagaagcagacauauauuaucuuauuugauucucaucacaaucauaugagcuaaaaagaauaauuauuccauuucauaaauagggaaauugaugcucaauaaaguuaagaaauuugagauuacauaguucauaagagauauagccaggauuuggcuugauguuugauugugaagacuugagcucuuaaauaccauaucauaugucucuuaugauugauaccuuugaguguuugaaggacuuacaugugagagagggaucccagaaauuaaaacuaggacagauaauuggcaacuucccagaaaaaaauucuugaaucaguguaaagaauugguuucuagauuggaggccaguggauucccuaauacagguuacauucagguguuugcuaaguaacugguugauaggucuuuguaaguagcuaguuguaaguuugggauagggguggggauagauuaugugaucuuuaaggucucuugcugugcuuucucaaguaacucuagaguugagaacucugugugcuuuccuguuuuucagauauauauauauauauuuaaacauuuuaaauugucaaaaaauacauacaccauaaaauuuaccaucuuaacuauguuaaguauacaguucaguauuaacuguauaugcacccaaucucuaguacuuuuucaucuugcaaaacugaaacucuauacuuacucaguaacaacuuuuccuucuaccuccagaccuaggcaacaaccauucuacuuucuguuucugugagugugacuacucuagauaacucacauaaguggaauuacacaguauugccuuuuuguguguggcucauuucauuuagcguaauguccucaagguucauccauuuuguagcaagugucagaaguuccuuccuuuuuagagcugaauaauauuccaugguacguacauaucacauuuuguuuaucaugucagguguauuuuagcuaaaaaacaaaacaagaacaaacaaucacuuuaaaaagcauuagaguuaauauuauucuaacaacccauggcucuguaugcaaauuauuauguguagaguuaucugggaugguuagggaauggugugcccuaauuaaccaaauaauuugguucauggaguagaaauacaaauuguaggagauuaucuggaaccuguacugaccccauggcauauucugaaaguacuauuuugaauuaaguuucuaauaauugauuuauuuucuuguaauuugugcccuuaaaaaucaagucuaauauuuauugggcaaaauguauaguuuugaaaauaaaaauaaauagaaauaauuucuaguuauuaggaugacagauuauucaguauuuucuuuggauuuuuuuugaaaguacuuaauguuauaauucuguggaauguucauuuuaaaaaaucuaaaauuuauugauuuuuuuaauguaccaaauacuaacuuuaaacaucaaagguuuuacuuccaacaucugguauugggggaaccagcccccaauauuucaacguagguucuuucuauuuuccuuaaguguuggccggucugagaaauaaagagaaagaguacaaagagaggaauuuuauagcugggccucuggggguaacaucacauaucgguagguccgugauguccccugagccacaaaaccagcaaguuuuuauuagggauuuuaaaaggggaggggguguaggaacagggaguaggucacaaagaucacgugcuucaaagggcaauaaagaucacaaggcaaaggcaaaguuagaauuacugaugagggucuguguccugcugugcacguauugucuugauaaacaucuuaacagaaaacaggguuggagagcagagaaccggucugaccaaaauuuaccaggcuggaauuucccaauccuaguaagccugaggguaccugcaggagaccagggcauauuucaguccuuaucucaaccacauaagacagacacucccagagcgaccauuuguagaccuccccccaggaaugcauuccuuccccaggguauuccuugcugggaaaauaauucagugauaucuucccuacuugcacauccguuuauaggcucucugcaagaagaaaaauauggcucuauucuacccgaccccgcaggcagucagaccuuaugguuaucuucccuuguucccugaaaaucgcuguuauucuguucuuuuucaaggugcacugauuucauauuguucaaacacacguuuuacaaucaauuuguacaauagugguccugaggugacguacauucucagcuuaugaagauaacaggauuaagagauuaaaguaaagacaggcauaagaaauuauaagaguauuaauagggaagugauaaauguccaugaaaucuuacaauuugugguuagagauugcaguaaagacaggcauaagaaauuauaaaaguauuaauuuugggaacugauaaguguccaugaaaucuucacaauuuauguucuucugccgugguuccagcuggucccuccauuugggguccuugccuucccgcaacaaucuggucuccauauaguguuuuauucuuucauuuuauuaauugaacaaacugagauauaauguaugaaaugacaucaccaaggccauagugacccagagguagacacuagcauuaauaauuauucuuuuccccuuuuuaauuagcuggguuuuguggucuuuuuuauauuucuucugaacaaaagauuuaaugauagaguuuacauuagugauagauuacugcauaaagucuccccaaaagaaacauuuucuugguuguuacuuggugguaacaugaaauaaaggcauaaaaucauucagucauuggcagugaggccaagggguggguggcuugggaggagguguaccuaggcucuucuguaauuucucucucagcuaucccaaaucaacacugcaagcuaaguaaaaacaaagugcuugccaugcaaagcaccuucaagacaaguccccuaccucuguguacuggcuagaucaccaccccucccagaauacuugcucagaagagcaguuuuugggguaaacacuguuuacuaaaagauagacugaaagggcauucaaaucacaggaugguucuuagaagugagauuucaauacaucuucagaugaacauucaguguucaacuuucuaaguuguuuccauagaaacaguugggaagccacagauauugggcugugagaagcagcguauggagaagaauuguucuaaaaguuuaccaggaaagauuaggaugucacagaucuaagaagaucugaggcaauaugcacauuaggcacauggagaguugauguggagccaugaucuuuuucuugagugagauucaaacacauuaagagagcuuucuuuuuaaacuaaaggcauuuuaaauuugcuaacuucugccuccuuuuccauugucuuaaacucaugcaggcagugauccuggagcacugugcuuuuguuuuuccuuccauuccuaaccccugcuucacuggcuucuguuuuacagauagccaccaagguucaaacuugauguaaaccuggauuuuuuuguuuuaguuuuccguguucuucuggguauuuacaguugccauauauuuggugagggugucuucuccccaguuccccuugacucucuguuuuucuguauuuucagggaagaagagcccagaccuaggggaguaugauccacuuacccaggcugacagugaugagagcgaagacgaucuggugcuuaaccugcagaagaauggaggggucaaaaaugggaagaguccuuugggagaagcgccagaacccgacucagaugcugagguugcagaggcugcaaagccacaucuuucagaagucaccacggagggcuaccccucagaaccccuugggggccuggaacagaaggcggccuccucccuggugucauaugugcgcacgucugucuuccugcugacuuuggggaucucgaugauccuggugcuccugugugcuuuccugauccccuguccucccagagaucugcacagcaccuggagccgccacuugggcucccagggaggugagcugcagaaucuucagcccuaauccugugaaacuucaugcuaugucugauuacauuuaaauuuuccuccaaaucuuaaaacuuaauaugugucaugcggcauuccccacccugccguccccacuguguggagguggcaaggagauuaagauuugaaagaaaacaaacaccuccaaaaaccugggaaucauugcucuguugugucuguuggcauuggucuuuauuagauccagagaggacagggcugguuugcuggauuccugcuguggagccagcacuguaucaggggaaugcaaagcuguaggaagggcuauuuacagagaaaagcaagguucaaggccugguugcaccagggauagagcucuugcagaacccuuugacauucuuugaugauagaggucugaucuaauuuaaauuauaaaauaauuucauuuccuguaaaagauaguugcuaucuuuucuuucuugcuccucaugguuagggcggugcugucugaguaauuccagcuauucugucuccuuuuuggaguaggcuucuuuaaaaccucuugcucuggaaugggacuuacaucucaccuguguugaguaguccugucucuugugaacuggauuaagcuauccucagaccccuggcauccucuugaucuagaaauguuuaucucugccacuucucugaucccaguugaauuagcuucugaugaguucuguguucucaucuuuaguuucucugaaggcaaguuucauuuacauauauuuauauacaguuuaaagguaacaaauuguuggugugucuaccacccagcuuuagaaauagaacaucauugagaccuucacaaucucuugugugucccuccugaccacauccuccucugcccagcaaaggccucugcuauccugaauuuuguguugauuauuccuuuuucuguaaaguuuuaccaugucaauauguaccccuaaacuguauauucauuacuuuugcugguuuuuaaauuuuacaugaauuuaaucaugcagucuucugugaacugcuuuuuuuuuuuuuuuuugcgacagagucuugcucugucacccaggcuggggugcaguggcaugaucucggcuuacugcaggcuucaccucccgcguucaggugauuuuugugccuuagccucccguguagcugggauugcaggagcucgccaccaugccuggcuaauuuuuguauuuucaguagagacgggguuuugccauuuuggccaggcugaucuugaacuccugaccucaggugauccacccaccucggccucccaaagugcugggauuauaguugugagccacugcacccagccugugaccugcuucuuugugccacuuaauuuuuugaaaacaauuuauugagauucaucuauauugaugcauuauaccuggaguuuauucauuuucacuacugucugauuuuuccaugguaugaauaucucaugauuuauccauuuuucuguugaugaaccuuuaaguaaugcuuccagucuuuuuuuuuuuaaauaaauaaaugaugcugcuaagaacauuuuuguauauguuuccuauugcaguguauaagaauuuaucuaaggcauaaaccuaggaguaaaauugcuggaucauaccauagggugugugcauguucauuauuagcaguuuauguuaaauuauuuuccaacaugguuguaccgauuuacauuuccacuagcaaugugugaauucucuccaaauuuggugggcauccucugaguccacacuuuugggugguggggggauggaaguccagacuccucacuaggccucugcugacaccacccccguggagaggagggagagggcugccuuguugaugcuaguugggguggaacuccuuugguccugcuagaugaggaugacaguccuugcccccaccuggcuuucucugacaugacccugauggugguggugguggugggguaccuuguuacauccaggagagggugggagccaggcuccacauucagccuuugcuauaugaguggguggagcugggcugauaauuuuaucuguuugguuggaguagagcaguuauuaucuacaacuuuccugucuugcuggacugcaccuuuccugggcuuuuggcuagggaaggcagccuuuucuggggcuuuuuuugucuguaucugugguguuucuggguugcuggcuuuuccagcacccuaucuggguauuaugaggccaaaagaaaacccaggggacucaucaccuugucauuccuugggucuugcagucccuagcuggucugcuuccuucucucugccuuuuagaguugucuuauguuuguuuuauguacaguguccagggcuuuuccaugcacuuagcagggggaguagggagaggugugucuacuauaccuagucgaggaacuggagucugccugguguuuauagagcuacuggcaacagagaacugguuugugguaacuugcucaggaccuuuuugguuuuuuauguguauaacagguggggaccugucuccauuggaauuggcugaugugaauggagauggccugcgugaugugcuucucuccuuugugaugucaaggaacgggagugcaguagguaagagacguguuuuuuucaaggcugcuacaggggcacugucagcuaggagaaaacaucagagcugugucccaagugguacugcagagaaggaucugcagugaacagaaaguuaccaugguucuggcauacaugaaaacccucaucagaaagcuuccacauauaaauaaagcucagucuaagaaaucggagggaguuagagcuggaaggaauuuuuaguggugaccaggccagugaagaaacugugaugcagagaggaagugacuuguccacacacuuugcaacgaacaguguuaguccucggguuccuuggguuuucuccugguuuuccauugccucuuagauuauagugaacauugacuuuaugcuacccuccuaucccuggaagaaaacuuuuguucauagacuuauacaucuuuacacaaauaccucuuggccggguguuuuccuuucccccuucaguuuacacuuguagaccugcuguccauccugcucucugcauggggaagcugagcuguauggaugguaucaacaggcuuccuugccugcuggucuccuuucaauggggagcacagcucaggaaugggaggggaguaagagugugaggggagguauucacuccccuggcucccuccccgccggggucacugcagaauggcugcuacagccuugacccugggucacagcucguuucaagguggcccuccuauaggacuuuccuuuucuggauuccaguaauugcguccucuccuugugucuuuguuggggagccuaacaguucugagggucugcacuaucacuugugguguuucuacaugcuggccacaucuuugugaauagucuccuuaagaaaccguccacaacuuacccucauuuagggugcuguuucugggaucccagcuuuuacacaugucagcuguagaaaaagaaaaaaugcguucugauuucagccuaaguacacaaggcuuuugguugauccugcagccuccacuacaguggagucaaacugcagccugugagcugaugcagggaccuaguuugaugcugaggaugcccuagugacugcuuuuaagucgucuaggccuuggaauacaugucuagguguguuuuagagaauucuaaaccacaucucuuacauuaguaggaguggcuuucugaggcccacaugagauguggaagcaaucuggguggagaucugcuguagagagcaucuccagccuaggaguagauuuccgugcaaucaaaacuugauuacacuuuuccugcccgugacuucugaaguaaaaaucuuccccaucuacuuagauuuagagauguuuuuagucauuugguaucuuacguaguuugcuucauaccaagacucauaauggcaaggccauggguuuggacacaauauggaccaggcugauuuggccacagacuguacaaauaaggauauagcgaacauauggugcuuucuauguguuaauacaccauugucagcacauaacguaugaaggaauuuauccuuccacacaguccugugaaguagacccauuauuaucccccuuuugcacaugaggaaggugagacguugugagguuaaagaacuugcccaguccuacugcugguaaaugauagagcuggggauucggauccaaggagucuggcucuggaguucauguccuugacccucaugccaagcugcugugcccauaacccacaaagcuuugugcuacuggacacagagggauugaguuuuuugucuauucacuuguuccuucauucagcaacuguguguugauacuaacugugcggcagccacucugcaccuucucuagaguucugaugguuacacacagacugccgaacaagaggagccuggcuuuggccucgagaagucauagucuagcaggaagggguaauccaucaccaucugggaaaagacgagucagagcauuguaggauggaguaggguccuccaguaggaagaaccacacaggauagggauccuagcaccuuugagaagccuggaaguuaccauauaccaccucuguuugucauauauaucuucuggcaacagggucugaaacagccagccauuguuugucacuuguuuuuagguuguauauucaauuagucgugcugaggaauagguagaaggaagcucuaaaaguuuuguuuccuuauccauauuaguuguugcugaaagugggaacuguaugaaaugagucacgugucccuauccugagagugaaugugaaacugacaagggagaaaguucugagucugauguaguaauuaagugacauaaaggcuuauuuacuaaggaucauggcuacucuaaucccuuaccagcuguacuuggaucuagguauuaggucuucccaaauauuuuuuccugacugggaccaaaucaauugauuccagagaacucuagacuagcaagacccacucaucauugcuauauguaaucuucaaguuuauuuuuucaaaaaagaaaauauuuuucugcucucaggaagcauuuauuagugaugauuagaauucagguauuuugcuccccgcgcugcacacguucuggaucagucucauguuuccgagcauaucuuuuccuccugguuuuuuguucuuaacuacuuuuucgcauucuugauuuugcuccugucucuuauuaggcaaacagucgguugcuguagguacagagauuagugagacagucuuucuccuuaaggauaucaccauuuaguuggggccgagguggcagacauguaaagaguaguguugggaaaggugcagaaguggagaugcauucgacaguguagaggaggccacagcucuugucuuacaugagaagcguguucagcaaagaugacaggcacucuguguucacaucuugcugccagaagugugagagggagcugaauacacaagugugguugcugccuuaccaccauccacuugcaguuuucuggccucuuguucaucucugccucuuaucuccuuugccugcuuuccuuuuuuuaucucucuugugugcuuuuaggugucucaagaccagcugcuaaucuuguaugccuuucggggaugaauggcagcacacuguggucuagucuucucccugaggaggcucgagauaucacauguuuggagcugaugccaggaagcuuggcugaaaccaucugccuugugacagggacacacaagaugcucagcgcauucaaugcaacgucagguaaauaccauuuaccacaaaagaacuuugcuccuacgagccauacuuuuggauuagaauaaucuguuggguaggggaccuuuugacucucacgugguggaguaucugauuuacugaucuggaauaugguuauuaagagaaaugagagaaaagguuugggcagauugaguaaacagauccaugguucaaccuguuuggugauaggauggggcuggaacugaauuacccaaacagaaacuacccugaggccuuugguguguaaauagucucccaacucuguucuuuguacaaaagacgacugaacuuuaauucuucauauuugguauacaugggggccauguguaaauuuggcauuaacuacuuaaaaaaauacgucagugaagaaauaaagguuuguugaggcuuguugacuggccuuuuagcuucuuacugcauucagacauacaugacaaaagggaaugaaaaagaauaacauguccugaaggcucuuauagaauccuaaguauauggcccauaggcuuaguacugcugggccgugugcucacguggagcggaauaaauaacauccuucccagguuuagagguuggaguuuggucgcggggugcuucugagugaaaaaaacugggauuugaguuaacuguagaacugaagccaucuggaaaacuuccuaugaugcuguggugcuuacuuaugugaccgugugggggaaggaagcagaguggucuggucggcugccccuggggguuccuuaauaguuguuauaaucucuaacagacaguucccucaccccaggcaagugagcccuucuuuguuggaaaggauuuagcaccuccauuuuaucuaaaaaaaucuaggugagaaaucauugcauggauuuguuugccagauacuuuaggauucggaucacacugccugcuuccuccuccucaguaagacaaaaacgaaaggcaauaaguagguaggaguugcugucuguuguucagccccuugcgucuuucuuuucuggccugggaacauggcaucugccuuuuccaaaggcaagaaguugucauagugaccagccuauguguccuuccucagggaaagccauuuggacuuuaaacccaaacuacuuguccaacgguaccuuggcugccccaguugugguacugccagacuuggaugaagacgguguucgagaccuugugguucuggccauuggggaauugcagguaugaucucuauuaaauguuuuuuguuucuuauagggacugcuucuauuuuaguugucucagcuccuaguguuacauuauaaaugcugcuugaaauguucuuuuuacaaggguuuagguuuaaguaaauucucuuugugagguuaagugaauacuugaccauuaugaacccauuuucucuggcagccucauggcuccauggacugggguguaguggagcuuuagaguuaguuaggucuguaugcgaauuccaccucuaccacuuuauaucuuugaggccuugggcaagccguggagccuguccaagcucugguuucuucauauguaaaaaaggcauguuauaucuacuuacaucauuguuaugaaaauuacagcuaacauauuuaaagugccuagaguagugccuaauuuuugcuguguauauguauuuuuaguuuuacuguauuauauauauguacauuuuaugucaauuauaaaacaacagaacaggcugauacaaaguucauaaaagauacauaggaaaaaaucuaagucaagcaauaauaacaacaaugaccaaagaaaggagugucauaaucuaggcugugacaaggcagacuuugauucaggacaguggcccuugaauuaugguccuaaauuaugauuugcaggaacuucaguguacugguuacucugcacacagauaaaauaagaguagucuuucccccaaaucacaggaaggaauaaauuaaugaacagaauaaucucaauuuuaaguuuuuauucuggaagcguuuuucagagcuuuugucaaaguuucucuaagacuuuuucucagacuuccuagugugucugccaaggaaaugcuugugcacaaaagagucaaacaaucggcaaagaauguuuguggaaaaauguggauauggcuaauuuugucucauuugauaaccuauuuuaauuuuaauagaccuuguguuugcuguugugaucuuuguauugcauauauggaguagaguuguaaauucuggaggugaaauuauguagaauggaaugaaaucuguuaagauuuuguggcuuucugccaagagucccccaaacuuaagagugccccaucagucaugaguuuugaggagcacugcucuagcacacuaaacucucccucacauuugcaagauaaaggcaagauccagaaugagcuaaauuucugaagccuacuuaguuuuaaggguuuuaagcuuuaaggguacuuuauguucguuuucuucagcuagccaguuggucucaaaguggacccgaaccaaggauucaggaauuauucauguaaucuuuuuuauccuagccauugugaauagagagauuggggacuagggaaaauuugaauuauuacuuccaucagggagcaauucuuugaagggaacauauggggagacacggcaagccauugaacaaguuuuuaagucgugauugaauuuagaaaucuuggucuaaccaucccgucuggccgcuuauuagcugguggugguuggcaggauaguggcucaggcccuuggggacccuccauaguaaggaggucuccacuggaggaaguggcuucuugcccacucuuacucugugcccuuuguguuggucucuacucaguguauugcccaucuugcccuacagaauuuacuuguuuucacaauaggguacagcuagggcauagucucaguucugcuugaaaagugguagacaguucuaggaaaaccuuguagaggcacuagguauauagcgcagcagcuucauccuuguacugaccucuuuugaccucucugccagcaacaagggaccccaggaaccuguauaagcuccugagauggaagacucucucuucacaaggaaggaaaccuaagucugugacuuauagugauugcguucauugaucuggguuuagagugaagugggcuuggagaacuggaccugguuuuugauuacaggaacugauaaggucuagaacauuagugggaagggaccuugaagaccauuugguuaacuuucucacaccaugcuaugaucucugguucagcauuacagacauguuggcaccccuacucucuuggugcacucaggcugaugggaauaacacuaauuugugaggcgauccauuucauuuuugggccagcuccagaaaauucuguccuaagcagaaagaaaucugcuuucucauagcuuccacucauuguuccagcuucauucccauagagcuacugugaaugagucuaauccccuuucuauaggaaagcccuuuaaccauuagccuagucccucuaagcuugcuacucaggacuaaauauccccauuucucguacuguuccucaugcaaccaggaaguccaaaccccucuuuuucuugauuucuuucccuuugcauucuaguauguccaaaucucuuuuaaaaugugguacuuauaucuaaaaacagcauuuuauuuguaguauaauuaauauaucaaccuaagggaauuguuucuuauuuugauguagacucuguauuucuguuuuugcagccaaagauaauaauauuuuuucuaagauuugcuuucuguuuguaaucagcuaaaguaccuauaucuuuuaaugauuaauuauuaauagaccaguuuauuuuuuuguggcagauuuugacucaucuuccagccuaagguuuuuuugaauuuugaguuugucauaugccauauuagcuaucccucucagcuuugugauaaacuugaauucuauucuuucaagucuuugauaagaauguuuaauaggaauggggcaauagcacagugcuaugacauuccucuaaaaaccucccucuaggcuaguauugaucccauaaguaccuuuuccugguacauggcaaaccacauuucuuuaucuuguccauagaguucaugaugauaaacuuugucaaaagcuuuacugaagucaagauaucaguaaaauccucauauuucuuaacuggugacucuaccccaaaagaaauccucuagagcugaaguuggcaacuguggcuuguagguuaaauuuggcccacuacuuguuuuuauaaauagagcuuuauuggaacauccucacacccauucauuuauguguuauuuaugacugcuuucacacaagaacagcagaguagaauaguugcuacagagaucaucuagcuggcaaaggcuaaaauauauacuauuugacccuucacagaaaaaguuugcuguucucucuuugagaauaaaguugaugguguccaggcccgacaucugguguucugaugggagagcacugccucgauuaacucuagcuggaaccaaauauuacuggggauuucugguauugaaguaaagacccaggggccagccauccuauguuaagcuguaggcuagaauucugugccucaggagacuauucagcaagcaacaauucugcuucagaguagcugucugaggugcuuugaagaugcccuuugccuggcucuagugaggcaaugggacauuugcuucacuugcuuacuugcagggaaauaaagcgaagcagguuuggcuuugugcuuuccaacuugggggaguguuucugagcccguggcuuaugaggaggcagugacugucuggagaagccauuucauuagcaaacgauagggcuucuauugacuccaccccccucucuuacuuccucagccagaucugugcuuucugcuggugucuggccggaccggaaauccagugggucgaccugugaaguacaacaucguuggaguugggaaucugauugguccucagguuuacaucaccacaaauggggcugucuacauccuguuuggcuuugguaagaagcaaggcuaguuuuugcuccuguuccccacuggcauuugugaugaggccuuccuugugagacagggugaaagcucaggaacuccugacaccagccuucccauagccuucuaaugcaggggccucuuacugucccccaccgaucacaggcuauuaacucugccuucccuugcugccuccucugaagggaagacucuuguccagcacccacuuaaucaccuccccacuuguuccguguuguccagucugggcgggcucuguuagacccaucuggucaggcucugugucucuugcucagauccucaccaugggacaguucuguuaaauucaacuucucaguguugguucuucuguggugcuaggaaauauacaagcugucgcacugcgggacauuuuuguucaggcccaaaaucgagacagcucaccaccuucucugcagauagaagagccagaaugggaaaagcgaagauccaucaaccugucugagcucauugauguuuacagguagggcagacgucuguccuuggucacagugagaucucuugugaacucacaugccuuugagucucuaaguuugguugggcuggugaauauguggguagagguuuaggggaaacagugcuuaucuuaauuuaccaucuucugaucugguuaacaugaguuagaaauuuucuucucuugguaacauaaugcguugauaucuauguguuggugaccacaugugaucacuccucagguaggaugcaaggaaggauacuuagggcucugagucagaguagggagggagauagacuuaucuaacuguuugugaaacugugcugaaggaucugaccuacucuuuucuguauuuuucucuuaguugaagcaucauuuugacagaagcaaggauaguguccaugaaaucuuauuuuuuauuuuuauuuauuuccuaacuagaagcauguaguuugucacaugcaggggauuuuacccauuuaaccccaagccuggcuaauaauuguuucauucuuuccuaccagaaguuccaaaucauuuucuagcauuuucuuaggcaguaucaugguguuuuggugacuuugacagguaugaaguagaauggucccaguggcacugagcaagaacuaauucagugaaauguaugccaugggcugcugcccaagcucauuggcaaccucuggccuccuguccagaucucugucugccuucccugugauuauccuuggcucuguugccuuucccagaguauccagugugagagauauugcacuguagcacuuuuccugugaguuccuuuugaacuuguauggaauuuucuggggauccuugguuucuaaggucaagaaaaugagauucaacugaaacaacaguacaucccacuugaugagauaaugguggggcaugaauacaagaguguguacagguguacguauacugagagaaaaagccaaaguaaauggcucagaaaucucauccaagccagagacuaaccguuggggucuuauuuaacccagugaugguguugaacuacuccagauggugaaggcaccagauuccaacugcagcaaccuucugauuacaaccagacaaagccuugugcugcuucgggggcaaaaucugacaccuuacugggcauugagacuucaaggccugcgcagguuugcauuguguuccuucuuguguuugcuguuuugauccacuuucccauguuuaaaaauuguccaggacaauugcuugcaauucuuauaucuggggccagugcaagagaagggagggagaguucuuaguuuuccuguuuuucuuguucacuauugauugcuuacuuuguccuuauuugcagccagccuacuccuggauauuucacugaugaucagacauuagauuuccuucugcagauacaggauggaguugggaugaaaaagguaaaacuuugggccucagaucaaucaaagcauauguaaaguauauacuuuguguccaacccuguguuaggcacagcagggaauaaaaagaaccuaaaauaugaucucuaacuucaaagaacucaaagucucauugaguggauaaaaugaaaacucacaauucauugcuaaaaucuguagcacuggaagccuuucuaggauaaucuccuuccuauguaggaguuucuuguuuuggaucccuagcuuacaguuaggcauugggggccuucugaaaucucuugguggggaaagacagguauaaagaaauguaaugcuuuaacacacagcuauaccuaagauuucagagaagucuguggugacugggguuuuauggaagaccuuauaaaggagggaaauauaagcagcuuuuuaaagcugaaucguauuuauguagacaggaaaacaugccaggucaggggugccaagagcagaggcccagagacagaaaggauagagcauguuccaaggacacugaauagaucuuugauauugcaugaaguugcauauugugagaauauaaugauuggauggaugacuuucauuucuuuaacauuacagcagaauuacagaguuacaauuuuuuuuuauuaucgaccuugcauuuugguuuauuuucacugugaaauauauaucuauuucuauacauugcacauuguucccugagagagacaaauaauucaacaaacacuuuaucaucaccucuaaugcgugccaacuucuaugcugaaugcuggagacacaaaauuaaugaagacagagucacuacauagcucuaccaugcgguggaaagugcuguuguggagguucgcacagggguccaccgggaacacagggagcagauggagugcaggcgagcuggagggccagggaggcaagagaugccucauguuggucagggguuguaugugcagaaucaugagagcagagaaaagguuugcugaauagauaagggugggcugaggugcacucccaucagagagaugagaaugaggucggcuuacagagggccccaaaagcacagcugcagaaucuggaggaggcguuggaggccacagggcuauuugguuaugggcagaggacagauacauugauaaaaacaucauguuagggagagacuuccagcaguguuauauaggaaaagccagugccugcguguaauucaaaggaauuucugauacacuggugcuggcaggauaacggaagaaagguguauaguagguauaguagguugaagguggagaugcugaguuucagcccuggguuuuaauccugacaccauuacuuauuggagaccuugggcauauuaccuaaucuugccuagcugcaguuucugcauuuauaaaacagggguaauaauauugccugccuucauaggauuauugugacaguuaaaugaaguuaaacuauaauaauuaaaaaaagauauauauauauauauauauauauauauauauauauauaaaaugaaauauguguuugaguggauagaaguuuuuagugcagugucucuagacuucucuuuuccccaagauugccaaaggcaaucuugaagugcuugucuguuuuucuuucucugcugguugagaagauuuugucucugccggguugguuccaggaacuugugugaugcagagucugagcauaggcagagaaaggcaggacucaggagccuggaagaauagggcaagcgguuguccaaagagguuagguccuccacuuacagaaguguggagacacugagcaggagggaguaaagacacuugggcuggaggaaauuggggaacuucuuggggauuuugguaaaugagaggcuccagaucugugaggcauuuaggaugaagagcagacauaugccaggauuaugaauuugaaccccuuugucauuauccuuugacaaaugcagcuaagcaaugaauucccucuuggauuauuuuuuuugccuguuuaaacagcacugcuuuaaauuugagacuucccuagguccauaugccacgacaccaagagucagauccauaaaacugggaacaccgugccccaggacaguguucacugggccauuguuuucugagugacugcuguguugugggggauaaggugcugcuguuggcauuugcagaguggcugcucugucucucugaggacuguccuaaacguggacaauccgcguguccacaucacuuccugucucucagauccuccuuuucucaccuguaaaaugggguggacuacaugauuugaaugucccauucccacuugagaacuuugcaguucuugaaaucuauuaaaugggaacaagggcugcagaagccuggggccugguccuuagccauuauucgugcucucggaacacccaguuugcuugcaucuuaaaagcgcagcguguugauauuuguguuauuugaauaccugugcauuuuugugugugcauuuucugggccugcugcuuuuuugaggccuggccauguuuacugucugucuucucuuuuguagaugaugguuguggauggugacucuggcuccauuguuuggaguuaccgugcuccgugucacaugaaagaaacgccagccaccucagcaguuacuucagaccagaagucugucuuccucuucugggccgaagggcugucagcugcaucucccaauuccgugagugagccugggagggucccuuuuuuacuuugucagauggcagcugcugugcagggcugacuguguucuggagauguuauuugacccaucacuuuccaagggguuggaauagaaacaagucagcacucgcuggagaaaagcaggaacccuguguccuccugagccacaccuuugccuuuuagcagagaaugugcaagcugacaacagccccuaacugcuggcuacugacagugggaggcugaauaaagaauaaaaaguccucccaagauacuagauccaaauuuacagauaauucacauaugcuacgguuguugaagaggagaaaucauuaugacuggucugaagugggcagagagaauuucaaggaggaguaaggcugggcuuugaggcacaugcccugagacugaaggaacggggaugggggaggguggccagcaguuggagagggacauugaccagauaaaacugagaggucauuugaggaacuaugggagagaaggucugacaccuagaaggcagauuuuagaaagucuuaaauguuacacugcaguauuuucaugggguuggugaggcagggugcuaccuguuuuagguacuggggaguuuuuaguaagacccgcccugccugaguucaaugaaacacaucuugacucagcacuuucugugugccaggcgcugugaucucuguagggacuaaggauaaacugaaaauaaucuuggcccucuagagaaggcagaugguccacagauaauggggggaaccugacggaggcaggauccugaauucaucaaccaggcucagucaacaagucgcucaacuucucugaaccucauuaucuuuauccauuaaugguuaaugaacaugcuaauauauuuacucauuuugaggaucagauuuaccuaaaaucuagauuguauuucuaacucugacauggccuaacagugugaccgugggcaauuuaccuaacauuucaacuuccuccccaccuaugaggggacuucagaaaguucauggaaaaauguaauuaaaauauaaaaauaaaaaauaucggcugggcgcaguggcucaugccuguaaucccagcacuuugggaggccgaggcaggagaaucacaaggucaggaguucgauaccagccuggccaauguagugaaaccucgucucuacuaaaaauacaaaaaauagccaggugugauggugggcaccuguaauuccagcuaucugggaggcugaggcaggagaaucgcuugaacccgggaggcagagguugcagugagccgagaucaugcaauugcacuccagcccaggcgacagugcgagacuuugucucaaaaaaaaaaaaaaaaaagaacuuuauuucuuaacauaagcuccaucaaguucaagacacuuuguaagcacugauaccagccguuuaguccaucccuaaagaacugaggguccugggcguuucaucaugucaaugcagucuuuuuuuacauuauaaacugaaaaaaaugagagcccuuuaaagauuucuuaagauuaggaaacuaaagaaagucacaaggagcuaacucagaaccauaagguggaugccucaugauuucccauugaaacucacaaaauugcucguuugaugagaggaaugaguaggaacauuguugugauggagaagaacucucuggugaagcuuucccagguguuuuucugcuaaagcuuuggcuuucucaaacacucucauuuuaagcagauguuaucauucuuuuuuugucuuuuuuuuuuuuuuccuuuuuguggagaauggggucuugcuguauugcccaggcaggccucgaacuccugggcucaagcugucauccugccucugcuucccuaagagcugggauuacaggcaugagccaccgcacccagccaauguuaucauucuuuagccuuaacgucaacauaaugugcauuucuucugcuguagagaguuugaagacugacacucaggccuuggaacuuuuguuuuauaauugaugauuugccucugucuggucaacaagcaaaaugccuugggcaucccuccaaaauacugucaugacuuuugcuguugaccuuuccacuuuuucuuggacuggaccacuuccaccucuuguagucauugcuuucauugugcuuugccuucaggagcacacugguaaagccauguuucaucuccugcuacagaucuucaaagaaaugcuuccaggaucuugaucccacuuguuuaaaauuuccauugaaaguccugcuguugucugcagcuaauaugggccaacaguuuugccacccaucccguggaaaguucgcucaacuuuaauuuuucaaccagaauuacguaaacugaaccaauugaggugucuucagugguggcuauuguuugugcuguuaaucauugguucucuucaguuagggcaugaacaagauuaauuuuuuccucacaaauuguugaggauggucugccauuguggguuuaaucuccgacaucauuuugucccucgugaaaaugagcuauccgcgucuaagcugcugaucucucuggggcauugucaucacaaauucuucagaaagcaucaaugauuucaccauucuuccacccaaaauucaccacaaauuugaugcauguucuugcuucaccuuuuuggcagaauuuguguuacuuugauaggggcuguuuucaaacugauaucuuacccuucuuggugccucagacuagcuccuguucaggcauguuauaacaaguuaguaugaguuuccucuggugcaaaaaaaauuuugaaguccuugcauaguuuuuucauaaucugcauuuccaugaacuuuuugaagaccccuccuauaauaaaaugaggguauugggcaagauaagucucaaguguagucuucuauaaauaacuacaaaaagaaaagagccauguuacaaaugcuuuaauagagguacaaguaagaaguuuacauggaagcacaaaagaagggagauguuaauuuugccuaggguaauaagggagcuuuuccucaaagagggggccaaggugggcaccuaaggacgagaaguguagagaugggguagagaggauaguuagacagucuaagaggcaaauaagauuggcaacgguuaggcagaguaaggugaagcauggauugagggugaugaucagacauuugugcagcauggggugggcaggugagucauagcagcucagucuggaaaaggcauauuuugguuaaaugguauaagacugcuaaggaauuugugcuucauucuguaggcagugaggaagguguauggcuguuuucuucucauguuagcugagcuggagaucuguccuuucauaccugggauccuaaggguguguggaagaugcccucuucugcuuuguggggauguguugagagugagguugcaagcuuccugcucacacuucuccucacuuggggacuucuucccaugcagcgauauggaagcagggguaauauucaucccucagagcuuccauuuccucuacugcaggaggcccaagguagucccaggggaggagaggcacuugggaagcucuggagagcagccacuuacuaacucacauggguguacuucugugccuuaacaacugcauggcugcacacucauguaccugccaagucucaagucccauccccacauagaagucauacugauaaagauagucccaaugugcauuucuucugcuguagagaguuugaagacugacacucaggccuuggaacuuuuguuuuauaauugaugauuugccucugucuggucaacauuccacucauuucaggaacagauaagauuuuuguaauuuuuagccugaugcuugcaguuggcuuugacacccagugaaaggaaauaucuuuggcucacuguguuuucaugaauagauuacaucuccacaaagccccaucugcugcaagggaugaaccaguauuccaguacuuccaugggcagaagacugggacaucuugucagauuccucucuugggaccuguacauugccuuuucuuuucuuuucuuuuuuuuuuuuuuuauuuuuugagacagagucucucucugucacccaggcuggagugcaguggcaugaucuuggcucacugcaaccugugccucccagguucaagugauucuccugccucagccuccugaguagcuggggcuacaggcauaccaccaagcccagcuuuuuuuucucuuuuuuuuuuuuuuuuuguauuuucgguagggacaggguuucuccauguuggccaggcuggucucgaacuccugaccucaggucaucugcccaccucggccuccuaaagugcugggauuacaggcaugagccaccgcaccaggccugccuuccuuuuuuuucuuacaagggagaaagcauuuuccagcuguagauagugguuugaaagaguuagugauuacuauuuugagcucuuugaaauaugucucuuauacaggggaguuucuuucaaacacauucuuguaguuaggaucaggcauuagcaucugagaggaaugaguaaucaccauuuucuacucugccuuuucaccugaggacugucacgugugggaauguagcguuaccuuugcucuuccuuuuugcugcuuauuaucaggauaucauccuaggaacugagccgcccagccuucaccaccuuuaccuccugcauccugcguuccccuccauccuucuggaucuggccaacaccaccggcacagugacggcuucagagggugagucccagugccagcgggagucuguguacgcagauggugggagaguauguguuggcuguguguaaugagaccauugccccacccagggaaggaugugugcuucucagacgacagcagggcacuuucccuggugucccuggugccucuuugcuggaaugcuccccuggguggaagccccgggcucacagggugagaacccauaugcucugaauguggaggugaaagcgcgucccauuccaaagggucuguaaggugaugauucauccagccacuccuucagcagacauuuaaugagcaucaucuguaugccagacacugugccaggugcugggacuacaaauaagacuaguuucuugacccacucagagauuaggauuuggaauuaacugugaaggacaugauggagauagaauguguuuugccagggcauugauuuagaaaaccuuuuuuugaauauaacugugcacccugcauagaaauuggagaaagaagaaaaaucaaaggaagaaagaaaaauuggccauaaucuggccacucauaaccacuauuagcauuuuggaaguguucuucuacuuuacauaucugucuaaauaacacuguaaauaaaaugggauccuauaugggagacccucaacucaggaaaccaaagcauugggauugcagccucugcugccugcuagucuagguugucuggugaucuccucagcgauuccuucccucauggaaucugcuguuccuguugggaggucagggagugcaggagugggagaggaccagaugaccacaucuccuuucuuucuuuccacauucucuugcuacuuauggacuuggcugucuacuuacaaacucauuggccuugggcugcagcugguguuuguagcucucucgauuuauugggauacacggggaagaacagcuuaccuggaacuugcaggcacaccuguccacugauuggggggugggggcagggagguaugagcuuggaaaauccugugauuagaucugagugagcuguuuuuucaacaguagcauaaaauauucagugaacaucaaauaaugguaauuaagaaucuugacaccauuuuuauuacaacuuguauuuuauuuuauuuauucauuuuuuaaauuuuauuauuauuauacuuuaagguuuaggguacaugugcacaaugugcagguuaguuacauauguauacaugugccaugcuggugugcugcacccauuaacucgucaucuagcauuagguauaucuccuaaugcuaucccuccccccucccccccaccccacaacaguccccagagugugauguuccccuucuuguguccauguguucucauuguucuauucccaccuaugagugagaacaugcgguguuugguuuuuuguccuugcgauaguuuacugagaaugaugauuucuaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaauauacgugugcaugugucuuuauggcagcaugauuuauagucuuuuggguauauacccaguaaugggauggcugggucaaaugguauuucuaguucuagaucccugaggaaucgccacacugacuuccacaaugguugaacuaguuuacagucccaacaguguaaaaguauuccuauuucuccacauccucuccagcaccuguuguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaagugucuguucauguccuucgcccacuuguugaugggguuguuuguuuuuuucuuguaaauuuguuggaguucacuguagauucuggauauuagcccuuugucagaugaguagguugcgaaaauuuucucccauuuuguagguugccuguucacucugaugguaguuucuuuugcugugcagaagcucuuuaguuuaauuagaucccguuugucaauuuugucuuuuguugccauugcuuuugguguuuuagacaugaaguccuugcccaugccuauguccugaaugguaaugccuagguuucuuucuaggguuuuuaugguuuuaggucuaacguuuaaguccacagccaauauccuacugaaugggcaaaaacuggaagcauucccuuugaaaacuggcauaagacagggaugcccucucucaccacuccuauucaacauaguguuggaaguucuggcuagggcaguuaggcaagagaaggaaauaaaggguauucaauuaggaaaagaggaagucaaauuguccauguuugcagaugacaugauugcauaucuagaaaaccccauugucucagcccaaaaucuccuuaagcugauaagcaacuucagcaaagucucaggauacaaaaucaauguacaaaaaucacaggcauucuuauacaccaauaacagacaaacagagagccauaucaugagugaacucccauucacaauugcuucaaagagaauaaaagaccuaggaauccaacuuacaagggacaugaaggaccucuucaaggagaacuacaaaccacugcucaaggaaauaaaagaggauacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccguaucaccaagucaauccuaagccaaaagaacaaagcuggaggcaucacgcuaccugacuucaaacuauacuacaaggcuacaguaaccaaaacagcaugguauugguaccaaaacagagauauagaucaauggaacagaacagagcccucagaaauaacgcugcauaccuacaacuaucugaucuuugacaaaccugagaaaaacaagcaauggagaaaggauucccuauuuaauaaauggugcugggaaaacuggcuagccauauguagaaagcugaaacuggaucccuuccuuacaccuuauacaacuuguauuuuaaagauaaggcaaaauaaacacuggcaagguaaaucgccucugugacugcgcacugacagucugggaauucucaggcucccuaguguuucgggcuugcuuuucuacugaauucuugccacaaggggcacauucucucaguuccugaguugggcuuuuuuggaaauagcuucagaggaguaaaggugcaaagaccaggaagaaugugcugcuuuacuggcguccaguccuuccccucuuugcacccgugggcuagcucacugccuucuguuuauucagugcucaguacauuuccuguaugaacuuaugaguaaauaaauguauuguugaaccaaaccccucuccuguuaguggacgguauguguccauguuaacugcucuuguuuuuguccuuccucaguuggaauuaacgaccucuggaaagaugccuuuuauguuaccaggacaacagggccaagcuccgaaggccauccagcagcccugguggucagcaagcuuagucuacggugggcacuaauggagggccagauggcucagcuacaggaguccacccccaaaauuggccguggggagcugcgaagauuucucucuaggauaaaguuuguugaagcucccuacgaggugaguggcugcagaaauauuguuccucuugaggguuuaggacaaauacuaccaauuccagcuuugucuuuagaaaguaggcagaauggggaacuuucuugaguagauguguaucaagacaguuguuuuggaccaacacuguuuccuauggaugccuucugaccaugaagaaaugauucucaauuguuuucagcuggaaauaauagcaucuuccuuaggggacauuugacaauguggggucgugguuuuuauugucccaaugacugacagggguggcuacgacugguauuuucuggguuggggcuagugaugcuaacaucaugcagggcuuguagcaguuacauacuacaaagaaucaucuugcucaaaaugcuaauguucccuccccauccccacucccaagaaauauuauagucuagugcaaaguucaaaagcuuaucauggaaaauaacaaaguuucugggccuuucuggaaggaggaaauguuuacagacuauuggagcuaaagaaaaggacgggaaaauagagaaauauucugaccuuuaguuuuccugcuuuucuuugaacaucucuaccaugaaaaacaauaaagucacgauaacucuuuuuccauagaucuaaucugauggaaucuucaguugcagaagaagugaacagaguggauacccucucuacucuccugucacuguaaaaucaguucuauggagagaagacuucuucguccucauuuaccaccucccugaugguugcaaaggcuugggaaggcauguuggagucuuugacggcagcaugaucuauuuggcuggggcaucuuaccuaccuuuucagucccugcauuaauccccucuaggaacucugcguggaucguuuggaaaugugaaucucuuaaguauuuaauuuuuuugguaugucuaauuuaugaagucuugcugggaaagccagugaagucuaugacuaggaaacauuuuguuguacauugugcuguguguguguauauuuuaguguuguggugaaguuauuuuccagguauguccuaagcuucagggauccaguuucuuguccuucugaaauauaucugguuuguuuggucauuuugagacuuccagaugcccuaccucugauguugagggccacuuauuucucuccuuauucuuucccaccuguaccuuggcuacuuccaaauuguagacagaaugagaaagauuuauaguggaagacugaguuagccauccaagcauuuucaucucucuuguuuuauauccuauuuccuuagauuuuccauccaugucuauuaagugaccacaagaauaacuauauuccuaucacaaggggagcaagaggauguagucucagugacccaucucugaccaaguccacauguuguguuauauguggcucugaugguucugccagucaugaucuuuuuucuguggcgacaucagaaguguauguuugcaugcugucuucaacuuagaggagaacuggaagucaggagccuuugauguccuuauccugcuguaugucuucucugcaucuuuuucuauagggcacccuccuuagcuccccucacucuguuuucucuucuauucagggauauguuucuggacuuuuucuucugcuacuugaguccaggaugcaaccauuuuguccugcaucucuucuuuccuguagagccuuugaagcauuguauuuugggaaaauucuucuguaaauacuauaacuuuuauaaaugguuaaguuauuuagaauuaucuccagugcuuacuucucccuucuucuguauaaaucugcuacuucaauuaaguucuccucuaaacuuuuaggucauuguuuauauagcagaaaauucaauguuagcggauggaaaacugcuucuugaauaaccuugauaggucaucccugagugcaccucagguucucucuuuaccugggcuuguaucuuuuuuuuuuuuuuuuuuuuuuuuuugagacagaguuuugcucuugucgcccaggcuggagugcaguggcacaaucucggcucacugcaaccuucgccuccuggguucaagcgauucuccagccuuagccucccaaguagcugggacuacaggugcccgcuaccaugccuggcuaauuuuuuuuuuuguauuuuuaguagagacgggguuucaccauguuggccaggcuggucacgaacuccugaccucagauaauccaccugcuucugccucccaaagugcugggauuacaggcgugagccaccaugcccggcugggcuuguaucuuuuagcuuguguuaguaaaaggauucuagaaaauuaugaaguccagauucaaagggaucucuguuaauuacccacugacaggcauuaugaccuaacaggagguugguagcaguagauccaagcaugcauguugccuggccuguagauuggccuuaucagguuucugggugccucugccuuaagauccugaaggcaaauuuuguuucaacaguuuggaagucaucuguggguccagcuugacuuuggaggaauaagaagauacuucuagaguaugggaaugauuccagauaauuucugggauuugaaucuacuugaguuuaagggccugggaccuaauuugguuuaguauagaauuugaagaauuaauuuauaggcagcugaauacccaaaacuuggguggugguccugugguuuggcugagcuguccgggcauaaccugguucucuguuauguuaaggcuuucugggaagccagccacucugcgcaggagugaaacaugaaguuguuuucugaggaccuguuuuggugggauuguuugggcagaggacuguguuuaugcagggcaaaucccagaaagauaagaggaagcuagagaaacuuaauguaccugaauucuucaugguguauuugcaaacuaacuuaacauagauucuuuugacuaugguaaguuugaaucucuccuugccaaacaacauuauaaguuuaguuuucuucuuccucuugcagccgguacagaaagguguaagugguggcugaaaauugaggaagcuucaucugaccaaugugggugcugguuucuugugaaaugugucccuaagccuccuucuccuugcaggcagccacccacccaggugucuaagauaggacaugcuccuuucuuucucuaaucccauccugagguugccggcaaagccaauaugaccacuacugagaaauaguaaugacuucuacaaaugcaagggucuuacccuccucuuucccuuaaacacccucccuuuuccuuagaccccguuuuugccaucccccaaaugugugguauggugaaacuaauccccugaaugugaauugcuauccuuauugcccuauuaaagaagagccagcugguauauugucaggaagcacuauuuaaaaugugaacuguuauagaguaaauaaauaaauacucuacaggaauacacuugugugccauucucauucgucuuagucaucaaggaugguuuguuuccccauauggaaaagagaacgggcaaguagauggguggcauucuuuuuuuuuuuuuuuuaaguucuaggguacaugugcacaacgugcagauuuguuacauauguauacaugugccauguuggugugcugcacccauuaacucgucauuuacguuaguauaucuccuaaugcuaucccuccccccuccccccaccccaugacaggcccggugugugauguuccccacccuguguccaaguguuuuuauuguucaauucccaccugugagugagaauaugcaguguuugguuuucuauccuugcgauaguuugcucagaaugaugguuuccagcuucauccaugucccuacaaagggcauaaacucauccuucuuuauggcugcauaguauuccaugguguauaugugccacauuuucuuaauccagucuaucacugauggacauuuggguugguuccaagucuuugcuauuauaaauagugccguaauaaacauaugugugcaugugucuuuauagcagcaugauuuguaauccuuuggguaucuacccaguaaugggauggcugggucaaaugguauuucuaggucuagauucuugaggaaucagauggguggcauucuuuaugaaggaaauaauaggguacauuucucagaagggaugaaaaggugggauccagagaggagccuaugcccccuuguucacugggaagucccuggugugacuguccagaagggaaccacaguccaaucugaauagccuuggugggcuauuucuagaagugacccugacccugugugcuguuggcgccuucucauguuaaaccacucuccuaagggcuccugggacaauauuuaauaacacuuuuacuggguaccuacuguguggaugcaggacacugucccaggcaguguggaggacuucugugcuauaugacaaagcacucaggggcgcuucugucuucccaucugugacuuccagaacaauucgcgcguaccauggaaaguugagccacagucacacuaccguuaauuugcucaccuccauuucuccaauuuccagaccaauaacuagauguaucagauccuuaaggucgggaaguguauuuuacucuucuuuuuaucuccaugguuuagcccagaaccuggcacagaaacuaucaguaaagaagggaauucuggaugugugagauguggggugggugaaacaagauggagcuguagaggaaaagagagcaguggcacccaggaaucccuuaggacuuaaagauaacccuuauucauagccuuauucguagccucuaaaaaccaugcucaagagacggauguuggcuuaagcacauguugauaaucagcagacguguaagguagggcucaagccuacuccccaaacccgcuuaacuccuaacacugcucuuccucuacagaugaccuaacugcuucuuucagcuccuggcuggccccucuuugaaaucccuuguuccgcagcucggaguagaagucgacucccucagagacagaguggaugggcugauuaugauacuggugguagcuggucaaaggacccacggugggggcugcacuugacagccgccgagggaaacacugauggugaugugguaggcaguucggguuuuccuugaagcucuuacuaugcuugcacuugaacuccagcaccauccugguguacguguugaagguggugacagccgacgccaugcagcaggugaaggagagccaggccaugcuagggacaaaugcacaaaaagauuggacaguaagaauaggacuuucuugagagaaaaaugccaugaccucuuccuacuaguggacuagcuuauugccuuguagggauuuagggacuuuccaccauguuucagguaaagaacugugggaagagaacuuacugguuucuaaaaagagaaugacucauguaguccuaguaucagacaaggagcuuaauggauuuguuuucacugaauugaugaguugucggugccaugcccuuuucuaucuggugugccuauuguguguguaugucugugcauauuuggacuccuguuucccaagcugcauugacccuuguaaaaucuccaagauuccccaggccugaagcugagcuguaugcaguggacauaaccuacugcauacccucccucucccaccccaacacacacacacaugcccugccaaagauguccccccacucagaugcugggaggaaucaucccucuuccaucuuccuuuguuuugaacuuagcagucuuaggguccaaaaaggugagccucugaaagucauucaggaaaacauuuacuacaaaucaggagguauuauagguuguacuaguggaauuugcuucauauggaaacagugugguuuuggcuuaagggaguuuguaaugggugggagaggagcuggagauuaagagaauguggauggauucaagaaaggaaaagaagacauuaggcaaccauauuaaacacauuccugaaaacuuggaaagucaaaucccuaaaucucccugugguucugggaagcucaggaaacaggaaguuuugugagguuagggagggauuucaugaggccaagugaugguuaaagccaggucacaugcgggcacuguguguucauaucugcugccucugacaaaugcaguagguucagucugggaugcuucugggaguugacuaaugggcguugccuagccugagcuccacagccguuaaugccaagaauggccugaagacagacaaaaggugagaagugcuggaucugggagcugcauugagcugaugcccuggcugguguaguagacucagacucccaaauuauuagcgcagauuguaccacaggaaaggggauagggccucacaacagacuugcaggcuuccuuccccgaauggaaacuugagcccaucacugugucuuuucagugcucucaaaguacuuagcacuuagacaguaaauaucaguacaaguuggcaacuugcugugaauaaagagugcuccuuaagggagaaaguaagagcucucaaagauaauauuuaacuugaauguguugcuuugugaugguugcugucgcucucuuuuuaagagaacucuaaaaugacugaccccuuaguucuuuaaggguuagagaaugacccuaggguagugaaguuuuauuuccaacacgguucaguagaauaaaaauggauauagaaggaagugaagaggagaggaguaagccauuuacagagaaugcaauucaauccaaauuucaaagcgauuucucuauuucucuguucucuaauaccuugaaucauaaaaaaaagaaaaaaaaagagcacauuucuauaaggccuacagaaucagucuuguuuccccagggugacaaauauaccagguaaagaggcaacugccacagcugaugagcaggaaaacuggacaaaauaacauccucccaagacacacucgaggaauccuuccuguacccccucagaaggcagggaagaauggaugugcccugaugaugcagcccugugugguugacaggcucuugggaugagggaugaagagaaggcagggcuucaccgaauaagcaucuagcugagggcagaaaaucucgugaagguuggcuggggcuacaaagguucaggagaugacagcacuuacuagaaggcccagccauaauuccaaacauguggucuccagucuucuggacccaaguugacagucgcuuggaagacuugugaauacaucaugugggccaccauccccaggagaccuaccaaggaaacaggaaggcagagcccuuagagaaaggcuuucaugccaucugccaggaguacgauuuuggaucacccuucuugcagucaggcgcagccucuguuggaguagcccauuacccuaugccaccacauuucccgaagacuaauucacaaugggggcuucuccuuaaauacacaucuuugcaauaggugaccccagacuguaggcugagagcuauggaaaaagucugagucaaggcugcacccaaggccacugcacaccaccccuacuccuucccacccacaccccaauguuggcuuaauucuucaucuuauaugugcaucuuucacuuuauccaauggagacuggucuugaaaagcuguguguaugucacaacugaaaaguaacccaaacaauagauuuuacauauugagaaagcuugcaaauaaaggaaccuagagguaaaucauuuuguaaaguacacggugauccaauauacaauuuuguauguuacuucaauuuaaaauuaaagaugccuaccuccauucuuuaaagagccuuugggcuccuccccuucagggcaaagacucaagcccuccagcuagggcuucaaaaguggccagggccaaccacccucucucacuccaggagcaacucaccugacaggacagaggaaacagcagcaaaggcgcucaguuugagcccacaggcaggguucccagugaguagcaagucuguuaguagcaggaggaagcugaugaauugaaguccgauguaggugaucugcguucccagggauaaccauaggauuucugccagaaaccagaggaagagggagcgcucacccugacaguuaaaaaacugaauaagcggugagcauaggaugccuauuaggaguuaagacccuagcagcaucugagaaggggagaaugaggcacagcugaaaccagggaggaacauuacuucauuucuaguccuuugacgucacucacagcucccacuccauaaccaauauauacccaaguaagcuugacugacuguaaauacuguuggggagauuugagaagaaaucaucgaauuuucauaaauccugcagggaaauaauguugcucuaguuaucauuuuuugucuuuuuccucauuuaauuuuggggugguucccucccugccucccuucuucacucuuuuccuuucauuuuaccaaauaauaauaauaauaguggagaaaaaggaggaaaaagcuaagccuuccuacaugguuacuuggcaacaagaguagguuagcacuguuggugguuuucuauuugugaaucuuauuuaucccugcuguucuguuuuugcauuccugcauaugaaugaaagucagcucaaggaggaauuugugucacccuuuggggcucagaagagaaaagugggagaucacagugcaguuuagauccggagaggcccaagucaaugguaacuacuguaaauuccuuaucagacacauacuugccacaaagccccaagggaggggaggggagggaagccuucuccaucaaccgcuucccuccaaaucggagaguggggugacaugggccuugcaacguggcaaauuccaguaguccuuucucaccucucuuggcuggugguguaaguucaaugaaacuucggcaccucuccccugaaacauacaagguacaacgucauggagcuacucccugggaugguuggaaugaaaaccuuccccaccccauaacugguacugcucccucugcucugacagcaccugccccgcauagagcaggaaagcaggaaagaaugccugggugaaugaauggcacagccaagagucagcccaggugaauuucucucuucagucucugauaaugcagaagauguuuccaugagagcaccuacauagcuuaguguucccauuucccguguccagaagaguuaaugaucuuaguguuaacuaauaccuuuugcugccgcuguaccacuggaccgaagggcucuaaauuguuuccaggacuggggauggagcagugcuaaguggcacaauaauaaauauaaauguaaauacacacauuuuuuuaauuccucuuccaucucgcuuuuagcugaaauagggagaaguagcagauaucaaauuguucaugauucugggcauuagaagaacuuuaguaccaggugcuuucuucccaggccggucaccuuucagugcucuugggcagggaagaggaggugucuucagcucauuccuccaaaccugaggaacgcacaucgaccagcaccugccugcuuugcuagugugcacugaggggcaggagaccuggcagaucugccuucagcuccuugagggcucucuuacaugaucaguuacccuggcuggcuggcuucgguucccccacuuuuaaaugguagcgguaauacuuagaaugagaaaauacuuuggggccaggaagaggcuguaagaugaucugcugugaugcuuucaucucacaaaugagcaaaucaagaccuauagaaacgaaguuauaggcugggcaugguggcucaugucuguaaucucagcacuuugggaggccgaggugggcagaucaccugaggucgggaguucgagaccagccugaccaacauggagaaacccugucucucuaaaaauacaaaauuagccggguaugguggcacaugccuguaaucccagcuacuugggaggcugaggcaauagaaucgcuugaaccugagaggcggagguuguggugagccaagaucacaccauugcacuccagccugggcaacaagagcaaaacuccauaucaaaagaaaaaagaaaugaaguuacuuguaugaggucacaguugagcagagcuagggcuuuccuacaauauuccucucccuucguuuuguuucuaaacagcaauucuagcucccuagaccagaaauucucauaaugugaaaggucuaaaugaaacuuuuaagguuaauucuauuuuuaacaugcuauuuugaaccaacaagucuacuacagagggaggaagugaaaauccagaggacuuucaaccuuauuaaaaggggcuccuauagagaaggacacuggacggagguggaagguucugugcugggagaagggagugaggcccacuggggugugggcagugcugcacuuccagggcaacgccagcccuaagcgggccuaccugauuuccaugccugcauuagaucccuugcccgcccugaccccguugcucuuauaucccagaauguaggcuaccugguucuuccacaguuuccucacaggauagccacaugccacuccggaagcuccggaaggagaaccggucauccccagucucccaguuguauuguaccaccuccuggguggauguguugguaucuccauccagggacacuggcaugucaaagcacuuggcugccagaccuuucucgcacaggggcuugggcaccuucugugugcccacaaaccaguaguugcugagcagggauguuguggagaagcugagugauagcaugcugaggauggcagauaggaguguccgcuggccagagaaggccuucgagagcuccaucuguaauagacaagcacaaguggaagggaagggagcaggggagcuugacucagagccgccucggagauguggccauccuucccugcacucccuccgcucaagccauacuccuccaaggcagauaggcacaacccgccucugacauuuuucuccaggggccgcauggaagccccgcuucaggaguggucugcagcaagcacccugagggcguaagaaaaccauacgcccaaaugggggccucagaagcagcucucucugacauucuccuguccuccugucucagucccacucuuucccaaggcuagccacagaaacuagaaucccucuuucucaagguggguuguagaaaccagagucccuuuccccagagccagccauaaaaccuaaaaauauuacucuaacuuucccucugccuucccguguccaaacuggcccuaaagagguuaucugaccuagcuugugugacuguaggucauaagacucccauuccagagaggguccugccccacacccagaaggaagaaaugcacgcucagagaggccaaggagaagcagcccuugcuggguuuccccacucaaucuauuaacauuauuagaucaggccagaugcaguggcucaugccuguaauccuagcaccguaaucccuuccagaggugggaggaucgcuugaguucaggaauucaugaccagccuggguaacauagugagacccugucucuacggaaaauaaaaaaauuagccgggcacgguggcgcacgccuguagucccagcuacuuuugaggcugaggugggaggaucaccugagcccaggagguugaggcugcagugagccacgaucaugccacugcacuccagucugggcaacagggcuaucugucucuaaaaaauaaauaacaacaauagaucauggccuugauguccaaucauauuucuaugugacuguccauacuuuguugaaccuaagcauaaaaauagacaauuuucccuucaucuuugugacuucauucugaagguucccacgucacgugaaacuacgaucaaauaaacuugaauguuuuuucuccuauuaaucugccucuuaucagugguuuucagugaaccuucggagggcaaagggaaaguuuuccccuggcuuuuacacaacacggggaugaugcaucuuuaaguugaaccuuacacagauccaacuacagaaaaguggugauuugcauagauugaaugacaggggcuggccucugggcaugauaugcagcaauacacagaaguaggauaaaggugauccaccagagaggacaaauuagaaugaggaaugcagaagucagagugaauuggaagugaguauguuaaaaucuuccauuucugccucaaauggugagaguggaaucaacauagccuccagccggcaaauccuagggaggauguauguguguguguguaccuuuauggugagugccauaaugaccccaccaa

SEQ ID NO: 14939 - RNA, 1392 nt, Homo sapiens
uguaacuuuuuuuuucauucagguuucuauuuuuauucaacuauaagcaaacagcacaauuaaugcaauguucagcaacuccagaccagcuuuucuuacucccgugaagaaugaucaguuuaacaaacaccgaucuaagguuuccucccaagcugucagcgagcgcugcugccggucuagauggccaugucccaacaacagcagcgccacucucccuccugcuucuuccaggauugcucuuuaaagggaccagagcgacauacugaugccuauugaggcaucugagaugcaccguguuggggguuagccucaaugccagccucugguugucuaggugagugacaucaccauaaaaacacauuguguaccauucuggacucaggaucacaaaggcagaggcaaccaaucuuuuuuuuuuuaaaaccuuccuuaaagauucuuugaugcuuugcucuaucacuguagaccugguuuuuucccccuaguuuuuucuuuuuuacauucuggguugcuauuuucagauuaacaauuugaugaccccaucacaguaccaaaauaucccccaaaaugaaguucaaauuugaucaaaacauaaaucagagugagugaguaaaauuauaaaggccaggcagcaggaaaagucacccucaaccaccaucugacuggucaggucucaccugugccaaggggggcaggaagaggagaaaccuauuauacaugcaacacugaacuggggaacauggcuuggggccuccagaacaguucagguccccaagcuaacccacuaguucccagagaguugcucguacaguuugggcacauagucgucccacucagccugguaacacgugccagccaccggggccccgagcucguacuuuuuacggaaggacaccaccucaaauuugccacgguggucuccagaucgguugcugaggaugggcucgucacacuuuaguggccuguccugcucauaaaccagccagacauagcgguggagaccugugcccuugggaggccccgagcccacauaaucggagaggagugugucacugcugaugucauugcccuucauguugaccaccaggaaaugaugccauucucuguauuugggauccuuccugcugggagcaucagggucugucaggaccaagguguagagcuucccugaaucaagaccaucccacuaaaugcuggugggucuauucuuaaccugggugggcgucagcacuuugcccagcucguccaccaccgcccgggcguaggugacaugcagcaggugcugugaccgcucguccauuucucgcaggcucaagggcccggaccacuugcugagguccaccggcauggcaaggccaagcagagcaugcagccgggagugccgcgguaggc

SEQ ID NO: 14940 - RNA, 1392 nt, Homo sapiens
gccuaccgcggcacucccggcugcaugcucugcuuggccuugccaugccgguggaccucagcaagugguccgggcccuugagccugcgagaaauggacgagcggucacagcaccugcugcaugucaccuacgcccgggcggugguggacgagcugggcaaagugcugacgcccacccagguuaagaauagacccaccagcauuuagugggauggucuugauucagggaagcucuacaccuugguccugacagacccugaugcucccagcaggaaggaucccaaauacagagaauggcaucauuuccugguggucaacaugaagggcaaugacaucagcagugacacacuccucuccgauuaugugggcucggggccucccaagggcacaggucuccaccgcuaugucuggcugguuuaugagcaggacaggccacuaaagugugacgagcccauccucagcaaccgaucuggagaccaccguggcaaauuugaggugguguccuuccguaaaaaguacgagcucggggccccgguggcuggcacguguuaccaggcugagugggacgacuaugugcccaaacuguacgagcaacucucugggaacuaguggguuagcuuggggaccugaacuguucuggaggccccaagccauguuccccaguucaguguugcauguauaauagguuucuccucuuccugccccccuuggcacaggugagaccugaccagucagauggugguugagggugacuuuuccugcugccuggccuuuauaauuuuacucacucacucugauuuauguuuugaucaaauuugaacuucauuuugggggauauuuugguacugugauggggucaucaaauuguuaaucugaaaauagcaacccagaauguaaaaaagaaaaaacuagggggaaaaaaccaggucuacagugauagagcaaagcaucaaagaaucuuuaaggaagguuuuaaaaaaaaaaagauugguugccucugccuuugugauccugaguccagaaugguacacaauguguuuuuauggugaugucacucaccuagacaaccagaggcuggcauugaggcuaacccccaacacggugcaucucagaugccucaauaggcaucaguaugucgcucuggucccuuuaaagagcaauccuggaagaagcaggagggagaguggcgcugcuguuguugggacauggccaucuagaccggcagcagcgcucgcugacagcuugggaggaaaccuuagaucgguguuuguuaaacugaucauucuucacgggaguaagaaaagcuggucuggaguugcugaacauugcauuaauugugcuguuugcuuauaguugaauaaaaauagaaaccugaaugaaaaaaaaaguuaca

SEQ ID NO: 14941 - RNA, 20080 nt, Homo sapiens
uuuaaaacacggugaaaagaaaccgcccauuacacaccccaguacaccagcagaggaaacuuauaaccucgggaggcagguccuuccccucagugcggucacauacuuccagaagagcggaccagggcugcugccagcaccugccacucagagcgccucugucgcugggacccuucagguaggacagcucccaacgcuguggggacucucagcaaaacuucuccuuccuuuccacggcucugcuucuucugaccucaucuuaguuuugcuuuuucuuuucuuccuucgcuauuuuucuaugauccucuaagaaccaaguccuugaaacuuuuggcucaaaguggauacagagacaacuuuuucuagaaaguucagaaaaguguauuuugaggacggagucuggggaaaucaaugggauggggcuaaaaucgugccuggcagugaccggguucuuguucuaggauguggagggagcagggacuuugaaacaaacugggauaggauccuguuuauggaggaaacaccacacaccuuggaaaugacaucgggaacuggccagauguuuuucaccuccuccguuuugauuccgauugcuucaggacuugaacuguuacucugcucgcugguuguugguugggauuuuuuggguggugguggauagauaacugguuuucaguuuauuuuugacauugcuuuuccugccuguuugcuucccuauucacuucuguuuaaauuuaaguauuuuuuuucuccucacaggaugggaagagggggauugguuuguuuaaagaaaacuguuggccgggcacgguggcucaugccuguaauccuagcacuuugggaggcugaggcgggcggaucaccugaggucaggaguucaagacaagccuggccaacauggugaaacccugucucuacuaaaauacaaaaaguagccaggcaugauggcaggugccuguaauucuagcuacuugguaggcugagacgggagaauugcuugaauccgggagauggugguugcagugaacugagauugcgccacuacacuccagccugggcagcugagugagacucugucucaaaaaggaaaaaaaagaaaaagaaaaaaaaugaaaaaagaaaacuguuagagagagaaagagagggaggcaaaugguguuuuaaaugaaacgugggagggguucacuuggucgaagcaggagcugaugaggauuccagaugccuucucuuggccagauguggagggcgggggaggcaaaagggaagcuggguuuggagaagaggguggggcaggagaacuucaucugugccuguuaaaaauuguugaguggcuuugugcuuucaccccagaaagagcugccuuucagugcugagugaaaagauggcauaccagaaacgauaaaagaacuuuuaaaagaaaguggauguggaauuucuuugcauggaaggcagugauuguuuugaaaugcuuaucuuuucucuuguucccgaaaugugauuguauaaaugcaaacacucaugcuaaucaugaaaucuggaggaaugaagaagggugcuuuuucuuuuuuuucuuuuuuucuuuuuuucgguuagcauuuugggugagugucuaccgagguguggcccauuucaacauagacacugguauauuuuuuccccaaguaaacaagaugagaaugacaggauucagcuugucugacaaaguuaggcuuuuccuuuagaaaggcaguacguugggagagaaguuacauguaaucaacccuguguugagcaggcaaugcuccuuguaaaacugccccaagggggacgauugaguaggcaucagggcaacuuuucaagaugaagggaacuccuacauuugcuucacauguuuauuauuuccacauuacauggauguggauuagccauuauuaaaucaauaguguuaauauccugugaaaauuauacaaaucuuuuaguucugugcagguuaaaacuaauaaccagucaacacacggaaagcccugacaauguugggaguguaaaccaucaugaacugcauuauuuguggcaagguuucacaugauacuguagguuuauaaaggagaaaauaugcuacauguuacuuccuggaguuugaagacaauuuagaaaaauaccguucugauuccugcucucugcucuuccuccaagaaguagugaaagagucccuuagcugugagaguuuuucuggauuucagcuuugacaaucccgaaaugugaggguuauuuuucccccccacucugcccgcugccucccacccucaggggcagauccaauuccacccagacuccgaagaauggggcgggggcgggggcugcaggacauccugucuggcgcccuggucagagggccccccacauuuacauuguuuguggguacuaaacugucuugggaguuggcaaaaggccaucaagaaccaacuuggagcaaaucacauccuuagaaucuggcuaucucccaggacugcugggcagaccgcuggggaaaggaaagagaucccuucuguggagaguggaaaggacucacugugccuuccucagcccuuccugcuuccuccagagaccagauuaggcccaucaaguucccagccuugucagugggcuucauggagaccccucacccgggaauguagacccucuuggcuugcucuggguggcucuagggauuucagguagugccagacccacagggacuacuggagagagacacguugaagaccggggaaaacuuguggaugaggcaagacugcuuuucuguagacucuauggagccugguggggcacauaacugaaacguggacacaggaaagggcaggaggcaagucaguuccauuucauccuucauuucguucacagaauucuaaauuugggagggaucuuggaucucauucauucuccuacuguaugcagaaaucuaauuuuuacaccaucuugaacagauggccauccuacagaucuuaaaauuuccagaugcggggagcucagaaccucaguguguaccuccacacucauuccccuuagcaggccaacucuaauuuuauuaaaguuccuuaaaucaagcaaaaucaacuuccuuauaacuuccugauucugcuggccugaaacaacucagaaaauaucuauucugguuuuguuguugcuccacccaaugauucucauccucuaaacacuuaacgccuauuuaauauuuaaugaauacaacuugauggaucuacauugcauuaucuuuucuucuucuucuucuucuucuuuuuuuuuuuuuuuuugccuaaggcucagaagggcagggagcauuuuugaaguuuggaauuauguacauagucaaucauacucacgggguuuuugauuuggagguauuuaauuuucuaaaugcaugaauaugguuccuucuuuaaccucccacauguauguacauagcugccuaacacaaaagcucaggccuauuugggacucucagauguacauacucggagggacacacccaguguugcuaccuacuaggucaugguuagaucaauccaauaccaggacacaggcuucuagcuaggccuuuuggggauugucccauaauuugguccauaguucauguagcccacaccuauacauugucaccacccaucauaguaauuacgggaacaggcugcccaucaaauguagccuccuuguaauugcuggccagcaaucuggguaucagccccuugagaagagcuccuaacccuuaaccagcguagaacgggaauuuucucaccauaagcuucccuuuucuaauacucuucccagauccgcccaggugaucuugaauuucuggacugcacuugcuauucaguaaucaaggaagcccaaauaugguuccaguuagggguuuacuugaaucuucagcacccagccccgacauacacacguccugagacugcucuuugcaacaauucagucccugguguccugccuggguaaaaccauuuccuucaauuuaccugggagauucacugauacuaaagcagaaagaugaaagcacaaacaccuguggugauugcugcuucucucuuccuuuuuaacaaaauguuugggucaagguuuucuuuuguguuguggagauggcauuucccuggaacugcaauggaauccucugcuguuggugcgcuuggacuuacguggcugugacaguuuuucuauuugcugagccuguuucaugaauuguuucuucaaaccggguaguuaaacuagagagcccuuucagcacagguugaaagcguggcaagaauccuggagcagauguaagacagcugacuaggaagacagaggggcagugguguuaucuugacgcugccauguaaccacaggcgagacacuugucuucuugcuuucggaaguugaacuuggugguucuuucagaccccuuauggcucugagauucuaagauucacccaggcgugguaaucccagcuacuugggagacugaggugggaggaucacuugaaccuaggaguuugagaccagucugggcaacauagugagacccugucucuaaaagaagaauuuuaaaaagcagggugugguagugcaugccuguagucccagcuacuugggaagcugaggcaggaggauugauugagccccagggcuuugaggcuguagucagcuaugauuguaccauugcacuccagccugagcaaugaaacaacacccugucucaaaaaaaacaaaaacaaaacaaaccaacaaacaaaaacaccaaaaaaacgaaaaacaaaaaaauuaagauccuaccauuucuauuuugagauaucccuugcgcugaugcuagcagcuggcuuaaucuguaaaaauugauagaaaagugaaauagggcaacguguggcauugaaaagggcauuuugcagaggauucucgucuccugggugccuugaggacccacggagccuccucugccccauccacucacagauucuuuagguaugguguuccccggacuuacccucagccaugagcauucacucggcacuaggaauaaaagaaagagguuugaguaauuaaacguaaagggugccagcucagaugaggagggcaggcugagucugugaagacauugacaacagcaaagcauucaccaggaacagaaucaggcucagggagaaacugagcuggcucugggaaagaaacuccacccucuucuugaggagggagacccugcagcaugaaggugugguguacagguguggacaggagcaaaugaggaacaguuugagaggaggaagaggaaggugcaacuaggacaggagggagggagggagggcaagugggaugcuguuucccaggccuguguguugagggaggaggcaggcagaaagaccuagaagcaggagaaaaagcuaaguggauagagaaagacagaaagggggcaaaagagcaagggagaagugaugaggauguuuccccuuccauccuuccacucuuguuuggggaccacccacccucaauguuucaaggcaguccuucggucaaaauucgauucuuuguccccugugaagaaucuuuugucgcauuggcuacuucuuguuuuuucaggaugguugacaccucuuugguaucauuuuaguuuccacuacaugugcccaccaggcuggaaccucuucaauguuucuccucuuccaggucagaucagagcugagagcaaaacgggguucuugauccuuagacuucucauuucaaagaaucaaagacccuuccccaggacgcuggagaaggggaguuggacagagguuugcaacccugaaacaacuaguuuggggcaaggcaguguguucacauugaucucagagaaagcucugaagcugagaccuggagcuucccuuuauugaaagauagucuccaugucugggugggguggggacuccugugcugaggguuagaagguugcucggaguuugcagggggauauuguucgggucuguuuuggccaggcaggcuggcucugcugggugggacuucucagcaaaacgacagggagaagcaguggccucggaagacccuguguuuuuauaauuggcacaguuuuaagggguauaugcugacucucugauuaacucagagaggguaggaggaaaagagagaacaguagaucugguagaaguucuagaacuuccaccaaacccuaagccaagagacaggagagaaaaaaucaugccagguggaagagcccugccuggaaggugcgaaauggcuucaguucugauucaauuccauuucuccuuuggggacgugcauuuccuucuuaucaagggguuggacugaaugaccucaaugccucucaaccucuaaagaacgaauugaaaugaagcccugagcccaccugaugggucuggggugucucuaggcgaggggccuccccucccagcuugccgccuuccaggaggcugcagcuuugcugguugaagcauguugccgccaucuacuguuggucccacccaagcgccgcuggggccgggccacaccuagguuuucuucccaaaccccuaguuauuaucuuggcaaccucucccuugaagacauucuggcugccagaacacucguuugucaaaagcagaaggcaacucacgcuuccguccucgcccagggaacaucgccugaucccuugaccagcugcagucugggggaguaggcugggccccaacuucacagcccaggucuggccucagucuuugcagauguugcccagauccaccccuccccuggacacgaaggaggacaagcggaaauaagagagagagguuauucuucuugggagcauuugcaaaaacaauauucaugccacuuguuugccuuuagcauaauuguuggcccucaggcucugccagagaagcauaaagcccauuuccccggcccgagccucucauuuuacacagaggaagagaccaaccaaccaggaacuguguggcccccacucugugccuggcacaggccuucagcccucaugcuaauccugugaggucuacaggucacaguucagacaugguggagccaggauuggagcugagaaucccugcucugugcuacuuugaacucugugccuguaggagccacugaccagagagguuaugugauuuuucuaaagucagaaguuggucaggggcagauuuauuauaagaaucugguucuccaauagguucucucucucucauacagugugcuugccccacucccaacccacaccuuggcuccucaccccugacuaugugagacucugugcuagucuacacagcaccagaccaacacgacuugcuguauaauaacccccauuuauaauagccugcauuuggaagaugaaaaaaauaauuguuuucccugcagcauguaggucccuguuacuuuugcugcuugauugacgauguuucuccugguuguaaaaacugcccuguauuuuccaacaucaaguccuaccugagguuccuuccuuccacaccaaacaugagcuaugcagaggccggaggaaauggccccugagaauccuuuuucuccccauguuucccacggagaaauuaauccccugcuuucccaccccugcauaaacacaauauugagaauggaaaaguacacuugauauaaaacaacaauaacaguggccagagaggcucauccaaggucucauccacucagccugccuuuaaucccagucuuuuccuccuccagacacauccucuccggcugcccccagaagggagugcuuccuuuucugcuuuuguguuacaugcgcauccauuuugccaaccaaaugauccuucaugggaaacaaacacaucaaaaccaaaccaacaaaagcaaaaugcucccgacuugcgcagaggacagaaaggcuuucgugccacccugcguggugucuuaggaaggagaggcagcugcggaguuucaggugucacgcugaggaaggugguguggggucgucugacucaugggggucaguugaccagaagcggcuacgccucucucucuccucgugcuuuggaggaagcaccacgucuuuggucagaugcugugagaaagcuuucuccaaaguuuacaguuauccagaaagagaucagaaucucacugucagaaaaacacuggccagcaaaaagacagggagugucuagcaguaaucucaggacuguguuaugacuugacugagauuuugagaucuaaggugaaggccucuggugaaucuucugauaaccugguaguucugcugugaagacaaccaugcuagaaagaggaagaauuagucuagucagguaaucucaccggcagaauuaaaagucaugguggucguugcaaagagcacacucggacguauugucagaaaaaucuuucuaaucggggaagggauccugguagguagugagcucuccaugacuggaggagguuaagcaugauucagauaguucuuuggucagauuuguagaugacuuucuugaauugaaaaggaauuuuaaagaccucccucuucaguccugagauucuauaauucaaagaaguagagagaaagauuaaaucugcagacaaacuaguguuuagaaauuuaagacauuuucuuugcauucacuuauuuccucuugaacaaaaggcaacacacacauauauacccuuguauauucaaaugcacucaggaaacagucacauauuuacauagguauuuauauagaaauauauaacaaaguuugcauacaauaagaugcucaauacauaguuguaguaaaguauuaagcaauuucugaaaaauaauaaaggacuaaagucuauguauguuaaaaaaaaaaggaaauauuuucccucuauaauucuguguuuauuaugaagucuucagucauuuugacauugauuauuuuuccauggggaagaaaauauggccauccuuaauucauuuauuuguucauugaacagauauuuauuugguaccugucacaggcaagacucucccuucagggacuuaaaaucuuagggcugucaucagugguuuuaauaaaaagcuaugugagggcaauagaagaagagagaaaagaaaacugcuccuaaccuauggaucugggaaggcuuuuuagaagagguaggauuuuagcuugguugaaaagaauuugauagacugucacugaaagaagaauacaaaagcagagcuuuuauuuuuggaaauccaaguccugggauugcaagggcuggcuugaggugcguggagccucuuuccugcugauugguggugguuagagguggggguuuggagguucuugagcaggggagugccauggucagauaacccaguagcaggguagaagauauguuagaggggaguuguucagagacagggucaugggugaggcugaugccauggucaggcuaggaccugaacuggacaguagcaaugggaauagaacauaaggaaggaugugagauaaguaauggagguagaaacucaggguaggacugugauguuuugggcaacaaaaguggaaugaggggaagggaagauaggacauuuggcaguggucauuacugcucuuuucuccccagaaaaauccuggccuuucuuaagcugccagggaaaugccagccagauccauacccugcuucucagaaagcucucucgugcccuuuuguagagaaggucuccaugaugccuuucauucugggagaaucucacccacucucaaaugaaucauggaaauuugagcccugagggccucccccaguguuugcaucgucuucagcuccugauuucugagcaugcuccccucccaccccucagcuagggcuaauucuucagugacucaagccccaggauuuugaccacuuccuucacuggggaaguggguuuuugguugcucuauucuauuguguugcucccaguuauuguguuuuaggucacucuuaaagaauugcugcugccgccaggccccauggcaguucagugaacacacagacuucuggacaggaagaaguuaucugacuccuagguuagcaaucagggaaccaaauuaugcaccucuaaacuucccuucugguccuuagaagucaauucuucucaaagucucugcagauuuaguuacccaccagaaaaggaaaggcucccaugggggccugaguaauuucucacuggucagagaacccuaaaaguguuaggcugccugaacaaaggcaacaaggcaaugcauggcagucucagggcuguguuccuuugauucuuucauuugugugugugugugugugugugugugugugugugugguguguaagagggaggcaagaagccaauaaagauuuaaauggauggagauaacuugagagguuugguuaucccucuuucccuucccucaugucucauauuaguuaguccuuuagagcuauagucacgagcaauuuuaauccucaggguucuauuuuauuuuauuuugagacggagucuugcucuguugcccaggcuggagugcaauggagcgaucuuggcuuuuugcaaccuccgccucccugguucaagugauucuccugccucagccuccccaguagcugggacuacaggugugcaccaccacgcccggcuaauuucuuguauuuuuaauugauacuagguuucaccacguuagccaggaugaucucgaacucccucaggguuauuucuacugacuauauuagcuauucuguuagcuaagaacuuuaucugaauacugaauggucaguguuugugagguuugcauuagagcuaggagcacaaagacaccucugcucuaguguggucugggcaaugcagaaagaaaaggaggaacagugaucagaaacaaaagaugguggucagagguagggaacugcaagccuguccguuagggcagaaagaagaacagaaaagggauaucagagaccuguguguggcuccgaggugcugaucuccauuucucuuaauaauacuucucuccagagucaacauacauggguccuauaccuuccucaguuucccacccagccccuaacugccccugugccauguauguuagguagaugaggcuuaagaaggagaucauccuccacucacagugguggguacagaaauguguuccuggcauccacauagaagucaguggacggccuguucuuuaaaaaugcaaugaauugauaagcucugcuggccuaggucugggagucuaagcaccacaaaugaacgcuguuaugagcguuccccuacaacuuuggaacugcucagugcaccaaaugcucugcaaaaagcgggucuugcuucaaaguauucagaauugcaaugcugugauucucugcaucuugguuugcgcugccucacuaggacuagggguaugcuuuccacuggagagugccacccauaucauuuuagagagggcugagggagaagucuacuauuguuuuagugaaacacacugcuaagaaauaaguaguagccaccaauacuuccaaugguauaaauucucauaaaugguauuuuuuucagugccuuuguaugaagcaagauucacaauggggcagagaaugaaucuccccacaagcuaccuugcaaguaauggguggguggaaguuucaggagcagggguucuucuguuuauuauacucugcuauuugauaaaugcccagacauuuacccauuaguuaccacuaauggcuuuuucauaaagaccucagugaucgccuccucccagacugaggguuucccugggggcaggagguaucuagcacaguguaaagacuggguaacuagggaugauucagcccagaaacucaagaagauaacucauucuguuuucaccuguguuggggggaaggccauugaaaauaauggaagccccucuaaacugacagugaaugauauuaguaaaaccugacaaauaaugggccagugaaaagauggagaaguuguagcuuaagcuaaacagccccuccuucuggcuggauacagcagcuaaaaacagagagaacuguguguuuugcacaagaccgcuugcuaacucaagacauuuugcuucuuuccguggugaaaagacagggagggcaccaucacaaaaaucuaagaugaaagagagucgcucuuuugcuugauucucacauccauucuuccagccugcaaugggcagggcauauggucagguggauccaggggccaggcacucgcacacaccaccagggcugugaugcaugggcccagguagaggugccgugggaggggucauugagacagagagugugagcugggcagaggaaaucagacuugacuuuagggguuacagagcaacccaaggagacaaaaugcugcugaauucccaacagccuaucagggagggaauguuuucugugacucauuuaaguggccucacuugguggauuauauucugucauuggccccuccagcccuucccccuuuuaagaagaggauguuuguaaauuagaagcaacaggaacaagaaagucauuugaagagcccgaggaggauuaaacauaaguauucguuauguaauauuuguaauucccugcaaucagccuguuccuuuccccauagggggcaaggagaucaggaucuggugaggugugaaucuugggagguaugaggaaguugggcugagaaagugaacuuucuccuggucuuuccugagggugugcucuuagaggucuccccccuuaaggggcaaggguuagacaaaugacaauuucuaagaggaccgaaaggauuguauacacccugccucgugaacuagacagcagauaucuuauuacuugcacuuaacauggggcagccuagcgauugaguaacuggguuggguuggcaacagcuacccggcuucacuuaugaauaauaguaauaauaauaaccgcagcuaaagcaaccccauuauuaguagcugccaugugucagacacuagguguuuuacauaaacaaucugaauucauccucacauuucccuuugcaauugacauugcgacuuccacuuucuaaaugaggaaacagaugagcggucaaauaacuggauaugauucuaauucauccucugucugauucaaaaaucucuuuuuacugugcauuuaagucaagcagaaaauuggggaggugugcuagaaccugagaaaagcaaaaaugaauuugaauguguggggggauuacuaauagcagacaugaaagcuccaaccucuccccugaagaggcaggauaaacgucauaauuuuugcauucacaguuaaguuggacacauuccuaaaaaacagccuggguuggaaggaaguggccagauugggaaggggcuguuggagacggucagggagaaugguggaagccauugucugccucucauuccuugcuugcagagagcaaggcacccugauguauauuagaucacucuagauuuuugguugccugauaaagacagugagaggagauaaaaggcaugugaaguguuggaauuauaguaucagugcucucuaauaaauaccugauguggcaugaaagugccucaagcacauucaaagcaucaauuaaauuagguggagugagagagggcaguggaacaauugcaggaugcgccuggccaucuccucccuugguuggggcauccacacauccauucugucuagggugugaauaaccucaagcccuuuccuuuugaugucccucugagccugcacugcuuugugacagucuuaggcaugacaaagcucuccuucuguagcugacauaaaucagaauagccucccccauguguauccuucacacuuccuuuauuuccuaggcuuuaugaucaaugggcucccuucucugcugugauuauggcugaaagcuuuuguuuauccaugcacauucuuaaucgauauuaguucccaauccucccacccugugauuuaugcauuugccugucuucuguauugaguccugaaggauuggaauuuguguaaaugucauguacaaggagaaggcacauuuggugcuaucucaaguugcauuacuuuuaaagcccccagaaccaucacauugagcuguggaaaauaugacucucugcccagaccaauggcaggcuuccugccaugaggcacacagagcccaaaggcucagguguaguaauacuagucugaaaugcucagucacagggugaccagaccauuaaacuguaauuagguuguuauaauuauugaaaaccaaacagcauuauaauaauagaauugugccucucacauuuuauaucucgcccaggaucauauuaguagccuauucaguauaugggcauugaguaauagcugcuauucuucagaaggcauuuacuucuauuaaaagugcugggugagcaauuugaugaaagcauggacauuuuccuaguggaaaauggacauuuauaugacauuguucagagaccuggaaauuauaaaggccuacuucuuugaaaaucaaaguccuauuuuuaaccucuaaaacacaaacaaaauaaaauacgaacaguuaucauaaaauguucuuguuccuuuuuugaaauagaauguauuagagaaaugaauauguaaauacccaagaagaaaccaaauucuguuuccauguagguauguauaacuggaugaauaggcacuuaggcaaaucagaacuagguuacagggguguuuucaggaauuuaugauuagauugugaugguuuuuagugcagcucuuccucauguuagcagauagcccacacgugugggaaagcugagucgucuuauugaaucugacaguaaccguuuuugucccuuucuuuuucuuuucagaacucucuuugcucacaaguuaccaaaaaaaaaagagccaacauguugguauugcuggcugguaucuuugugguccacaucgcuacuguuauuaugcuauuuguuagcaccauugccaaugugaguaauguucuuuuguucauucauucauugagaaaucauucgaauauuuacaucaagugcacaaaagaaguuuaagccacagcccuugcccuucaugaacuuacagcucaguugugggaaaacaaaauaaacacacgcuugcccuucaaacaauuaaauaacaggaggauaaaagugaauguccacaggaguaauccugccagagcuguaggugguuaagggcuggaggaucuagugcagcuucuucggucucuagaagagccuucccagcagcaggggugaguggagcuugaggugaaccuggaggagugguagauggcugagguuucucuuagugaaagagggaagguggaaggaucauagggaugcauucaggugggagugcuagcaaaggagcauauguaggaaggacaagcuuuggucagaggauaaggaggacacacaccuauguggcuggagccgaacuuccccuccuucugagaagcuugauuagaaggauagaugggaagaagaggaugccagacugacaaauucaaauuuugagcaaagaguagcaugugaaaguggaguuuugcaagauuaacccagugccacugaauuaacuaacucagacaaaacgagaaaaaaaaaauggagguagugucuuuucucucugaacccugggcuacucugaccucuagugguggcuuacagcgcccaauuugcuuuuacuugugcuuuucucagaaaaaagccagcuccuuggaccuaaaaaccaaggccaccaaucacuaggcaggcaaaccaugguuucagaaucuguuuaggucccuaucacaguuaaaguauaagugaguuuuaaaguucagauagaagagcuuugcaaacauuagugggugugaucauaagcaaggcuaauuaagaauaacugugauaagacaacccccgcccacgugaccuccuuguuuuguaauuuagccauucuauaugucaacuccuauaucuauccagauaaaucugauaagcuucuucaaaguguauuaaugagcgccaaagcgcugcguaucugugaauuaccagccccuaauauaaggcuaggcacacaguuguuuauugaaugaagagcagggauuggcguaggugaugcauguucccggccccaccuuuccagugugugcauuuguguguguguagacaggacacugcacuuguuuucucuuccagaaggauaauuccuuuucuugggccaggcaggaagggauggcggcaccaugaucagucugggggaauccauucaggucacccuucagcuuuuaguagccccuacaggaaagcacuugcuguaguauuuuacuaucaaauuacuuugcauguugugacagucaaguuugauccuucuguuuagaugaaaguggcuuauuaaccacuagauucauuguuauuuucccaguaggucuuauguuucuuaauuguuuccaguuggacauuucacuuuuuuccugguuaaccagggacuuaaaugaaacaaucuuguuagaguauaugaacugcacauaccuaagccaguuuccucauccuggacuucuguuucucagaaccuuagaauuuuaaaccacugugguugaguuacuuccauuuuuguuaagucgugaagaauguggagcccaaagagggcuaggugauuucuuucuggguuucacauucuucugugucucuucucuuggcaacuuugugaacuucaguuuuaaucggaccuuauuuccgcccacagauaagcugcauagccauaguuauagcuaaauagaaugucuuuauuaaaaucugaucccgaugcaagcugauuuguuauuuuauuuuuaaaucagagggccagcuuucaauuaacauuuucuuuccuucugguuucaggucugguugguuuccaauacgguagaugcaucaguaggucuuuggaaaaacuguaccaacauuagcugcagugacagccugucauaugccagugaagguauauauaaagauauugacccagugcugacaauagguguggucagggaauguucagccccuggagugaccucaugcccuuguucuccucguccugugucuacagaugcccucaagacagugcaggccuucaugauucucucuaucaucuucugugucauugcccuccuggucuucguguuccagcucuucaccauggagaagggaaaccgguucuuccucucaggggccaccacacuggugugcugugaguaucucauggguagacuccaguuuacacuuuuaaguccaucuuaccauggguguuucuggcaacuugaacagauuagcacaugguucagugaaacuuccuugugcaauuuucuccucugguuauuuguucucuuguggagaaccuuggauugcugcuuagguuaagaacccucaucugcuucauuguucaaaaccagugcuccuggguagcuaccaaguggcagugcauaucuguuaguagcacguguguacaagacacuucaagaaggcagaaagguaggaguucucagaaagaugaaaccacugccacaaugcacaucauuauugugauucucacuuaauuguuguucuuucccaauauacucgguuugguggaaggacaugcucuuuugcaucccugaguagcuuuccuagacccacaagggccagacaggacagcugggugguaggcaugagguucuguguuuuacaucacagcguggccacacaaaccagugcagacaugagagcccagacaccucuaauuuaucaacauaccgucgagcuuggcccaggggacauccaucagaacuccuguuuagggacaaacaagcagaauucauuuuccuauugcuaaugagggaaauaggaucuucuuaaaauuaguaaaacuuuuucucgacuuuaauguaagaaaacacaccgacaaaucuccuuuuccccugcagggcugugcauucuuguggggguguccaucuacacuagucauuaugcgaaucgugauggaacgcaguaucaccacggcuauuccuacauccugggcuggaucugcuucugcuucagcuucaucaucggcguucucuaucugguccugagaaagaaauaaggccggacgaguucauggggaucugggggguggggaggaggaagccguugaaucugggagggaaguggagguugcuguacaggaaaaaccgagauaggggaggggggagggggaagcaaaggggggaggucaaaucccaaaccauuacugaggggauucucuacugccaagccccugcccuggggagaaaguaguuggcuaguacuuugaugcucccuugaugggguccagagagccucccugcagccaccagacuuggccuccagcuguucuuagugacacacacugucuggggccccaucagcugccacaacaccagccccacuucugggucaugcacugagguccacagaccuacugcacugaguuaaaauagcgguacaaguucuggcaagagcagauacugucuuugugcugaauacgcuaagccuggaagccauccugcccuucugacccaaagcaaaacaucacauuccagucugaagugccuacuggggggcuuuggccugugagccauugucccucuuuggaacagauauuuagcucuguggaauucagugacaaaaugggaggaggaaagagaguuuguaaggucaugcugguggguuagcuaaaccaagaaggagaccuuuucacaauggaaaaccugggggauggucagagcccagucgagaccucacacacggcugucccucauggagaccucaugccauggucuuugcuaggccucuugcugaaagccaaggcagcucuucuggaguuucucuaaagucacuagugaacaauucggugguaaaaguaccacacaaacuaugggauccaaggggcagucuugcaacagugccauguuaggguuauguuuuuaggauuccccucaaugcagucaguguuucuuuuaaguauacaacaggagagagauggacauggcucauuguagcacaauccuauuacucuuccucuaacauuuuugaggaaguuuugucuaauuaucaauauugaggaucagggcuccuaggcucagugguagcucuggcuuagacaccaccuggagugaucaccucuuggggacccugccuaucccacuucacaggugaggcauggcaauucuggaagcugauuaaaacacacauaaaccaaaaccaaacaacaggcccuugggugaaaggugcuauauaauugugaaguauuaagccuaccguauuucagccaugauaagaacagagugccugcauucccaggaaaauacgaaaaucccaugagauaaauaaaaauauaggugaugggcagaucuuuucuuuaaaauaaaaaagcaaaaacucuugugguaccuagucagaugguagacgagcugucugcugccgcaggagcaccucuauacaggacuuagaaguaguauguuauuccugguuaagcaggcauugcuuugcccuggagcagcuauuuuaagccaucucagauucugucuaaagggguuuuuugggaagacguuuucuuuaucgcccugagaagaucuaccccagggagaaucugagacaucuugccuacuuuucuuuauuagcuuucuccucauccauuucuuuuauaccuuuccuuuuuggggaguuguuaugccaugauuuuugguauuuauguaaaaggauuauuacuaauucuauuucucuauguuuauucuaguuaaggaaauguugagggcaagccaccaaauuaccuaggcugagguuagagagauuggccagcaaaaacugugggaagaugaacuuugucauuaugauuucauuaucacaugauuauagaaggcugucuuagugcaaaaaacauacuuacauuucagacauauccaaagggaauacucacauuuuguuaagaaguugaacuaugacuggaguaaaccauguauucccuuaucuuuuacuuuuuuucugugacauuuaugucucauguaauuugcauuacucugguggauuguucuaguacuguauugggcuucuucguuaauagauuauuucauauacuauaauuguaaauauuuugauacaaauguuuauaacucuagggauauaaaaacagauucugauucccuuca

SEQ ID NO: 14942 - RNA, 20080 nt, Homo sapiens
ugaagggaaucagaaucuguuuuuauaucccuagaguuauaaacauuuguaucaaaauauuuacaauuauaguauaugaaauaaucuauuaacgaagaagcccaauacaguacuagaacaauccaccagaguaaugcaaauuacaugagacauaaaugucacagaaaaaaaguaaaagauaagggaauacaugguuuacuccagucauaguucaacuucuuaacaaaaugugaguauucccuuuggauaugucugaaauguaaguauguuuuuugcacuaagacagccuucuauaaucaugugauaaugaaaucauaaugacaaaguucaucuucccacaguuuuugcuggccaaucucucuaaccucagccuagguaauuugguggcuugcccucaacauuuccuuaacuagaauaaacauagagaaauagaauuaguaauaauccuuuuacauaaauaccaaaaaucauggcauaacaacuccccaaaaaggaaagguauaaaagaaauggaugaggagaaagcuaauaaagaaaaguaggcaagaugucucagauucucccugggguagaucuucucagggcgauaaagaaaacgucuucccaaaaaaccccuuuagacagaaucugagauggcuuaaaauagcugcuccagggcaaagcaaugccugcuuaaccaggaauaacauacuacuucuaaguccuguauagaggugcuccugcggcagcagacagcucgucuaccaucugacuagguaccacaagaguuuuugcuuuuuuauuuuaaagaaaagaucugcccaucaccuauauuuuuauuuaucucaugggauuuucguauuuuccugggaaugcaggcacucuguucuuaucauggcugaaauacgguaggcuuaauacuucacaauuauauagcaccuuucacccaagggccuguuguuugguuuugguuuauguguguuuuaaucagcuuccagaauugccaugccucaccugugaagugggauaggcaggguccccaagaggugaucacuccagguggugucuaagccagagcuaccacugagccuaggagcccugauccucaauauugauaauuagacaaaacuuccucaaaaauguuagaggaagaguaauaggauugugcuacaaugagccauguccaucucucuccuguuguauacuuaaaagaaacacugacugcauugaggggaauccuaaaaacauaacccuaacauggcacuguugcaagacugccccuuggaucccauaguuugugugguacuuuuaccaccgaauuguucacuagugacuuuagagaaacuccagaagagcugccuuggcuuucagcaagaggccuagcaaagaccauggcaugaggucuccaugagggacagccgugugugaggucucgacugggcucugaccaucccccagguuuuccauugugaaaaggucuccuucuugguuuagcuaacccaccagcaugaccuuacaaacucucuuuccuccucccauuuugucacugaauuccacagagcuaaauaucuguuccaaagagggacaauggcucacaggccaaagccccccaguaggcacuucagacuggaaugugauguuuugcuuugggucagaagggcaggauggcuuccaggcuuagcguauucagcacaaagacaguaucugcucuugccagaacuuguaccgcuauuuuaacucagugcaguaggucuguggaccucagugcaugacccagaaguggggcugguguuguggcagcugauggggccccagacagugugugucacuaagaacagcuggaggccaagucugguggcugcagggaggcucucuggaccccaucaagggagcaucaaaguacuagccaacuacuuucuccccagggcaggggcuuggcaguagagaauccccucaguaaugguuugggauuugaccuccccccuuugcuucccccuccccccuccccuaucucgguuuuuccuguacagcaaccuccacuucccucccagauucaacggcuuccuccuccccaccccccagauccccaugaacucguccggccuuauuucuuucucaggaccagauagagaacgccgaugaugaagcugaagcagaagcagauccagcccaggauguaggaauagccguggugauacugcguuccaucacgauucgcauaaugacuaguguagauggacacccccacaagaaugcacagcccugcaggggaaaaggagauuugucgguguguuuucuuacauuaaagucgagaaaaaguuuuacuaauuuuaagaagauccuauuucccucauuagcaauaggaaaaugaauucugcuuguuugucccuaaacaggaguucugauggauguccccugggccaagcucgacgguauguugauaaauuagaggugucugggcucucaugucugcacugguuuguguggccacgcugugauguaaaacacagaaccucaugccuaccacccagcuguccugucuggcccuugugggucuaggaaagcuacucagggaugcaaaagagcauguccuuccaccaaaccgaguauauugggaaagaacaacaauuaagugagaaucacaauaaugaugugcauuguggcagugguuucaucuuucugagaacuccuaccuuucugccuucuugaagugucuuguacacacgugcuacuaacagauaugcacugccacuugguagcuacccaggagcacugguuuugaacaaugaagcagaugaggguucuuaaccuaagcagcaauccaagguucuccacaagagaacaaauaaccagaggagaaaauugcacaaggaaguuucacugaaccaugugcuaaucuguucaaguugccagaaacacccaugguaagauggacuuaaaaguguaaacuggagucuacccaugagauacucacagcacaccagugugguggccccugagaggaagaaccgguuucccuucuccauggugaagagcuggaacacgaagaccaggagggcaaugacacagaagaugauagagagaaucaugaaggccugcacugucuugagggcaucuguagacacaggacgaggagaacaagggcaugaggucacuccaggggcugaacauucccugaccacaccuauugucagcacugggucaauaucuuuauauauaccuucacuggcauaugacaggcugucacugcagcuaauguugguacaguuuuuccaaagaccuacugaugcaucuaccguauuggaaaccaaccagaccugaaaccagaaggaaagaaaauguuaauugaaagcuggcccucugauuuaaaaauaaaauaacaaaucagcuugcaucgggaucagauuuuaauaaagacauucuauuuagcuauaacuauggcuaugcagcuuaucugugggcggaaauaagguccgauuaaaacugaaguucacaaaguugccaagagaagagacacagaagaaugugaaacccagaaagaaaucaccuagcccucuuugggcuccacauucuucacgacuuaacaaaaauggaaguaacucaaccacagugguuuaaaauucuaagguucugagaaacagaaguccaggaugaggaaacuggcuuagguaugugcaguucauauacucuaacaagauuguuucauuuaagucccugguuaaccaggaaaaaagugaaauguccaacuggaaacaauuaagaaacauaagaccuacugggaaaauaacaaugaaucuagugguuaauaagccacuuucaucuaaacagaaggaucaaacuugacugucacaacaugcaaaguaauuugauaguaaaauacuacagcaagugcuuuccuguaggggcuacuaaaagcugaagggugaccugaauggauucccccagacugaucauggugccgccaucccuuccugccuggcccaagaaaaggaauuauccuucuggaagagaaaacaagugcaguguccugucuacacacacacaaaugcacacacuggaaagguggggccgggaacaugcaucaccuacgccaaucccugcucuucauucaauaaacaacugugugccuagccuuauauuaggggcugguaauucacagauacgcagcgcuuuggcgcucauuaauacacuuugaagaagcuuaucagauuuaucuggauagauauaggaguugacauauagaauggcuaaauuacaaaacaaggaggucacgugggcggggguugucuuaucacaguuauucuuaauuagccuugcuuaugaucacacccacuaauguuugcaaagcucuucuaucugaacuuuaaaacucacuuauacuuuaacugugauagggaccuaaacagauucugaaaccaugguuugccugccuagugauugguggccuugguuuuuagguccaaggagcuggcuuuuuucugagaaaagcacaaguaaaagcaaauugggcgcuguaagccaccacuagaggucagaguagcccaggguucagagagaaaagacacuaccuccauuuuuuuuuucucguuuugucugaguuaguuaauucaguggcacuggguuaaucuugcaaaacuccacuuucacaugcuacucuuugcucaaaauuugaauuugucagucuggcauccucuucuucccaucuauccuucuaaucaagcuucucagaaggaggggaaguucggcuccagccacauagguguguguccuccuuauccucugaccaaagcuuguccuuccuacauaugcuccuuugcuagcacucccaccugaaugcaucccuaugauccuuccaccuucccucuuucacuaagagaaaccucagccaucuaccacuccuccagguucaccucaagcuccacucaccccugcugcugggaaggcucuucuagagaccgaagaagcugcacuagauccuccagcccuuaaccaccuacagcucuggcaggauuacuccuguggacauucacuuuuauccuccuguuauuuaauuguuugaagggcaagcguguguuuauuuuguuuucccacaacugagcuguaaguucaugaagggcaagggcuguggcuuaaacuucuuuugugcacuugauguaaauauucgaaugauuucucaaugaaugaaugaacaaaagaacauuacucacauuggcaauggugcuaacaaauagcauaauaacaguagcgauguggaccacaaagauaccagccagcaauaccaacauguuggcucuuuuuuuuuugguaacuugugagcaaagagaguucugaaaagaaaaagaaagggacaaaaacgguuacugucagauucaauaagacgacucagcuuucccacacgugugggcuaucugcuaacaugaggaagagcugcacuaaaaaccaucacaaucuaaucauaaauuccugaaaacaccccuguaaccuaguucugauuugccuaagugccuauucauccaguuauacauaccuacauggaaacagaauuugguuucuucuuggguauuuacauauucauuucucuaauacauucuauuucaaaaaaggaacaagaacauuuuaugauaacuguucguauuuuauuuuguuuguguuuuagagguuaaaaauaggacuuugauuuucaaagaaguaggccuuuauaauuuccaggucucugaacaaugucauauaaauguccauuuuccacuaggaaaauguccaugcuuucaucaaauugcucacccagcacuuuuaauagaaguaaaugccuucugaagaauagcagcuauuacucaaugcccauauacugaauaggcuacuaauaugauccugggcgagauauaaaaugugagaggcacaauucuauuauuauaaugcuguuugguuuucaauaauuauaacaaccuaauuacaguuuaauggucuggucacccugugacugagcauuucagacuaguauuacuacaccugagccuuugggcucugugugccucauggcaggaagccugccauuggucugggcagagagucauauuuuccacagcucaaugugaugguucugggggcuuuaaaaguaaugcaacuugagauagcaccaaaugugccuucuccuuguacaugacauuuacacaaauuccaauccuucaggacucaauacagaagacaggcaaaugcauaaaucacagggugggaggauugggaacuaauaucgauuaagaaugugcauggauaaacaaaagcuuucagccauaaucacagcagagaagggagcccauugaucauaaagccuaggaaauaaaggaagugugaaggauacacaugggggaggcuauucugauuuaugucagcuacagaaggagagcuuugucaugccuaagacugucacaaagcagugcaggcucagagggacaucaaaaggaaagggcuugagguuauucacacccuagacagaauggauguguggaugccccaaccaagggaggagauggccaggcgcauccugcaauuguuccacugcccucucucacuccaccuaauuuaauugaugcuuugaaugugcuugaggcacuuucaugccacaucagguauuuauuagagagcacugauacuauaauuccaacacuucacaugccuuuuaucuccucucacugucuuuaucaggcaaccaaaaaucuagagugaucuaauauacaucagggugccuugcucucugcaagcaaggaaugagaggcagacaauggcuuccaccauucucccugaccgucuccaacagccccuucccaaucuggccacuuccuuccaacccaggcuguuuuuuaggaauguguccaacuuaacugugaaugcaaaaauuaugacguuuauccugccucuucaggggagagguuggagcuuucaugucugcuauuaguaauccccccacacauucaaauucauuuuugcuuuucucagguucuagcacaccuccccaauuuucugcuugacuuaaaugcacaguaaaaagagauuuuugaaucagacagaggaugaauuagaaucauauccaguuauuugaccgcucaucuguuuccucauuuagaaaguggaagucgcaaugucaauugcaaagggaaaugugaggaugaauucagauuguuuauguaaaacaccuagugucugacacauggcagcuacuaauaaugggguugcuuuagcugcgguuauuauuauuacuauuauucauaagugaagccggguagcuguugccaacccaacccaguuacucaaucgcuaggcugccccauguuaagugcaaguaauaagauaucugcugucuaguucacgaggcaggguguauacaauccuuucgguccucuuagaaauugucauuugucuaacccuugccccuuaaggggggagaccucuaagagcacacccucaggaaagaccaggagaaaguucacuuucucagcccaacuuccucauaccucccaagauucacaccucaccagauccugaucuccuugcccccuauggggaaaggaacaggcugauugcagggaauuacaaauauuacauaacgaauacuuauguuuaauccuccucgggcucuucaaaugacuuucuuguuccuguugcuucuaauuuacaaacauccucuucuuaaaagggggaagggcuggaggggccaaugacagaauauaauccaccaagugaggccacuuaaaugagucacagaaaacauucccucccugauaggcuguugggaauucagcagcauuuugucuccuuggguugcucuguaaccccuaaagucaagucugauuuccucugcccagcucacacucucugucucaaugaccccucccacggcaccucuaccugggcccaugcaucacagcccugguggugugugcgagugccuggccccuggauccaccugaccauaugcccugcccauugcaggcuggaagaauggaugugagaaucaagcaaaagagcgacucucuuucaucuuagauuuuugugauggugcccucccugucuuuucaccacggaaagaagcaaaaugucuugaguuagcaagcggucuugugcaaaacacacaguucucucuguuuuuagcugcuguauccagccagaaggaggggcuguuuagcuuaagcuacaacuucuccaucuuuucacuggcccauuauuugucagguuuuacuaauaucauucacugucaguuuagaggggcuuccauuauuuucaauggccuuccccccaacacaggugaaaacagaaugaguuaucuucuugaguuucugggcugaaucaucccuaguuacccagucuuuacacugugcuagauaccuccugcccccagggaaacccucagucugggaggaggcgaucacugaggucuuuaugaaaaagccauuagugguaacuaauggguaaaugucugggcauuuaucaaauagcagaguauaauaaacagaagaaccccugcuccugaaacuuccacccacccauuacuugcaagguagcuuguggggagauucauucucugccccauugugaaucuugcuucauacaaaggcacugaaaaaaauaccauuuaugagaauuuauaccauuggaaguauugguggcuacuacuuauuucuuagcaguguguuucacuaaaacaauaguagacuucucccucagcccucucuaaaaugauauggguggcacucuccaguggaaagcauaccccuaguccuagugaggcagcgcaaaccaagaugcagagaaucacagcauugcaauucugaauacuuugaagcaagacccgcuuuuugcagagcauuuggugcacugagcaguuccaaaguuguaggggaacgcucauaacagcguucauuuguggugcuuagacucccagaccuaggccagcagagcuuaucaauucauugcauuuuuaaagaacaggccguccacugacuucuauguggaugccaggaacacauuucuguacccaccacugugaguggaggaugaucuccuucuuaagccucaucuaccuaacauacauggcacaggggcaguuaggggcugggugggaaacugaggaagguauaggacccauguauguugacucuggagagaaguauuauuaagagaaauggagaucagcaccucggagccacacacaggucucugauaucccuuuucuguucuucuuucugcccuaacggacaggcuugcaguucccuaccucugaccaccaucuuuuguuucugaucacuguuccuccuuuucuuucugcauugcccagaccacacuagagcagaggugucuuugugcuccuagcucuaaugcaaaccucacaaacacugaccauucaguauucagauaaaguucuuagcuaacagaauagcuaauauagucaguagaaauaacccugagggaguucgagaucauccuggcuaacguggugaaaccuaguaucaauuaaaaauacaagaaauuagccgggcgugguggugcacaccuguagucccagcuacuggggaggcugaggcaggagaaucacuugaaccagggaggcggagguugcaaaaagccaagaucgcuccauugcacuccagccugggcaacagagcaagacuccgucucaaaauaaaauaaaauagaacccugaggauuaaaauugcucgugacuauagcucuaaaggacuaacuaauaugagacaugagggaagggaaagagggauaaccaaaccucucaaguuaucuccauccauuuaaaucuuuauuggcuucuugccucccucuuacacaccacacacacacacacacacacacacacacacacacaaaugaaagaaucaaaggaacacagcccugagacugccaugcauugccuuguugccuuuguucaggcagccuaacacuuuuaggguucucugaccagugagaaauuacucaggcccccaugggagccuuuccuuuucugguggguaacuaaaucugcagagacuuugagaagaauugacuucuaaggaccagaagggaaguuuagaggugcauaauuugguucccugauugcuaaccuaggagucagauaacuucuuccuguccagaagucuguguguucacugaacugccauggggccuggcggcagcagcaauucuuuaagagugaccuaaaacacaauaacugggagcaacacaauagaauagagcaaccaaaaacccacuuccccagugaaggaaguggucaaaauccuggggcuugagucacugaagaauuagcccuagcugaggggugggaggggagcaugcucagaaaucaggagcugaagacgaugcaaacacugggggaggcccucagggcucaaauuuccaugauucauuugagagugggugagauucucccagaaugaaaggcaucauggagaccuucucuacaaaagggcacgagagagcuuucugagaagcaggguauggaucuggcuggcauuucccuggcagcuuaagaaaggccaggauuuuucuggggagaaaagagcaguaaugaccacugccaaauguccuaucuucccuuccccucauuccacuuuuguugcccaaaacaucacaguccuacccugaguuucuaccuccauuacuuaucucacauccuuccuuauguucuauucccauugcuacuguccaguucagguccuagccugaccauggcaucagccucacccaugacccugucucugaacaacuccccucuaacauaucuucuacccugcuacuggguuaucugaccauggcacuccccugcucaagaaccuccaaacccccaccucuaaccaccaccaaucagcaggaaagaggcuccacgcaccucaagccagcccuugcaaucccaggacuuggauuuccaaaaauaaaagcucugcuuuuguauucuucuuucagugacagucuaucaaauucuuuucaaccaagcuaaaauccuaccucuucuaaaaagccuucccagauccauagguuaggagcaguuuucuuuucucucuucuucuauugcccucacauagcuuuuuauuaaaaccacugaugacagcccuaagauuuuaagucccugaagggagagucuugccugugacagguaccaaauaaauaucuguucaaugaacaaauaaaugaauuaaggauggccauauuuucuuccccauggaaaaauaaucaaugucaaaaugacugaagacuucauaauaaacacagaauuauagagggaaaauauuuccuuuuuuuuuuaacauacauagacuuuaguccuuuauuauuuuucagaaauugcuuaauacuuuacuacaacuauguauugagcaucuuauuguaugcaaacuuuguuauauauuucuauauaaauaccuauguaaauaugugacuguuuccugagugcauuugaauauacaaggguauauauguguguguugccuuuuguucaagaggaaauaagugaaugcaaagaaaaugucuuaaauuucuaaacacuaguuugucugcagauuuaaucuuucucucuacuucuuugaauuauagaaucucaggacugaagagggaggucuuuaaaauuccuuuucaauucaagaaagucaucuacaaaucugaccaaagaacuaucugaaucaugcuuaaccuccuccagucauggagagcucacuaccuaccaggaucccuuccccgauuagaaagauuuuucugacaauacguccgagugugcucuuugcaacgaccaccaugacuuuuaauucugccggugagauuaccugacuagacuaauucuuccucuuucuagcaugguugucuucacagcagaacuaccagguuaucagaagauucaccagaggccuucaccuuagaucucaaaaucucagucaagucauaacacaguccugagauuacugcuagacacucccugucuuuuugcuggccaguguuuuucugacagugagauucugaucucuuucuggauaacuguaaacuuuggagaaagcuuucucacagcaucugaccaaagacguggugcuuccuccaaagcacgaggagagagagaggcguagccgcuucuggucaacugacccccaugagucagacgaccccacaccaccuuccucagcgugacaccugaaacuccgcagcugccucuccuuccuaagacaccacgcaggguggcacgaaagccuuucuguccucugcgcaagucgggagcauuuugcuuuuguugguuugguuuugauguguuuguuucccaugaaggaucauuugguuggcaaaauggaugcgcauguaacacaaaagcagaaaaggaagcacucccuucugggggcagccggagaggaugugucuggaggaggaaaagacugggauuaaaggcaggcugaguggaugagaccuuggaugagccucucuggccacuguuauuguuguuuuauaucaaguguacuuuuccauucucaauauuguguuuaugcaggggugggaaagcaggggauuaauuucuccgugggaaacauggggagaaaaaggauucucaggggccauuuccuccggccucugcauagcucauguuugguguggaaggaaggaaccucagguaggacuugauguuggaaaauacagggcaguuuuuacaaccaggagaaacaucgucaaucaagcagcaaaaguaacagggaccuacaugcugcagggaaaacaauuauuuuuuucaucuuccaaaugcaggcuauuauaaauggggguuauuauacagcaagucguguuggucuggugcuguguagacuagcacagagucucacauagucaggggugaggagccaagguguggguugggaguggggcaagcacacuguaugagagagagagaaccuauuggagaaccagauucuuauaauaaaucugccccugaccaacuucugacuuuagaaaaaucacauaaccucucuggucaguggcuccuacaggcacagaguucaaaguagcacagagcagggauucucagcuccaauccuggcuccaccaugucugaacugugaccuguagaccucacaggauuagcaugagggcugaaggccugugccaggcacagagugggggccacacaguuccugguugguuggucucuuccucuguguaaaaugagaggcucgggccggggaaaugggcuuuaugcuucucuggcagagccugagggccaacaauuaugcuaaaggcaaacaaguggcaugaauauuguuuuugcaaaugcucccaagaagaauaaccucucucucuuauuuccgcuuguccuccuucguguccaggggagggguggaucugggcaacaucugcaaagacugaggccagaccugggcugugaaguuggggcccagccuacucccccagacugcagcuggucaagggaucaggcgauguucccugggcgaggacggaagcgugaguugccuucugcuuuugacaaacgaguguucuggcagccagaaugucuucaagggagagguugccaagauaauaacuagggguuugggaagaaaaccuagguguggcccggccccagcggcgcuugggugggaccaacaguagauggcggcaacaugcuucaaccagcaaagcugcagccuccuggaaggcggcaagcugggaggggaggccccucgccuagagacaccccagacccaucaggugggcucagggcuucauuucaauucguucuuuagagguugagaggcauugaggucauucaguccaaccccuugauaagaaggaaaugcacguccccaaaggagaaauggaauugaaucagaacugaagccauuucgcaccuuccaggcagggcucuuccaccuggcaugauuuuuucucuccugucucuuggcuuaggguuugguggaaguucuagaacuucuaccagaucuacuguucucucuuuuccuccuacccucucugaguuaaucagagagucagcauauaccccuuaaaacugugccaauuauaaaaacacagggucuuccgaggccacugcuucucccugucguuuugcugagaagucccacccagcagagccagccugccuggccaaaacagacccgaacaauaucccccugcaaacuccgagcaaccuucuaacccucagcacaggaguccccaccccacccagacauggagacuaucuuucaauaaagggaagcuccaggucucagcuucagagcuuucucugagaucaaugugaacacacugccuugccccaaacuaguuguuucaggguugcaaaccucuguccaacuccccuucuccagcguccuggggaagggucuuugauucuuugaaaugagaagucuaaggaucaagaaccccguuuugcucucagcucugaucugaccuggaagaggagaaacauugaagagguuccagccuggugggcacauguaguggaaacuaaaaugauaccaaagaggugucaaccauccugaaaaaacaagaaguagccaaugcgacaaaagauucuucacaggggacaaagaaucgaauuuugaccgaaggacugccuugaaacauugagggugggugguccccaaacaagaguggaaggauggaaggggaaacauccucaucacuucucccuugcucuuuugcccccuuucugucuuucucuauccacuuagcuuuuucuccugcuucuaggucuuucugccugccuccucccucaacacacaggccugggaaacagcaucccacuugcccucccucccucccuccuguccuaguugcaccuuccucuuccuccucucaaacuguuccucauuugcuccuguccacaccuguacaccacaccuucaugcugcagggucucccuccucaagaagaggguggaguuucuuucccagagccagcucaguuucucccugagccugauucuguuccuggugaaugcuuugcuguugucaaugucuucacagacucagccugcccuccucaucugagcuggcacccuuuacguuuaauuacucaaaccucuuucuuuuauuccuagugccgagugaaugcucauggcugaggguaaguccggggaacaccauaccuaaagaaucugugaguggauggggcagaggaggcuccguggguccucaaggcacccaggagacgagaauccucugcaaaaugcccuuuucaaugccacacguugcccuauuucacuuuucuaucaauuuuuacagauuaagccagcugcuagcaucagcgcaagggauaucucaaaauagaaaugguaggaucuuaauuuuuuuguuuuucguuuuuuugguguuuuuguuuguugguuuguuuuguuuuuguuuuuuuugagacaggguguuguuucauugcucaggcuggagugcaaugguacaaucauagcugacuacagccucaaagcccuggggcucaaucaauccuccugccucagcuucccaaguagcugggacuacaggcaugcacuaccacacccugcuuuuuaaaauucuucuuuuagagacagggucucacuauguugcccagacuggucucaaacuccuagguucaagugauccucccaccucagucucccaaguagcugggauuaccacgccugggugaaucuuagaaucucagagccauaaggggucugaaagaaccaccaaguucaacuuccgaaagcaagaagacaagugucucgccugugguuacauggcagcgucaagauaacaccacugccccucugucuuccuagucagcugucuuacaucugcuccaggauucuugccacgcuuucaaccugugcugaaagggcucucuaguuuaacuacccgguuugaagaaacaauucaugaaacaggcucagcaaauagaaaaacugucacagccacguaaguccaagcgcaccaacagcagaggauuccauugcaguuccagggaaaugccaucuccacaacacaaaagaaaaccuugacccaaacauuuuguuaaaaaggaagagagaagcagcaaucaccacagguguuugugcuuucaucuuucugcuuuaguaucagugaaucucccagguaaauugaaggaaaugguuuuacccaggcaggacaccagggacugaauuguugcaaagagcagucucaggacguguguaugucggggcugggugcugaagauucaaguaaaccccuaacuggaaccauauuugggcuuccuugauuacugaauagcaagugcaguccagaaauucaagaucaccugggcggaucugggaagaguauuagaaaagggaagcuuauggugagaaaauucccguucuacgcugguuaaggguuaggagcucuucucaaggggcugauacccagauugcuggccagcaauuacaaggaggcuacauuugaugggcagccuguucccguaauuacuaugauggguggugacaauguauaggugugggcuacaugaacuauggaccaaauuaugggacaauccccaaaaggccuagcuagaagccuguguccugguauuggauugaucuaaccaugaccuaguagguagcaacacugggugugucccuccgaguauguacaucugagagucccaaauaggccugagcuuuuguguuaggcagcuauguacauacaugugggagguuaaagaaggaaccauauucaugcauuuagaaaauuaaauaccuccaaaucaaaaaccccgugaguaugauugacuauguacauaauuccaaacuucaaaaaugcucccugcccuucugagccuuaggcaaaaaaaaaaaaaaaaagaagaagaagaagaagaagaaaagauaaugcaauguagauccaucaaguuguauucauuaaauauuaaauaggcguuaaguguuuagaggaugagaaucauuggguggagcaacaacaaaaccagaauagauauuuucugaguuguuucaggccagcagaaucaggaaguuauaaggaaguugauuuugcuugauuuaaggaacuuuaauaaaauuagaguuggccugcuaaggggaaugaguguggagguacacacugagguucugagcuccccgcaucuggaaauuuuaagaucuguaggauggccaucuguucaagaugguguaaaaauuagauuucugcauacaguaggagaaugaaugagauccaagaucccucccaaauuuagaauucugugaacgaaaugaaggaugaaauggaacugacuugccuccugcccuuuccuguguccacguuucaguuaugugccccaccaggcuccauagagucuacagaaaagcagucuugccucauccacaaguuuuccccggucuucaacgugucucucuccaguagucccugugggucuggcacuaccugaaaucccuagagccacccagagcaagccaagagggucuacauucccgggugaggggucuccaugaagcccacugacaaggcugggaacuugaugggccuaaucuggucucuggaggaagcaggaagggcugaggaaggcacagugaguccuuuccacucuccacagaagggaucucuuuccuuuccccagcggucugcccagcaguccugggagauagccagauucuaaggaugugauuugcuccaaguugguucuugauggccuuuugccaacucccaagacaguuuaguacccacaaacaauguaaauguggggggcccucugaccagggcgccagacaggauguccugcagcccccgcccccgccccauucuucggagucuggguggaauuggaucugccccugagggugggaggcagcgggcagagugggggggaaaaauaacccucacauuucgggauugucaaagcugaaauccagaaaaacucucacagcuaagggacucuuucacuacuucuuggaggaagagcagagagcaggaaucagaacgguauuuuucuaaauugucuucaaacuccaggaaguaacauguagcauauuuucuccuuuauaaaccuacaguaucaugugaaaccuugccacaaauaaugcaguucaugaugguuuacacucccaacauugucagggcuuuccguguguugacugguuauuaguuuuaaccugcacagaacuaaaagauuuguauaauuuucacaggauauuaacacuauugauuuaauaauggcuaauccacauccauguaauguggaaauaauaaacaugugaagcaaauguaggaguucccuucaucuugaaaaguugcccugaugccuacucaaucgucccccuuggggcaguuuuacaaggagcauugccugcucaacacaggguugauuacauguaacuucucucccaacguacugccuuucuaaaggaaaagccuaacuuugucagacaagcugaauccugucauucucaucuuguuuacuuggggaaaaaauauaccagugucuauguugaaaugggccacaccucgguagacacucacccaaaaugcuaaccgaaaaaaagaaaaaaagaaaaaaaagaaaaagcacccuucuucauuccuccagauuucaugauuagcaugaguguuugcauuuauacaaucacauuucgggaacaagagaaaagauaagcauuucaaaacaaucacugccuuccaugcaaagaaauuccacauccacuuucuuuuaaaaguucuuuuaucguuucugguaugccaucuuuucacucagcacugaaaggcagcucuuucuggggugaaagcacaaagccacucaacaauuuuuaacaggcacagaugaaguucuccugccccacccucuucuccaaacccagcuucccuuuugccucccccgcccuccacaucuggccaagagaaggcaucuggaauccucaucagcuccugcuucgaccaagugaaccccucccacguuucauuuaaaacaccauuugccucccucucuuucucucucuaacaguuuucuuuuuucauuuuuuuucuuuuucuuuuuuuuccuuuuugagacagagucucacucagcugcccaggcuggaguguaguggcgcaaucucaguucacugcaaccaccaucucccggauucaagcaauucucccgucucagccuaccaaguagcuagaauuacaggcaccugccaucaugccuggcuacuuuuuguauuuuaguagagacaggguuucaccauguuggccaggcuugucuugaacuccugaccucaggugauccgcccgccucagccucccaaagugcuaggauuacaggcaugagccaccgugcccggccaacaguuuucuuuaaacaaaccaaucccccucuucccauccugugaggagaaaaaaaauacuuaaauuuaaacagaagugaauagggaagcaaacaggcaggaaaagcaaugucaaaaauaaacugaaaaccaguuaucuauccaccaccacccaaaaaaucccaaccaacaaccagcgagcagaguaacaguucaaguccugaagcaaucggaaucaaaacggaggaggugaaaaacaucuggccaguucccgaugucauuuccaaggugugugguguuuccuccauaaacaggauccuaucccaguuuguuucaaagucccugcucccuccacauccuagaacaagaacccggucacugccaggcacgauuuuagccccaucccauugauuuccccagacuccguccucaaaauacacuuuucugaacuuucuagaaaaaguugucucuguauccacuuugagccaaaaguuucaaggacuugguucuuagaggaucauagaaaaauagcgaaggaagaaaagaaaaagcaaaacuaagaugaggucagaagaagcagagccguggaaaggaaggagaaguuuugcugagaguccccacagcguugggagcuguccuaccugaagggucccagcgacagaggcgcucugaguggcaggugcuggcagcagcccugguccgcucuucuggaaguaugugaccgcacugaggggaaggaccugccucccgagguuauaaguuuccucugcugguguacugggguguguaaugggcgguuucuuuucaccguguuuuaaa

SEQ ID NO: 14943 - RNA, 1290 nt, Homo sapiens
augcugguggguuagcuaaaccaagaaggagaccuuuucacaauggaaaaccugggggauggucagagcccagucgagaccucacacacggcugucccucauggagaccucaugccauggucuuugcuaggccucuugcugaaagccaaggcagcucuucuggaguuucucuaaagucacuagugaacaauucggugguaaaaguaccacacaaacuaugggauccaaggggcagucuugcaacagugccauguuaggguuauguuuuuaggauuccccucaaugcagucaguguuucuuuuaaguauacaacaggagagagauggacauggcucauuguagcacaauccuauuacucuuccucuaacauuuuugaggaaguuuugucuaauuaucaauauugaggaucagggcuccuaggcucagugguagcucuggcuuagacaccaccuggagugaucaccucuuggggacccugccuaucccacuucacaggugaggcauggcaauucuggaagcugauuaaaacacacauaaaccaaaaccaaacaacaggcccuugggugaaaggugcuauauaauugugaaguauuaagccuaccguauuucagccaugauaagaacagagugccugcauucccaggaaaauacgaaaaucccaugagauaaauaaaaauauaggugaugggcagaucuuuucuuuaaaauaaaaaagcaaaaacucuugugguaccuagucagaugguagacgagcugucugcugccgcaggagcaccucuauacaggacuuagaaguaguauguuauuccugguuaagcaggcauugcuuugcccuggagcagcuauuuuaagccaucucagauucugucuaaagggguuuuuugggaagacguuuucuuuaucgcccugagaagaucuaccccagggagaaucugagacaucuugccuacuuuucuuuauuagcuuucuccucauccauuucuuuuauaccuuuccuuuuuggggaguuguuaugccaugauuuuugguauuuauguaaaaggauuauuacuaauucuauuucucuauguuuauucuaguuaaggaaauguugagggcaagccaccaaauuaccuaggcugagguuagagagauuggccagcaaaaacugugggaagaugaacuuugucauuaugauuucauuaucacaugauuauagaaggcugucuuagugcaaaaaacauacuuacauuucagacauauccaaagggaauacucacauuuuguuaagaaguugaacuaugacuggag

SEQ ID NO: 14944 - RNA, 1290 nt, Homo sapiens
cuccagucauaguucaacuucuuaacaaaaugugaguauucccuuuggauaugucugaaauguaaguauguuuuuugcacuaagacagccuucuauaaucaugugauaaugaaaucauaaugacaaaguucaucuucccacaguuuuugcuggccaaucucucuaaccucagccuagguaauuugguggcuugcccucaacauuuccuuaacuagaauaaacauagagaaauagaauuaguaauaauccuuuuacauaaauaccaaaaaucauggcauaacaacuccccaaaaaggaaagguauaaaagaaauggaugaggagaaagcuaauaaagaaaaguaggcaagaugucucagauucucccugggguagaucuucucagggcgauaaagaaaacgucuucccaaaaaaccccuuuagacagaaucugagauggcuuaaaauagcugcuccagggcaaagcaaugccugcuuaaccaggaauaacauacuacuucuaaguccuguauagaggugcuccugcggcagcagacagcucgucuaccaucugacuagguaccacaagaguuuuugcuuuuuuauuuuaaagaaaagaucugcccaucaccuauauuuuuauuuaucucaugggauuuucguauuuuccugggaaugcaggcacucuguucuuaucauggcugaaauacgguaggcuuaauacuucacaauuauauagcaccuuucacccaagggccuguuguuugguuuugguuuauguguguuuuaaucagcuuccagaauugccaugccucaccugugaagugggauaggcaggguccccaagaggugaucacuccagguggugucuaagccagagcuaccacugagccuaggagcccugauccucaauauugauaauuagacaaaacuuccucaaaaauguuagaggaagaguaauaggauugugcuacaaugagccauguccaucucucuccuguuguauacuuaaaagaaacacugacugcauugaggggaauccuaaaaacauaacccuaacauggcacuguugcaagacugccccuuggaucccauaguuugugugguacuuuuaccaccgaauuguucacuagugacuuuagagaaacuccagaagagcugccuuggcuuucagcaagaggccuagcaaagaccauggcaugaggucuccaugagggacagccgugugugaggucucgacugggcucugaccaucccccagguuuuccauugugaaaaggucuccuucuugguuuagcuaacccaccagcau

SEQ ID NO: 14945 - RNA, 1344 nt, Homo sapiens
gacaacaucacuuuaaaagcucaagcauauguaacccacgacuaaaggcgcugcaauguuaugcaauaugacugucaggggaacgaauuuccaaccucaugacucacuuauugaacguuuccuucauuaaaaaaaaaauaugaacauaaaagugcuauauaaagauaucugauauccaaagcaugaaagcacagcagcuacuaggcuaggaagaaucucaaguugacaucgugccaucagagccacccuuccaagacggaaaguuacuccacuuuuugaaaaauauggccgcagacacuuccugccccgagcucagcucgauccgacgguaucuucccagaacuugguccugagugcucacaaacuggcaggagagcgaaggcucugugaaagggaaguaaaaauaauuccgaaggaggccucaccgcaccgacucugccuccccuuugcccuacugacagcgagguggcuuccacccugcccaccuccaggccacccuccccugacgccucgagggugaccugcggacuaaagccguccagaguggcucaagcccacccaccagugccugcuccagggguuucccggucgccccccuccccuggggccauccgacauguccccgcgacuacacagcucucucgaccaaacgauuuucaccaacuuuauuggcucccgccgggacccucgccgcccaccuccccgcuagaugucaccggcccuccaugacauccagcacauucaaaagcauugcgggacgaccaugaaaagggccuuugcugggggagccagcucccugagggcggcgucagggucauuugcucuucgucuucugacucuccgucuucuugggcagcagcacggccuggauguugggcaggacgccgcccugagcgauggucacuuugcccagcagcuuguuuaacuccucgucguugcggauggcgagcugcagguggcggggaauuauccuggucuucuuguugucacgcgcggcguugccagccagcuccaggaucuccgccguaagguacuccaacaccgccgccagguacaccggcgccccggcgcccacucgcuccgcguaguucccuuugcgcagcagucugugcacucggcccaccgggaacugcaggcccgcgcgggaggagcgggauuuggccuuugcucgcacuuugccgcccuguuucccgcgaccggacaugaucaccucucgccuacaacuccagagacggagacaaaccgcucucggcguccgguaccggaaugcaacguaccgcacccgaacugccucuacaaacucuuuacggccgcgcggcagccccuuuccauuggcucugguga

SEQ ID NO: 14946 - RNA, 17191 nt, Homo sapiens
agaguaucuugguguagaacauuuauuuauuuuucccacaaaucacugaaaguuuaggucagugggaaauaauuuuaaucaaauaauuguacauauucuucccacauauccugccuuguauuaggaaaugacauugugauccauuucauuacaaguaaaauauuacaaaauauuuacaggaaaauauuaaaaauaacucaaacacaaaaggcaagaugaaauaaacuguuuuuuuuucuccagaaaucucuacuccagugcccacagcacacaagagucaaaacaaauaagcaacuaagaucccccgaucacaaauuuccaaagaacuggaggaggggaagaaacagggugaaaauggugguaugaaagggaauggauguuagcagcacugcuucaauaacugaucuauucuggaugaaauacccuuuuuuaugugcaguaaauucugaacaaggcuaaauuuuaggauauuccuugaacugaaauuagaaaauacccugacaauggaagcagcucuuucaucuaaguuuaauaagagccucuuucuccaugggccacuguugugaacagaagccuuuucuggcaucaaaagcugucacaguagcccuuccaucucuuucaugaaagccucauagacaucauccuuaguuuguacugagacaggaacagaaggaccagauuugggugcugcuuuggcaagaggcacagcagaaucauccucugacuuucuuuggggagcagcaguagccccuuuauucucccgacguacucucagugcagugggcacaaaucgaguaaucucugccuugggauuagugaucuguggcuuggcacugaugguugcuguggcuuucuucucaaugguggcugcacuuguaucauccgccuugggucgcugaaucaaguuggguggggcacuuaaaaccccaggguuuggcaagggagcuggugggaacagcccagggggggcagguccaaggggaggcaccaaaggugggcgcaucaugccaggacgagguggaggaauaccuaaaugaauaaaauaggcaagaugaauacuguaagaacuaauaaaauuuaacuacuauuaaggacauuuaaauauugguugccaauuuuuaaauaaauggauaacaacuuacagaaaauaagcugaauucauauugguugcuauuugaaacucaggaauauuuuauuauaaaacaguauuuaccuucagccuauauuccuguacuuacaguauuauguucucuucuucucuaaauaacauccuacuuuaaaauauaaagggacaucaacugguuucaaauuacuaucucaaaucucacaucccaagguucuauuccagcugcauagugcagguauuaguaaggacaaggucaggagacugauccccaugcauuauauuccauaccauuuccccugcacaaaaaggucaaugggcaggaaauaaaauuuuaacccuggucaucaaaugcauacggaggccgagcaugguggcucacacuuguaaucccagcacuuugggaggcugaggcggguggaucauuugaggucaggagcucgagaccagccugaugaccaacaugaugaaacccugucucuacuaaaaauacaaaauuagcugggcgugguggugcacgccuguaaucccagcuacuugggaggcugaggcaggagaauugcuugaacccaggaggcggagguugcagugagcucagaucgcgccauugcacuccagccugggcaagaagaaugaaacuccgucucaaagaaaaaaacaaugcacauggaguaagagaaugcaacuaaucacaaucugucaucauuacuggaaaagaacucauguccuauggacaguucagacauacacaauauucauauaccaagaacugcagauuucaguucuucaaauaccacuuuuaaaugaaauauuaaguacauuuuaucaaaucuaagauccuauugauuacaaacucauaauuauucuguguaccacugagagagagagaggaaaaaaagccccagcuggggcacugaaaagcagauauucacaugaaacugggacauuucaguguuguaaacuagaaauauaccuaccacauaaaacaagcccacaagaaaaucugcaugucuaaccuugacauuagguagagguaagggaaaaaaacacucuaauuuuaaacuuuaaguugguacucaugcagaugcaugaaacggcuucguaacuacaacuaaaaccaaaaaauuaucaaauagagaauuuaaucccauguucucuggcuacaaguuccucaagugaaccaagugcaaauacccacuggaagaacuguacuucaagccaggucaacggcaacuuaaaaaccaccacugacuguaagaugaccucagauuucagaauacugaaaugugaccauaugucuuagagcaaauuaaauaaacagcaggcuaaguuuuuauuauagaaauugaaagcaucaccuggaggugcagggggagguagccuugguggggguccacgaggagggggaccaggaggcagaccuggagguggaccugggggagggccagggggucggccugguggugguccuggagguaaaagucgggguaagggcccucggaguccuggcauuccagguggucucaggaauggaggagcuccugaaaagagaaaaaugauaaauuaaugucacacaaauguacacuaaguaauaauuauggcuuaaaaguaacucaaauaugguuugacuuuaaccugaaaucagauuaacuucaagaaguuaaugaaacauacauggaaacagaauucauucaauaaauaucugaguacagccgggcaugguggcucaugccuguaaucccagcacuuugggaggcugaaguggguggaucacaaggucaggaguucaagaccauccuggccaagauggugaaaccccaucucuacuaaaaauacauaaaaauuagccgggcaugguggcagacaccuguaauccccgcuacuugggaggcugaggcaggagaauggugugaacccgggaggcggagcuuguagugagcugagauugcgccauugcacuccagccugggugacagaacaagacuccgucuuaaaaaaaaaaauauaucugagcaccagaaaaaugguacuggauuuguuguggaucuuuucacuuuauuucccaacacugacaaaaagcauauucaaucacagcuccgcaauguuggaaauauacaaaggugauaagaauucuuaaaugguuccaguauaagcugaaaauggaauauaaaacacaaugcuuuaaggaccccuugaaacucaugaauauauagacaaagaccacuaagaaugacauaaaauagguaacuuugcuuugcaccaaucggaaaaugauuagcucaacugaagaaaacuuaguaggcugacaauaggaugaaggacuaaaaucacaaauagcugaaaaguucucuguugcuucauuucauaaauaaucuuuuuauacuuucaaacugaacacuuaauaaacagacuaaucaccuuugccucuaaaaaagaacuacaacuaaaaaacuauggagauuacacugacauucaacauuccuaaccuaagaacacaagacauuauuaacugugucuuacucccaccugcugccaauuuagagcuaggucaaccuaucauacuaaaaagcaauacuaaagaaaaccuccauuacauguucaaguuucugucugcuguaauaagaaaaacugugaaaacaagagugcucuggagaaaaacagguggcugucaguagaacuaugaguugcaaacaaugguuugggaaugaacaaccuuuacuuguccuuugagaauccuucacaucuuaagagaauccaauuaggaggaaacaagaaaacaugaacacuaacaacacauaguauuuuuuggaaugacuucauucuaaccucauuuaaacuuuauucacauuauguaaguguuuaccuggagguggaccaggaggaaggccuguagguggcccaggaggccguaaugguggagcagguggugguccaagagguggugguccuggcaugggaggugcuuguaucugagaaggaggaacagacugcggcggagccugcugcugugaagaagcaguggaugugccaucagaaugggauuccucuuuaugcugcuuuugugauugcuuuucugcuucagagucaucagaaucaucuucaucaucguccucugaaaauuccucuacuucccgucccuccucagggauuucuugaccugaaagaaauuuuaaacccaguaaauggaguugauucauuuucuuacaguuuggagaacagcaaugacugaauacacaugguuaauaaauguguucucaaaauuaaaaaccaaauagucuucuucaauaaaauacuuagaugugaaagaaauaacauucuacuuaucuauguuaaugcagcauaguggaaugaacucaggcuuuaaaaccagacagaccaauauuuaaaugccagccccaccauuuacuugcuguguaacuuuaggcagccuauauaaugguuccaaaccuuauuuuuguaaaacaaggacuuauuacuuacuugaagguugcugagauacuaaauggaaaaacguauguaaaguaauuagcgugaggauacaccaaaaggugauucacuauuuuuucccugccucaccugccauacgaagcaucauggcuugaagaggagucaguuccuucauguucuucuuuuucuuccuugauuuuccaggcauaucugcaaaccguacacucagaccuaaggggacaaaggagggaguggaguagauuggcaucaacaaaauucaguaaauguuuacuacguagcacuauaaaguacuagauaugauugcuacccacuacuuggcagaggugcaggaugagauagcuauacuaaugauacgaacacccagauaaaaacaauuuucaagaaaagauaaauuacuaaaguuggccaaagaagugauaagcccagaauauacaaaacuuaaaugguaguugaagaucuacuccuuaaaggcuacaaauaauauuaggaggaaauucagccaaacauuaaguuacagaaaucugauaaagagcauaggaaaagaugaaauguuacccaacucaugaaacuagccuaaccaugauaccaaaauucaucuacuggccaacauaaaauauaagcaaguuacacauguuuauagcagcacaauuugcuauugcaaaaauaugaaacuaauuuaaaugucaucaaccaaccagugguuaaagaaaaugugguauauauccaccauggaauacuacucagccauaaaauggaacaaaauaauggccuuuacagcaacuuggaugaaguuggaggcaauuaagugaaguaauucaggaaugaaaaaucaaauauuguaugcucucacuuauaagugggagcuaagauaugaggaugcaaaagccuaagaaugauacaauggacuuuggggacucaguggggaagggugggaggggagugaaggaaaggagacuacaaacuggguacaguauauacacuacuugggugagggaugcaucaaaaucucagaaaucaccauuaaagaacucauccauguaaccaaacacaaccuguucuccaaaaacuaucaaaauuaaaauuuacaaaaaggaaaaaaaauacaagcaaguugaauccaaguguucuaaaagccagcaaucuaauucacuaaagaacuuaaaaaaaacaaaaaaaguuacaucccaacagauaccuaaaaaauauuuaugauuaaaaaaaaccuauuagcaagcuaagaauaaaaagaacuuaacugacaaaggcuauccauuagacacuggauaggaguauuuuuaguugguaaacauuuuaggagaauaguuccaugugaacagaacuuuaguuuuguuuacccuguauccuuagugccuagaaaaaaugccguauauaguaaaaacucaauaaauauuagcugagugaguaucaacucagaguugggacggccauuuucagaacauguguguugaugagaauauauaagaaaaaucuggcuggguugguggcucaugccuguauucccagcacuuugggaggccgaggggggcagaucaccuguggucaggaguucgaaaccagccuggccaacacggugaaacccugucucuacuaaaaauacaaaaauuagcugggugugguggcgggugccuguaaucccagcuacuugggagacugaggcaggagaaucgcuugaaccuaggagauggagguugcagugagcugagauugugccauugcacuccaaccugggcgacaagagugagauugucucaaaaaaaaaaaaaggaaaaaaagaaaaaaaaucuguaggcagaauaaaaggaaaagaaggcaagagaccacacagacccagaaaaaaauggagcugccauggcucuaauggcuuucuacuuuccaguccuaguuccuaccuaauaguccucuauaauuaucuuucauuaccagcucuaucauuuuuaaccagcuuuuuuguucuugcaaccaugauucuuaagacacagcaggagaaaaauuugucauuaucaauauuaauauuacauaguauuauauauucuguuguaggccacauaaacaaucccaaaagaagcuccaaaauugcugagguuugacagaauuggugugcauuuuccacugucaguacccauuaugaugcuuaaaauuuucuugacaaauguccuauuugaauuuuuuaauaaucaaacacacacauuauagauauaauauguuucaugauuccacucaugaguguaccuggguuauaauuaugauccugguucauguaagauaccauaaaagggcuucaaagguagauauuuaaacagauuuauaaaauacaacaucaauguuuuucuuaauauggcuacucuccuuucuuuccuguaacauacccauaauacguuuaugcuguugaauaguuauaccuuuuaccccaaagugaacuuuauuacauagacauuuuuauuacauacaguuuaaugcuuuuccucauaaacauccacugaguacuuacugugucaaaaacuuucaaaauuuuaauauauaagaugaacacagcuaugaucccgacuuccaaagauuucagaguacucucacagauucauuaauaaauuaggaccuucagcuuguuuucucuuuauugaucaauaccaugaauccuucaucugcacauaccugacuucuuuucuucauuguugucucucucaccauuaucacggugcacaaauucauccccgucacuuucuccaucugauuugucggugucacugucaucaguacugucaucaugcuuaucuugauccauguccucaggauagccaucaucuucacuggugcuagaaacaucaucaucaugaccucgcugggcugaaaagugggaagggaacauggagaaguaguaugauuggacccuccacuacaugguacccagaaauacagaaaauuaugcuauucaacucagacuguaacaacuuaauucuuaccaaaaaaaaaaaaaaaaaauucuuguauauauagcuacucauacagucuaacaaaauuuuccucugccaauaauuuuaaacacuucuuuuugguaauuuaagauuuuuuuaaaaagaguucuaauuugaaaacccauuuccuccuuuagcaacaaucauguuuguauacacauacacagucagugaauguauacaaugacgcucuagucugaugacaauaaagcuaaaagggaaccagauauacaagucuuaaaggauuagcagcaagagugacaucuccaggaaaagccuaauuuaaaacacgauaaacauuucuauacuuauguaugaugcuuuuacuugagaagauccuaugauuuauccaacuguauguauauuaguuauguacaugauacccucucauuuacuuucuaaguucugaggguggugaacaauauguuaaacagggccaacauaaaaaaugauaguuauaaaagcaaaagaacagucacuucucaccaaguucaggacuauauaacaugucuucaucucgccuacgagggggaagaucuagggcaaaacccacuuuacggccauacaucugcacgacuugaggaggagguggaccagggggagggccaggagguuuucugccagggggcaaacguggaacaccauguccaagaagaggaaggauagaaacugcccgaguuggaggucuguuaaaaaaaaaaacaaaaacaaaaaaacccccacaguaaucacuuaacaguaaugagauauuuauuuucucuucuaaacaauuuucaagggauuucuuauuuuacauuuaaucaaaugucacacuguuuacauccauauugucuuuuauuucccucugcauuaauuuuggcacuggacagucaacuugugccuuuacuaaaugcucucugauugugacacugcuuccuuacccauaggcugagguuuucuuuaggauagaggguggcugggcaccaggaaguggaauguccuggaucaaaauguuggaaggagcauguggcauaucuggcaaaggaauacucuccacuuccacaugcugagcauucugaaacagagaaccauucaguaguaugauaaaaaagucaucuacuaacuaaacacuaaaaaugacaagucagcuguuucguaacuuggacaugcuuuccaacuaacauaaauaucaccaaaaacccccagaaaaauaaccuuacgucaauacuuccacauugucaaagaacugaaagaaaucuuuacuucuaaaaacgucagaacccagcuguuuuuuuucuccucuuaucagguaauucuuuuuggaugauucgaaacagcuguugucuagagaaagccaacuguuacaaguaucuagcaccagaacuacccuauuuaacaugugauagaaaaauacaugucaggcugggcgugguagcucacaccuguaauccgagcauuuugggaggcugacgcaggucgaucacaagcucaggaguuugagaccagccuggccaauauggugaaacuccaucucuaauaaaacuacaaaaauuagccaguugugguggcgugugccuguagucccagcuacucaggaggcugagggaggagaauugcuugaaccugggaggcagagguugcagugagccaagauggugccacugcacuccagcuugggcaacagagugagacucggucucaaaaacaaaaaauaaacaaaaaaaagaaaaauaauauaugucaacuaacaaauaguauauauccagugguggagguugggcucauuagcuugccuauguugaauuucuguuguguauuagcuuaguuugacuaagcaagguaaccugugccuucaucuguaaaaugggagacauauuaccuccuuuacagaaauuauagcauuugauuuuuucccaucuuuauuuugagguaaaauuuacgaaauuuacaaauucaguaaguuuugacaaaugcauauaccucauacuccuucccaauccaucucuaauaucaucccccaaggcaaccacggcuacauuuuuuuuuccugcacagauuaucugugacuauucuagaauuucauaaaaaugaaaucauaacaaugagauaaacuuagcauguuuuugagauuuacucacaauuuuucuuuuuuuauuccaugcuguuuugaguauuagauuauuccuuuuauugcugaauaguauucuauuguauaaauaugcuacaguuuaauuauccauuauccuauuagugaacacuuaggcugauccaaguuuuugaauuaauuucuucuguuuaaauaaagaggauuagauuugcagguucacacaguagguauauguuuaguuuuagaagaaacugcuauaaggaagagguucaacaugacauucucccauuaacuuuuuaaaucuaaguauaggcugagcaucccuaaucugaauaucuaaaaugcuccaaaauccuaaacuuuuugacucccauaugaugccaugguggaaaaauccacaccugaccuaaugugaugggucguaguuuuguuucaugcacaaaauuuauaaaauuaucuucaggcuauguguauaugaaacauaaauuucaugcuuagacuaggguuccauccccaaaauauaugcaaauauacacaaaaacaaaacaaaauauaaaaaaaacccaacaacccuaaauccaaaacacuucuggucccaagcacuuugcauaagggauacucaaucuguauaauauuuuaguuuaucucucaaaaaaaaaaccuugauuaccuugacagcaucaaaauauuggcuaaguugagcccucuucuguucauauucuacuucuagcuuucucaauucuuuguaaauaucuggauucucuuuuucauagagucguagaauacguucaaagguuucacgcagcuuuuuacgcuugucuuucaguacuuucucauuuaauuguggcuguugcacuggguuaaacucuaagagaaaaaguagauuauggaauuaaauauaagaggccacuucaauuagguaucaauagguuacaugauaaaaaccuccauauaugcuaaaaaauuuuuaagagaucuagacaccagacauacucuuuucaauuuuauucgaagaacuacaauauuuauuaaaauccccacccuuuuuagauggccacuaauuuuaccuuucucagaaaugccaccuaauugacuuucaucuucauuguaauaaaaaucaauuuucacugcucugugcugaaaaccucgugaagauucugucagauuuguguuuaccuacuacguuaguccugucaaauuuugagaucuuaagcauuuuacuugaauucucugauuuuuugcuuccucaucuaaaaaauggagacguuaaucacuuuguaauaaagcuaugaugauacaaugggauuacaaauaaaauauccagugguguuugacucaccacuuaacuauaaucuuuauaacagauccguauuccuggccuagcuacuauacaauccuuucucucccuaacuaaucaugugucaauauggggcuuaacugcagguccucuaucccaagaauaagaccuccaggccugccuggucaaucauauccccccaucuuccuuuucagugaaugacucagagaucaauuagcacaugauccaaacugggaccagaacauucccugagauuuuaaauguagaugugagagagauaagcucucagauuuucuuucugaauguguuauguagagagaaaacaaaccuagagcugccuguggccuugucucucaaucaucacuaauuacacacauauauuccaccuucuaucccaaggaguucauuaguaguaagcugaaugaggcuaacagacaucagacuagacagauggacaguacugaugaugagacuggauuuugaggcuaguuucucucagggauuucucaucuuuuuuuuauguuaagacuucuuaauuaagacagccaaugcaugcuuuuuucugccuuaacuagucuguauugaguuuuauaaauuguaacuagaccccugaugaauaguauucucuucaccccuuuccuuuuucuuaaaagaauaacaaauuuaucuucuuccuuaaauccuauuaacuauuauuaaucuuggcaauuuauucaaauccagagggcguauucuuacaccauacuaauccuagugugauuaguaaaagcgcugaaugccugaguuuuaaucucagcuuugccacuacauagcagugugaccuugaggaaagcuauguaaucucuccaugccugaguuuucuuaccuguauaauagggacagugcaccuacccuaaaaaauugugacgauuagaaaacugguggaaaaaaacuggugcguagguguauagcaagacaacuacucaagaaaccucaguuauuccuauuaucuccuuuuaaaacaacacauaacauuuggggucauuuaaagaaggauucccugauuccccaaggaaaguaauuaucccugcugauauuuagaccagaggcaggaaguggaaucaguuacaacugaacugggaaauaucugggauccugaagccugacccagaacucuuagccaggcuagcugcacagauucucccacauuauuucagaaaccuuguaauagccuaaugccaugacugaauuuuuuuuuuguaccccauuuaauguaucauugaggaguuucauuccaucucuuuuacuuacuacucuguuuuugggcaaaacauggaacuuguaacgaucacuuuaaaaugcuauuuuacaaaaguggcaaaggguagaagacaaaguggcagaaacuugacaggugaaaagcacauggaaguuaacuagacuauuuuauuuucuugcauguuugaaaauuucuauuaaaaaaacaaaauauucuacauguucuaauauuaaacagaauggauauuuguggguuaggauaaaauuuccaguggcaacaucaaugauuuucaaacuuagaugcaaaaaaagauaacaugcagcuauuucaugugauuccaguuauaacaaagcagcgauacuuaaaaugcauaugaagagugaauaaaacuauucuauaaaaugugaaaaaggcagagaauccugguauaguauuuuauuauuugguuuuuagguauuugaugauuuuuuucuauauccuuacuaaauggauaaguaucuuuuuggaucuucugauuggaaaaauuggaaauugccuuauauucacaggggccuaauacuuagauuuacaugguaguugccaacauuaaauaaaagacgacaaacaaaaaacccaagguuauuucauaaaucagauuaagucuucucccaaaaagcaagcuggccaaacugugcuucuguuaucucacaauaacaauuaacugaaagccaaauaaucgcuucccucuuauucugguaucuggggucuccaguuugcaacagcccucuagcacuccauuuugucucccugaaacuaacauuaaauccaagcaucaaaugccaucaugcuguucuguuuuacuuacgccuaugcugcuucacucguuaccugccugccucuguacgugucagacuguuauagcugccuguuuguaaauucuuacccauuucauccaauuucuccaugucucggauuaucuguuuuggauccuucaucuuuaaaacugcagcucgaaccaucaugcgcuguuuuuuguucuuagaaaaauaaaagggcagaugucaagaagucaggcacucaggaguuuuacuucaacuugcuuuaagaaucuaaacagaauaacuccuuggcuucugaucacuuguuucaaccaccagaaacagcuauguaauuuuuugccuuaaaaauguuuacacuugucaaaaagauaaagaaaugcuauuuuuaagaugugcuuucuuaguaaaguauuucuuugaacucugagaucuuuagcaguuacuuaaacacacauacacuuuaaauuucuuuuuuuuaaccccuuauguucuugaagaccuugggugauuguuccugcccccuguuguaaaaccucugcuaguugaaguccaaagcaaagguugaagcuaaauucuaaaauuauauaaagaauauuuaaaaauuuugcaggaguuaaugcuaaacaugaaaacacaaucgaacauuauuuaaaaucuguguugcuucaauguauuauacuauaauacuauaaagcacaauacuauaaggcaaauccuuucuaauucuuuugaaguacuuugccacaaauucaacagcuaagaggagaaugcuaauugggaaaauggauauauaaaucuaauauaucuauaaauauuauaaaccuacauauauauauuuaagcuaauguaauauauguaauagacagcuaaucaggaaaauggauaaagcuaucuagcaucauguuuauuuccauccucaucaguagacuuuaaaacaguuauguuuuaaugaguaaaaaaaagaauuauuuucaaaaguauuuuuuaacucacugggaaaaguaaucaaacaauggcauuauaaccuguagugagcuucucugcaaaguuacuucaguuccuaaauaaaguuuggcuuaguauaucuuacaguuuuuauaaaaagcauaaaguaccuuuucuagaaaauauuagaaauguuauucugaaacccacuaaucccaaaucacaagauguaccaaacaauacuuaaaguuuuauaagaugccucuaaaaucauaccuucuuuaauucucucuuccgggcuuccuuuccuuuaaaaggagagagggagauauaauaaaaucuuugaaucuugaacauuagcauuuccuccaauuuaauacagguaauucuuuauuguggaaaguuacaguaugcacuguaaaagagcagcaucuuuggauucucuccacuacaugccaagagcaucccucuaauuaugacaaccaaaaaugucaagacauuuuuguuuaauguuucauaaaaaacaacuaugaaucugaaggaaaaacauaacauaaaacgcgaaacaagggcucgcaaaacuaauuugcucaaaauuuccaauauaaaaagaaagauuucagccaauucuacuuugcaagucaaucaaauuugaaaaauaaaauacggguacuaauuucuuugcauauuuaaagucuuaaugugcccauacaaacccugaauauauaauuuauuccuccuaucacugcuggucuuguaauuaagccacagagaaagaaauucccuaauauuugcaauuuuuaacacucuccuacuucaucauuccacacuaauggacacuuacgggcuuggucugugggguucauaaauuuuccacucuugguggaugauguagaucuccgucccauguugacaauuuguaugguuuacuuguucauuaaaaaaagaaaaaccugugaaggugaagacaaagaaauagcuuauaucuccuaaauguauuucuuccuuuuucuagucccuaccaaucucugaaaaaaaauuccuuuaauuagaaauucugugagacuguucuuuccuuaguuuugacuuuaauguccaagaaagauggcaucaccuuucuugaccaugaaaauuuagaucucuaucauucuucagaaaugugaugagugugaagaccacuuugaauauccucaagucaucaguuuagcuuuuuucuuauggaucacagcacugacuuugucaacugauaaaaacaacuagaaaaugcuuuaacgauauggcacaaaccaugaacaucagaauucauuaguccuucuucuauaaccucccuuuauuaacauguaauuguaaaagaagaauaagaagggaauggggguaauggaucuaggcucaaaacacauaccucaccuuugccucucuccaugguuuuucuuggcauguaugcuguacauucucaauacuucuaagacacuaaaaacucauuaauuuaagcauauuuaauucagauucaguucuaguucagauauaaugcuugacucucaagaguucaaaacacaacuaaaaaugcaaauauuugaaauuagugcuauacugagagcuccccaaaacuuaaauauuaagacacauauuuuucuuacuaagaccugacucccaauauauauuucuuaagguaauuaaagggaauacuuauuuuuguuugaggaaaaaauauuuuguaagcuaaaacuuuuauuaacacaguacccuauuacaugacuucuuccucuuauuccaaaauaauggggcuuaauuuuuugaagcgcagucuuuccaguaauaaaggcggacaaauuugcuuccuuuugcaaguagacacuuuuuaaagguaagaaagggaagauuuugucagcccaguuuauuacaguuaaugucucuuucaccaaguguccaacugccccgaaagccagauguuucagaaagccagauguuucacagcuguucugguggcaauuacuucaagacagcgguaucaaaggcucugauuuuuagcuuccucaucuaaaaaauggggacaucaauuacuuuauaacaaagcucugaugauacaaugagauuacaaauaaaauauccugugauguuugacucacuacuuaacuaaaaucuuuauaauggauccauauuccuggccuagcuaccauacacccugucaagugguuuccuucuaagaaaaacuggggauggggggguuaggggggugggagagcagcagggaguaggagguagggaaggaggaaaacaagcaaaaucaguacauauacaagcucucccaucuuugauugccugcguuuuuugugcuuuccuuucucaaguuuccucaggcucauguucugaaucuccucccccacaaaugaaacacaacggauacgaauuacagagaauuuuacggaagacacuggagcuuaagucugcagauuaguuuuuugucuacaagcggaggcgacuggaaaaucaagccaaauaagcguuggauaacucuaaacagccaaagaagcuucaaugggauaggguccagguucaccaaaggaggcaacaccagcaacugacgaaaccauagcgacggcugaccgaccaugacucgagguacaagacgucaaaccuaaggcuacuaaucaacgugcguaagaagcggccccaaccgacccgggcgaugccaaccgcgcaaccacuggucgccgcgccaccccaggcccaggaauagcccaguccgcaacagggagaccucaaccagggagaggaggagcggggcaaaggggcugggugucccccaagccgcugcgcgggacguggaagggacgaaagaggugaggaagaguaguaaaucaauucaauacacucacacuucugcugugcucccaggacuacgagaagcggguagggggcgacucccggccucuuucacuucguaaaggccuucaacugggucucucggucaaccccucagcuaccgccaucuugaaaccucgcgccccuccgcacuccucacgucauuucccauuccucugucccgccuucucuuagcgccgcuugacccuggaaccauagagaauacccaagaauuccaggaccagagucucuuccgguuccauacaauacucaauugguugguugucggcuaagagcccgccucauugcgcucaucuaguaca

SEQ ID NO: 14947 - RNA, 20895 nt, Homo sapiens
uaauaaagcaaaacuacagguaaauguuuugccagaugacuuuuguguacuuauguucuaacauagcacauguuuggcaccaaaagaucuuagaaacuacuaugaaaaaccauaagauuuuaaguaguuuucugacagaaaugaacauuucuguugcaucccuacuugucacuggcuuucuuaaacacagaaauauucauuuccauagucuuuaucgcuuuuuggaggaucucuaagauuggucccauagccuugacaauuuguuccaacaaaucugcugcugacuuugugggauuuuuggaauccucaguuuuuaguacauccugcaguuuuuucaaggugucuaucauagugguuuuggaagaaccuggaggacuucugguucucucagauguggugacaucugauugcucuuuggugucuucuguauagaagucacuuaauugaagauucaugauggggaauuucaucaagugugaaagagaagauuccagacucccaaggauguuacugcuguuuagcacagagaugaugacuggcguaugggcacuuuugaauacuucuuuagcugacugaugcaacuccucuacauugguacucuucugaaccacagagcacauggccauugcaaccuuggaacauaaagacuccuuuugaauuuugucaugucuugcauccacuacagauugcaucuccuuaaaaauuuugagcauuugcucaaaaaaauccuuaauguaacuauuguuuuucacagccaucaaaaggauuugaguauucauacugcggcuaaacaauucagucaguguguuuaugacagaagcaagaucuuguacaugaaagaagaacauuuuggcagcuugaaucagucucucuuuauccuuuucugacucugaagacauuucuccaacaaauaaguuccaacacugcaaagcaaagcaguaauccaaaugaaaaauaaaagucgauuuggcaaccauaaagaaacugaaaguauagucuaaauaugaagauaacucccccugccaagggcaggaaagcuauacauacguugaaacaaaaaugguacuaugcuucaauaaaaauaauaacaaaaauaauuaaaacaggguagaauaggguuguaucgccaaauuuauaccacauaucaaauacugggugcuggaucccgaauauauggauagauugauauacugaauuacacuacacucaaggauacuacccuuaacuauucaauguagugaaaaauacuggauaaagcauuacaaauuacauagaggggcucugguuccaguuaagguagacuaagcacacuccaucugaucuuuccuacugauuacaacuaaaaauccuggacugaauauauaaaaucacuaucagauaauucugaaagguggaugacagaaggccaaggaaguagggaguacagcauuuaaaggacaauaaagcaaugaagcucugacuuuuuguuugaggguguguuuuucuguguuuguuguuguuguuguuguuguuguugucguuugucuucuccugcuuccuauauaucccaucuugggcucuagggcagccuggaauuagaacugugaacaagcccaaacagggaaagcuccaaaauaaacccacucuacacagcaaaucaggugcaggggcucugccgggcagaucccuuuugaucuaguugccaacaacaaaaugguagcccccccaccccacccucugucugcccccaacuagucgugaccagaggcagcuccaaacacuuuugacuucgagcguuaacaaguaacagcagugccacccacccccauccccuacuccccaccccacccccacacacaccucacaaguacagcagaggucagccaguccuuugccccugccccugucaacuggcagugaaaacgcuguccuuaugggguggaccccuuuucacucuucccacucuacccuaggcagaagcaacuguggugcagggauggugguagugaccuugcaggcuucuuucucucacugcuuugcccccaggugagaaccaguugcaaugggaagagcugaaauuguuuucuagccagaacaccaggaaaggggacccccgggaaucaaacagcagguggcagaccacagaaagaagcaaaaauuauaaccaaaaaauagcacuguugggauuuucaaugcauguagacuuaauguauaugacaauuacaucauaaaggagagaggguaaggagacuuacguagcugaaagacuucuugauuuuacuugaagugauaaaauauuaauucuaaguagauugugugaaauguggaaguauauuauaaucucuagaguaaccauuaaaaacagagcaggaaacaauggggccauggaagcagaaauggaggugauguggccccaacuuaagggauggucauggccaccagagcuggaagaggcaaagaauagacucucccucagagcccccagagggagagagguccugcuugacuucagccuuccagccuugagaacucugagaggguacauuucuguuguuuaaaaucacuaagugugagguaauuugugacagcagcccuaggauacuaauucagauuuucgucaauaggcaaauuaaaaugaaauuucaaaauuauuuaaguaacuacuuauauuacucaaaagauggcuugaaaaggaaaacagagaaauuugaaaaacagaacagaaaaacagaaaacuaagauuaaauguuacacuuaauuuaagcauaucaauaauuacauuaaauaugcauuucuagaaguaauaacuaaguuucacaagguugaaaaauacaagaucaaauguacaaaaucaauuguauuucuauauacuagcaacaaaauaaaaaucagaaauuaaaauuaaaacaaugaccuuuacaauaucauuaaaaauaugaaauauuuauagauaaaucugacgagagaucaaauaucucuacacuuacaacuguaaaauacugcugagaaaaauuagggaagaccuaaauaaauagaaagauauauauuguuaaugggccaaaacacucaauauugcuaagaugucaguacuccucaaacuaauuuauaaauacaacacaauuccaauuaaaaauuccagcaguuuuuuucauauauguaaaagacaauaaaucuucucuuaauagaauuaaaauagaagucaacaaagaagauacaugaaaaauuacaaaauauuguaaauuaaacaacacacccuuaaauaaucuguggcucaaaaaagaagucacaaaaauauagaaauuauuuugaacugaaugaaaaugaaaauauaucaaaaucugugggaugaaaccaaagcaguguuuagagagaaaucuguagauuaaguguuuauauuagaaaggaagauauaaaaugaauaauuuuaacuucuaucuuaagaaguuagaaaagaaagagcaaacauucaaaguaagcaaaaggaaaaaauaauaaagaguagaaaucagugaaauugaaaacagaaaaaauagauaaaauccaacaaaacuacaaaguguuuaaagaaaaaccaauaaacuuuaagccagauugaccagagaaaaaaggagagagaacacaaauuaccaauguaaauaaugagaugucacuaugacccuacagauauaaaaaggauaacgagagaacacuauaaacaacucugagugcauaaauucaacagucuaaauauaauaggccuauucccuuaaaagacauaagcuauggaaacucuuccaaguagaaacaaaaaacuuaaauaaaccuauauuucuuaaagaaauugcgccuguaguuaaacaccuucuagaagagaaaaucaaggcacagaugguuucacuugugaauucaaacaaacauuuaaaaaagaauaacaauucuauacaauauccuccagaaaacagaagggagaauaccucucaacucauuuuauaaggcuaccauugcagaaaaauaagaaaacucuagaccaauauuccuuaagaacaauuuaagguguaucccaaaaauguaagguuaguucaacauuaaaaaaucaaacuaaacaagaaaaaccauaugaucauaucaguagaugcagaaaaggcauuuuuaaauauucaauauccauuaauaauaaaaauucuuagcaaacuaggaauauaagaaaacuuccuuaaucauagagggcucuuacaaagaaccacagcuaacauaauaaaagacuaguugcuaccccccaggauugggaauuagucagguauguucacguucacuaguucuauuuaauaucauacuggaaauccuagaaagugaugugggacaagaaaaagaaaauauucaaauugagaaggaagagauaaaacuaccucucuagacaacaugaugucuacauacaaaaucccaaggaaucuacacaaaaguucuuagagcuauuaguaauuuuagcagaugcaaggucagcauucaaauaucgauuguuuucuauucacuaggaaugaacaauagggaaccaaucauuuguauaaguaucauuuauaauacucucucaauaaaauacuuaaauauaaaucuaagaauauaugugcauaaucugugcacuaagauuuuaaaaaaauaaaauucugaaguaaaaaaaaucaaagaaaauguaaauaaauggagagauaaacucuguccaugaacugaaagacucuauauagcaaagaugucaacucaaacucuguccauggauuggaagacuuauguaguuaagaugucaauuuuucccaaauuacuccacagaauuaaugcaaucacaauaaaaaugccaccaagauucuuuauagauacagaacagugaauucuagaauauauauguaaauguaaaggaacaagaauaaacaaagauuuuucuaaaggaacagaguuagaggacucacacaaucuaauauuaagauauaccacaguaauugagacaguguaguauuggugauauguagaccaaccuaacagaacaggaagucuagaaaaagacccacaaauguggucaauugauuguuuuuguuguuguuguuuugagacagagucuugcucugucaccaggcuggcgugcagugacgcaaucucagcucacugcaaccuccgcccccaaccagauucaagccauuccccugccucagccucccaaguagcugggaguacaggcacacaccaccauguccagcuaaauuuuuuguauuuuaguagagaagagguuucaccaaguuggccaggauggucuccaucuccugaccucaugaucugccugccucagccucccaaagugcugggauuacaggcauaagccacugugccuggccggucaacugauuuuuaacaaagaugcaaaggcaauuuaacauagaaaguuuagguguuuucacccuagaagaaaaccuaggcaauaccauucaggacauaggcaugggcaaagacuucaugacaaaaaugccaaaagcaauugcaacaaaagccaaaauugacaaauggaaucuaauuaaacuaaagagcuucugcgcagcaacagaaauuaucaucagagugaacaggcaacuuacagaaugaaagaaauuuuuugcaaucuaccuacaugauaaaggucuaauaucuagaauuuacaaggaacuuaaacaaauuuacaacccuaucaaaaaaugggcaaaggauaugaacagacaguucucaaaagaagaucuuuacacgaccaacaaauguauaaaaaagaaagcucaacaacacagaucaucagagaaaugcaaaucaaaaccacagugagauaccaucucaugccagucagaauggagauuauuaaaaagucaggaaacaacagaugcuugcaaggguguggagaaauaggaaugcuuuuacccuguuagugggaauguaaauuaguucaaucauuguggaagauaguauggcaauuccucaaggauauagaaccagaaauacuauuugacccaucaaucccauuauuggguauauacccaaaggauuauaaaucaugcuacuaugaagacacaugcacauguauguuuauugcagcacuauuuacaacagcaaagacauggaaccaacccaaaugcccaucaaugauagacugcauaaagaaaauguguuacauauacaccauggaauaccaugcagccauaaaaaggaaugagaucauguccuuugcagggacauggaugaagccagaagccaucauccucagcaaacuaacacaggaacagaaaaccaaacaccacguguucucacucauaagugggaguugaacaauaagaacacaugaacacagagaagggaacaacacacaccagggccaguugaggaguggggggcgaggggagggaacuuaaaggaugggucaauaggugcagcaaaccaccauggcacauguauaccuguguaacaaaccugcacauucugcacauguauccucccuuuuguuuuggaagaaauaaauaaaaacaaaaaacaaagaaagaacaacaacaaaaaaagaaaguuuaggguuuuucaaugaauggugcuggaaaagccugauacccauaugcaaaaacauaaaccuugauuuuaugucauaccauacacauacauaaauuaacucaaaaugggacaugaaaaauauaaaaccauaaaacagaagaaaauacagaagaaaaucuuguaacuuuugguuagcugauuaguccuuugauauguaugacaccaaaagcauauccauuaaagaaaaaacgauaaauuggccgggcaugguggcucauauauucuuagauuuauauuuaaguauuuuauuuuaguguaaucccaacacuuugggagacugagguaggcagaucacuuaaggccaggaguuggagaccagccugcccaacauggcaaaaccccgucucuacuaaaaaauacaaaaauuagcuggguguggcacacgccuguaaucccagcuacucgggaggcugagggaggagaauugcuugaaccugggaggcggaggaugcagugagccaagauggcaccacugcacuccagccugggugacagagugagacucugucucaaaaaaaaaaaaaaaagagaaaauauaaagaccugaucagcaauuucaaaugcugcaaguaugauaaacacuguaaauuauuucuuauguuuagucauuacaaugucauugacaaugcuagaaaagcaauuuugcaagaggcaggaauauguacagaagcuagauuauaaauacuggaaaauuaauggagaaaaugaaguagaggcaaugcauguacacuaccaaacugggaagucuaacugugaagaagaaagauaaaggaggcuauugggucaaaaaggugauuauuuuuagguuugcuugauuuuuuuuuaagugcagcauucauaagugcuggcaaauuguugaaacaaucguaauugaaucgggcaguuuauucagggucauguaauauaugguuuuugagcagagauuuuaggaaaagaaggggaugagcuuuaggauaaaagggaaaauaaagcauucuaaauaaaagacgaucaagugagagcuacaugcagauaaguuuggagauauuauugcuuucacucucauuucccaccacugucaauccagcagugaaacuugucaaaucagccuuccugauucccuaaaaccacccugacuccaagaucuacacuaagaaaaugugccuccuuccuaagguucaguucugacuauugacuugacguuaauacuggcuuuaguagucaagaaagauuuaagaaguucaaguuuucaaccugagaaacugauugcagaaaaaagaaguucaaguugauuagggggcucaguaugaagucaauauugcuucuaguuuuucucugauaauuauuuugcauuguuacuguuuauccuuaauuuuggcaacuccacuuaggcugcuaugugguaggagagaaaggaguggaugaguaggcaauaaauguuaagaaggguagaaauaggagagaaacaaacaccuuaggaacaaguggguuaaaugguacucuucaacaauagccucuucggaaacaaaaugcaacuguuuuaagacaggguaaaagacagacauauuuuguccacauacuguaggcaaugggguugguaacuuaugcuuuauuguccauaccuacuaaucaaguuuacauaauguacccuuccugaaauccaaaucuccaaauauuacaccauaauuaaaaggauuuuuuaaugguucauuauuaucuacagaaugaaauacaauuuccuagcaugacaucuaaggcuaucuacaaacuauuuucaauuuuccaugacuuaccuucccuuaacugcucccacuuacacccuguaucaccagcagguugguuuuuguucccugaaaauguucuacaauuuuugguucagcuccuuugcucucaguguucccucuaucuguauuauuuccucuauaccaccauccuccccaaacaucuauuaaaauccuacuuaacauccauaccuaguucagauacacuggccacacauccguacgugguggggcccuggauacaucaagggcaagaugauccacugggacaaaaguagaaaagugaccccacuuagcccuucuuuagaaucacagggcagcaucuuuagauuuuaaaguuuccugucugccugucuggcauuuugauucuguauccuguacccacccauucuccucuccccuccaccaggagauacuguuguuaauauaugaauagcuaccguuucauaagauuuugccacauaucagccacuaugccaauuacuuuauaaacacuaucccauuuaauccauaaauuauuaacuaauacucauauuacaccaaugggaaaacucaggcuaagugacuuucuuaggauuacaugacuaguaagugguacuuggaguacacaaaaccaggacugucugaguguaaagccugcugucuuucacuaaguuacacuggggcugagugauuucccugccacucaggugucuuugcuguggaggaauuaacgggucugaagacugaagcugggaagaagcagcagggaagacugaucugagcuuucagggaaaagagugaaguuggacuuuaagguuuuuauauugucaagacaauuuacaaacacaggaagagaaagaaugacaaagaggagaacuccuagcuggaaagaagagaaaaaaaaauuggaugcaaguaacugcauuuauauaucuugagaauuuaaauaaucagcaacaguuagaggugcaaaugcaacagaagcuaaaagaaacuuaguaucuggaauaguugacaagauaaaaccccaaaaucugagagcugcaaucaaagagccaucuucucuacuaaauugaauuagcucaguuauauagcgcuucucaacaauaaaaaguccauuaaagaacagaaauuuaaaaauaaguuuuacacacuauuagucuuccaguuuauauaacuuaauacuguauacuaaguuuuuauuaauaggaaaugaaggaauucugagggccaagccauguagaaauagccuauaaaccagacaggcagagggacccagcagagacuagcaaagucuguaagucaucacauuccaucagaaauauccagaugaaaccagaugaaaaagcacuuuaacaauacuccuaaacaacugcuaggaccacggaacucagaaacacagcaagguaagcaacguggauauuucuauuaguauugauauaauacucuguuucucaguaguaggaggaauuugaauuagcccgucagucuugaauccuaaccauaaauaaaauaaaguaaaaaaacagcuuuguuauaagaggaucccaugacauguuccuugugauuuggaaggaaccuuuccuggugccuucucugaagacagcagagaaggaagaaaauuaacaauuucuaggacugauuaagucagaguggaagagaagcaguaaagacaucaauucuaagaaggauuaaggaugaaaugauaccugugugaaugugugaaguuuacauggauaguaacauuuccuucuaugucauuaauauuaauauaggcacucaguaccuaucuaugaaagaaugaauguggaaucuaauacugguuaauguauaguacuuauacuccuucauaaauuauguuguaucuaaauaucucugagcauuugcugugugucuccaaacaggcuguuaucgucuugagggcaaggaacauugucguuuucaaaugccucaagggacacaguagaggcuucaccagugagcacuugauaaaugcugaugaaugacuuuaauauucuucuuucuggucagaaacauuuuuuaaaugaauuuauaucagaaaguauaucaucacaucaugaucaauuuuuguuuuaauuaaaggccacagauuuuuauuugaauuaaaggagacucagaacuaguuagaagcuguuauuuucuucugaaaagcuccugauuuuaccuauacccuauuuccacacucccagauaaggaaacugugcaugauggcaaaacccuguuuggacagugaagaaaagugacagcaagaagaaauguaaaaccucagagagcacuaacgacuaaacaucagagguuuagacagggucacguuuuucuuuuucuuucuuuuuuauuuguuauaagaaaaguucaaacauacacagaaguagagacaauaauauaauaaacucccauguacccauaacucagcuuuaaaaauuaucaaaacaaggccaaucuuuuuuccucuauaacccuaccccacuauucuuuccagauuauuugugaacaaaucucugagaccauuucauuucaucuuaaauguuuucaguauguauuuccaaauaggcaagaacuucucuuuuugaaauuuaaccuuacucuucccaaaucaacaauauuuaaacaggaccaucuuugacugggaaauauaccagcacuaugcucaguaucugggugacaggaucauucacaguaaaccucagcaacacacaguauagucagggaacaaaccuguguauguaccuccugaaucuaaaauaaaaauuguaaaaauuuuauagcaggauacccaguauccugcuauaaaaauuuauuugggguagcacaguaaaagcuuuuggaaugcaauuuacgauacauaucaaaaguaauaaaaauuuaauucccauuacuuaugccacuaauuauguaauucuucuagguacuuaugcugaggaaauaauccagauaauggaggaaaaaaaaucuguggguaucaaaaugcucauuagaauauuagugauagugaaacaauuuuagauuuauugaaccaggguaaagacagggaauaguauacguaaccaauaaaauuuuuuuuuuuuuugagacggagucucccucugucacccaggccggcgugcaguggcacaaucucggcucacugcaagcucugccucccaggcucaugccauucuccugccucagccucccaaguagcugggacuacaggcgcccgccaccgcgcccggcuaauuuuuuguauuuuuaguagagacgggguuucaccguguuagccaggaugguuucgaucuccugaccucgugauccgcccgccucggccucccaaagugcucggauuacaggcgugagccaccacgcccggccaaauauuuuuaaagcuauaaauaggggaaaguguuaagugaauaaaagaugaauuuuauuuauacuauuaugauaacuuugugaagauacuuaugcauauaaacaaauuuugaaaaagaauaacaaaaaucaaaagugaaaugguagguuuauggguguuuuuccuccucuauuuaaaaaaguguauauguuacugguaauaaguauauauuuaaaaaucguuuuaccaaaccguucacuuuuaauuucuccauaauguaccaucuaucaaaguauaaaucauauauugcauucuccaugaagcuuucucuaaucaccuugauauuaauuucuaaguucaacagcacuugacagucaacgcacuacuguuauucacgaaaguacccugaagaguuguauuugaacauaugaugaucaguacauuuucauuuuguaagguaguuccuuuucugaaaaacuaaaacaacuguaugaugucauuaaauaaaacuuaacuuuuagacacaauuaucagcauauuucuaccauaucuuagaugcccuuuaaucuuaaauguugacuucucaauucaaaaaaauuaacaagguuaggugcaguaagcauccaucucaagcuaaccuuugucuccauuuucauuucuuaaggugugcugaccaaugacaucagcacuuucagauguuuuuugucauuuuuuaauaaaauaacaagucaaaaauuuccaaacuuuguuuuagcaacagaacucucucaucaaauaaaauuuuaccuacccagagcccaaauguguagagcaagagaaagcacagcugcuccaguccagcaaaggcccaggugaaaaaugggagacccagagaccaagagcuccaccugcugucuagcaauucccaaugggcugcuccagggcacuacagaacccauuucauggauaacuacaagaaaauauucaaauaauagcacaaacucuguacaaaaguggaugguaauuccccaaguggaacuuuucaccaacaggaagcaccaucaugugacaauucaaauuauguaaaaguucaaacuuaccauacaauagguguaguuaauuagagcuggauuaaauauaccacuugcuguuggugcuacaaucuuugaaagugacaggucaucaaugaaaauggaauaagauggagaaaguauauggcucagaacuccucucgggcacaauauuauggguuguuuguaaaauaucacuugaagcuugccugaguaacaacuacgaucuuuaagaagggugacuccaaauaauugcagggcuuuuguuuugcugaguggaguaaucacuuugggagucagaacuaaauuguuaagggcaauagcgaaaauacugcacacugccaacuaugguucuccauguggugcccagccucuccucaacugucaagcacauaucuaagaauacuugaaagguuacaaauuguuaaccuuacuagaugacuaaaugucuccacauggccacagugccaauauauuauauauuaaaguguggguuguuuaaaacaaauuugcacaagucaaauaccaaguguaccuuuaauuuuguacgacauauuacuuucaacuugauauuacaguuauaaaucugucuuaacuuccuaacuagauuagaaauuccaaaaaagcaaggaccaugucuuuuucaucuuuguaugcuuugcagaguggugcuggcauaugaccuuacacgugguaaguacuaaccuauuagaugaauuguuaaugaaucaauaauugccuucuucgcuaagcucuucaaacuucaccuguccaaaacacaauucaaugguuucacuuucaauccccaccucuccucuuccuaauuccccagugcuucuuaucucauuugggguguagaaauaaccuugagcuguauucagaacuggagcucagacauaccuaagcagguaugguggcaggccugcugaagauauguuagcacaagaaaacccuccccacuccccacccaaggaaaaaagcuaggaagguaagucugacucagaauaaaaguccuuuuucauuauaagggaaacauaauucuuagcacaucauaacauuucuuuagccaaacucguuauuggaacgaagucaugaacugaugucuagaucccacgaaaaagagucuaagcgcaagugcaagagcaagacuacuuaaaaggaggaaaaacauuacuuuaguaguugaaaacguacaaugucuuacacuuugauuucuaguaagacugaacuuuucccaccauuuuauuagauacuauuuuuuguacucuguucagggugguuugcucauuuauauauuagauugucacugcuuuuugaaaauaauaacaauacuuuuuuugcauucucuccagcuuguuuucaguucuuuuuacauuggccaucuuuguuagucaaauuuuugcaugugcuuuuuuuuuauugguuuuaggcuuauaaagucccacuccauaccgauauuugaaaauuauccauuuucuucuagcuauuauuuaauuuucuacauauauuacacuaacaauuuuguuauuaauuuuuaacuccaaagucuagcccaugacucaagaccauuuauggaguaauaauuucgauuauuauugauuugagauucuacaauuuauuauuauuaaacagauagaagggucugcuuuggggacuaauuuguuccauuaauucacugacucuuguaccuguaccauacuguuuacuauuuuguuuuuaugguguuuuaauacuggggggagaagaguucuauuuuauuuucugaaaaaaaauaaggcucaccuguucagucuuucagauacauuuuacgauuaauucgugaaguugugcuaaaacaaugaguuaauugaaaaggagccgaccacuuggaagcauucugccucccauccaggaggaagguucauuucuccauuuguuuaucuugagguagacagaaccacccaccuuuucuggaaacuaugccuucauauaauggcauaugauagcugcuagagauauuuugaacuuuuucaggauaagaaaacuccucucaccuaacugucugaaaaggaauauagcuaauuuucuccugucagucagaaacuagaguuuucacuucauaauaagaucugaaaaccgggagucaaaaaagacaaacguuuaauggaaaauuacuagaagaaaaaagaaaauucaaaguccaaaucugugcuuagcaaauuacaguuuccaacccauuguaaguuuagagaauauuuacuggaucaucaacaagcaauuucuuuaaagggaauuggauuaggaaauuuucuaaguauuguuuuguggaaaugugugucuguuacaugugugcaugccuguauauauguguaugugugcuggauuugaaucaaggauaaaaauuaauuucugaccaugguaguuuauuuuaccaggagguuccagugcauuuuucuaaaucuaacaacauacaugguuauuuauguuccuaaaccauuucagaaaaauuuucucuuuuccguugccaacuuauauccauacgauuuggaggauagguuauuuucagguuuacuuucuugaaagaaaaaaaucuucauuccuacauuccauacuucugagguuccccuuaagcagaauaagaaccguagugcuagaagacauacgguccaaauuaauuacgauauuauuuacucaaaaagaggcugugccagauuccacauggauauggauaaagaacuccauuuuuucucucuuuucucucaagaguguaauuuaaaaaaaaaaaguaccagccacauaggaaggcuacucaaaguaugcauauugaguagcaucgugcucuuacuggcucaaauuuagauuuuucacccaaauaaacacagaagagcaugacuguuagguacuguaggccaaaaggacaaacacugaagucucuugucaaguuuauuuuauucauucuaugauguacucucaguacuuuuuuuuuuuuugagacaaagucucgcucuguugcccaggcuggagugcaguggcaccaucuuggcucacugcaaccuccaccuccguguucaagugauucuccugccucagucuccagaguagcugggauuacaggcaugcaccaccacacccaacuaauuuuuguauuuuuaguagagaugggguuucgcuguguuggccaggcuggucuugaacuccuggccucaaguuauucaccugccugggccucccaaagugcugggauuacaggccugagccaccaugcccggccccuuauucuuuaauacuuuuguaaaauggcauuuuuuuucugacguucacucuaguuuaucuaaauaaugcccaagugcgauacuauuuagacuauucuaaauaauuuaauuuauaagcuuugcaaauggagaauaaucacaugauuaucugauuaacacugugcccuguauagugccuaccuucuccccacaugaaauuuuaauccaaagagucuugaauauauacucuuaucacaagaaaaaauuuguuaaagauucuagcaugauauacauguugccuuuggauauccuuuagguuuagaaaacaaauaacuugccuguagagauauauaaagugacuugaauauuuuaaguuaaaauaaccaaguauugaaauacaaaaaacagcccuguaaauuuagagauguuaauauuuaucuggcccugacuagaguuuaacuccaaaugcuagagaaaucagucugguagguguggucaauguggugacuagggguucgggaaacuaaggagcacuaguaaucaagagcuaagcauuucaaauuggggucuguuucaaauaaaaguuauuaaauauuaccuagaaauaaucacgcuuauuaauaaacagaugcuugacaaacgaugaauauuucucaccaccacaaaaucuaauaacuuaauuuauccaucaaaggguuguauucuguugccuacacuuuccauacacugacuccaaauuucauaaaaauaacuguuuuaaagaaccugcugagggcgggcacaguggcucacgccuguaauccuagcacuuugggaggccaaggcagguggauuaccugaggucaggaguuggagaccagccugggcaacaugaugaaacccugucucuacuaaaauacaaaaaucuagcugggcauggcaguguaugccuguaaucccagcuacucgggaggcugaggcaggagaauugcuagagccugggaggcagagguugcagugagcugagaucgcaccacugcacuccagccugggugacacagcgauacucccucuuuuaaaaaaacuuguugaguguucugaggaauuauccuuagacagcaucuugcuucuuugcuaugcaugaagaaaaagauuuccuagucccuucuacacaguuagcagacauuuuuuaagacuuucaguaaaaauuuaccauuuuauuuuucagcgaucauauuggaaauauggcccaaagugacuuccuuuacccagagaacccaaaaaggcgggaagaaguaaaucgucuucaccagcagcuucuugauugcuuaucugacagcuucgaugucaccaauaagcugacugagguucuaaauaugcacuuggggugcaggcuggccuccauugagaugaaaagagaugggaccaucaaagaaaacugugaccucaucauccaagccauuaugaaaauccaaaaggaauugcagaagguugaugaagcacuaaaagauaagcuagagccaacccucuauagaaaacuucaggauauuaaggaaaaggaaacagacaaaauugcaauagugcaaaagguuauuucggucauccugggagaagcuacaucugcagccagugcagucgcuguuaaacuugugggcucaaaugucacaacuggcauaauuaacaaguuggucacuguguuagcucaaauuggugcuucucuccuugguaguauuggaguugcuguucuuggccuuggcauagauaugauuguccgugccauccugggagcaguggaaaaaacacagcuucaagcagccaucaaaaguuaugagaagcaucugguggaguucaaaucagccucagaaaaauauaaucaugccauuacugaggucaucaauacagugaaacaccaaaugaaaugaacagccguuuuauuugccacugaaguguuuuucugcuuccuuuucaguaacaguguuugcuucuuugauuagguucauuuucuauaggcuuccaauauggacuuaaauaagauaaacaauuuggagagggaaacuggagaugccaagacuagaugacuagaugaguuuugagucaacaaugccuggaucagcugaugcuagacccugugagguaaaaaaauuuucucccuggauguuuucacacccugcucuaccagaucaacauugggguaaaugcuaucguagaguagcaaguauagggguuacuuuucucuuuucuaauuucaguaaaauucuuaaauuucacauugaaugcagagacuuucauuucuaccaccagcuucaaacaucauuuaguuauaaggggacauacucaguaacuucugccuagacacaaacucuaggccuucgaaugagacagaaauacuaccauauuuuugaccaucagaguaaaucugguuuucuguaaacuagaagagacugaaaaaugguuuguaacaaugugcuucaauuaggacaggaagcugaucuguaaacgucuacugauuacacaauguaaaccggauggauuugaaaaugguaaaaaucaaaacuaaaaacaucaagguccuguuucagucacugcaaucaacccugaccaacugugauaauuaaauaucgcucaagugaauguucaaacacugaaacauuuagaagacaagaaagcaaaacacagcuacacauauugcauuuaggaugcagaauagaaggucacuacucaaagcauuugucauuuaaaagaaagucauaauuuauuauaagcuuucagaaaaaagaauauaauuucauuuucaacacuagcaaaaaggaggcagcugccuuugcuacaugacgcauuaggugggccauuucacuaauuaccugauuuuagaaaacgccaaaggcuauggaagccuauuaaugguuccgcugaaucucugcagauguguuuguuuucuaaauccuuugccaaccaauaauucccaugaggacucuuuuagucuauacugacaaaauuauuaauaugcuguugaugccagacuguguuuguuauaguugauucucccauccaaguacaagaaauguauugaaauaaaaacugcucagcauaucuuaaaaauaguagcuacauauaaaauuuuagcuacaugaaagacuuuaauauuuccaacauacacuguuuucucuuucucuucuugcauuguuuuucaaaacgaguugcaaaacuaugaucacuaauguguuaggaaagaaaaaaaacuaguugcaaaacauuacaacuuagcucaccuucgcaguucaagauuauuuucuuuuuuauguacuaccugguuuaucagcuuuaaccuacaauaucucgucauugcuuucugacacucaaauucagucuaaaaucaaaucaagaauuuccuaacacaaagguaaguuuagguauaggaccgaucuuauaccuucaagggcaguuuaaagauucugcuaaaaauuaguauguaucuccaucaauauuuugaaauauuuauaacuggugguaagaauagccuuccuacaugggauagucagguuaagauuagaaauaaccaagcguauccucuaagauaguuuuuuaaauguuuaaacuuaccuuuaagggaaauaagugggggcugacucacggaaagaggggauagaagguagggaaagggcgaaggcuagaguuaagugaagaaucccguacguagagugacaucauagaggacuuuuggcuggugaaaagaccagucgggaauauagccaauauauaucaaccuugccacucauauaacuuaaaaccgacugcauauguauccccguauuucuucuucaaaacacuacuaacaaauaauaaaucaccgcccauauaagcaaucugcgacucuaauacgggugcuaauuuauuuguucagguggucuacaaacguucuguucugccugucuauuaaauuuccacacguacuaggcgcucacaugggauaaccugaugcuuacaaagcggauuaaacucaguggcaaauguuaucuggguauucguuuacacacggagacaccccuaaaggaucgcaccugcuugggucauaagaaacagaaaaaugcaaaaacuaagguaauuccaaaagacagaaaacgcagaacgcuucuuuaucugcagaauguaccguucucggacggcucaacguaccaggcucccagcaacuaagucaagaugccuccaacucgagagacaggaccgucagccacucaguuagcagcuaucuucuucuaauuccuauuguacuagaugagcgcaaugaggcgggcucuuagccgacaaccaaccaauugaguauuguauggaaccggaagagacucugguccuggaauucuuggguauucucuaugguuccagggucaagcggcgcuaagagaaggcgggacagaggaaugggaaaugacgugaggagugcggaggggcgcgagguuucaagauggcgguagcugagggguugaccgagagacccaguugaaggccuuuacgaagugaaagaggccgggagucgcccccuacccgcuucucguaguccugggagcacagcagaagugugaguguauugaauugauuuacuacucuuccucaccucuuucgucccuuccacgucccgcgcagcggcuugggggacacccagccccuuugccccgcuccuccucucccugguugaggucucccuguugcggacugggcuauuccugggccugggguggcgcggcgaccagugguugcgcgguuggcaucgcccgggucgguuggggccgcuucuuacgcacguugauuaguagccuuagguuugacgucuuguaccucgagucauggucggucagccgucgcuaugguuucgucaguugcugguguugccuccuuuggugaaccuggacccuaucccauugaagcuucuuuggcuguuuagaguuauccaacgcuuauuuggcuugauuuuccagucgccuccgcuugua

SEQ ID NO: 14948 - RNA, 4000 nt, Homo sapiens
cacagccuuccacuaacaucccguaggagccucucucccuacugcugcuacacaagacccugagacugaccugcaggacgaaaccaugaagagccugauccuucuugccauccuggccgccuuagcgguaguaacuuuguguuauggugagaaacuuuucucccauuucucuguguuuacuuuucugccucugacuuuggcuuacuucuauuuuuccucucccuccuccucuucuucccccuuucucuguuauaaucuuaaaguaccauuacuuucacauuucccagucuccgcagaaacugaucuguucuauuaagucuuuuuuauauccuaaauauccagagucuuaugcaacuuaacaggcaaacccguucagugguaagucucuguauaucuagaaacucauauuucagaaagaagauaccaaauucccagcccccugcauccucauuuuuaaggauauuuauuuagacuuugguaucaauggguuaaggguauuguuuaaaccacuugccuuugagaaaauccauuuuuaugugaaguauuaaguauagcccuuucuagggacuggacaaucucaugaacuuacuauguuuguucaguuaauuaauuuuaaaauaaaguuuuacaucaaaagaauuuuagaaaagaaucauuuucauaacuccuguugucagaaaauaaauuuugccuguuuucuauaugucauuaaauauaccugcauuuguucaaagcuuauaaaaggaaaucugaagcaaaguuauuuacuuauuucagucuuuuguuucaauuaccuagauauuuucauuguuuuaaaauuuaaauuacauuaacaaccauaaagauuaugcuucucacucuuguauucacaaauuuucuguauuagaggauuugauuucuucaccuccuuuuuaaguuuugaagaaaauucacuugcuggcaaauauuaauagaagcuucuuauuccaaaauuuaucugcugugcucaggagaguggcagaaagaagaaaacuucggcuuugauaucguuucaguucucucucugaacuggcaucgugcccagggugagcugucagcuggagcuagugguuucuguggcugccaauuuaacacagguucuuaagaggcuuucggaacccucuuagaaaccugcccuaguaagcccagcagagcaacugcccuguaguucucuugccuggagaaaccuggcugucuucuggauccuucuuaauccucuuugacccuguucucaaacaggcucugaauaaaucagagaagaagguucucuggagacuucuguacagcacuuaaagugucuuauuuugcuugucugaagacgucauagcccuugggaaauuuuagcugaaaauggccacucccuccuucaacaucagagaaacuaaaauauagagauauccacagcaaggccagagcuagagaaaaaccucauaaauccuaaauuccugaaauuucuaauaaccacacugcuaaauauauucuucauguuuuuagacucuuuccucuucuuccaucccuguauuuaaacuaucacagugucuaaauugauaaauaauaacauaaugaaucauggauaaauauugauauaaugaaucuuuuuuuuuuaauuucagaaucacaugaaagcauggaaucuuaugaacuuaguaagugaauauuuaacuucuuuauucaaaucccuugcauuaaagaaccucuucuuauuuuuaaauaaacaagauggaaagauauauaacagggagggaaaagggggccucuuuuggaaaacuaaaguaaauuuuuaaaucuaaugacuauaaaaauugccaaaggagcaauuuuuuaaguuugaaguagugcaauaugggauuuaagcuacaggcgacauauuuagaagccauaaaaucucauuuggaaauuuuaaauuggcaccacgucaacugcacagauggaaaacgaggaguaaugacaaaugguaaagcacagagcuggacgccaagucagcugggagaccacaggcgccacguuaagcugagugcuguuuugguuuuuuuguguuuuucuuucuuguuuuuuuuuuugagacagugucucacucugucgcccaggcuagagugcaguggugugaucucggcucgccgcaaccuccaccucccagguucaggcaauucucaugccucagccuccugaguagcugggauuacaggcccaugacaucaugccuggcuaauuuuuguauuuuuaguagagaugggguuucaccauguuguccaggcuggucucgaacuccuggccucaagugauccacccaccacagccucccaaagugccgggauuacaggcaugagccaccacacccagccagcugauugcuguugaauagcuggauuuauaaagacugagcauaggaggaaauggcacaucacucucauuuuuaauuuauucauuauuuuuauaguguuuaaacuguucauguaucggcaaucuaguuaugcuucauaaauccucaggacagagaauuucuccucaaaaggaauuuaaaaucuaccaaguagaaauacagaaauuaagaaaggcaaagugaucguccaaacucaaaaccaacaaagccuauaugacaagucucuaagacacauggauugauuacugauuucauuugaucaggaaguuaaugaaaucuacuuuauacucuccuuuaauuuuugccaaucuccguuuauaugaguugcauaaguuaaggcacuuucaaauauauuugugucaaggaauauucacggaaauauuuccagcuaugugucgcuaaaacugcauuuauuuauuuucuguucuaagaucccuucauuaacaggagaaaugcaaauaccuucauauccccucagcagagauggagagcuaaaguccaagagaggucaguaacaaaacuucaugaggaguggucauuuuucccaguguagaucacagaucugaauuggagugggaaacagcuuuuucaucauauacauuauuucuaauuguaucuuuaaaaucaaaaaacuuaaaagcaauauucagaaaacaacugaauuauuagaaaauuauuuggggaaagauccggaaaggagaaggaaggaggagagaaaggaggacagaaagaaaacuucuauuuucauuaaaaaaaaaaaaaaaaucuccuguucugccuucccucccugguuuuuuuuuugguugguugguugguuuuucugagacagagucucacucuguugcccagacuggauuauaguggcacuaucucgugccucagccucccaaguagcugggauuacaggcacgugcuaccauguccagcuauuuuugcauuuuuuguagagacgggguuuugucauguuggccaggcuagucuugaacuccugaccucaagugauccacccaccucagccucccaaagugcugggauuacaggccugagccaccgcacccagccucucccuguucuuuaaauaucucuuaauauaggggggcauggagagaaagucucuccaauauuuucuucuucuuuuccauuuuuguauuuuuccacuuuauccuucucaauuuuggccucuucuuccacuuucuaggauccgagaacgcucuaagccuguccacgagcucaauagggaagccugugaugacuacagacuuugcgaacgcuacgccaugguuuauggauacaaugcugccuauaaucgcuacuucaggaagcgccgagggaccaaaugagacugagggaagaaaaaaaaucucuuuuuuucuggaggcuggcaccugauuuuguaucccccuguagcagcauuacagaaauacauaggcuuauauacaaugcuucuuuccuguauauucucuugucuggcugcaccccuuuuucccgcccccagauugauaaguaaugaaagugcacugcagugagggucaaaggagagucaacauaugugauuguuccauaauaaacuucuggugugauacuuucaucuuguaaaucugc

SEQ ID NO: 14949 - RNA, 19927 nt, Homo sapiens
gccauuaauugacaagaaugcugcucaaguuggcugaucaagagauaggcagugcaaaggaacaggauuugagacagcccaggguuuccucuucaaguaggucuaaaacauuuuuuuuucucauugacuuccuuccuguucuaacugccaguacucagaagucagaguugagagacagaggcaccccggacagagacgugaagcacugaauguaaguucaaauaccucgggcuggggaggcuucaggugggcacagagcaaagucggaaaccucuagacggggcuaccgcccucgacaguuuauuauuuuuuuagaggggcaguucuucuuuaaaacaaacuuuaugauaagaaauugcuaaggaggcugcagagaaggggaaguuagaggagggaaggguagcagugacucaggggaggaggcuuaaaaaaggaggguacagggugcgcugcagcccaggaagugcaauccugaauauucucagaagggcucugagaacacgcaccgggagugccuggagggguuuccugcaaaguaggagcaggcaccuggccaggcuuggaagaaaaagacuguagauccaaaaugauacggucugugcugguggaugguggguugugcugggguggagauaugugguuuccuguuuuuaagcagacaauguaaaaagacugguugaaagagaaaaaaaaaugguucaaagcugucaaauauuaaacugucuuccacuaaauaauuuucuggugauauaagagaaaugcauaaugaaauccucccuuagagugcaggggcuuuaucccucaaagaggaaguaugguauagcacauuguuauguacucaugagucauacagugauagaauuucuaccacugacaaaggcuguguauuaaauuccugcagucggaugggcagaucuuugcuguuguugucaaaaauaauaauagggcugggcgugguggcucacgccugcaaucccagcacuuugggaggccgaggcggguagaucaccugaggucaggaguucaagaccggcuugaccaacauggugaaaccccaucucuacugaaaauacaaaauuagcugggugugguggugcaucccuguaaucccaguuauuugggaggcugaggcaggagaaucacuugaacccaggaggcagggguugcagugagccaagaucacgccauugcacuccagcaugggcaacaagagcgaaacucuggcucaaaaaauaaaaauauuaauaaugauaauagcccuuuagguaugagauaacuaacagcaaacauggaaaacaccaaauaacguauuaagagacagguuugagaaaaauucaagggggcccagcuaggacagcugaucagugggccuucaaaaugucaaggucugaauuucagccaccauuaggagaagugcuuuagguaugaccugaaauacuuucuucccuuuuagaggacuucccagccagcauguuucauaaacauaaucuguaauuaaacucuagaccuaugguaacuugaggugugugucuggcaagcccugggcaguucuucauucagaguggggaaaggcagacugcucucacccggagggcucauggucaccacuucacauggagaccuagagccccuggagucaggguuggccuggccaucuucacugcagggauggucaggcacaggagaucaagaggaccauggcaccuguugguccggagagacagggggcagagguccagucccuagcaggcaucgugaaucuugccauuggcuuuguguuuuuuuaauuuguaagaauauauucccucccaaagcagauauagcacaagcuuaguaacaagagcaucuuacucuuuugugagaugugugaaauucuaagagacaguucuuucuccauccaugcuucacagaugcaaaaccugaggacuaacuaugcugucacugaacagaaacuggcaagcauuuuucaggccucgacuggaauuugguccuuccuugcuuuggagagcaugaguuuguccccuagggaaguuagcucugagcaacauuaagguucuguuuucaguagacacucagcaccacaaagucauucugagggaaagauacgggucugagcugauuugggagagcacaguacaugacaaacaucagcuagcaggaaaagagaagcccuggggagucgaaauuaugcagauagaaaaggagaaccaacauucauugagugccuucuaugugucaggccuggugauaaaaacuuucaaauuuuguuccugagaagaaugcagaaguguucaauaauuugacuaaaauuacauacugauacaaaaaggaucaauagccacaaugccucugaauugcaauucacagggcaugguggugcgugccugugguccuaccuacucaggaggcucacgugauccucccgccucaaccucccgaguagcugggacuauaggcgcgcaucaccacgcuggcuaauuuuaccauuuuuaguagagacgggguuucuccauguugccagggcuggucuugaauuccugggcucaagcaauccgccugccuuggccucccaaaguccugggauuaaaggcgugagccaccaugcauggccuauuauuauuuuuuugagacaagucucacucugucacccgagcugaagugcaggggcgugaacgcagcucacugcagccucgaccuccugaggcucaggugaucucccacauucuuuaggaagaaucacauggaagaaauuuucuccaauuccauauuuugagaguucuuauuccugguuuguguuauugcugcccgggauccuguauucaaggcuacacuggcauacccagagaugagucucauguugccccugaaacgucagcaacauuuaucugugcaauaagcacauccugaaucauccuguguuguguuacucucugguguccacagccaaagagugaauuuuaccgcugguaaaaauucacuugggcuuucuuaaagagccuaauaaucuuagcacaaacggucauaaaaaaaauucucucucaauucugucuaacuuuucaugcuaauuuaaaacuuuugugaauauauugagauacugaaggcaauggcuuccuuaaugcacaguuuucuuugagaauuauuuaaaauaauauuugugaagguacuugguggcaugacuucacacguugggcacucagcaaagcucacgggaucucuuugaguucucucucuuugugcauaugaauguggguuagaaaaacacacuaaaaaaugcacaggcaagaaauaauaaauuguuucucucacaaagacaaaugguaagaaauuacguuucuaguaauuugugcccuucucuggauugauuacaauauuuauugucucuuacaaaauaaucuugucuuugguuuuucucauccaguuuugaaguuuucguaguccuucauggggcugaggugguagaaagcagcaccgcaaaguggggaguauggauuccuccaugucaccagggacaggggcgguggggagaggguggaaucccgaaccaagaaggcuucugguguccugagagacaaauuugcaaucccguaauacaccaaauugccaggcaagcagcacagcacauucaaauccuugacuagcucugaaaugucaacaguguuuuagagauggccugacucuccagaccugcacuagacccacagcccgauuugggggaagucagacauauccuagucagcagggaaaguggagguagcaggaguuacagagaaugcugaugcucacauaggaacuucucugauagaaauccccuacuucugguauuuccacuuuucucucucucuucccucucucucuuucucccuucucccuccucucucucuccucuuucucucucccucuuuccccucuuccuucucucucucucaucgcuaucucuucuaccuaauacauuaauauccauggccugugugucuagaugcauaauccagcacaauuuugcagauccagcuuugggccgugaguuaagucucugugguauuuugcuccagagccagagggaauucucuucauuagcugugccuguguucacugacauuucucaucauucgcagagugaccucuggcuucaaugaagacagggagcaauaaauaaaaccuaaaauuaaauuguuuacaugaaaguuuuuaaaagaaauauaauauagucucauuuuaagguugauucaguuuuuaaacaauccuuucaauuccccagaacuucuuaucucuuuaauacuccucaaagacaaaaaucuauuuuuaaggaggaaggaguggggacauagcucccauccaggggaaaguauuugguguggaaacaguuaccuagcuucagugaagcuuugcaacaaagcagaccacacuggggcagggaaggaagaagaggaagggaacaaauauucacggaacaucuauucuugaccaguauaguccuauaauuuuucauguguuuucuccaaucuuucaaccccguaaaaaagaauauccccauuuuaguggugauaaaacugaggcucagugaaauuagcaacuugauugaguccugucauaaugcagagccugguuuugaaucccugguccaucugacucaaucuauguucuaugagacaugaaagucaccuuucucugaauuacccagguaauuuguuuaaucuaaacucaggaguucuaccuuuucuuguccucaguucauuuagagcugcauuaaugaaacagaugaugcucuauccugacauggguguaaauuuuuaaguguaauucacuuucaaagucuuggaaauuucacugaauuugcaagcaaaaacauugaugugugcuaugucauaugcaugcugugaguaaccauccuaauuuaauucgacauuuuaauugagccugagaagauuaaguccccaucucagcacaucuaaugcuugccagugcuuugcugaguagcaaacaugaggaugugaggccuccaaugugaaaguuaaucuguaugcgcaucugugaagcagaaaauacagaaaacuagaguagcaagccugugugaaaaaaugauaugugcuuuggggccuaauaaaugggguccacauuaaccugguuaaacauauaacuguucauucuccauuucauuuuuccugugcaaaggaccaaagucaaaaauaagcaaaacucagcucugcccuuuguagaauaggggaugagcagcugaggaaggugaggaaagcccauccagaagauucuaugcugaugggcugaguccuccccaaucucccuuuuacuuccucuuuucuuuucucauuucacaagcuucuuuaaauuagggagcauuugagucauuaaauuaagaaggggccucagagauccucucaugccacggcuucuuuuugcagaggaugaaacuggggcccagugagguuaagcaacuugcaggagguaacgcaggaaccgaguugcgcugaaacaucguuaucugacacuucccugcuuuguuaaagcugucucugcagagcuugcaaagaagcauuuaccucugcuugugcaccuccagguagauucccaagaugacuaacaaacucuaauuuuauuauaacuucuuaaagaugacugaagcaauaaagcauagugccuaaaagucagacaaccugggcgcagacauuaauucugccuaccacgugguaugucuucuuaggcaaguuacuuaacgugaacuuuaguuuccuggucuggaaaagagaaugaugaugccaacaaaguuacuguaagaacuaaaugagauaauccucuagaaagcacuuagcacuacaugugauaacuauuauaauuuguauuaauaauaucaauauuaucaauaggaaaaucaguuguccuuuagaugaugggauuggaaaacagucuguagaauuuucauaaaauuccuauucucauuucaacacacauccauaaaauaggaggauaaaaagagaaaauuguuguuugugguuaaauaugcacacagauaauuugagaaaucauugucaaacuguauaugccauuuauggcuggggcuucgggagaaacugagguuacccagaaauaacguuaaaaaugcaguacaaugcuuaauaauauuguauuguacuugaguuuugcugaagaguagauuuuaggugcucuugccacacacaaaaaaaagugggugagaugauggauauguuaauuugcuugacuauaguaaccuuuucacuaucuauguaucccagacauauuuuacaucuuaaauauauacaauaaauacuuuuuaagaaauugauucauaggagguauuuauguauucccgauaucaaucucuuguuaauacaugcauugcgaaugucucauuuuuagaauccagaccauuacucuuuucacugucuauagggugauauuaggaaaggaauuuuaaaugcuuguguaauugaaauauuuaauauuuucuucuaugucuuaguuuuugcacuuguaaaauguaauugugccuaccucacaacauugcgaugacugaaugaaauaaugcaugccaagcacuuaucccguacuaacugaguuuuuggcucacaaguguucaguaacaauuugcuauuacuauuaugguacccuuuauuaugcaaagaccuguucagugaaagaaaaauaauuuuaugucugggagaaaaauaaguaaaauaaaauaaaauaaaauaugcagcaucuguuggggauucacauacauuuuauuuuuuaauuuuuaaauuuccuuuuaaagaugaauuuuauugcauauauuuaagguauacaacauaauguuuagggacacacaucgauaguaaaaauguuagugaagcaaaucaacauauccaucaucucacguaguuacccuuuuuuuguuucugugccaagagcagcuaaugucuacucacuuagcauggggauucacauacauuuuaaauaacaaaacacagacagauauucucucauauucacaggugaaauaagguaacugaaugguaacuuagcugacccaugacugcaggucaggagaaauaugcggaggccuuagaaaaguaaucaucuaaagaugaugugcucuaaucccucaucccccaagaugaggaaacucagauccgcagugguugcaacauucaguuaacaggggaaaagcuaguuaguaggaaagccagaacccaaacccaggcaugcauaacaaggccuaguucaaugaagagagcauuauccaaaaucaaacggaaugaccacggaauucuccuaagggucuacuuccugcacccaugugcaccugggcuucucugccaggcuuuguggucaugcgcccucagacacaggugucaccugauaucuucugcuucaauauauucaacacuuugagcagguggacaugacucucagcuugagacuaaguugugucaaugaucugguggagcuccaggaaaaagcaagcuucugcccaggcaccuguaaucccagcacuuugggaggccaaggcggguggaucucuugagcucagguguucaagaccagccugggcaaaauggggaaacccuaucucaaccauaacuacaaaaaauuagccaggcagguggcaugugcccguagucccagcuacucagaaggcugaggcaagacaauugcuugaguccaggaggcagagguuguagugagccaagauagagccacuguacuccagccugggugacagaguaaaacuaugccucaaaaaaagaaggaaagaagaaaggaaggaaggaaggaaggaaagaagaaaggaaggaaggaaggaaggaaagaagggagagagagagagaaagaaagaagggagagagagagacaaagaaagaaagggagaaagagagaaagagagagaaagagaaagagagagagagagagagagagcaagcaaaagcaaaaaagcaaccuuccucuguaacacuccacucucugcuucaugcuuccauaguuuugagguuauguuccuaaucuggagaucuugaacccaaauaagucuauaaaggacuucagggguccacaaaccccuggaucauaugcacaaugucauggguuuaucuguuuuuuuuuuccuugagauaauuaccauaauguuuaucagauuuuuaaaaaagagaccuguaaucuccaaaaaaaauaagaaaucaaccaaaccaggugggcccuuuugguauaguuagauugcccaacuuccagccucuucucuacucugaagaguaauuuaaacaucaguauggcugaaguacagugucuuguaaacagugggugcucaccaaauaaucaugacccuaauuuuacuuuaaaaggcuuucucugagaacugcucuuccaguccuuuauuuguuguauuauuacucuuucuaaucagcuuucuagaaugagcuaguuugggaucaccuggucucauaucucuuuuucuuaugcuauaauuaaaccaaaugauuuuaauguggcccugaauuucccccuuuugacugcaacaaaauuuuguacagaaaucccacaguauccuccacucuuuaaugucuagguaaauuugugucucuuuuuaugaaacaauuguuauaucuguuugcaaugaaucgagaaaauguagaacauaagccucagauuuacugaugagaagaucaagaccuauauguuagauaaauggacaugccaauggucauacuguuagaagguggcaaaucuuguccuauaccuaaucccucucucgcucucuuucucuuucucucucuuucucuuuucaacauugagauuugagccugcauaguugcaauuuccuggagguuauugaaaucaucuugagccagugacuggauguaauguuaccaucugauggccagguuucauucaaucaggcgacuuguuagaaccaagugauacaguucagaaaggccugaccaugggggcugggaugucuuccucuaugaaccguuguuccgaugcucggucagcagguuuguuauguggcccccauccuccggggaucaccaggguucuggguaugccccugucucaucugauuagucuuaucuggcuugcucuucauuugccccuuaaugaaugucauuaaauuucccacaaccuacaacaucuacacgcugccuccuucauuuuuuuccaaccaguucauucacuuucccugaguguuguuuggaauacgaauugcauuagucacuauguuuauucugcugugcucuagagucucaucuuugaguggugcuguuucuucugcuaaagcaagaguugccauaggaacaggccuacauguuuucuuccuguacaggaagugaaccugggcauugcaaugcuguuuucagaguuggucaaggcuagcucauaauguuuggcugcuuauuuagauggaagagaauugaugagccaagggauauuauuucuuuguuucucuuuuuuuuuuuuuuuuugguuccauuaaaauugcucucauuuggcuuuacuuccaaauuauuuuucuuccucuugccaauaauagugacauugaaacucaaaacuagaacugauuuuggccagagauaucuucacuccugggagacuuuauuaagguuugcagaaccacucaggaugugaugugacagacauuuucuuauaguugugucacuuaggagcaaugaaggcuuuaaccacaggcagggaaaagaguuacccucaagauagaauuaaggaaaucagaaaacaaucuccuugcccaaauaucuccccggcagccaucucauguggcugucagccacagggccugaaauucuucccagagggacuucuuccucuugguuaguauacugccucucauccagcugugugaaccugggcaauucucuuaacucuggaucucaauauccucaaugauuacaugaaccccagugguucauuucagcucugaaaagcugugacuauacauccucuaaaaggaauaauuuuugaaucuacuauucagucauuaacccuuaacagguaaauaacuugccuagauuucuccucaauguuuuaacacaaaacaaguaaauguagauaauaagagaugaaggaagacuccaggguaugcccagguggggccuuauaaggucaauggaaaccuaggaaggggagaaggggagagacugaaagggaaguggauccagaaaagggaaauggauggacaaaugcuaagggcaaauuuguacuuacgauuuugucuggaggaauuuaaacuguccuuugcuauuuuuguggcauuuaaaaagaauagaauaucuuuagauauaaaaccuuauauaucaaucaaggaaauuguauaaagugccagaacuaugcaaguguuuuagggggaauucaagaaaaacagcaaaccuaguacccacccuugaggggugauuagcaguguugggugugaaccaugcaggcaccugaggcagguaucauaaaggucaacgguucgucaugagucaucuuugaggcauugcuggaguucagggacagauuccauugauggggaggagccaaccauuucucuggcaaguacuccaccucucucuucucucuccugccucucuccaccauuaucacucagacugugcaugcugcaagcuuugacgcuagccaggcuggcuggauuuggaggacugugauaacuccuacagcuuuuugacugggcuuuugcuucauuuguucaggagucuuugugccauguugcuucacucguaguacguuauucacauaugagugauuucuuucuugucaguuuuguucagugaauagaagauacuacaaugguacagagaaauucaggcaggucagagaaauuacuagaauacauuagauuauuauuucauagaauuuaaugagauugaauuaggaaaacaaucaggaaagugacugaugaucagagaaguccaugaggguaaggaggcugcuaacagcagccccacuaacaucuuuuauauucaugacuuguugacuaacgggcugucauucugucucccagaaauagaucagaaugacugaaaaagccccagagccacauguggaggaggaugaugaugaugagcuggacagcaagcucaauuauaagccuccaccacagaagucccugaaagagcugcaggaaauggacaaagaugaugagagucuaauuaaguacaagaaaacgcugcugggagaugguccuguggugacagguauguguguacagagaacaggguggguggaagaucgcugagagggaagaagacauuuuggcugcucaggagcagcagcaaagggaagaggaccaacugcuuccaggaaaaagugagcgaggcacaauuuauauaugcugauuaaaguuaugaacuguauaauuaagucuucuuaagagauaagaugcaagucagcagugagauaggcacacauaacacacagaggggauuuagaaagaauuccaggcuaccacuuagaauuguauuucucucucuccauuuucucucuuucucaguccuuaccuaaccguucaucucuuccacauacaccgcggcagaacaagacauggcccagagauauaaauggacagugcccaauuagcagaguaccugacccauagccauucaggaaauguuggaugucaauaauuagauggaccuacaagugccuaaagcagaaauaacuuugcuguaauuuacaaggccaucaagaccaagcauagcaaaccugccacauccauuucuauuucuacuccagauagaaagaucacuuuuauuuucauacucucugucucccacuugaaaugcacacacccacuauacacaugucucuucuugguacuuacauucccuuucgauccugcagauccgaaagcccccaaugucguugucacccggcucacccugguuugugagagugccccgggaccaaucaccauggaccuuacugguauguagacacaucuguacuguucaaagggggccuaagauaucacaaagaaaacuuggucucugucuccuguuccaacagaagaaaacuggugaaucagagagauauauaugcuaggaccaguuaacaaaucauugcucuuagagugcacaguauuuaccauguuucaugaaaagcccaaucuuuaucucuauuuaauugaagagagugcaggcauacacauuugauauauuuacagauuuuugucuccacaugauaguaagagaauuguuauuuaugcaauaaagacugcugauggaaauauuaagaaacaaauugugugcuucugaaguuauaagguuuauacagucuaaacaucaaaguauugaucuucuauccacuacaaaacuuacuggaaggugagaagcaauccggaauuauacuagaaauuccacugcuauagauugaauuguuuuagcuugaaacucugauucuuguuaaauaaacaacgucuccuacuaaaggcguacaaauuaagauguuauuuucuuucaccuuauuguaacuaagggucaagccuuucccugagacuuagggcuugaggaggagagagacugggaaggggguuauuguggaggaaaugggcaucagaggggauaugagaggagaagcacggagccaggagauuggggccuucaaaggcaaguuuuuaguggaaaaaaaaaauaguuaccaaaugaaaaaauuggacucuugugagacagacaaagcacaagucuagaacaguuggcuuaguuagcagcagaguaguuccccucucacaggacacagccagucuuuaccuuauaugggcuuuuuugucagagggaggaaaucagaggcugagaaggcacacuuccuguucaacugaaaucauuagagcaggcacacacacacauucagcuaccccgacaugcugacaucucuccaggagagaaacucacgcucucucaccagaacucagagucuuccuaauauuaccagguacagcugccaguuugcaagauaaggucugaauuagcgcuaaagaaaucuguucucuucagcaggaccugguaguauugcaaggaaaacuuggucucuguccccuuucccagcagaggaaaaccaaauuggguuuucugucacuaacaagcugcuaugcaugaagaaaagcauagagagugauuaccuccuuaaucaggguacaggaauuugggacagauccugguuuuauggaaccugaagcuuuuauaacuucagugauauuccuuaagaaaaauaguaugaaauugcaaaugaaaauacaagaguaaacacaaaggugaacauuuucuuaaagugauaaaaugaauaaaaacaaguagaauuuuaaaagcuagaaaaugccacaaacaucaccaaaucuauaaaaacaaauagcugacacuccuaaauacuauuuuucuuauauguuuuauuugagggguaaggggcauauucuuuaauaaccucuucauuugaccaguaauauaauucucaaugagagaauaaauggaccaaaaaaagauuuaucuucacaacucauuauuuguaaugucuuguguauuuuuagcauugucaucaaacuugggggcagggaaacucucauguuuuucauaacagagcuguaagauuucaggcauuaagugugugugugugugugugugugugugugugugugugcaaggacuaaacucaaauacucugugaauugagggcccugugaaccauguugcccucgugggcccaacaaauuuuuccgggacuuaaaagucauuuauuaacuuguguaucugcuuuugaggauaaacucucucuaaaucuucuucuacaggagaucuggaagcccucaaaaaggaaaccauuguguuaaaggaagguucugaauauagagucaaaauucacuucaaaguaaguauccugccuuguguguuuuuguaaaguuuaaaucuuuucuuuaaucagugacuacauuucuugcaugaucauguugagguacuuuuuguuuguuucuccccuaguacccccaagcugggucuggaauguccucuucccagcccugagggcuaccuguugagacccacguuugccuccugucuuuuccuagccaggacuucuuaaacucuucauuaucucuuaagccaaugggaucccucugugaacuccaaacacauccucgaggcacacacugcuuuguguuguaccaccugugucauuucuucuucauagaauauaagcaccucaaucuagggugaaauuguacaucucuccuuuccaauauuucacacaaaacuuuguaaauagcauauaguucaugaauauauauugaaaaguggacaaacaagugaaucaaccaauaggaaaagaaaaugggacagggccucagcucuaauugcucaaggauuauauaaauccaggaagugugaucuuugcuaaagaacuggaaauuacaauuauaguuguggaacagguaaccaggaaagaggaaacuaaauaagaaauaaacugacaucuaauauaucccaaugagccauauaucccaaugagcagccaaaaucacaagaaaaauaacuuugacuuugaaaacaaauaaguuagaaaugcaguguuugcacuucgugguuuauguuugcuuugguggccucucauucccacuuagccucagucuccagggccugggcuccaccaaggaagacuccaucugcucucucuauuugcacacugggaacuuuuuuccccaagguacaggauaugauucaggguuuauggaugaccucccuaccccauacaaauauaacugaaaauaauuucauccuggaaauauuuguugaugccuacucuauaauggacacugagcuaggguucacuuacuuguuuccugucauauuauuuauuauuggagcaccugaagguuugguaaggcauuauaucaaaauaugccuagaauggguugcacaucaguuucauuuuuaaucauugaugcuauugcauuaauuugucuauuugguaaaccagguuuccucaaaugaaaugugacagguaaauuuugacgugacuaagaugcaaaggaaagcucuggaacaggggcuucuccucuggauggggagguggaggaggaaugugguaugugggucuguguggacagguuuacacauuaggaugaugcaggaggaggccacagaaaggggcuuuugaguacucucuaauucagagguuugauggcucucuggguaaccuacguaaaguugaaccauccuguggcuugucccagcauggugcuacaauuagaagaaaugccagaucaaagucaaaaauccuugaaaaacaacuuaaaucuucacugaagucucuugaaaaauguccaagaaaguuugcauuuauaacacaaguaacacauguuaaguccucuuucacaaucucuguuaguugcacucaauguucuuuuucuccucccaaacuucuuagcacuuucuaaaaaccugaccuacgauuguuauuuuagguucuucccaacuuuuuuucugccucccaaggaaaugugguaucucugacuuccacagcucucacuuugauucauaacaccaaggcuucuucccccuggagugggagacacaauagggauggggaugugggcagaagaagaggauucuaugaauauucauaguuuuauuucacccaccccaaauguauuuauauuaaauggacccacugaagagcgcuggugagaugguagacucuuugucuugaaguccuuauugcuacaccaauauaauucuucuucuuaggucuuucucccacuaggugaaagggauaagcuucgggacaucuagaaaggugcauuuauuuucccuauuccuaugagcuacauuugagacucacaguauuagaaagccugggcuuuaucacagucucuuugaugaugcuaauuuuuuuucugacagcuuuucauagguuuauacuacagauuuacccugugacagucaagaaucuaagcuggcagaguucacugcucugccaccucccugccaacaaaacaaaagauagcacugguugauugguugaacuauuguguccaacacaaaaggacagccauaauuauuguugaagaaaaauuauuugaagaugcuuuaauucuucacauuggugaacagauaaccaagcucuucggcuaaugaugcaauguccacuuuaauuuguuuguauagacauaacgacuguguaaaauuaacagacaacccaggucagucccaggugaaaugaaucauggaaaaacaaaguucuugggcuguccacauuuucauucugcguuacugaauuuucuuugaaaggcuugggaaaauagcaagaucucagacaacgucugaaaaugacagacauccaacauacuugccagauacaagugaauuucacccauuauuucaguuauauugcagucacagccaucuucuagacaugaauuuucacuuuccuccuuguuguuuguuuuuuauaugguaaguggaucaucucugagguugugguuuuuagauauuuacauaaugugcucuauugguaucuucauaacuuuuccuaagacaaggauggucucuuggucagcaguauuggagagggaaagcucaaggccauucuugggaccauugagaaaggagaaauacaaugaagaauauugggccaauguuuuaaugaaccacuccucucucccaaaacgguaaaaaucaaaauguucgauaauuaaaccaguuuggcaauguugcauuuuaugauuuccccucucuaaucuuugccucacagccaugcuaaauaauuauagaaacaccaauucugaacuaaaucuuuaguuuuuucauugucagagacgauucagcuaggcaggaucagcaugaaagaugagaaaaaaugaaagacccucuuaaucugaacaucuugguuccuucccaccugcaggugaacagggauauugugucaggccugaaauacguucagcacaccuacaggacuggggugaaagguaagggaacccacauuuccacacugucccaaacugcuucucauugauacuuuaacuucugguuauuagcaacuuuuagcuauagacucagaugagaauacaauaaaagcuguggaugccggcucuaggaaaaggcacaaauacaccucugauauagacauugacaaggccaaugcucaggggaccucguuuagacugcaucagcugcuaacguucagcagucagcuuuuuggauucaauauuaucacucguaaaggagaagaguaaccaagauaaguuuaaaggaaauaaaguauauaaaaauacucuacaaaguaaacaaccaaaaaaggcaguucacagguacaaaacccaagugucagagaaaaccaagaaagaaaaaacuugcccagugccauguguaucuggggugggaguagguggggguggcauuggagggaagggggaggcaaugcucaauuuccuaacaaagaaauagaaaaaaaaauauuuucuaggauugaaaaagccugucuaauuaaaauaacacaacaacauuacuuaaucugcaauucuucuugucaugccuugggacccugccuucaauuuucuuucauuaauauaggcagggagaaaugagaggcgggaaggugauggaggcacuuuacaguuccuuucuaccuaagggucuguccccuccagaggcaagaaacaacaaagcaugucucaguuuccaccaaauuaauaagcaagauaggggagaaauugucugauaaaucuggaugacauagaggaccagucaauuucucaaaucccagagaagaccauugaccugaaagauauugauuggccuuuccgauaccuagucucaugaaaaaaaaguuuaauuuccuauuuuccuuugggcauaaagcccguaucaccucacuuagacaaaaggacagugacaugucugcaacuguuuuuucaaacuuauuagcaacacuuagccaacuauaugccaccuaucugccuauguauacuuuucaaugcccaacuauucuuaauauauauuccaguuaaccaccuauaaauaaacuugauuggcuauuuucaccauuuguccuaguucuucacuuuuuuuuuuaccaacuuacugcuguuguuguuccauccaguuauucuauccaugaauucucaucaccaucuguuacuuuaucucccccaacugauauguucauagaaugacaguuuguagauagaagauccuuaaaguccaucauauacacaaagaaauggaggcucaaaaauguuauaugacuuaggccauugcaggacugagaucagaacugaggucucaauuugucugaguuuuuuaaaaugguguaaucugcuauaucuccauaaaaaaaacaacaacaacaacaaaaaaaaaaaaaacaggcuuaauccccauugauuuaggccacugguuccccaacuuuaccucagaaucaacuuuguaguuuuuuaaaaacacugaucccugggacccacagaagguuacugaaccauagccuuuggaaguaggacaaaggaaacuauauuauuaaaaggcacuccaacuuaaaaaauguuuuaaagaauaauuuuuuuaaaaagaugccucagggccaggugcgguggcucacaccuguaaucccaguacuuugggaggccgaggcggguggaucaccugagguugguaguucgagaccagccugaccaacauggagaaaccccgucucuacuaaaaauacaaaauuagccaagcaugguggcgcaugccuguaaucccagcugcucgggagguugaggcaggagaaucacuggaaccugggagguggagguuguggugagccgagauugugcuuccgcacuccagccuggacaacaagagcaaaacuccaucuuaaaaaaaaaaaaagaugccucagguaaaucuaauguuuauuuaggcuuggaaaccauugcucuugacuuuaaucacuguaggcuguaguccagauucuccaguuugcaguguauguuuuuccucuaucaggcucuuacccuaaugaacucuucuuucuucuuaguggauaaagcaacauuuaugguuggcagcuauggaccucggccugaggaguaugaguuccucacuccaguugaggaggcucccaagggcaugcuggcgcgaggcacguaccacaacaaguccuucuucaccgacgaugacaagcaagaccaccucagcugggaguggaaccugucgauuaagaaggaguggacagaaugaaugcauccaccccuuuccccacccuugccaccuggaagaauucucucaggcguguucagcacccugucccuccucccuguccacagcugggucccucuucaacacugccacauuuccuuauugaugcaucuuuucccacccugucacucaacguggucccuagaacaagaggcuuaaaaccgggcuuucacccaaccugcucccucugauccuccaucagggccagaucuuccacgucuccaucucaguacacaaucauuuaauauuucccugucuuaccccuauucaagcaacuagaggccagaaaaugggcaaauuaucacuaacaggucuuugacucagguuccaguaguucauucuaaugccuagauucuuuugugguuguugcuggcccaaugagucccuagucacauccccugccagagggaguucuucuuuugugagagacacuguaaacgacacaagagaacaagaauaaaacaauaacuguguguguucuggcugagaccuucauuucccugcuuucuugcuuugaacaaauaugauaacuggaugguucacauucaugaguucccucagaggggauggggaugaggaaaacacacuggaggagauauuuacaucuuugggaacaaauugguccccuauuacacuauaauaggcaaugcacauucagaauacagccagugggaaaucuacau

SEQ ID NO: 14950 - RNA, 177854 nt, Homo sapiens
uuuauuauuaugauuucuucuucuauucauacauuauugggaagucuguuuuuuuuuuuuuuuuuuuuuuuuuuuuuuagauggagucucgcucuaucacccaggcuggagugcaguggugggauuucagcucauugcaaccuccuccuccuggguucaagugauucuccugccucagcccccgaguagcugggauuacaggcaugugccaccacacccggguaauuuuuuuuguauuuuuaguagagacgggguuucaccauguuggucaggcuggucuugaacucuugaccucgugaucugcccgccguggccucccaaaguucugggauuacaggcaugagccagcaugccgggcggggagucuguuuuuaaaucccauuuaaauuaaucuuuagaaauuaaaaaguacaauuaauuaaaauuucauuuuaaacuuaaauguuuuaaaaauuagucggcuauugauuucuaacuguacugccuuacaaacagaugagucaagaucagaggucagugaaucaccacccuaugggccacacuuggccugucaccuguuuuucuacagcuggcaaacuaagaaugguugguacauuuuaaauggucaaacaacacaaaagaaggauaauauuuugaggucuguaaagauuacauaaaauucaaauuuagugggucuuacauuaauuggaacauaguuaaggucauuugcuuauguauugucuauggcugcuauugaguuacacaguggcagaguuguguaguugcaauagagaccacugaccuccaaaaccuuagcuuuuguuaucagguccuuuacauaaaaagauuuuuaaccccuuuucuagaugaugcaaauucucagaaauguauuaagguaugcugguuaauuuuuacaaauauuucuuauggguuuguugaguauguguauucucuaauugcuauaugccacauauguauuauauauaugauauauacauauaucgauagauauaggucucuauauaaguaaucuauauauauauugagagauagagauagauauagagagauaucaauaacuuaacagugguugaauggguguugaaauagcuacacuaugauaaugaguuuuucaauuuccucuuguagauuuuaucauuaugugaugaccuuuucuagccacaauaaugcuuuuuuaucuugaagcucauugcgugugaugucaacauagcuauaccagcuuuaauuauuauauaauugauauaucuuaagcuuuccacguucuuauguuuguaaauaacauauagcuauaucuuuaaaaacugccuugacucugucuuuuaacuagaaaguuuaguccauuuauauugugauuauuuacaugcuugaauguuuuucuccucagucuuuaccuucuaucuaugugucuccuuuccuucuacauuucuuuuuucuugcuuuuuuguggcuuacagaggaagauugauuguuaauauuuguuuaccucuuauucuuucucccuuccucuacugguuuggaauuucuacaucacauuuccguucuuuuagagucuuuaagauauuguagagcauaauggucaaaaccacguucucugcuugaauucaaauccuagcuucaucacauacuaacucuaugauuuauuaucuuuguguguguguguguuuaccuguaaaauugagguugugaaguaccauauggaucauuucuguuaaaaucuuauugugaauauuuuucuuaaggacacuuaaaauuaauauauuaaacuccucagaacaauacaaaaaccuuagaaugauuuaacucuaauuauccuccuucugauuuguaaguuauucucuagcauuuaaacugugucuuuuaagccucacaauuucauauuauuuauuaauauuauuuuguacagaccaggccucuuuauauuaacccaaauguuaaucagcuucuuuguucaccauuuuuucuuguauuccaguauuuccuacugggucacuuuccuucaucugaaaguguacuucagaaguucaucuagugaaggcagugaaaagaauaguuuuuaaucuaaaaaugucuuaauuacauuuuuguucucaaaauauaauguuucuggacacuaaauuauagguugacagcuauuuucauucaacauuuugaagauauuccacucucuucuggcugccauauugcuguugaaaauuauucagucuacuuguuuuucuuuuguaaauaauauuccccccuucgaugcuuuuaagauugccuuuccccugguguuuugaaauuucacuguaguuuauauugguuugcuuuuuuucaugcaucuuaugugauacauguauauguacugccucuauuucauuuucuuuucagguauccuacuugauacauguauauagccaggacuuccucuuuuuguagauucauguccuauguuaaucugggaacaguguuagcuauugugucuucucuugucuuuacuccauucuuuguggucucucauucugggauucuaauuagagaugaguaauaucuuaacauucucuauauuccauaucucuuaauguuuauuauuuucugucuuuuuucaccuucuguggugcauucugcauaauuucuucauauguagcuuacauuauucuuuucaacuauguuuaaucuacucuuuaacucauuuaugggguuuuauauuuuagcaguuauauuuuucuuuuccaaaaguucuaguggguucuuuucacguaugccuagucaucuuagauauuuauuuaugauuuuaauuuuuauuucuuuauacagccagauaauagcuaauuaguuuuuuugccucauaaaucgaauuauauuuguuuauucugcuaacacucaugucagcagaauuuucuuauauggcuugagaucuuugauuaugaauuccuauuugguugauguuuauuugugggaaauucugggacacuaacuugagguuauuuuucuccaaagaggauuucugucuaucucucuugggaacuugugggcccaaggaccugaaaccguacugacuuccuuccagcagagucagcuaacaugggauuuaaaagauuagcuucuucaccuuguagccgguuuaagucuuauuuaaaagauuacugccuaccccaccugcuucagcaauuuuguuuuguuuuguuuucauuuuggacccugagagauucccuuuacugucucagaguccuacaaugcauaucaaaguauauuuuaugcgggauccaggugauguguagcuggagaacuuuucaaauaaucuaauuuaccuuucugugugaagcuuaaaaaaaauacaugccaacucucuacaugcauauaaguauaguguauaagauggggaguucuuugccugaaggagcucccaauguccucuacauuuuguuugguuuccucuuuuuucuuagaguuucauuaccuuuuccauguguuucauuuggucucuuuccccuuuuuccuucuuucaaaggucucucuugauuuacccucuuaccucagcuacacuauuggauucaacuacauuauuauuucaaauuauaauuauuaguugaguccaaaaguauuuguugaaugaaugaccauuucacacucauuaaauucuucaaaagacucaaguucuuuucagaugcuuuuuacucaaguaacacugguuggauuuucuucccuuuguggaaaacuaauucuugauuauuaaaaaagauggaaaagcaaaagauuucauccauggguaagcaaaguuguauauucauuuauuuauuuuuaacuaauauaguuuauuuuuggugaaaauagagguuauauuuggaaaaaauuuccauguuaagaauacuuccuaucaugcuucaaaauuuccauacauuucuaauuacauauuacaaaagaaauuagggcauuuugacauuugaaggcuaaagcaaauugaguuuguuaauccaaauggguguaaagaaacauaacuaacaagaaauauaaacaucaguuacaaaguaagaagcaagcccaagcaccuccuaaagugagaacaaauauaauaauccaagcaauuugguuuguucuuucaacagugugaaauaauaacaagggugauagccaaccugaaauuacuugucuaccaaguuacacuuagaagauuuagaucaucauaauaauaauauucuaagcuacaguguaccuuuucuagauuuacucauggauauguuuuauguuauauggcuuuaaggcugugagucuacagagguauacacagcagucccuaaauuauauucauacaucagauuggggagugggagugaacagggauguuugaagaauucugacucuuggguaauguggagauagcucuuacuccccagauagaauucagucauuauaauuucuccacauuuucuguauguagcauuuauacccagcuguagacucugcuccuauauuuugggacagaguauugcucugucacccaggcuggagugcagucaacugaucuuggcucacugcaaccucugccuccuguguucaagugauucucaugccucagccucccaaguagcugggacuacaggcgugugccgccaagccugcuaauauuuguauuuucaguagagaugggguuucgccauguugcccaggcuaaucuccaacuccuguccucuggugaucguuuggccucggccuccuaaagugcugggauuacagaugugagccaaugagccuggccugcaccauauuuugaaugccccauucacuccagguaucuaucuccauucuacaucauuccuacaucauuuucaucccaaaugccaacauauacuaaugagauuuucaaaaaggaaaaacuuguguauagugauacucuaaauagguaaguuugacauagauucuuaacaaaaguauaaaccagauuauuaacaaugguuuuagugggaucacuaauaccagaauggguuaaucugaaaacagaucuuauuuaacuagcuuccuuuuuuuuuuugaaagaguuucuuggaccaguagauuuggggaugcuagaaacaguaaaucuuuauuucagcaaagcaucuagaaaaccuucaugaacuccauguugguuaugguaugggugcauggacuaaagugcuugaaaaguguugguucauaaaugacuguuaccuuggagaucuauuuuggcagugggcugucugaagauacaggggaaaagaaaccccaaaccuaaguguuuuuuucuguucucuuauucaacaaucaacauagaagacuucuguaagcucugguuaccaagaaguguguaagaauuuccccuaccagcaaucaaccaaucaauccugcagcagacacaagcugggugucuucaauucaauucugaaacuaucuaccuggagauaaugucagauccuacagguugagggcucagucccacaagacuacccugacuucagaugccaaacaaaaaagccccagguggcuuuacuugugcuucuggcugaacaacuagaaauuaggguucccgugacucccuccuugaguuugguuauuuugcuagaccugcucacagaacucagggaaacauguuuaccauuuucuuauaaaggauauuacagaggauacaguugaagagaugcauagggugauuuaugcccucucugggagcaccgccauccaggaaucuccguuuaguuauucauguuccccucucuggaagugcauguaacccauucuuuuuuuuuuuuuuuuuguggaggcuuuauugcguaggcaugauugaucaagucaugggccauuggugaucagcuuaaccagccccggaaguuagaggguggggcugaagguuccaacacacuaaucaugccuugguccuuccuaugaccaguccccauccugaagcuaugcuggagcccccagccaucagccaauucauucaaauacaaaaagauguucaucacuuuggagauuucaaggauuuuaggagcuauaugucuggaaaugggaugaagaccaaauauauauuuuauaauaucacaggccuuuuuaaagcccguucuguguuacuguuucuuacuagacguaaauggagccaaacaaggcauacuuauuaaauuuacaaauguuaaaagugaucacuaguauuuaucugaaauuguguccuaaaacaaacacgauaaaauuuaauaagaauaaaacaaaaaucaagauuuaaauacauagaaguauagacuaugaaagguggaagauacgguuuaauuuaguugaugugaaauagacuuggguguucuguuugaaucuagguagugugugcuugcaucaaagggguggcugaucagcagcuggagaacuggaacucaguucuuggcccacuguauuugaauauuguauucucagugcacaauuuagagaggagaaugaaaaucaaaacacauucaaagcaaggugaauagugugauuauggcagcucacugcuauuugaaaaacacuuaaaagagaauuuuugaagaaauguauuagaucuguugguuacuuaauaguugccccuacuauuucaaggcuugcagugucuauaaagaaugagauucauauuguguuguuccuaggggcagaaccaagaccaguaguaucagggaaguugauuugauguucauaaaugauacaggcuauaguguuaagcagaccugguuguuaauucuggcgucagcauuggcuuuggcaaaaagaaggaaacuucuggguuucauuuuccuaauguguuuaauagguauaauaaggcccaucucauuuuaaggacuaggaauaauguguguaaguugcucaguuccuggcauagguaaauauucaacaaauaaucaugguuauauguaaugauaaaaauagaaauuuacaacauuggaaauguucaaguggauaguggucugguggaaauauuggagagaguauucccacuuaaaauaggggacuggacuuagccguuauaucgauuccaacuuuuagaaugguuugaauguccaccuuggcauguuacgucguuucucccugacugugcuuuuauuugcuucacaaagcaagcaaguccaaucucuuuuaaccaaguuuaauuuauaggcuuucguggacuucuggaagucaacugacuucgaaguuaggacagcauggggggauugggggaguagcuaugacaaugaggaguuuuaagagugagaaaacacaaugucuaugagaacauggacuucucuuuuagaggcuccaugagcuacucagagaggagguuaugaggguugguuaagguacgagaggcacaaagugaaagaagccuccacuacuucaaaccacaucagggcuuuuggcaagagcuacaugaaaaauaggcucacaggcagccuggcgaggcgggucugggcuugcaggcuggcgcuaaggaccggcaguugggagacucucagggacccgauggagggccuugggcaccaccaguuuaccgcauggguuggagagacaaaaaaagaggagagcgacaaaagggggaaaauagguccgaugaucagaggaggaagacgaaggcuggcuggucauuagaugcgucuuguuugccgccaaagggcagggguuacgagcugugcagccagacuggguguugcaacccgagcgcucccuccgcccggggcguccauccucgccgggggcgaagcucuccacacgcucuuugccccuuccugcgccuccuggcugcuagucaguccuguuagggcacuucuggaaaccugcugucgacucgcugccuugguccgacuuugaucgcggccuugauaacuuggcgcagcgccccgucuccuuuccuccggucccucucccgcccacccggccucaccggccacuucgccucaagcgcuggagucgaccagaacucugcggcucggcugccggcaagacccggauagcggauuucgcuccuggcugcggggcgcgcacucgcccgcccgcccgcucgcucguuccucgcgcgggcacugggcaugcgcggcgcgcgguuggcacuggcugcgagcgggcgggcggcuccagacuucacaggcagcagcuagcgaggcggucucgcccggcgcgaggccggcgcugugcucgccucggagaucgcugcucuuuagcugggugcagaaggcggcuccgcggcucgcggacgacuggcugggcgcgaaucagauuggggggcuuucucccgguccccucccaccucgucugggcucgcggcgucuccggggaaagccguggccccgagggcggauccgagguaagagccccuuggcgaaaggcgccggucccgggguccggcggcuuugacuuucucgauuuuaaaaauccgccuuugugugcuggaaucggagcggugccaggagccgcguccgccucccuucacuuugacugcuuucaacugguguuggcagccaggugcgguagggcgcugcggccggaggcguccgcucgccggguccgggcaagcuguggggcccgugcagacccgcgcccagggcuccgggaggcugggcagggaggguucgccguggcccagugauauucaugguaaccugagcuuccgcagauacaccugcgcucaucugguccguggggcgacugcagaccgaguaucccgaucucggcuuauuacguuagacuugggauuugugcgcugcucugccaacccgccucaaauggggagggguucuuuucaaaaugacccuuuagggcagggucccacccccguuuacccccucgaauuaacauagcuaauuguuucggaaucguugucaaugccuaauggcuguugacuuucuuagcuugcuccacuuuacucaccauuuuacuuuugggaagacagacggccuuucuccgguuguggucaguucaugcauuugaaagggguuuccccacccauguacucccugcccucuccgauguucucacucuuacuuuccuuccuaggacuaccuguuugcaaaaucuuugcaccgaccguucuccggcaguguuucucaaauccuccuccucccauagggcccguaguacuguuggaaucucgcggggggcaggacgccgugguuaggauuugaaauccgcagacaucuagagcggugaaggauuaggaauuagaauccuccuuuacaaaauauguuucagugaaauguguuacugcuucucuuuucaagguuucuugccuuagauaguaaggggaauagguaaaagagcuaauauguuaggaugaguucagguaaaacuugauuucagaugugugaagagugugacuuuuuggcuuugucauuuuugggaaauaggagaguuaggauuccgggcaaucuucuuuauauugaaaaagccccucaaaguaacuguguuguguauugccucuaguuuauuuucauugaaaggacuccauucuuccacagcuccuuggguucuggaaagugagcacuaguaauggacgucaugugguagugagucuauuggaauuaaagucaaugucauccugucucaccuaguauagauuuuuuguuugggaucgcaguuuucuaaacauauugcuguaguucuuaaguugcugguguggaaaauuuuuggucacgaauucacacuuuuacuuacaauuugacaguuaaaacaguauagaauugucacauaaaggguaagguagaauguaucacaaaugcaauagugauaauauaaugccuuuauugcagaauacacagauugagacuuuguaagauugcaccacaagucauucacuuuauagcagaaaaaaaagaaggaaaauauaauuugcuuuuaauucuacuauucugagauaaccgcuguuuacaagacuuggugcauucucuuuguaauuuuuuucacuucccaaugucauugaauauuauauaguaauuuccaguaaguguaauuuaacuuauacuguuaguagccccacucuuaauagggugauguuucuuuuguuuccugucaggaaccuaaugucuaauuuugaauauuuugcuuguuugugaucaaacuuaaagauuuauuuuguuuuuauuucuagcuuuuuccugcuuucaagguuuuaucaauacugauucuuuucagauaccaguucuuuucuaugcuauggcauaggcuugcuacucucuacuuuguguuuauuacauuccaaauccuaguuauuuucuuacacucuguuucacacccuuuacccuacugcuuuuuauucuucucucuacucccuucuuuuacauaccucuuuuaauucugcagcaggucacuugaaccaagguuuguauaagaaaacauaguauccagaauaggaaaugauagguuuuuaaaaguugucucuuuaaauacuugaaguucuauuggaugaauauuuuaacacugauuuauguaauauuuauauacaacucagcuuuccugaguugugugaaacauacuugguaguuacacggaucaucacaaaacaacauaaguuaaugauaagguacaaacuuuuggacaucuguagagguaugucgggggaaaaaguggaauuuuaauuaaaguauucuggcuauaguaaaucccuccugggaauuauuaauacuacaugaaauuguuugcagcuguuagugauugaaaauauuuuuguaagaaaaauucugcauuggaauaguugcaaacauuuuaaguugaauauaugcaagaaaguuuaagggucuucagugcuucacuacaaccuuuucaguauuuucuagauguauuccuaaaugggauuuaaaaaaauagaccuuauuucucagaaguuuuggauuuacaggaaagcuacaaauacggugucuauauacccccauaccagcuuccccucuuauuaacaucuuguauuauugguauuuguuacuauuaaugaaccaguaucaguacauuaguauuaacaaaguuuauacuuuauuuagauuuccuuaguuuuuaauguccuuuuucuguuccaggacccuaccauccaggacaccacuaaauguauuuccucguaaugucucccuaggcuccucuuggcugugacaguuuguuagacuuccuuguuuuugaugauguuugaggaguacuggucagguauuuuguagaauacauuugcauuggaauucaucuaauguuuuuucucaugauuagacugugauuauagguuuuugguagaaagaucacagagguaacgugccauuuucaucucauaucaaggguauauacuaucaguaugauuugucacugugauacucaucuuuaucaccuggcugagauaguguuuaucagauuuuuccacuuuucuccaccuuuuucaugcugugcucuuagaaggaaggaacuguguauagccuauacuuaaggaguagagaguuaugcuucccccuuugaugguagaaaucuauauaaauuauuuggauauuuuucuccgugggagauuugucucuucucccccauguauuuauuuacucaaucauauuuauuuuguucuggacucauggauauauauauauuauauaaauauaaaaucuaucuaucuaucuaaauauuuuggguuauaauacaaugcuacuuuguuacagcuugacuccagugccucuuugacauacuaccaucaaugugaauuuuguuuuuuuggaagcauuuccuuacuuucugguauuaugagaugcucuagguucaucuguauacaucuugccacaguccuagaaucagucauuucuccaaggaaucuggaucauuuuguuggggaaugguguuagaaaccaagaucugggugcuaggugugcuuguugcuacugugguaucauugcuucuagguucucucaugugacaaagcaagaaauacauguguguauaugaacauaucuguacauauuuuuauguaacaguuuguauccauguuuaacuaugaauuuacauuuuaucuguaaugcuaauucauuaccacagguaucauucuagccuucucccuuuguuuauauguaaacuuacuccaacagugagaagaaaccugguuugcaccaucugccauacauuugcuuaaucauucauuucuaucauagauguauagcagcauuggaauuguuaaccugugcucccaugggaaacaacuuuagcaucaagaguacaguguuuauguacuauuccuuuugcuuuuagucucacagcuucuacucauuucuagaguuagucagcuaagcaccuuuccuccuauccuuuucagugagauuguagcacacauuuauaauacaguuagauuucuuuguuacaaucugcauuccaccuugggauuccuugaccuucuaaaugauuugcuuacguuugcauacauuaaaguuuacucuuuguccugugaaguucuuuggguuuugacaaauacuuaauuugauguagcuauccuuauaggaucauaguaucauaccgaauaauuucaacacauuacaaauccccugggcuucacucauaaccucugugagccccucucccagaaaaccacguaucuuuuuacugucucuuuacuuuugccuuuuccagauguuguauaauuggaaucauacagccuugccagacuggcuucuuucauuuagcaauacacauuuaagguucauccaugucuuccugagguuuaauagcucauuucuuucuaucauuaucagauauaucaugguuuguuuauucaccuauugaaggauauuuugguugcuuccaguuuuuggcaaguaugaacgaagcugcuaugaauauucacaugcagguuuuuggguagacauaaguucuuauauccguuggauaaauaucuagaagugcgauugcuggauccugugguaagauuaugguuagcuuuguaagaaauugccaaacuguuuuccgaaguggcuguacuauuacauucucaccagcaaugaaugugaguucuuauugccccacaucuuugcuagcauuugauuuugucagcuuuuuuggauuuuacccauucuaguagguguguaguaauaugucauuguuacuuuaauuuacuauuuccuaaugacauaugauguuaacaucuuuucacauaccccuuuucaucuguacaucuucuguggugugauggcuguucagaucauuugcccacuuuuuaaugggguuguuuucuuauuguugauuuuaagaguucuuuauacauuuuguauacaggcacuuuaucagauauguguuuugcaaauauuuucucccaguuugguuugucuuuuuauuuuccuaacagugucuuugucagaacagaugucuuuaauuuuaauaaggccaacuuaccaauuucauggauaggcuuuuguguuauauuugaaaacucauugccaaggcuacauagauuuuauccuguguuuuuccuagaaguuuuauaguuuugcauuuuacauuuagguaugugauccauuuagaguuaauuuuuaugaaagguauaaggucugugucuagauuaauuuuuuuuuugcauauggauuccuaguuguaccagcacaaguaaaugugauuuuuaaauuaauagauuauaaauugcuuagaauugaaaauguuuuuauuaaaauuuuuauuacauguucugcaaaauuacuuacuguaaacaguugagaaaugacuuagaaaccaauauauaauacagcauguacugugugcugagauuuauuucuagacauuguacauaauucauuuuccucuuuuuuuuuuuuuuuuuuuuacuaacucagagaugcuucuuugugaaaauggaauuguuaguauagaguaacaucugucaguucuuuuagaucuuaucauagggaauaauaguuugauuuuucacaaaaaggaucuggaauaaaggauuugcaggguguauguugagaagaggcaguugauguaugcaccagcuagaaaucugagacuuaacuauguggucuugaaucuuuucccaugcuauucuuccugcuacaagugacuuuuuucaaguacaguugacccuucaauagugcagcgguuagacucacugaccccugcacagucagaaauuuuuguauaauuuuugacuucccaaaaacuuaacuaguaacccuucuguugacuggaagccuuacugauaacacagucuguuaacacacauuuuguauauuauauguauauuacauuguauucuuacaauaaacuacagaaaagaaaauuuuauuaggaaaaccauaagggagagaaaauccaguacuguauuguacuuauugauauuguaaguuuuuguuugcuuaccagaugacuccucuuucugaaaaggugggggaauggaggggcagggcugggaacugcagcugcagaccucaaucuaugguacauaccaagcaauucaacuuuaucucucauaaugucaugacuuuucucuguuucuugggagcauuucuggcaucucuaguggcacguuuucauucaagguuuaugguauuguaccaaacaggaugaaaaauacaagagaacaccaagaaaucauuuuuuacugugauacacaauuuaccggagagaugaacugcucacgcagagaugauuaacaucacacaguggacuaagcgguuacucacaacacuugagcucgcugcaauaacaacaggagguggcuaugaaauuauuacaguaguacaguauguacuacaguuaauuguaugcaguuaggacuuaauacugcaucuuuacauuuguuuacauuucucuugaccgcgaaugauacuauguaucguguguguguaaguuuugauaaauuuuaauuuuuucuaauaaauuuuaugguuacuaccauaaaaugauaaaguagacuaguauuuauauacauauuaugcauucaugacauaccuaacuuuuuucuuaauguuuuuguuauccuggcuacgugguuugucuguguuuuuauuguauuuauuuauuuaaaaaaauuuuuugagacagagucucacugucacccaggcuggagugcaguggcgccaucuugggccuacugcagccucaaccacccaggcccaggugauccuccccauucagccuucugaauagcuggaaccauaggcauguaucaccaggccuggcuaauuuauuuuuauuuuuauuuuuugcagagacaggaucucucuguguuguccaggaugguuuugaacucccaggcacaagcaguucuuccaaguuggccucccaaagugcugguauuacaggcaugagccaccacacccagcccgaguguuuuuaaauugucacaaaucuccaaaaauuuuuccaaauauauuuauugaaaaaaaucuguguauaaguggacccauguaguucaaaccuggcuuuucaaaagucaaauguaccucucuuuugguauacauuuuguguuauugauauugugauguacuauaguuuacauauuuguccucuccaaaacucauguugaaauuucauccucaaugugagaguguugagaggugaggccuuuaagaagugauugauccauucaugaauuaauggauuaagggguuaucaugggagugggacugguggcuuuguaagaaaaggaagagagacuugagugagcacaugagcacacucagcccccuugcccugugaugcucucuguuguccugggauucuuggagaguccccaccagcaaggaggcucuuagcagauguagccccucgaccauggacuucuuaaccuccauaacuguaagacauaaauuccuuuucuuuagaauuacccauuucagguauucuguuauaagcaacagaaaacagaguaggacaggauuagaaauauuuauaauguugcacuaaaguuagaaccaguagucuucaagaagcagguggagcagcucacauaauaauaguaccuuuuguguggcagguguuacauacauuaucuucuuucacuguuacaagagcccuuuaaggcaugcuucuuuaucucagaauuacagauaaaggaauaggcccagaaagaaaaagugacuugugucacacauggggagaaagggaccgaauugggaugagaacccugaccugacuccaaaauccaugcccuuuccacuugguugugcugcccuuauuaaagaaaaagggcaaggauggccagaguguccuuaauuacauucuuuuauuuaauacugugcuauauacuugcucaaauuacuacugugccaaacaagaauagcgaaaaaguuuguguauuuaagcuccacaaagauucuucuagcuuuguuuucuguugacucaucuguauccuacugaccagagguauguggugauggaacacgguuguuuuaaagaaugaggaucuuuuaaaaagaaacauuuguggggaauuagacaaaauaaagcaaauaaugguagcauuagcuaguuauuucuuucuuucccucauuguauuuaaagcuucucaagggcagggaacugagucaguuaaguucccugauguauuuaaggccaacauaugaccauaugugucagccauaugacacacucacaaaaggcuugcugaaugaaauuagcacuuauuaucauauuuuuacauaaauacuuaaaagggcaugaguuuuccucacauaggaaguugagcauuacuacauuucauuuguuuauucauucaucuuuuaucgaguguuuguugaguaucuguucugugccagacaccaggaauacaaagaugaguaagacaggaucucugccuuuuguugucagaaggcucagagaauggaggcagccagacacccguuuuaguacaguguggagcugaaggaaguauauauuaaaaaacaaacaaacaauggacuuuggaaucagaccuuaucugccuugguuuucuuaucaaagagguggaaaugucaaguagguacuauuauccauggaggauguuaaaugaaaaguguguaugccuguguguguguguguguguguguguguguguguguguguguguguguguuuaucccagcacauagcagaaaggagagccucacuguggccgagggagucagaaaagucuuuacuggggaaggugauguuugagucucauagaaugaauuuuugaggcaaagcgagacgcucaucucucuccagguagaaagaugagcauguuugacaugugcggaauagguuggcaugaugggaguggugggaaauucugcacauucccacauucagagcuuacgggaguauuagaaagaacugaaugagcaguuauuuuucauuuuuguaaguaacaauacaauagaguauucauuacauuguagcagaagagaauaaagauaccaaaccuguuuaagaauugcauaaaucuucucuucuagucacauggccuucuaaauguagcucuuuauguagcaaacaaauucauguguucuuuuucaguccugugauacucaagugauuauauggaauuuaagaaagagaacuugcauguuuuugggugaaauuggagguccuguuucaaaccauucuuacauuuaguagcauagcaacaaaagaauguaauaaucuaugaagccagaucuaguccuguuuaagccugucuaaaauucuaagccauaguuucugaacagaaccugaaacauacuauuuaggaauguacuaaaaaauaacuuguuaaaugaauuaugugcuugauaagagaucagaguucuauaauugaaaaauuguguuuuuaauauaaggggagaagaaaaagagaaagaaaaaauagugagaaaaaagauugauagaaggaagagaaguuuguacuuaaaugagggagaaacauuuuucaagucccuuauugagggcuguugaauuaucuucuguuaacaccauuagaauauuacuaaguuauuccuuauuauagaaauacauguauauuauugagauauuuguugguuuaaugcaacaauagaauguuuccaguaucugaaguggaaaaacaaagcugcaaauaaaaauauguguaaaaucugucucuuuugagaagacauugauuacaguuuaucuaauuuucugcaauaauuuugacauuuaaaguugaugguaauuuuagaccugaauguacaauaagaugauuuuaagugcucuuuuagaauuuaaagaaagauauacuuuugaugauagagauagaagauacuuuuaacugcuuugcuagugaaaagucuguuacauuuugcugggcaagguggcucacgccuguaaucccagcauuuugggaagccgaggcaggcggaucaccugaguuugggaguucgagaccagccugacaaacauagagacgcccugucucuacuaaaaauacaaaauuagccgggcuuggaggcacauaccuguaaucccagcuacucgggaggcugaggcaggagaauugcuugaacccgggaggcaggagguuguggugagccaagauggcgccauugcacuccagccugggcaacaagagugaaacuccaucucaaaaagaaagaaagaaagaaagaaaaagucuguuacauuuuaaaaucuugguuugccuucuuuuuuggggacuuggauuucuugaaauuaauuuugugaguaacuugguaaauugaugacuuauuuucugccugggcaugcaaacucugcauuugauaguuucuuucauauauggaagaaaugaaaacacuaccuuuaaguagauuuacuaccuuuauuccccccauaaaggcaugaacagcuuguuuauguuuauaugcaugcguacauaaucuccaauuucucuuugcaguguguuuucaaaacuucaacuguuuuaugacaaacuauauguguuugggaguuuacaaauauuauucuuuaauccaggaaugugaauuuuugaaacccuaucuucagauugaguuguccuuacuguuuuaguguuuaucuguauucucagaaccucuguugcguggucuguuuucaaaaaaguacuguguaccauaaacuacaguguuuuuguuuuguuuuuugcacaucaagauccuuuuagucgagagaacauuaauuuugucaguaguucuuuuauuuagcuccuuuguggggccuuguuagauucugaauaauuuaauagcaauggaauccuuucugugauaaaaaucuggucauugguccaauacuuguagcauuauucacaugauacucaugcaugcaaaggugugggauuaaugcguaugccugaagagugugugucagaguguuuuuaaucauuguugaaaaucacccucugaagauuuucgugugcauuaauucucagauuugcuuaaaguauuaucacuucuauuuuaaaaugaauaauccaugguggccuagccugaacaauaauauguaagaaaaauuggaaaaauuauaacuuccuuuaaauuuaggaauaaggucuauauuuuuuguauauuuguauguuugcuauguuugcagaauuacagaauaaauuguuuaaagcauauuucuuucuauguuauuuuaauuuuuuuacauuucuuacccaaacuguugaaacaaaaaguuucagucccaguuaguacaacauccauaaacuuuguccacauuucacauuuucagcuuuaucuuaagacuggcuacuuuccauggucuugucaagaaaauagucuuuuacaacucuugaagcagauaaauaaccaugugggcuuuccuucaucacccccuuucccaacucuuuuccuccucccagcuguucccccuccuuuugcucguuucugacacccuuuuucaauccucagauggcuuuaauagaaaaguauauuuuucauaacuuugauagcuuuccaauuacuauucuaacucuuucucacugccuggugagaucucagucauggagagagaagucugaauaaaagagacauucauagugguuaugacagugaagguuaaguuuaggcugcuaggggguuugaaacaaaggagggauugaagccuucaucgccuuuaccuuauuuggguacuaaguaagugauuuuggaaauaguaaaaucucauuaugaaaagagugaaaucuaguccggaauaaauguguuaacagugcuuaacuuuaacuggaaugcaucuuaacaccauucaguuuuuauacugauuagaaagguccacugugguuuuggucauauauuagaacauaugcuguugguuuuuuguuuuguuuuguguguguguguguguuuuuuuucauucugcuuuguaaguaccccuuaucacuguagggaauuuuagaauuugaauuaaaauauaucuugaguuauauaauguaaaaaaaaaauuuauauaggcuacuccauggcauuguaaagaaucuuaaaauagauauaaaagugacuucaucuuaccuccaauguccuuccuccaucuauaucuguuaucucuagcuauuuucaucuuuucucucugccaggcaguuaguagaauaguugaagaaugauuuuaucagcucucauuggacuacaggauaaaagaccuaaaaauaugggauaauuuaauccaauggcuagcaaauacauuuuguguuauguuuaugguuuucaaaggcauugauaaaaucaaacuaucauuacugggaaauaugaaauuuucaauaagauuccaaacuaauagauaaagugauaaaaugauugggaaaacaaguggugguagaaucugauauaaaaauaguuuggcgguagcaaaaggggaaacgcuaaaauucucaagaacccaucagccauuuuuacuaacacugugcucuucauaagcuauaucuagggaacuuugauuauaugcuguaaggaacaauauauuauuuaaguguauauugaauaaguauucaauaaauaacugcaaaauaaaagacaguucugaauguggaaauuccuauucuugcgagauugagccagacauuucuagcuaacauugacguuauugggcuaacgugggcaucauuuggguuuuggguauuagguguaacaaaugcuugcugaugcauagaggccaaucuaggucuguguuaguuccugagagugugcaugugaacuugaggggaagguuuuuagaguaggucacucaccuaagccagcuguuuuuuucucucuuccaaaagaguaccggauugcuccuuugcaggggcugacuugagaacauggcuuaacuuuuaaggcuagauaaacuaguucagccagaaguguauuauuuccccccaaaauuacauuuaaaagcuucuagcuaugaucauuucagcugcuucuuccucccuuucuaauuauucuugcuauuucuguuacugauaucaaccauaccaaucacuggaaaggagaauacuugggcaaaaauuucuuuuaaaagaaaaauugcuggagagaaauauguacacaaauuuauauugaauauauaauaaaauacauauggaacugcccuuuguaugugaaggugaguuuuguuuguuguaguggugucagaucugguuugauucauuucagcuuuuuccaguguucuuucuugugauacgcauauaugagauaggaauuuugcuaaaucauuagcaggcccauuggcuuaauguaacccaaucuaguuucuugaucuaacaguccuggaauauacaacuuuaccuaauagaaaauaauuuuguuucaguuaaugaaauuuaucugucaauaaagaaauauuaaauaagugccuauuaagugcuaguacuaaauaaugagaauacucuaauugacaagauagacaacauucuuauccuuguggacugcgugauguuagacaccuaaaugaaaagaagcauaaaaacuuaacagaagcaucagguucuagguaagggcucaaaaaucuggaaaauaaaggcuaaucuuuuuugcuuuucucgcccucuuuccuuaauauagauucacauuuuuuccuauucaaauguaaugauauucacauuuuguauuguuuuucuacauauacugguacuguggauuuauaaaauaagucuauuuccaaauuacauguauuuuacaaugauuccacaaaggaacguuggcuauuuaugagcuuuggggaaaauuacaguauaucaguacucccuuugaaagauuuuaaacuauuaaggucaauuuaagaucagaccagacaagugugguuugugucauuuuuauauacgguauucaguauuuuuuccugcaagcuuuugggagugaagaagccauuauucauaaaaugaauucauauguaacaccuuaggcugaucguaaaguguuaaaccuuagagauggggaaaauucuauugucuugaauuuugaauguggguaacuuuaagacugccauaugaauugccaaguugcaaaauuguuuuugcauuucacuugcaagcaaggaaaauguggacuccuucuuuaguggggccaagcgcauucuaacacaccucucaaauuacacaccacugaaaugauacucacaauggguuuggcucauauguuucuaguuagcuacuaugaaugaaagauucauaacuaucuguuucaaaaaacuuccuuauuugcacugcagggagcuuaauuguuugguagcagggucaagaauugcuuuuaaauacuaagcaugcauggauugggccauuauacacugaacuaaaaaaaagauuucugugcacaaagaaggcuuuagauaaauauuugucaaaucauugauuacuuuguuggcuguggaagaauaaaagucccugaguuuucccacccuguugguaauuuggaccaaauauuuuggucacuauuuuuuauauauauauauauuuauauauuuauauguuuaaaauauauauauguguguauauauauuuuauauguauguauguauauuuauauuuauauauguauauauauuuuauauguguacauauauauuuauauguguauauauauauauauguauauguauaacaaaccuguaaccuuucccuuaccuugccuauugagcauuguagaauacaggauaacagggaggaagaagucauucauacuuacuagacagaugguuggcgucccuguggcaaccuugugaucuaauaauuuuccaaguucugucuaccuaacugaagaguaauagcuguuuacuguuugcuuaaauaacacuaggccuguaugcaaguugcaggggggguggggugaaggagggggguagauauauaaauucaucucugcaguuuuaucaaaucuguaaaagagguguagcauacaggcaccucuuuuccaaaagaaaaaauucauuaguuccucauuuugguuauuccuucuuauucguggcucaagcaaaccauuaccagagaaucuuuuuuuuuuaauugaugacacgcuaaaaauuaguuauuuuugaagaauuuuuuucaaagguaguauuugaauauauugguaaaagaugguggaauuauuuuccugcuuuucugcaguaaauuaguuuguacacuucuggugacauuugcucgacuauccaaagaagaugaggcuguuaaagaaauuuuaacaaauauuuaugaaugcaugaaauugauuauguuuauuaaagucacaaaaaauuucuagccuuuauuauaaauuuuauaaauugcuacugcaaaaaugagagagaauuauaguuaccaaugugaauuacuuuuguuuggucagacauugacuuccccugauugccaccuugucacucuguuuacuagacacagauaggaacuucuuucuucuuccuaugauaugcauuugauucaugucauaugcugucaaaauaauguuguccugagauuauuugcuggaaugauaaaacugaugcagacuaugucagcuagacuuguuaauaucacauuauucuuucuaauaaguacuuguacuuagaauacuuacuugcuucugcugcaucaugucucucuucuuauccccaaugcuuuuuuuuuuucuuaaaucucucuccauagucucuugaaggggcugauaaacacaguucuaaaauauuucauguaucuaucucccuuuaacacauaauuugguccugugcauauguuuaauaccaggguauccccauucauuuccuccuucuucugaggaugauugaaauuuuguggcuucaugauugccuucuaauuuucaacuugacuuaaaccagagcauaguaaaagaaccauuaauaaucacaauuaauaacauuagaauguaauuuuaauaauucaggccucuauugcaaaauguauuauggagucaguuuaaaaugugauucuucucucucuuauauguaccuauguccaaguguguauauaguaagcucuuggaguucaggugugucuuggugagguauucugcauauauggaacauagucucuuaacauccuuuugcugcugccuuauuucugucuuguuuccaccuaagauucuugaagagaagcuuaaugucuaugguuuccucuucacuucuccuacaucagcgagcccacuguggucugaugcugagcuuaugucuguaggucaucugccaucuucuaaaagcuaaaccaaaaggaaaauguuuaguuuuuacuugauuuugcuguagcauuuaccuguaaacucuuugaggacauaaacugugucucguucacuaugaauuuuuaccauuuaggguuucugguacuuuguagacccgucuauuugcugaaugaauguauguuuguaaugauuuuugccuucuuuuaaauaaaaagaauauucucuuccuuuggcuccugugguggugcuguucuuuccugguuaacaucuaccucugcuuuguuacccaucuacacuuagauguugauucagaagcucugcuacuugggauggaauagguauccaaaauucuuccuaagugaaacucucaaguaaguucuagcaccaucuguuggcagcagugagagccaaugcuuuauuuauuuauuuauuuauuuugugccucaguucaugguuuuguguauucucagaacacucacaaguugaaaaguuucuggauuuucuggaauuauuuucuuagccuucaucucauuucauguuacagccuaaguuucauucucuuucuagggaaccucaguguuucguuuagaacaguuacucucaguucuucaggugaugccuuucuugggaacucuaacucuauuuaugacugaagcugaauaucacacaggccccucagacuucacauuucccaaaauuaauuucuugcuuuuacucuggcccccucaucucuuucugucucucuacuuggagugacuuuuauccaaaugacaaccuuagaaaucugaauuuuuccuggacucuuuuucuuacccaccuuucugccccaccuauaugucaacagucauuaaaucuuuuugagucagcaaauggcugauagagcacucuccucuuccgucucucacugcuaaucauguuaacuaccuugcuuaaaacucuucagugguuccccauaugcucauuagggugguacaaaugaagacuacgggcgcccgccacuaugcccugcuaauuuuuuguauuuuuaguagagacgggguuucaccgcauuagccaggauggucucgaucuccugaccucgugauccacccaccucggccucccaaagugcugugauuacaggcaugagccaccgcccccggccuuccccuuucuuuuguauugaaauuagcucucaauacugccacaaagaauucuuuguaaugaguuagccacaaaaauaguucaguucuaggaagaauuucuuuucuuuuucuuuucuuuuuuuuuuuaagagacagucuuguucuguuacccaggcuggagugcagugcaauccuacggagaauuucuagcccauuagaagaacacauccaugaccccccuucuccuuuaccugccauaugcaacugauugccagauuuugcugcuuucacauuaaaguuaacccucgccuuugccccuucuguucaguuuuucacuguuucaaggcuauaugaccauuuucuuaagcuauucccuccugaaugucucuguaucugccucuguccuacuucaauucauguuaauuacuacuuucagaucagucuugcuaaagcugaguucagaugaugucaguccauugcuuuaaaaacugcuaacaaagguuuccuuuucaggcuuuucacaaccuggugacuuucuuuaauuuuagccucacuacccgcuuuccuauaaauuacucauuagccaaagugagguacuauacacuuucaucuguauacuucaguuuucccagucugugcuucagugucccucuugucuauauuuggaauaacuuuuuaauuuaucucuauauacaaaucgaauccaucaguuaaggucuacuuuaucugccauuguagaauaaucuaccuucuuugguaccucucccacuuaauauuuuuuuucucaggaucgccuaggcacuuauuuucuuucgugaacuguaauuuauauacauguguguuaccugauaccagguaucaagcuccucuaagguaggcuccauaucugauuuuuacuuuuggacaggccuuaaagccuggaguggugcuuuugugugauagacgcucaauguguauugguuaaaugaugaaauaaaugaauuuuuucuugcaucuuucaucaugagauuugugccaguaacaucccaacucucaauaugaaaaggaaaaaaauacugaccacaguuuuuacugagccuaaauugaaauauucugaaaaagcuuaaucauggugacaaucagaauguacucuguuauuuaggauaaacccuucuggcaaacaugccuguuuuucagguucccauucuuuuaaaugugggcuaugauuaugcucuuuaacaucucacagauuuaauaaguaaaccauuguuuuaaaguauuauaacuuuuuccacaaaaaacugagcucuuagaauaaaaagccaacaaagaugauauuuuuucagucugacucuuuucuauccuuuccccucauuagagcacaauuuucaagauuuuuguauuaugaguaagacagugagagcuuuuugauauuucaugaacuaaacccaaaagggccuacaaaaacacgcuuuagcacauuguuuuuaccaaauccuacuguaauuauaaauauuuuuaauaguaugaauaauguuauuuuuucccuuccuuucuuuuucccuuucccuucuucuucuuuuuuuuuuuuuuuugagacagggucucgcucugucaugcaggcuggagugcaguggugugaucauagcucacugcagccucgagcuccuaggcucaagugauccuuaagucauggguggguggaucacuugaguccaggaguuugagaccaaugugggcaacaugacaaaacccuaucucuacaaaaaauacagaaauuagccaugguggcaugugccuguagucccagcuacuugagaggcugauaugagaggauuacuugagccugggaguuugaggcugcaaugagccaagaucaugccacuacacugcagcaugggugaaagagcgagacccuagucucaaaaaagaaaaaaaaaaaccuaauuaaaaaaacaugaaaauuacaaauaauuguggcacuggaacuauuuuggguauuauucaacugcuaagaauaaaaucagcauaacugcagaauacaucugagaaauaauaaaacaugacuuuggucagaaaguucaggaaauuuuuguacuguguccaauuuauuuugcucugugaucagauucucgugaaugcuaguguuagacaaaagacugaaaauagaguuacuauauagagauguucauuguuuggggagaaauucaauagagucuugaauauucucgugaugugcagaauaauuauauagagauuauuuuaaaucauaaauacaucuuauaucuuaacaucuuaaauguuuugcuuuccagauauacucaagauauuucugugaaaauguuuuuucuuaauauuugccaacaagagcgucuuauauuuguguaauuuuuccaaaguugaguaauaacuguaaugcuaguuugcuuauuuuucauaaaacucugagugauuuucuuuaauauauccuugaaaaugcauuuuucauuuauuuuuucuuauucuuguuguauguauauaucaaguguggcauuuauuuugagagucuugauaaaauuggcaaaaguagaguuacaauuuuauguuaauaaugaaagaaugacauauaauauuugccugauuguaucucuuauuuuuugugugcuuuuuguuaagcauaugucaauuuauuuugccaacauuauucuauagacagagaacuccuguuuuuuucuuucagguuaguucaugugauccugguuaauggaacauaaagugagauuuuaugggugacagggagagagaugaggcuugacuugggggcauaugggaaaagaagggggcugucuguucacaaagauuuaaauaucugauaagaacuguuugccagcgcaauuaugaauaaguguauuugugccuaauuuuuauuuuuuaaaagcucaggugauuauaauuucaucuguaaaauguugaaaguauagucugauuaaaauaauauauaagaaaugguuuugguucuuuuugaaucaaaagguguguaaaccuggagaaucugcagagugccagaccucugcuuuugucuuuucuuaguauuguaucauguuuuccuugauauuaaucuuaagaugacuucauauaugucaauauuguuuaauguuagccauccaccuauuugggauaggaaaaaaaguuuuucccuguguagauuuguguggauugccgaaucacuacuauguuggagggagauuauuuugcuugagaguaauauugaaaaagcuccuauuuucucccuucaaaaaaacuggcuucugaaaauuccgugacuuaauguaucaagaacccaacuccucaagugauguucuuauuaauuaauauuuaguaaauacuacacacccaacuuaggguaauuuguuggggaacuuaucucacuaccucugcucuuaaaauucuuuuuuuuuuuuuuuuuuuuuuuuuugagauggagucucuugcaggcuagagugcaguggcguaaucucagcucacugcaaccucugccucuugguuucaagugacucuccugccucagccucucgaguagcugggauuacaggugcccgccaccacgcccggcuaauuuuuguauuuuuaguagagaaaggguuucaccauaucggccaggcuggucuugaacuccugaccucgugauccacccgccuuggccucccaaagugcugggauuacaaacgugagccaccgugcccagccuuaaaauucuuaaaucucauuucccuccuuuuauuauuauucaauaguuaacuguauaagccagaacaguuuuuuuaaaaauuggauaucucccagauuucuuccaacucuaauauucuguaagucuuugguuuuuacuuagguuaauucuuaacugcaauggaagaaaagcauaauuccaguuucuaagguaauacuuaacauuucuuuacauuauucuaaauugaauggaaaacuuuauuuguaaaauaacaaccaaaaauaucuauuuuauucucuggggaaagacaacuuuguaauauauuuuuccacuugaaauguuuuugcuuugcaaaauccuguugggaaaacagauuuccagacagcuuaaaacugacaaaugaguauuuugacagguauuccuggaaggagagcuguugccaccaaccauuucaauuuccuuauucuaacaaccauguuuagcagagaagaagacauaucucaguuugaaacaaauauuuaguguugagagaggugggugaauauaagccuuuuuuaauguauuggaaaaauagggcauuuaguucacuguuuuggaaaauagaguaacaaugaggauaauaaaguacuucuuuauggccuaagacugaccugauacugucaacuuccuguguuccauucaguaggguguuccuagaggaggguuucauuuuaugccacugugucauuuaacggcuuuuuucugugugcaaccuguuguggcuuuagaauagaaagcgucaagauaaaacauuucauagcagaaacauuuuucugcauaaaauuccacuggugaacaguaguuacuagaccuuaguagaacuagucugcuucuguagaaauaauuugugaaaaugguagggaugaacucuguuguucuguccauauuuaauuuaccuuccaauuuguaaacuucuuauuaacauugauauauuuugaacaauauuauuuagauuuccuucaccauacaguuauuuuuugaguagaauauuagaaguagucaugcaaucucuuguucuuaggugcuauuugccaggcccacacacauuguuaguugcugucauuauuugucuccaucaucauucucaccaccaccaucaucauugucaucauauauauauauuuaaacaucagagauggcuauuugacuggcuuguggaauuugugaaaagcauaaaucugagaaucuuaaaaugugagaccugcuguuuaaagauagagcaaauguaguuauggauacuuauagaauuuagacuaauuccuuuugguaguaaugacugagugauuuuggcuuauuucaaagaaucgaguuagacauauguuugaaugaccccauagagucuuacuuuauaugcuuaagccuggaugaaaaucaauuucauuuagcuuuaacucggauaaggguuucauggucauuauuauauucuuuuuuucuuaaaacuuuccuuuuuuuuuuuuuuggagacagaguuucacucuuguugcccaggcuggagugcaauggcacgaucucugcucacugcaaccucugccuccuggguucaggcaauucuccugccucagccucccaaguagcugggauuacaggagccccacauuagcucccaauguccagcuaauauuuuguauuuuuuuuuuuuuuugagauggagucucgcucugucaccaggcuggagugcaguggcgcaaucucggcucggcucacugcaaccuucgccuccuggguucaagugauucuccugccuuagccucccaaguagcugggacuacaggugcccaccaccaggcccagcuauuuuuuauuuguauuuuuuuguauuuuuuaguagagacgggguuucaccauguuggccaggauggucugaaacuccugaccucaggugauccacccgccucgaccucccagagugcugggauuacaggugugagccacugcgccaggccaaaacuuccuuucuuucuuucuuuuuuuaaacacuaaaacaaacugcugaagaguauuuuuuuucucuguuaaaacuuuuaggccgguugcagguggcucacgccuauaaucccagcacuuugggaggccgaggcaggcggaucaucaggucaggaguuugagaccagccugaccaacauggugaaacccugucucuacuaaaaauacaaaaacauuagcuggguaugguggcacgcgccuguaaucccagcuacucaggaggcugaggcaggagaaucgcuugaaccugggaggcagagguugcagugagccgagauugcgccacuguacuccagccugggcgacagagcaagacuccgucucaaaaaaaaaaaaaaccaaaaaaaaaaaaccacuuuucuccaaaaguagauaugugucaaaaaccaaaauacuguugccuuuuacaagacuuuuguaauuccuuuaacucccugcagacauuuugaaaaucacuucuuuguaacacuaauuuacuacaguuuacuuuucugaagaaaucucucuccaguuucuguuggccauuuuuuauuuaguucuucucuacccccaauaauuucaguaucucauuuucuuuuaauaauuaaaacaauuuuuuuuucuuacugaaagcuacugaaggguacaguuucuugauccuuucuucucucuuucugggugcaucuguuauuguuuuuuuccuguauuuauuuauuuuugcccucagcaagggacuauuuuucaaacucuuuaacaucugauugcuguaagaucuguuggaguagcauguaaaagucaccaguugauauggguagaaauacaaguauggaauugugcacccaugacccuugguaguauuuauacaugagacuuuuacuuguagucuacaguuuauuguauucaaauaacuuauaaagugaaggaaucacuacuaggcaucacuuuuugggauaaaggcuuauuuuguuucauuuagguacuuuuuucagguucuuuuguuaaagucugccuggugugaguuuugauuugcaaacugaaaaagcuuuaaaaugcuaaaaauuggcucugcuccuuuuuguuuggauuucucugggaauucuaaguuggcuaugaccucauaacuucaagggcuucuaaggucaauuauaaccugauagauaucauuaaacaaggauuaaucucaguuuauagaaaaauucugacuuucaauauaaaauaauucaauggaaaaugauuaauggucuucuguuuuuggagagugauauuguacuugacauugauaauguuuaguuuuaaugguuguagauacuacuuguuuuuuuauugaauuacuuguauuagaucuucauuccccagaaaguaugagaccugauguucuuaucucaagaugagagcuuaaaggaagaagaggucaagguuuuauuuaaauugucuuagcugaaccuuucccuuucccuaagaucuagcaccucagaauugcugacgucagacauaguuauugacugaaaagaguuaaauugauaaaguauaauuucuggcuucagagguucagacauuacuuuaucugguugaaguuucaucaagcccugaaaauaaaaucuuuagguuguauagucauagauuuagagagagaaaaguucuucaaaggccuguugguuuuacaguuuacauaaaaucaguccucgguucugguaaccuuugucugauauuuugccucucuccugcugauccuggaauauuucuuaauuugccuggaaccuuguggacuugaacagauugucucuugacuugucauucagcuccuucuaacuugacugauugauaugguuucacuguguccccacccaaagcucaucuugaauuguagcuugcauaauucccaugugucaugagagggacccggugggagguaacugaaucaugggggugggucuuucccguggugcuguucuugugacagugaauaagucucacgagaucugaugguuuuauaaaggggaguuccccugcauaugcucucuugccugcuaccauguaagauguuacuuugcuccuccuucaccuuuggacaugauuaugaggccucccuagccauguggaacugugaguccauuaaaccucuuuuccuuuauaaauuagucucagguaugucuauuauuagugugagaauauacuaauacacugauagaauauuuuucaaauuccagcuuugugugaauaccaugccgaauauuguugugaaugaaaaacuagucauaguuuucauaauagcaagaaaucuacuugagagguaauuaauuuuuguauaccuuuguaaaaaaguauggggacauaaauagggguagaggcauuggauuauguauguucugugugugaaaucauucuggaauuugugauuuugaugucuagaguacaacacuggcuaugguaugggaaggcuacauaaaaauuucauaaacaggauggagaaagaagagugccaugcagcgugugcauauauagccuugggaguuuaguuuuuuucuaauuuuaucaucuagaugagagcagcauacuuuucuuuauaaauacuguuuaaaguugagaaucucugagucuuuuccauuaaggaacagaggccccuuguugugaagcuggcacagucacuggugcaggaugguaaauugccuugcugucaacucuccucugccucuuauuuuguugccucaaacauacauuguuggaagacuaaggcaaugaucaggcucuuucuguguucucugauuaguguacuuucuccauuuauuuuggaauugacccacaugugccaucuuuuaggguuguugaauauuguauuccuuauuucauugccuugcuuugcauuuuuauuuauuuuuuaccaacuuggaaaguuuaauguuugaacccagucagauaucacuauuaagcauuagcauacacacucauuuucccuccuauccagguaugauuauagucugucuuaggaaaaaaaacaacaacaagcaacuccuaucuauuuuaaaauauaagccuguaugaguaauacuaacuguaaucuuuuauuuaauguuuucuuuuuaaauuauguauuuuugcuuuuuguggguauauaaaagguguauauguuuauggggguacaugagauguuuugauacaggcauguaacacauaauaaucacaucauggaaaaugggcuaucuauuccucaagcauuuacccuuuguguuacaaacaauccaauuauacuauuuuagcuauuuuaaaaauagcuguaaccacuaugcagaauaguacaauuaaauuauuauugacuauagucacccuguugugcuaucaaauacuaggucuuauucuuuuuaacuauuuuuuaauacucauuaaccauauccccacuucaccuucccagccucugguaaccauccuucuauacucucucuccaugaguucaauuguuuuuauuucuagauucugcaaauaaaugagaacauaugauguuuuucugugccuggcuuauuucacuuaacguaaugacuuccaguuccaccuguauuguugcaaaugacaggauucauuuuaugaauaguacuccauuguguauaaguaccacauuuacuuuauccauucaucuguugauggacacuuagguugcuuccaaaucuuggugauuguaaacagugcugcaacaaauaugggagugcagauaucccuuugauauacugauuuccuuucuuuugggucuauaccuagcagcgcgauugcuggaucauaauguagcucuccuuuuaguuuuuugaggcaccgccaaacuguucugcauagcgguugcaguaauuuacaucgccaccaacaguguaugaggguucccuuuucucuacauccuugucggcauuuguuauugucugucuuuuggauaaaagccaucuuaacuagcaugagaugauaucuuauuguaguuuuaauuugcauuucucugaugaucagugauguugagcaccuuuucguaugccuguuugccauuuguaugucuuccuuugagaaauuucuauucaaauauuuugcccauuuuuugaauggauuauuagauguuuucuuguagaguuguuugagcucuauauauauucugauuauuaaucucuuuucagauggauaguuugcaaauauauuuucucugauucuguggguugucucuucacuuuguuguuucauuugcuauucagaagguuuuuaacuugauaugaucccauuugucccuuuucguuuugguugccuguucucgugagguauuacucaagaaauuuucaccuaguucaguguccuggagaguuuccccaauguuuucuuguaguaguuucauaguuugaggucuuagauugaagucuuuaaucuauuuagcuuugauuuuuggauguggcgagagauaggggucuaguuuccuucuucuggauauggauauccaguuuucccagcgccauuuauugaagagucugucuuuuccccaguguauguucuuggcaccuuuguugaaaaugagucgacuguagauguguggauuuguuucuggguucucuauucuuuucuauuggucuaugugucuguuuuuauuccaguuccaugccuuuuugguuacuauagcuccauaguauaauuugaaaucagguaaugugauucuuccaguuuuguucuuuuugauuaggauagcuuuggguauacugggucuuuuguggguccauauaaauuuuaggauuguuuuuucuauuucugugaagaaugucauggauauuuugacagggauuucauugaaucuguagauugcuuugggaaguauggaaauuuuaacaauauugauucuuucaauccaugaacauagaauauuuuccauuuuuugguguccucuugaauuucuuucaucaguguuuuauaguuuucaugauagagauucuucacuucuuuaguuaauuccuagguauuuaauuuuauguguggcuguuguaaaugggauuacuuuuuuuuucuuuuucagauuguugucuguuggcauguagaaaugcuacugauuuuuguaauuugauuauauauacugcaacuuuaaugaauuuaucaguuuuaauaguuuuugauguggugucuuuagguuuuuccaaauauaagaucauaucaucugcagacaaggauaauuuggguuuuucuuuuccaauuuggaugcccuuucuuucuuucucuugucugauugcucuagcuaggaguacugcauugaauaauaauggugaaagugggcauacuuccugugugccagaucuuagaggaaaggcuuaucagguuuuccccauucaauaugauacuaguugugggacugucauauauggcuuuuauuauguuaagguauauucuuucuguucccagcuuuuugaggguuuuuaucaugaagggauguuaaauuuaaucaaaugcauuuuuggcaucaauugauaugauuauaugguuuuuguccuucauucuguugaugggaugugucacauugauggauuuguuuauguugaaccauucuuguauuggugggauuuaucccaccugguuaugaugaaugaucuuuuaaagguauuauugaauucgguuugcugguauuuguuugaggauuugugcaucaauauuuauuggagauauggcucauaguuucccuuuuugguaugucuuugguucuguuaucaggguaauacugggcuuauagaaugaguuuggaaguauuacccucuccucuauguuuucagaauaguuugaguaggauucguauuaauucuucuuuaaauguuuuguagaauuuagcagugaagccauugggucuugggcuuuuauuuuacugggagauuuuuuauuacaccuucaauuuuauuacuuauuuuuggucuguucagguuuuggauuucuucauaguucaaucuuaguagguugugugugucuaggaauuuguccauuucuucuagauuuuccaguuuauuggcauauaguugcucuuaguagccacuaaugauccuuugaauuucugugguaucagcuguaaugucuacuuuuucaucucugauuuuauuuacuuagaucuuucuuucuuucuuaguauggcuaaagguucaucaauuuuguuuauuuagaaaaccaacuuuuaguuucauugauuuuuuuuauauuuucuucuuuuuaauuucucuuauuucugcucugaucuuuaucauuuccuuuuuucuaugaauuuuggguuugguuugcucuugcuuuucuaguucuuuaagaugcauuguuggguuauuugaaguuuuucuucuuuuuugauguaggcacuuauagcuauaaacuuuccuguuaguacugcuuuugcuguuucacauagguuuugguauguuguguuuccauuaucauuuguuucaagaaauucuucaauuuccuucuuaguuucuucauugacccaguggucauucgugagcauauuguuuaauuuccuuguacuaguauauuuuccaaaauuucucuuguuauugauuucuaguuuuauuccuuuguggucagggaagaugcuugauacuauuucaaguuuucugaauguuuagacacuuguuuugugaccuaacauauggucuaucuguaaccauaauuuuauaaugaaaacacaauuggaauucuguuuuuccuacugaaguuuaagagacugaagacuuuuuaguguauaaagguuuaauuugucagugcuaguaucuuucuuaauggauaaauauuaaauacaguagauggucauuauaauuuuuuuauugcauaaaauuaguuguguugaaucagaucaaaauuauggaaguauagcuaauuguugccuucaaagcauaauauacauuuauuuggcaagaaacuauucagcuucccaauugaauuaauagauguuccuuuuaaaauuagucaguuaaucaaaacauguuuuuugaggcauuuuuaguguauuauagcacucuguuggcaauuaugaaauccaaaagaaaacauaggggauauaacaauaccauauuaugaaauauuaacacauaagcuaauuuugauaauaugguuuauauaagaaguauuggagaagggagaaaguuuaauuccccugcaucuuuuaauuaaaaaauuuuaaaaaaaaaucuguagaagaauccagaauccaggcuggagugcauugaauaguacagugaacauauaugcuuccuccccauucacugauuauuagcauuuuacaguauuugaauguguucuucccugcccccuuguauacauguauguauauuucccugccuccaaccauuuguuaguaggccgcagacauuaaggcacuucaucacugauuauauaucuccuaagaacaaggacauucuccuacauaaccacuauaucacuuucauacugaaaaaauuuagcacucauugaauauuaucagcuauacagucuauuuucaaauuucugcaaucauaugaaaauugccuucauagcucuuuuguuuguuuaagcuaggaucuaaucaaggccaauguguugcguuuaguuaucuugucucugacaggccuucuuuaaucuguaccagugcuguacaguaugguagccacuagccacaugugaaauugaaauugauuaaacuuuaauucaguuccuuacauaccagcaacauuucaagugcucaauggucauauguggcuaauggauacucuguugaacagcacgaccauggaaaguucuauuggagagaucuggaauguaccccaccucuuuuugucuuugugaaauugauuuuuuggaguucaggccaguugucuuguugaauguucuacguuauagauuugucuuguuucuucaugauuagauucagguuguggcagauuguaucuuucaaaacuagcuacacuaagauacuuggccuaucucacauccuuuuuaaaaaugugacugacauuccugcagcugagagguggggucuuugcucuccuuggauguggacaagggcaugugacugacaggugaccaaugaaguaagguagaagucaugcuaugugacuuaagacuggcucacucuuuccugguaugcuggcacuggggacuuagucaucacacugugaggaagccuaggcggugugaagauguuacacaacuccagcuaaggucucaagcugacagugaauaggccuucagaugauuccaaccgcuggcuuuugaguuuuccaguugaguaggcaugaggagcagauagcuguuccagcugagaucugucagaauucuugaugcaaagaaacugugagagcuaguaccuuacgcuauuguucuucuaagcugcuaaguuuugaggaauuuauuacagagcaguaaauaacuaaugcacagguuaaacaguauuacaagaguacugcauaaaugauggucugcauuuccuguugcaucacauuagggggcauguaaugucagugugacuuguuacugaugaggcuugaucacuuaagugguggccacuucaucuuuuucuuuuucuuuuucuuuuuuuuuucuucagacggagucucgcucuguugccaggcuggagugcaguggcgcgaucucaacucacugcaacuucuggcuccuggguucaagcgauucuccugccucagccuccugagcaacugggauuacaggcaugcgccaccacgccuagcuaauuuuuguauuuuuuaguagagaugagguuucaccguguuggccaggauggucucgaucuccugacuuugugaucugcccaccucagccucccaaaguucugggauuccaggugugagccacugugccuggcccaucucuucaucuuaaauaaauaccuuuaccucuuuguuauuaauaugcaaucugaaggaaaguuuaauuuuggauagaaucagcuuccaccaaguuucuugucaagaacauuucacucuacaccacuguuuugaggguauuuaaaaugguaacaauuuuagaaaucauuuuauucagucucuccauuuuguagcuugauuuaauaaauauuucuagguuucuauuacaguuacuagggacauaaaauuuaugagauaugaucauuauccacuuggagcuuauggaugaaaacuaacaugaauggcauuuaagggguguagauuggguaauacuuaauuuguauuucaagaugauucaacugaaagguuuuuauuuuccaaaagacuaaaaugauguuauuaugaugacuguagacucuagucucccaaggcuggucaaugcuguuuucugaauuauuuucuuaucacacagaauuaaaagaaaacacauuuuaagugcacucuuauguuagacguucuguuaguccuguaguuuagggguuugacuguaucuuuuucugaagauagaaauauauguguuuuaaaauauagaucugucauguuccaaauuucuuccuacguaaauaagaaauagugagcuaaaugaaugucugugaagugaaggcugucaggauacuguuguaugauuuuugaaaaaauauaagguacaauguauuaacgaaguaugcuaguaucuaauauauuguccuaaauaguuguugauuggguaaauucuauauagaugaaccaugcuuuuuaauacugguugcaugcuuaugaaaaaaaguggaucaaagguaacuauauagagccuuuaaaguuuuucugccaauaugaaaccauaguuuucuuauuguguuuguuuauuugguucugauauaagaauaauuaagaaauacauuuuucauuuguuuuugguuugauacuggcaaauuuacuuauauuuuucugucccaaauucuauuugaauuucuugguagaacauauaauugaagacaaagaagaaauauguccauuuauuucauuguuaucucuuucugguagaacccuguugucuagacuacuuugcuaauguggucagacucaugauacuuaauuucuuuguaggcucuacaguuucaccuguuacuugcugcuagacugaauauuuagcaacauuuuuuccuaaguaacuggcuacaggaaaaacuccauaaaugauugaauaaaucaaucaacaguuuaguaaguuaagucagacuacaacuguugccaaguaaaaugguguuauaucuuuauacagagggaagaugugauuagagcugcuucagaauuauaggaagauauaagaguaauccuaucuagguggggaaggagcaaucaaaauacaaaucaguucuggaaaguguacaauucugagaggcaaguugcgauaggaagcucuguauguuuaacucugggagggugagauaaaggugaaagaauauagaauuauuuaagaaauggagcaaaacuacagaguaaagaguuaauguagggacaggaaggaaucauugggggaagacuuuugaauggcagcagacaggaagggacgaggguggagagaaagcuaaauuuuugaguggagguguggguuuggguacuuaggauaaagagaccaguuuaaggauuugccgaggagggaacccauagaaagagaucacugcuucaggugguuccaagaugaauacuuucuuuuuuuggauacauuuagugcuuuacauuugcuuuuugugcuaaauccuuuacuaaguuuaucauuucaugcaauaccugcaacaacccagugacaacaucuuuauuuuacauaugaaagaaacaggcucagagagauugcucgaaaaucagugguccuucugagaugucagaagcucaucuuggugggaaagggggaaagccagaguuucaggaguucagcuuaccuugccccuuuucuccuccaacaacaguaucucaguuuuaaucuguugaauauauagguuuugcauguaagauuucaugucaagaaaaaagcaaaggcugggugcagcagcucaugucuguaaucucaagaugaauacuuucaagugucaaggagaacuugauuuuccaacaacuugaaaacagaaggaauuggcugauagacugcagaggcucugaaagugugccucuagaugagugaugucaucuauacucaccuuugguagauguaaucuguauucagcuucucuccugacaucucuaaccacuaggaucaagcugaccugaccacuggacagcauucuggguaugcgcacaucaggccaaggugguaucuugauuugcagucgcaagguuuaggcuucagaggggaagcagcacugcuucccuuucuaccuuggagaaguggaguagaaaguaaccagguggcagaaaugcccagggagcuuaaugauugcauuggccuugucacaucacaauaucacagcacacauugcucagccaguccacauuccugucucuaacacuugggggaaaaagagagcuaauauuguuguucuaauuuuguaagcuaauaugguagagacuuuuuuguugguuucuuucacaaauuucauucacauuuuuagugaaaucuuguggacuauuuacuuggaacacaugaaguuggguguucaaagaaggaaaaauaauuuccaauuauggaaaaaggguuugagaguucucuggaucucuuuaucuaugguggcguauaugacuguugcucuguuuggacagggucuaaggaugaauagcuauucacuuauuccucacuugcuuucaagccaugccaacuacuaaauccucagaucagcuacuaaauaaaacaagaauauguuauuaugugacucauccuucuuguuuuucccccuguauuucaaauuuaaaauggugucgugugaagagauucaagauuuccauuccugcuuuucccuuuccugccaagcucaugaccucugccagcuccaucuuuuccuuccucugcuuacaguuuugguuugaguucuggauucuuggaguuuauagaacaagagucauuuaaacucuuuuuuuuuuuuuuccaaauggaacaagugucuuaauugaggucaggccaacacuuagugugacagaaucuucuccucaccuuccuugggacagagagaauucaugccaaggagaauggugugaaacugugaacccaaagaguguccauugggauaaagcugaugcccaguuggaggcacagcacagugacuguuuugccaggcucuguuguucuguuuggucccaagccagaugguggccuggugggugaaccauuggcucuggccuuucuuucaccuccucagguauaagaugaaauacccagcugucccuuuccuugcaugagugacccucuggaaacaguaauugcccucauuguuacuuaauguuuacaugauuuuguuuaaauuuggcuuuuaaaaaauaugguuuauugguaguaugaaaguaucaaauuaauaaaauucaggaguggaauuuauuuaacaccauauucgaguuuaaacagagcuucuggagugagcaugagagaggaagugggcagauuugaaugagauugaacgaguauaguucauguauuauauauaucauuauuuugaucacuagaaauacguucaagaugugcuugcauuagaguuuuuauuacguguuaucuuuuagccacuuuguaacauacauaagauggaaaugagcauccaaggucucccucaaauggaaauauauccacugaaucugaugcgacuuaugcuuuugucccuggauuguacuguaguauuaguuaugccuuaucuguauaaugguaaaagcaauagcauuuacaggucuuacgauuuguccagucucaacuguaguaggagcuauuugaagcuaucaagaaggaauucugaaaaagacacaaagaccuugucauucuacagagcuucaucgagaucuuccauuuucauaccagcuuugauuucuaugauuaugaugcauuacuaguagcauucuuacaauuuuacuuaauuuuggcuuuauuaaaaaaucuuuuuaaaaguaacaagaaacaucucggaauuuucuugauaauguuucggagacacauaaauguuucuaaacaaagcaaaauuacuuuggcauguugcaggggacaggggugguagggguggugcaugucuuccugcuguggcccuguccagagucucuuguucagcccuggauuugcagcucaaagagauauccuaauuucugaaggaucuaguugcugccugagucacauuucuuuaagccacagagcuauaaauaaaugaugguuaucccacaauugccccuuuuaccauaauguaacugaaaugaugcaacuaauauuguugauguuguuaggaaaguaaugguucuugccuugccuuucucauaggauuuuaugauaaugcaaugagauaguggauucaaagguauuuuuaagguguuaugugacugauaaauauaaagaggcauuacaauuauuacuguuauuacaauuaauuuuccuacuauuuuuaucaugaccaacaucaucauuauuaauaucuucacugucgggguauaacuucucaggcccaucuccucuaccuccugagcaggagaagggaaaucauacccauugguuauuacaauuauaaagacuuuuuuuucucagauaauuugggggcucaauauaauguuucugacucugggccccugaauuucuuuuaauuccauugcugggaauauuucacuccugcuaaaaggcucaacuuaggcuagaggggccagcucuuuaggggaauuuauuuuuauuuuuuuuguuuuuguuuuuuuuuugagauggagucuugcucugucgcccaggcuagggugcaguggcaugaucucagcucacugcaagcuccgccucgcggguucacgccauucuccugccuuagccucccuuguagcugggacuacaggcacccgccaccacaccuggcuaauuuuuuguauuuuuaguagaaacgggguuucaccauguuagccaggauggucucgaucuccugaccucgugauccgccugccucggccucccaaagugcugggauuacaggcgugagccaccacgcccggccuaggggaauuuuaauagcucuaauuaggagcugcuuucuugauaucaaguaccauugcuaaugauucuguauuaacuuugugucucagucugauaacuggccuucugucuugcuuguaugaugaaauucucaacuauaccucaaauccagucacugauuuccuguauuggcacuuugccuuggccuuagaaaccugcccagaaucucuuaauccuccuugauuuucuacacuuuucuggcucuccaccucccccacgcccaugccuacacacaugccagauuuaacuccugcuugagucucaguguauuuuaucauguaagggagacuucaucagaagucuaguuaacgucuaacauguugucugagcuaugguguaaguagaguaugguaagaaggauacuaaggaggagggaaaguauagaggagggagggaggagagagcgaaauggcaugaacauagcauaaaaguacaagggacggguauauucuuucauucacuagguugugaccuuuguaaaggcaaaaaaucuugcccccuuuuuuuacugcuaugucccuagugucugaaacugcccaguauugaaucuguccauuaaauauuuguugaauaaguguuuguggaggcacacuaauugaccgguuugucuggaggacacuugaaugugagcuuuuuaggacugggaucauuguggccuuguuuauugcuauagugccauauaguuuuggcaaaaugaaugaauaaauguugggaucaguggcguugaggcuagaaggcagaaauugauaauguggauucuuuuuuuuguugagauggagucucacucugucgcccaggcuggagugcaguggcgugaucucagcucacugcagccuuuaucucccagguucaagcgauucuccugccucagccuugcuaguagcugggauuacaggcacacaccacuacguguggcuaauuuuuauauuuuuaguagagacagaguuucacuauguuggccuggcuggucucgaacuccugaccucaagugauccgccugccucguccucccaaagagcugggauuuacaggcaugugccaccaagccuggugauaauguggauucuugaaugcugaacuaaggauuugguccuuauugugacaaggagagaaacaguguccuucugaucuuaacauuuacuuuuacugucuaauguacuaagaauuuuguucuugcaauguacuguaauuugagccgaaggguucagaaagaaaauccuuuugauacuaaaaaaagaagggauauuuuuacauaagaugcuucuuuuugaguuaauauaaauccagaaucuuaauugguagauauguuucuaaaacauggucuuuaaaaauugcuuauauggauagucaacauguuuacacacaacaaugcuguaaguauguuucuauucaguaucauauaaauaauagcuaugguuucaaguacucagcaaagugaugaaaagcauccacuguuuucauucucacuggucuacuuuggcauccugugguugguguugagcaguuguucacugcuugaggcuccuugaaucugggaaccagagugaauauuuccaggugucagauucaucucuucaucuaccuguacuucuggacucuaacauuguccauauuagaccauaaagauguauacuuuucaaacacuaugauucuggaaaaugaaaccuaucuagaguacaacccaaaugcucaaauugaguggggggaguuuaucuugauagacauauguaaaggaauuucuuuuuuagguuuuuaucuucacugagugauuggacugcuuaugggaucaaagcaucuuggauugcaauaaacauuguuucauguaaauaggagaauuuuuuugugugugugcaugugcauguaugucugccauaggauguaguguaaagccaagcuugcuugucagggacaauugcuuuguuagcuaugaacuaaaacuggaguuggaauuagggcagggccguggcaaacacucacugagcacuggaguggcagguguauccucuacagggugggagaucguugucacucuuggcuccccguuuucuucuuaucuucauccaagcacccggcagguuuagagagauagaguccaauucuggaggcaguuguccucagcagggagaaacagaggaaaguuaucugaaaucuuagacaaaaggaacaaaaggcagugggcuuuuagguuucugaaguguaacuauucuacagaaggagauucguuuuucuuagaugaauuacuauagucuacuagauuuuguuuacauaaggaacugauuuauuuugggcuuacugguguguggaagcacaacuaauauucccuaacuaauguuagaaaacagaaaauaaagaagaaaauaucuauaaucucaacauguaaucacuuaauuuuauauuugauuuuaaugaacaaugcaauaugaagauauuaugaacaauaugauauauguuguuuugauuagguuaauuuuucuuccuaccacuaccacuaucauaaugguuauugucaucaucaaguauuuauugagucccuucucugagugaggcauagucgcagccagagugaagaagauaaacaaaaggcguguguuuucuuguaaggagauuauuuucuauuuuggacugaacauauaucuuggaaacaaauuacaauaaaugauuuauucauuaggcaaaugauuauugagcucuauuaugugcaggcccuuugcuuagcauuugagaaauaauguugaacaagacauuccugcucuugaguauacugugcaggguaagugauagacaagcaaauaagaauuucaauaaauuauaaugcaugaauugucaaugaaaugccacagacagcgagugcuauaaaaggauauuauauuaaaagauauauugaaaaaccuauuggacaguguuggaaaccagaauaaauuuuuuuuuaauuacuuguuuccuauauuggcccuuagugagagccuaaggcauaaucuuaaauagucagguaaucaauacauuuuaugacaaauuaagguaauauaguucaacaguauuacauuuagcucuuccaaaagaacacuaggauggaucuugacaaaaauaguuaaaagggccuuaaguucucucuagcaucaguugucucaguauuugcuuuugcuggaguuuaacauuaacauuugacaaguacauaaagugcugauguucuaugguaugaaaggaagagaagacuauacguuuuauauucuggauuagcaagugucaaaguuagcauuccauuaugaaaauuaggaaaccagauaggcuuuuuuuggugaggcggggcuaggcaauggauguuuucgcccuuucaggaggauaugugaauaaaagagaaaaagcuuagaucuguuauacauuggauauucugucuuuaccugacauaaaacuuguugcagaauagaauuuucuaucuagaguuauuccauuuuaaacuaacugggcauauuuucuuuucuuuauaucagaugaaaggaaugaaagcuacguguuuauacuuuauuugaguuguucagauccagagugaaaaauaccaagggagcuguggaauuucucucccuggagaucuuuaagaaaagguguagguauucagacacuuaauucacugaaauuguuucuguagaguuuuguguguccuacuuuaaaaaaaaacaagauguguaaaaacccagacuuagaaaauugauauuauugaggauaauucuuuccuuucuaauccucaucacuuuaguuuuccuacuaggugaauuuauuugguaauagaugaauacuuaaaauuggugagcauuugacuuaagaauauuacuucauaauauuuuaauugauauuugugaagaauuucgaaguuuucaaaacauuuuacauuauuauaucauuugcuucucagugaucuuaugcaguagacaagguugguauuaugauuauuucccauuuugcuguuaaggaaucugaggauaagaggcucugagauuugacuguggguuauuaaguugcggggcuuggcacagaccuuuugauagcaaauucucugccuuuuuugcaugcaugaggcauuacuuuuuuuuguuuuguuuuuguuuuugauuuugagauggagucuugcucuguugccaaggcuggagugcaguggugugaucucggcucacugcaaucuccgccucccggguucaagcgauucuccugccucagacucccgaguagcugggacuacaggugccugccaccacguccggcuaauucuuuguauuuuuaguagagacgggguuucaccguguuagccaggauggucucgaucuccugaccucgugauccgcccaccucggccucccaaagugcugggauuacaggcgugagccacugcgccuggcuauuuuuuuucuuaaauuggaguauuuguccuguuuuauauugaaaucaagucacugaagauucuggagaauaggauaauaucucuggaucauucauuucuucuuucuguaagcugaaugauggcugagggaaaggaaaauauguuuugggcuccccccaaguuacuuuuuugaucauuugccacuuucuuacuaaugcaguguuguagaugguaacuggggguucucuaucaguucacaaaaauaauuuaacuuauaagauuacugaauugguaguacuggaacuaaccagcugcuccuaaaauagugcauuuugguuugaaaaacagauuggguuucuaggaaauggaguaaguuuguuaauguacuaagauuaagcacuuucugauaaccauauuagcuauauauaguauccacuucagcuuaccauuaauaaauuagaccaugcacuuaaaagaaccaaaauaaaaucaguuuauuaacuauugagucuuuacauuagagccacaguuuauacagguuaaguuuuaaaguuaauauccaaauguguacagcaaauaaucucuagcaagaaaaauaggauauauuauugaggguuacuagguuggcuuuaugcauugagauaauuuuacuuuguaguucugguuugaaaaguuuguuuauuuucucugaacacuuccugcguacaaaauauguauugacuguugaggauuuaaaaauaucagaaaaaggcaaagaagaaaggagucccuuguuaaccccucuguuuuagaauaguuuugguaagaaaggagggugaguucauuuuauaagaagaacuaguuaguagggcacuaugguaacuaacauaauucaggagcaugcaaacaguaguggacaguaggaguauaugcuuagggggaugcuuguagaugaguuugauuagcuaaauuauggugggccaugaauuccaggauaagagauuuguuguuuuucaauagaagggauuccagagcucuucuaauccaggacuugcuuuucagguaaggaaaccaaauugaguugcucaaauuacugaguagaggaacuggggcuggaacccaagcuucuugauuaauaaguuaauguuucuucuguuauacgaucucauguguugccaauguugguucugggagagaggaaagcaaaauaaaagcagugcuuuuugaauaaauucuuauagucuuagaaaaagaagauugauuagaagggggaaguuauuuaaaauuggaagaccaguuaagcucauuuugauuauccagacaugugaugauggagucaucaauggcuagagugaugaggagaaaggaagugccauuaaaaucagugagaaaauuugaagaguaagcuuauggugggaaagaucagguucaauuuugaacaaauuagaaaucaagcagaaauguuugauuaggcagauagcaauauggggcugauauucuugguguuaaauuauauuuagcagcuaaagaggauugacuagcugguuagcaugcaauauaauccuuucacacagugcuacugagggcaguugaguucuaggaagucucccccugacuccugcuucaaggaaaaauuaguucucuauuagaugcaucacugacugaaacauuuguuuaauaaacugguauaggcaaacucaccucaaaaagaccaauacuggccugaugauauaaucguaugaugcuucuuuuucuccuauaaagguguucauagaaugugcaaucccauguaaaagcuguguguuaaagaaaaugguguaacucuucaacccucauaaggcuuugugagauuuuauggcaugaucgcauuuauugucaugauaguaauucaguuuaauaauguuaacuaguuucauuuggacaacguauuugcccuggucauucauccuuuguuguuuuaaacuuacauguacugggaaaccacauauaauagcucuugauguuucuacuaaaaggcagagaacuugagcuauuaucuagauagucuaugaaaauuuuaaagauggggcagugucuuuguuuaauuucucuuuguguauuuccaaggauuugaaagugaacaaugggaggucuauauuuugcuagcaaugauugcuacacucaccugacaaaauaaaagugauuucuuuuucugugguuuaaagaauuuuuuuuuuuuuuuggauacauagucauagauuuuuggagucagauggggacuguagagacugucuaauucagggauaauaccugguuuccauuucuaugcugacuuuauaauuuaguaguggcuguuuacagcaauguugagaauucccacaucuuuggguucagcuuggcauuaaagaguguaaugauaaauuauugauguuuuuuaugggaacggggagggcccgcacaaacgucauguacuugcuauccugaucuacucuaguucuuuuguuuuucaggugaggaaacuaaaaucuacugaacuuagucuauaauaagcaguuagguuguaaaguguucuuuuauacucauuucuuugaaacagguagaguuuuucuuuacaaauaauguuaaaaauaauggacaauuggccaggcaugguggcucacgccuauaauaccagcacuuugggaggcugagguggguggaucacgaggucaggagaucgagaccauccuguccaacguggugaaacccaucucuacuaaaaauacaaaaauuagcugggcgugguggcacaugccaguaaucccagcuacuugggaggcugaggcaggagaaucacuugaaccugggaggugagccgagaucgcgccacugcacucuagccuggugacagagcgagagucugucucaaaaaaaaaauaauaguaauaaaaaaauaguaauaauggacaguuaaguuuuuaggcuaguucacaaaagacuuuuaaaaguauuuguuaacguuauccauaacuacuugguuuaauuaaauucuuguuuguacuauucccauaaccuuuguuucagcauuuaucauacuguguuauaauuacuuaaguuugaaaccagccuuuaccacuuaguaccuguaugaauuugcaaguuacucaaauucuacauguuucaauuuucuuaucucuugaaauaggaaaguauuacaacuuaccuucaugggcuuguuguaagaaucaaauuauuaaauauguaaagcacuuaaaaaagagccuggaaucuugaaagagucaugagaauccuucucaauggugcuuuaggcagcaaauauuagcuggaagugcucaaauauuagguauuguuauucuuacugaucaguuucacucacuauaguucauccuuguauacuuggaucuagaacagugucugcauuuaauaaauuucuuugaaggaccaauuaaauaaggaaggggcagaggaagacgcuaucacaugguaucucauagggugaaagaggaaggaagagaccagcucuuuuaacaaagugcuauuuccaugcuuguugagcuccacucuagaagaaaguuucuuuuuccuuagucguuaagacuuaauguugcugaucucucugauggccagugaugaugggcauuuuuucaugugucuguuggcugcauaaaugucuucuuuugagaagugucaguucauauccuuugcccacuuuuugaugggguuguuugauuuuuucuuguaaauuuguuuaaguucuuuguagauucuggauauucgcccuuugucagauggguagauuguaaaaauuuucucccauacuguagguugccuguugacucugaugguaguuucuuuugcugugcagaagcucuuuaguuuaauuagaucccauuugucaauuuuggcuuuuguugccauuacuuuuggucuuuuagucaugaaguccuugcccaugccuauggccugaaugguauugccuaggguuucuucuaggguuuuuaugguuuuaggucuaacauguaagucuuuaauccaucuugaauuaauuuuguauaagguguaaggaagggauccaguuucagcuuucuacauauggcuagccaguuuucccagcaccauuuauuaaauagggaauccuuuccccauuucuuguuuuugucagguuugucaaagaucagaugguuguagauaugugguauuauuucucagggcucuauucuguuccguuggucuauaucucuguuuugguaccaguaccaugcuguuuugauuauuguagccuuguaguauaguuugaagucagguagcgugagccuccagcuuuguucuuuuggcuuaggauugucuuggcaaugcgggcucuuuacugguuccauaugaacuuuaaaguaguuuuuuccaauucugugaagaaagucauugguaguuugauggggauggcauugaaucuauaaauuaccuugggcaguauggccauuuucacgauauugauucuuccuauccaugagcauggaauguucuuccauuuguuuguguccucuuuuauuucauugaguagugguuuguaguucuccuugaagagguccuucacaucccuuguaaauuggauuccuagguauuuuauucucuuugaagcaauugugaaugggaguucacucaugauuugacucucuguuugucuguuauugguguauaggaaugcuugugauuuuugcacauugauuuuguauccugagacuucgcugaaguugcuuaucagcuuaaggagauuuugggcugagacgaugggguuuucuagauagacaaucaugucaucugcaaacagggacaauuugacuuccuguuuuccuaguugaauaccuuuuauuucuuucucgugccucauugcccuggccagaacuuucaacacuaugcugaauaggaguggugagagagggcaucccugucuugugccaguuuucaaagggaaugcuuccaguuuuugcccauucaauaugguauuauuggcuguauguuugucauaaauagcucuuauuuugagauacauccaaucaauaccuaguuaauugagaguuuuuagcaugaagggcuguugaauuuugucaaaggccuuuucugcaucuauugagauaaucaugugguuuuugucuuugguucuguuuaaaugcuggauuacauuuauugauuuguguauguugaaccagccuugcaucccagggaugaagccaacuugauugugguggauaagcuuuuugaugugcugcuggauucgguuugcuaauauuuuauugaggauuuuugcauugauguucauuagggauauuggucuaaaauucucuuuuuuuguugaaaugcaaauuaaaaccacagugagauaccaucucacagcaguuagaauggcaaucauuaaaaagucaggaaacaacaggugcuggagaggauguggagaaacaggaaugcuuuuacacuguuggugggaccguaaacuaguucaaccauuguggaagacaguguggcaauuccucaaggaucuagaacuagaaauacuauuugacccagccaucccauuacuggguauguacccaaaggauuauaaaucaugcugcuauaaagacacaugcacacauauguuuauagcggcacuauucacaauagcaaagaguuggaaccaacccaaauguccuucaaugauagacuggauuaagaaaauguggcacauauacaccauggaauacuaugcagccauaaaaaaggaugaguucauguccuuuguagggacauggaugaaacuggaaaccauaauucugagcaaacuaucgcaaggacagaaaaccaaacacugcauguucucacucauaggugggaacugaacagugagaacacuuggacacaggauggggaacaucacacacuggggccugucguaggguugggggaaggggcgagggauagcauuaggagauauaccuaauguaaaugacgaguuaaugggugcagcacaccaacauggcacauguauacauauguaacaaaccugcacguugugcacauguacccuagaacuuaaaaaaaaaagacuuaauguuacugaucuggaugugauguugcaaaggcaacaguuugauuaaucuaagcuggaguagcuaauaguuucccaguggacuuuacgcuuuaaaagaugauaugugcuaaccaaucaccucucuccucuugguaguauuuuuguugcccucacaaagucagggacaggggcaggcucgauaaauugcagggccaagaacaaaaugaaauguggggguuccagcuaggaaagucacuuuccccuucuaccccaaacugcagauggucaaccuacaaaugauccugccaggauucgcuugguaccugaauugggggugggcaagaggaccccacugagucacccaccuaaaguggcaucucacugcuggcucaggauggggauggccauuuccucucugcaacccaguuucugucccuaguggagggggguggcuggaggcaggacugcacaugagucacagugcuaagccaagcucuguuaccccauuggacuuuauauacaaaaugcaaauucaaagauacaguuauuaagaauuuaaagauaauuaccacagaacaagguccuggaccuuuugagcccacgacucuaugcagcuguacuggcugccugcccaugaagcccaccuuggugaagagcauuuuuuagauauaccccucucucuggguagggucuucuuugugggcaguccaauucugccugggaauuuggacuuuaggacaacucuccauuauuggucaguuucuuggcugcugcugcuuuggaacauacaggucacuaaaagcaccauuuuuuaaaaaagaaauugaccuuuuuucuaucauuaccaauccacguagauguacucaacuuaaugguuguggacaugaugcauuagccacauuucucuuaauuucgcuacagggagguauuauuguuucuauuuuacauacuggagacugaggcucagaguaguugauaaguaccuuuccugaagucauguauuaauuggcagagcugaaauuuaaacuugggagagacugucuuauucuuuagccuguacuggcucucauguaaauuuuagcauuaaaucuauaugacacauauguucuagcagcagcuuuuugccucaggaacuuccuauuuauuuauuuauuuauuuauuuauuuauuuauuuuuauuauuuuuuauuuuuucuagauggagucuugcucuguagcccaggcuggaguguaguggcaugaucucgguucaccgcaaccuacgccuucuggguucuagcaguucuccugccuuggccucccgaguagcugggauuacaggcaugcaccaccacgccuggcuaauuuuuguauuuuuaguagagacgggguuucaccauguuggccaggcuggucuccaacuccugaccucaugaucugccagccucagccucccaaagugcugggauuacaggcgugagccaccgcucccagccuacgaauuucccauuuagugaacuuaguguguaugcuuguaggugcucuagaguuuuuaagcccuauaaagauuuuaguuauuaauagagauuugguccuuuaugcaauaagauugugcaucuaggaguuugauuuuuuuuucuaguguuuugcucacaagauuucuagucugcuccgauuuuuucuuugagcaugcuuuuuauccuuaacuuugccgucaccucggaguagcuucuuuugguuaguauucucuguauuccugagucccugugugucagagaauguaagaguugaaaaugguagacucccacaaggaaacaaacauugcuuuuuaaaagcucauuaaaaacuaucuaaagugaccucaagggaccuuuagaggcuucuuugaaaagcuuuguuuacuaguagccuucuguacuagucagaguucuccagagacagaaauaauaggauaucuauuuauggauggauggguggauggauggauggauagaugauaaggggcuuauuaggggaacuggcuaacacaauuguggaggcugagaagucccacgauaggccaucugcaagcuggagaaccagggaaguugauggugaaccagggaagcugagggcccaagagccugaggagcugcaggugugagucucaggguccaaaaaccagagacccuggaguucuaacauccaaggucgggagaagaaggguguccugacuauggaagagugggaagaaauucacccuuccuccaccuuuuuguuccaucuggucccccagucgauuggaugggugcccauccacauucagggcagcagauccuccuccccaggccaccgacucacacgccaaucucucccagaaacaccgucacagauacacccagaaguaauguuuuaccagcuaucuagguauuccuuaauuuagugaaguuggcacccaaaauuaaucaucacaccuucuguuuaggaaugucagugguggagaauguggacuguacugucugacagauguggcucaaaucuugccucugcccuaugaucuugggacuuuaaacauuuuuuguaaccucuuuaaggccucagcaucuucaccuguaaaaugggaguaauacuauucucagguuauuguaaagaucacaugaacuaagguauaugauguguuuuguguuguaccugguacauagagugcuaucagugaguauuagcuauuauuauagauuaaaggaucuaggcuuagaauaguaacccagggauguagucugugcuauauuagagcaaucugcauagacaugccugcauggacuaaggggucagaauaagaccaaaugaaagucucuugagagucgugucucagguuugguagauuuagcuccaccauggacuguuuaacguggcacgcuuaaugauuuaaucugagguccuuggagugaagguguaugcuuguaaguggauucaacaaacauuuauuaagcaccugcuauugccaggacuuuguagcugcugguauuacaaaaaaaaaaccaaguuggccuguguccuuuuguaguuuauauuccaacuaugagacaaauaugcaaacaaaugacugauauuaaauacaacacaagugcuuuaagguacuuaaaaugcccuagggcauaauaaugcagaaugcccuagggcauaaagugaguuggaaggaaguuguucuuuguuaauauuuuaucuucagggcuaagaauguucuuauuauagaaggaccuucaguaaguucaaugaauuauuuugauauuuuuaguauagauugauccuucaaacaccaaacauauugaaaauguaacuuaacuuuggguauuuaagugacagaagcccaucuuuaaauuuuccuaacaauauuauuuauccuuuaucuucacaacuuaggugaauaggaguuauaggcaaaaucuuguuaauuaugugaagacuaccuauaucugcaaugugcaaaaggguuucuuagccacucaggguggguguguuucuaaaugaucauuuacaucuaugggaaauauagcuggcaguugagaaaugagucuaauauuaguuagaauaaaagugauauuaauuagaauaauaguuagauauucacaauuaaaauauuagcuacuauguauuaaacacuaucuaccaaaaauaacacuaggaaauauaucuauuucgguaguuuauauacaaaauuaaaauaaaaaauauuucugugaagagcgaauuccccucauuuacuauuuguuuagcuaauuuuaaaguuuguauaaaaaguggaaaaaugcuacucuuucuuaguuucugaguuuuuaaugacaggagucuuagggaaguuuuucauguacuuacaaaaaacaccugaggaauauagagcagauagauccaaaucauaaacauguauugguaaaugagcaaaaauggaaaauaauuggugucgcgggacuguugaaacagauuuaauaauauuuaaaaaaaagucacuaggauaugcuuugagaacuauauuuucuacaacacaguagcaucauuaaguuuuuaauauuuggguauauaauaguuagcaucaugggcucugaagccggacuuucuguuuucaguuuuaguucuucacuuaccagugucacuuugggcaaauaauuuaaugucuucaugccucaauuuuaucaucuguuaauuuaggauaauaauagaacuucccucauagggucauugugaggauuaaaugaguucauauacauuaggcacuuagagcagagccuggaacauaguaagcucucaguagauguuaguuguuguuguuguugucauuauuuuucuuuguagaaaggaggagggauggaacuucugaugcuuauuuuuaaucuauguuacagagucuucccuuugguauauuuuuucuaaacuauuuuguuuguuucagccuucuuaaagucacguuuugcaacccuuucugaacuaaagugucuaggcuuugaacuucaguagcugguaaugucauaaaaggagaaaauuaaacauuauaugucuuuuguuuaaccucuauuacggcaccaaauaguauuacaauuuauugauauuuauggugguauuuucuacugagcugugagcuuuuugaaagaagagaccuacacuauuguguuuaguacacugucugguacuagguaugaggccugagccccuaauaguuguucuguuaacuauacuaacaucucauuuaucagguuuaccuaauagugugcuuuucaaauucaaaaacaacugaguuuccuagcugucuagcuacaugaauuaaaguauguuacuuuaaauaugaagauuuuauuuuuuuaaguauuuaggauaauuuuucuuauaagcauugagcacaucccauccuucauaagcauaauguaaauucaucaucaugcguacuguuuauuggggcuguaauauagugucuccauggaggguauugacauaugcuugguuguaugguucuauaucacauacucugaggaugccuuaugcauuuuuucuuugcaucuuauguauuauuuuucucucauuaucauaauacaccaauuucuuucuucuuucugccacaucuagcaacccuagcuuccuaaauucaaauuuaaugcuucuaaccugcugcggauugauuugcuuacuaacuucauuagaaccuauagaaaaagaaagauuuauuaauaagaucuuaaccaagcuugagggcaucuucugugaguaaaaugcagaaguucagcacauagauagagggugugacaucuauuuagcuagccauauagguuuuacacuuacuuuaugacauugcugagguugucauauauguguggccuccaggcaagugauuuuuuauuauauuaaccucuguacagaagaaugaaauucucuucaguauuuccguaguguuaacuuauggcguuggaauucaaauccagaucuccuuuacuccaaaguccauuuuccuuggugcuagacucauguuauaaaaaaguuaauauuguuaauuauuacaguucauuaaagugacaugauacuaggauaguuuuugguuuaaaacacaaacucggcccggcacaguggcucaugauuguaauuccagcacuuuagcaggcugaggcaggaggauugcuugagcucaggaguuugagacuagccugggcaacauagugagaccuuaucucuacaaaagaauuuaaaaauuagcuggguauggugguacgcaccuguaguccuagcuacuugggaggccaagguggaaggauugcuugagcccaggagguugaggcugcagugagcuaugauaaugacacuguacuucagccugggcaauagagcaagacccugucacaaaacacaaaaaaacacaaacucuuugucuuuguccuauuauuggcauuuuuuucuauauaaguuuuuaaaaauauugccaauuauggauuguuuaaauauuuaauugauagauacauauucaacauauauuuuacaacaguaaguuacacagauauagguuacauuuaauaacaugcacuuuuaaaaggucuacaauuuaaauaaccugauuacuauguuuauuuguaggcuuugagcucaauauacaugcacaucuacauagaagaaguacuuaaaugugccuauuuuacuuacaguuuauaaaacgcuagaaaaauauuaaaaagauucaaaauuaaguagcuuugaggcauuuaggauuagacauggauucaaaucauaguuuuaaucuuagaauguuagcuuuuucaguacuuccuaggguuacuguaaggauuaagucaaguagcauuaacgugggaugcgccauaagacaauauuugauccuucaugaucucuuuccucuucauuuuuuccaucuauauaauuuugaaucuugauaaaaaagagggagcaaaaaaguauagggaagaaugaaauauauuucuuaagcaaaagcaacuaugguuugcauauugugcuucaaaaugaauauuuuucuuuuaucauuuuguuacaugcagaauaccuuuaacuuagccuucauuggacuaaaguagaaacguaagaauuggagcuuauuuucauuucugaggugaguucauuuguagaaaaauuaguauacuuaaaucagucuacuguuucuuuggaaacuuugucauuugcauguaccugggaauacuacaguuauccaugaaaugcuguuagugugaagucguggugaggguuccaggcuaggcauucggagcucccugucaauaccugggcugugcuacagaugcccuucaguguugugacccuaguuccuugacaucuuugugucaguuugcuuauuuuuaaaauggaaaugauauggcaguuggcccugcuuaccuuccagcuuacauauuauaagaaucaauugagaucaucgauaugaaaguauuuuauuaugaacaauguaagguagaaguauuaauaucgugaagugucacagugaguuaaaugggaauuaacaaaguuacgugcagagaaucuuuuuuguuuuuuuuuguuuguuuguuuuuuguuuuugagacagagucucgcucuguacggagucucgcucugucgcccaggcuggaguacaguggcgcgaucucggcucacugcaagguccgccucccagguucacgccauucuccugccucagccucccgaguagcugggaccacaggcgcccaccaccaugcccggcuaauucuuuguauuuuuaguagagacgggguuucaccguguuagccaggauggucucgaucuccugaccucgugauccacccgccucagccucccaaagugcugggauuacaggugugagccaccgugcccaaccacagagaaucuuuuuaagcaugaaacuuuugaauguuauuguagccuaaugccccuggaacaguaguaaaacagggccaucuuauauguuguuucugaauaaacuggcaaacaaauagaagaaaaggaagaggaggaagcagcugaggaggagagaaaacaaaacuaaacugauuauauggucuugaaagcauugacauuuuuagaacuacacaucacuugaaaauuuuugaaggcauuguuaaucuauagguuauuaaaaaugaauuuucuggccaggcaugaugacucaguccuguaaucccagaacuuuggggaggcugagaugggaggauuacuugagcucaggaguuugagacuagucugggcaacauggagagacccuuucucuacaaaaaauacaaaaauuagcugagggucucacugacuugggaggcugaggugggaggaucacuugaguccaggaggugaaggcugcagugagcugagauugcaucacuguacuccagccugggugacagagugagacccuuuuucaagaaaauaaaaauaaaaauguauuuuccauuaaaaaccagcuuacauuauuuucaauguuuuuacauuucuugcuguggagaaaagccuagucccuucucuagaauuuuaaucauucaucuggaugccuugauauaugugguaugaugcuuaguaaaauggaauggauauuucuucuaucuccauuaguuuuucuguuuguuuguuuuucuuuuuaccugccuuuauuucuguuguuguuauucuucuuccauccaccaagaacaugugguccucuuaucucugggcugagguguuuucacauguccuuuuauucuuucuucaucucacaaaagguauaucuaggcuuuuuaaaggugccaagauacuauuuaaugaacaauaugauauggauuggcucuguguccucacccaaaucucaucucaaauuauaauccccagaauccccauguguugagggagggagcuggugggaggugauuggaucaugggaaugguuuuccccaugcuguucucacgauagagagugaguucucaugagaucugaugguuuuauuaaguguuugacaguuccuccuucacacacuguccccucucaccuguuagacgggcuugcuuccccuuccccuuccaccaugauucuaaguuuccugaggccucucagcuaugcuuccuguuaagcccguggaacugugagucaauuaaaccucuuuccuuuauaaauuacccaaucuuguguaguaucuuuauagcagugugaaaauggacgaauacauuauauuucuuuccaguaucuguuuugggagaggaaugcuggucagcugcuaguaaaaucaucuccauguacuccauuauuuagguaucguucaauucuagugugguagucaugacuaccuagguggucauuuuugucuaauguugcagcugcuauuucugugucuuagucuacaagaaaacguuauauuuuccucacauagcuuacuuauucuguuccuugcauaaugaccgagguggcuguauucaaagccuuaacaaugauuaacaacauguccuuuaaucuucagcgcuagcucaagaguuuuauucuccuguggccacuguaaccuccaaacuaugaguaaucuggcaaguacuuuuguguucucuuuauugcaaaucauauucuuuuucaucuuuaagaaauguuguuucuuaguaaacaguaggucauuuauuugacuucuccaaaaaauaauugacuauuuaaagaaaaauaguuuuaaggaacauuuaccaguugcuuuuuuauguagauagugaguguaggauguagcagauaggccgggcuucauagucuucacuguuuaguuuugggcaugcaugcucucugagccuuaaauguuauaguuguaaaagggguguaguguugggauuguuaggauuaaaugagauaguguauauaaaaugccucguacauuguggagcacaaagaaguucacagaauaauguaaguauuguuauuacugauaucuucuccucauuguuguugucauuaucaccauaauuaugugggaaaaccuaaagggaguuuuguacuaaugggcucaaaauggaaugcauuguugaugaaggucucgauacaguagaucaccuugacaaauuguguguagucauaguuucuuugauacaccauucaucucguuaagaugagaauguccagccagcccuagagauaugucaacauuucuggcugagauuaauauagacuuaugaaaauggguuaauuggucacuaaugagcugcauuacugggaauaggguuagaguuuuaugaaaugcguaguuucacuuuagacuuaccuacucucaggaguaggcaguuauuuaaguaguagccaguuugaaagaaaaaaaucuaccuuuucaguuuguuuccuuuuuauggauaaaaugaaaaaauuccauccugaaaucagauuuuaaggaacagauauauauagugauuaaccacccagcuuccuuuugccuacacacacacaugcacacacacacuuuaucuucuguuuuucauucagaauaugacugcacaagcuguagggguuagcuaacagcacacugaacagcuuuuugcugccaguuugggggaugauugaaauuauugacccuuacacgaagacaaaaugaaauauuuuuaugcaagaauacuagaaaaaaaucuucucuauucagaaaauacuuuagcucuuagaaucuuuagcaugaagucacaugaugugaaaaagccaauuaaaagucaauuaaggccaggcaugguggcucaugccuauaaucccagcacuuugggaugccaagguggguggaucaccugaagucaggaguucgagaccagccuggccuacacggugaaaccccguuucuacuaaaaauacaaaaauuagccaggcgugguggcaggcaccuguaaucccagcuuuugggaaucugaggcaggagaguagcucgaaccugggaagcugagguugcagugagccgagauugugccauugcacuucagccugggcaacacagugagacuccaucuaaaaaaaaaaaagucaauuaaauauuuuuaaugguggaaggcuuauuaaaguuuuauauucugaauuugucuucaaaauacuuugaaaagagaauaaacauuuccaaggcuacaggaauucuguuuagaggauuugguuaagcuagcuaaaaaccuggauagcaguugcccaugacauuuuaauuauucuaucuaaaaaagaugaauuucuaugucauauauagauaugccuuuaagguacuaugauauauauuuuugacugaacuuuuugcacaagaggcauuucugaaauaaguaaaugggauauuugaaaugucaucugugaaucuauuuuuaaagcaguauuuaacaucuaauagaccuugugugcuauuguagauauucuuauuuauauguaaaggagggcaugccauuuguaucucuuuuuuuuuuaguuauaugggagaugcaauuauuuucugaggggagugaaggaaaagaagggcuauauuauaauuugaggacauaguuauuaugggagacucucuuaaggaaccaacaagaaaggaaguauagaugagcagcgguuagaaacuagucgauacugauaacaauguauagugguccuaauagguucguaauucucuuaaaaggaaaacaggaagcaaauacagagaagauugaguagucauaugccaggguaaagagaaggccccugcccucaaagaguucauaguuuuauuuacaaacuagaauuaucuaucuuaaagucccaucguuuuuaagcugccugcagacaauuauagucuaguucuaguguaucuuguugaaucuuuauuuuucagaauugucuucaaguaccuagcuccaugcuuacaguuuauacuccccaauauagguuaaauuaaacuggauggaaucaagugcuaaaaaaaaagucaugcuuuuauucuuccagugauggacagcagaaguuuuagaguaaucaagaucugaauuugaaaccuggcucugccacuuaacuuauguggucuugggcaaguaccaaacucugagcuuuuauuucuucuguuguaaaaucaugauuaucauaccuauuucauaaguuagcugaauggguaaaugacucuguguguguguguguauuacaaaaguguuuaucaaauaacuguaauuaucaauaugguuaucaaaacuaaggaaaaguugagaugccccaaaguuauagagaugggaguugauauaauggagaggguuccaggugacgauggacuucagaagcuacacaggugaauuuacaguguugugauagccaguacggagccauuuuagguucuugaucccuagaaguguauugugaauaguuaaaucaaaauguauuuaaacaggauuaaucgagagauacuauucaagagguguguggggagguacagaccuugagaguuaaucauaccuauguaaacauuaaugaaggcacuguacauaucaaaauaaacuguauuccugcuuauaaaaaguaccucaacauauuuagacagauugaaaucauacacgcauucugugaacacaguggagucaaacuagaaaucaauaacagaaagauaaguaaaucuccaacauugagaagauaacacaacacacuucuaaauaauccauaggauaaagagaaaauuucaagggagauaaaaaauacacugacuaaaugaaaaugagaacagaauauaucaaaauuugugggacacaacuaaagaaauuaaaaacuaacagaaaugcagaaugccuuugauuccuuugaugccaucaguagauuggagagggcuaaugaaagaaucggugagcuuggagguagggcaauagaaacuucccuaaccgaagccauaagaagaaggaaaaaacugaaacagaauauuuaagaauugugagacaauuacaaaagguguaacauaugcagaaugggaaugccaugaggagaagaaagagagaaaggaucaaaagaaauauuugaaauaauaaugacugagaauuuuccaaaauuaaugacagacaucaaaccacaaauguuggaagcucaaaauuaaugagagacgccaagcucaggacaaacaccaaaaaaucuacagacaggcauaucuuauucaaauugcagaaauucaaagacaaugggaagauuuugacaggucggggggugacuucaccuuaccuuuaggggauuaaggguaagaauuacaucggacaucucuucaaaaacuauguaagcaagaagagaguagaaugaaguauguaaaguauuggaaaacagaaacaaaaaucacuuagaauucaguauccaguaaaauuauccuucaaaagugaaggaggaguaaagacuuucucagacaaaagaacugggaauuugcugccagcacagugccuuacaagaaauguuuuuaaaaaagauggauuuacaaauauuuucugcuagucuguggcuugucuuuucauuuucuuaacaguguccuuuagcccauuuuuauuggcuugaauauuuugcuaccaaaguuugauauuaacauauauugugcuuuaaauauuucuagaaauagcaucucugcaacaaacauuuucaguuuaaacuuauugaaagucucaggaauggaguguuguuuuguguucaaguaagucacaaagcauaaauauuucacugaaauguaaauaguaaaaucugugauuuuaggccuuguauuuucauguaaaagauauaugcuauccucacauaaauauggugguauuaggagcaaugccugacucuucaaauucuauuaaugacucagcacccgggagaguguuccuuauuauuguugcuguguuuguguaacauucucuaagguucuuuguagugaggaacagaugacccuuccaugagucgggauccaguguucuuaaaagggccacugcuguaguuucuuuaagcuucaucuuggauuguuauuagcauggcaaggacacuggauaaguuauauacacacauacacccacaaggcacccccccugguuugaaaauggaaucuaugaauuggcuuccgugccugcuuuuauugccauggugaugaauaaucugcugaguuuuaugguuggcaugauucuucuggauuaggucacuuguguuuucuuucuauaauaccagucgacuacgcuuuugguaacaguuaaaguuccaucacuaaaaagcuaguagguagaaugcaaaacuaaugauuuaguagaauuagcuacaucaaugcuuuuuaaucuguugauuauucccuuucagugcuaaguagcaggggcuuacucauuucacagggcuuuaaaucuuuccauugcagucagaccugguagggaauuauucuaugcugcaguuauaaguuuuucaucauuuauuaaagcauuaugggagaaccaucuugauaaaagcaucuuaguaaaggaaacuagacuuauuuauuuuauuuuauuuuuuuuggggauggagucucgcucugucgcccaggcuggagugcaguggcacaaccuuggcucacugcaaccuccaccucccagguucgagugauucuccugccucagccuccugaguagcugggauuacaggcacgcgccaccacgcccggcuaauuuuuguauuuuuaguagagacgggguuucaccguguuggucaggcuggucucgaacuccugaccucgugauccgcccaccucggccucccaaggugcuggaauuacaggcgugagccacugugcccagccuuauucuuuauuuuaaugagucagaauuuuaaauaccuugcuuuacuguauuuacaaaaguuguagcaaugggucaguugucuuaaguuaaauuuauuaguaucuaccaacauuaaaggaaauauuaaaguguuucaauuauguuuaaaauaaaacacaagaaugaggagugauggacacaaguaaaacaaugaauuugggaugauaaaaugaguuguugauuuagaaauauauacuauaugccaaauggucagaucuacuuggggauauagugagaguuaaucuacuucgaaucguugcuucuaaagcaaacccaguuguguaaaguccuacguauaaagguagauauuaaauccacgagggaaguaaucagaaccccaggugcccaggcuuuguaaaaaauuuaaacaguaaaaacguagucacuuguacuuaacuuagauuuaacuaaacaaauucauaaaauuuccugaguggaaugaugguuucagagagcuagugaguuucagaccuugaaaaaauaccacucacugaacuguagucauucuuaacuguuuaacaauugaaaucuaaguugucauauguuuaaauuaguacaguucugguuaugcugugucuuuuccaacucauaacuuucaguaaugaaaauagcuuucuauuuaauuagccugaauuaaauuuuccucucucuuccuucuacaucacuaaugaaaguggaguaaucauuucugcuucaaggaugacuauaugauuucauuuaucccuaauauaguacacacuacauaguaggcacucgguaaaucuuuauucauucuuucaggaggcaaagcaggaacagauuaacuaauuaccagcucagaccaaguuaagaaaaauaaagcuacagauugucauuucaaaauuugccucuuuuugcugucucacuauuuuaaggagugcccacuauaucacuaauaucucuggcaagaaagcauuccauguguauguauguaaguguguaucuucauuuuuugcugucaccacacagacaucaggcuuuuucacaaaaucugacccccucccuugaccauuuuuuauaacuaccuggcauguaucacuacagagcuuuuguucugguccuucuacuuggacuuuggcagauauuugaacucuucugagccagugcuuuccucuucagggauuuguuuuuaagauuuucuuccuugccaaccacagagacugaauuuuauaucccacagaugagucugagauuuccagcccccuccguaaaucccaucacucugucacucuugacaguguaauuaucccuuuuguuucuugcugcuuuccugcuuguaaucuuuguuccucaacauguccuucaucugaaaaaaaaggcacccaauccuucuugcuuugucagcucuuuaauuucucuugugaaauaguccucagauaucagcuccccacaaaggcuuucuggaggagaaguggcauuuugcuuccuuaaaucuuucugucuauucaauuuucaugagugacugauaacuagccaucauauuaaagucuucugaucuuauauuuaaguaugauuuuuuauuagauuuauguuuuguucaguguuuaugcuguucaguguaugcaugugcuauguguacacuuuuaauauguguaucuauaccuguauuuguaaaacagagaaaccuaaaggccaaauucugcaucuuauuuuugaaccaaucaagcagccuacugaugugagacaaauuucaacaaaugcuuaagacacacaucugauaaauauauaauaaaacuuguauguugacagagcuuguaaauuuuuaaaauucauauuuuuccaucuuuuuguucauuucucuguuauuugaugaugaugagucaggauucuuuuaaugagauaaugagaucuuuacaggucuaauguccaagguugauacugugguggugagugaaucaccauaugaugaagacccauugugucaccguauuuuagaauuuuucauaagguaacaaagguaugagaauuaggcaggacaauguaaaugaagugccguguaaacuacaaaauguaugugcacacccaugcagauuuuuuuuuuuuuuuuaguuuuuuuccuuuuuuuuuugagacaggguaucacuauauugcccaggcuggauuugaauuccuguucaauucuucugcucaagugauccuccugccucggccucccaaguagcugggauuacaggugugagccacugcaaccagcuacaugacuuuuccggagaucucuugagggugauuucaggugauacacaguuagugguaugagauaaagcacauugcugcuaaaauuccagacaguccccauaaacgaguagaaauugcuucaguuaucuagcagguaaguaucagauuugcuggcuuauccugauuuauugacacagaucuguggacuggugguauccuauuggaaugcagaaugacauuuaccuugaaaaagaaaguggauuuuuuuuuuuccuaacaagauaccuaggagugagugaucuguggauguugaauuuuuuucauugugacauaauucaaaaugacaaagugaacugaagacuuauuauuuucaugcauuguaugcuauuuuaaguuuuggagaaaagaacuucggagaucuuauuagucuguuuuuacacugcugauaaagacauacccaagacuggguaauuuauaaagaaaaagagguuuaauggacucacaguuccauuuggcuggggaggccucacaaucauggcagaaggugaaaggcaugucuuacaugguggcagguacgagagaaugagagccaagugaaaggaaaaaccccuuauaaaacugucagaucucuugagauuuauucacuaccaugaaaacaguauggaggacacugccuugugauucaguuaucucccaccaggucccucccaugacauaugggaauuaugggagcuauaauucaagaugagauuccgguggggacauagccaaaccauaucagagauugaaaaguuuuaaaaguaaagugauauccauacuuacagauauugagaugucuguaaacagucucccuuacaaaauagagcaaugcuaagauaauuugugugggagauaugcauauguauaucguaugucuuucuaaaauauucauacauaagacucauacaaagugacuauuuaauauguacuuauuauaccauaacagucaaaauuugaaauagaacugaucugaauuaguuuauaugauuugacaacacauaaaacuuugauaaacuuuauucauauuaagaaaagcuacuuuuucuuucugggucuaagucucauguuuaccuaauguugaagucuuugaaagaagacuuuuuggugauauuuuacauauaccuuauacauaaaguacacaguuuauccugggagucugagaugaggauugaauauugacaucaaauucugaaaguucauaaaccuuaggauucacugacccaaaggugauguuuugauuucauauuaagaagccauagaauuuuucuguuaagucaaugaauucuagaauauucaaagucaauaaaagauaaagaauaaugacagaugucucuauauaaaugauguaaugaugcuuuuguacuaguauaguuaaccuguugguuaucuucaaauuuaauucuguauuuacaguaaaaauuaaggugaccuucugggauuugagagguagcaugagguuaguggguaaacuucaucuucuuaaguauaaaaugacuuuacuuaaaaguugaucaaaaacuuuugguuuuggauuaaguauaauuagaauaaucuauggagguauacaguaaggauuaccacuucaugagauuuauaaaaagauaaacagaugugguuuuuaacuuaaggauguuauugagaauacagaaagacauaaucuauaaccuuuuuugaaguguagauauagaauaggucuacguuaauuuuuuaaauuagaacuugacagugaaaacauaaauccaagauguauguauauuuuggucuucaggaaaaaucuuaugcauauuuguaccuuauacauauacaauuaaaaauccacgcugaugacuaacaaaugauuccuauugaucuaaaaggaaaaagaugaaaaaucagcaagaaaauauugaaaacuuuaagaggaaugguuuuaaagaaaggauaccaucacuacuaagcaaagaaauaguaauuuuuuccucuaucagauugaaaaagauauauauauauuuuuuugagacagggucucacucuguugcucaggcuggagugcaguggcacaaucauggcuuacugcaacuuuuaccucccaggcucaagugauucucccacagcagccuuccggauagcugaagcuacaggugugugucaccauacccagcuaaguuuuuguauuuuuuguagagaggagauuucaccauguugcccaggcuggguucaagugaugcaucccccucagccucccacaguucugggauuauagacaugagccacccugcccagccuugaaaaauguuuuuuuuuuguuuguuuuuuuuuuucaaacaagugauauccaguguuuuggugagagugugagauagcagaaaaaaaaaucuacugguagcugggugcuguagucugaaugugucgcuccacaauucauauuugaaaccuaaucuucgaugugauaguaugaagaagagauggggccuuuuggaaggugauuaagugauggagagcccucaugaacgggauuugugccuuaaaagaggugagaaggaaccguuugccccuucugccaugugaggacacugguagaaggaaggcaccaucuuugaagcagagagcaaguccucaccagacacugaaucugcuggcgcuuugauuuuggacuuuccagccuuugcugugaauggcagcacauuacaaauuacccagcauaaggcauuuuugcuauagcggucugaaugcacuaagacagaguguaaguugguguaacaucucgggagggaaauuuugacaguguauuaauaauuuagagaugggcauauccuuuuacauagcaucuucuuuagaauuuuacauuaagacaacauucuggaauaggcauaaagauuuauguucaaggauggcaguugcagauugucuuuuauuuuucaguugcagauuuuuaugauaaauauuagcaauguacuacucaaggcucaaggaaagauuaguuacauaauuuuugggggggguaauuguuuaaaauaggcuguagaacaagcuuguccaaccugaggcccaggacagcuuugagugcggcccaacacaaauucauaaacuuucuuaaaacauuaugacuuuuucuugcguuuuuuuuuuuguaccucaucagcuaucguuaguguauuuuauguguggcucaagacaauucuucuucuuccauuguagcccagggaagccaaaagauuggacaccccugcuguagaaggcuucaaugagaaaucauucauagugcaauggucuuuuuguugugacuucucaggauacuuugaguuaaaagauuauaaaaccagacagacaguagcccccuuugaaaaaaaaaaguauguaugcauuaaaaaaaaacuagaaaaauuuauaaaaugugaaagcauuugucucuggcuagcaggaugacucaugauuuuuguucuuaaaauaguuuuguauguucuaacuuucugccauggauuuacuuuuaugaucagaaauaauauuuauaauauauaauaaaaauuuuaaaaagucugauauuuggugcugaaugaaacacuagaaauccuguaggcacuucuuauuucuauuuguuguaguaaagugugcuuuuauuacuuuuaaguuuucaggaaaauccuuuuaacuugaugcgcaagacaaaggcaaacaagauuguugucuuucacaagaaauggaggauaaaauguacuauuccaaagaaggaaaacugaugggcugagauguagagcagugugccuucuaacuggagagcugccuggggguuuggagaugaaauuuuuuaucuauugguucacagaaccggcugcuuccagacgauuacuuuuuuguugagccccacaaaccucguucuuuuagcugaguauuauguaguuuuuccaguauugcuuucuuucccucauuacaucuaggaaaacaguuuggagaugagcuacuggaguuaaaaaaaucuauuugguuuuauuugucaauuaaaaaaucuauuugguguguguuagguuuauuuuugugaguggggaauggcauaugacuguauauuacagacauggguggguuuccuacagauugugaaugggaaaaguuugaguuacucuguugugguauuuguguuauaguauuuucuugcuuucuuuucacucugaguauauguggacauauuuuugauugccuucaccuauuaugugccaacuauuguacuaagugcuggggauacagugguaaacaaaggcuggcccuugcccucaagaaguauguauucuaaugggacagacagggcaaaaauaaaugacaugcaacaucaccaacuguaguaagugguagggagaaaauaaaaaauaaaagcacacagagauuaaugcaagaggguggguuagguuuggggauagauaaucucauacagcacuuuaaauaucugggugugcuucucugagcaagugguagauaaacaggcuuaaaggaugagaauugcuaagaaauggagaacuugaguuucaggcagagggagcaacaugcccagggaguccacagcuggggcaaagugagcaaggaggucauagaagaaggaaagagacaaaacugaaaagugaggcaggggacagauccuaaaagggcuuuuaggugacaguaagaggcuuugauuuuacuaugacugcauucagacaacacugaagcguucuaaguaaauaacacgaccagauuuaaggaacaccccauuuguugaucacuaaguguaugauuauuuguaacacuuagcagaaugugacugucaauggaccucuuuuacaguaugcuuugcuuacaucaguagugugaccauuauguucuuagucacccuggaguaaagaagaguuauuguugggcaugauggcacaucuguaaucccagcuacucaggaggcugaggcagaaggauugcuguagcccagggguucaaguguagccuaggcaacauaggaagaccuuaucucuuaaaaaaagagguuacaauuuauguuaccucaucugaucccaaguguuaucuagcaagggggaaauauuugaauuacuuagaaaacucagaugugauuuuuuaaaucuaccauuuauuacuuauaauuaaucagguacuaugcuauacucuuuucauauauuauuugaaaauaauaugugaagaagauacuauuauuuucauuuuauagauaagcaaacagauuuaguaauguggccaaaguuguauagccuuaaaguauggaguugggauaugagucuguuuuguacaugaaccugaauucuuuacaacuacauucuacugccuauacugaugauuuguuugucacauaacacuaaauuguauagccaggaaaauaauuaagguuuagauuucaaauccauggcuuuuugcccauaacauaccaccucuugacguaguugguuuaaucuguuuuucauagccccaugucaaaaauagaaggggauuagauaccauuuuuagaauuacaauuaagaggucuuaaacuauaaucuaaauaaagauuaagacuugguuaggagaauaagcauuuuaucaauugaaaauaaacuugaaagggauccuuaauauuuugcccacccaggguaaacauucacugcacuaacaauuuucagccaaaggccccagcuaaauucugccaccugggcaaacucuaguccaaugauauucaaagaaauuaaaccguuuuaaaaacugauauguccucuggcaauuuaaugugaguguaucacuguggcauucagcuucagaucauguguugcuguaauaucuucucuuuauaugacugcauuucuguugugugucacugacacggcuugucugauuucaagcccuuucuaucacuccuauuuauugguaacauacaagcuucaaggaucauuugaugugcaaauuuaauugcagguuuuacuuuuaaaggaugacauaagcuauaucauuuuaacaacuguuugcacagcuuuuucuaaacugcuacucagaaaacaggcauuuuuauucuguguauuguaaugcuuccugacuugucaaggcugcuugcucaguaauuaacuuauauguaaguauguauguauguguguauauauauauauauguauguuuauauauacauauauaugaugauguuuugcagugcuucaauagguacaugcuuuggaauuaaacuugggcauuuccccugauuuuuugauaagaggacaccuuaucagcauucacaguuccuuuuuuguauuuacugauuugccccuuucucuuccuuccuuccucgcuuccuucccauugcuauauagcacaugauuauagauaggagagguuaagucuugcuaccuagcuaaugugauaauuuccugacaguauuucagaguuaagguaaaaauacuccagaaaggauugauacuucuguaagaaaugccuuuuuuuuucucuaaauggcacuuaagaacccggaagcacucaugauuuuaauaagcugaaguaguccugucguuuuguuuagaguuuaacuuuuuguggaaaggacaggcuuugaggacauuguagguuuaaaaaugcguuuuacaaggaccuucuagacaauucuuuugauauacauucaccaacauguccagcuagcugauuugguagaauaugagacucuugauaugcacucaucaagcuaauuacaggggaugggaguuccauuugagccaggugaaaugaggaaagucuaaguaaaaucuucauaauuaugggaaauauugauacuacaugccaaaagcuuucauuuucccugcuucaauucuuuguaccuauuguguuucagcagagucuguauuuaaaugggaaauuuucagcagaaaugggaggcucuauaaauauuguuauucaauaauuuguaaggugaauuugcagauguccucauagugacucauaauuuuuccuuauucgucauuagguuuugugacuauuugguuauuucuuuuuucagaaauuuuauguugaaaaguguaaaacugcuaguuacuguauuuuagccaaaaucuaauuaaauagguuuucuccuuuuaaauuugaauuaggaaaauguucugggguauuggaucugaaugagacuguacaaauuggucucauuggucucauuuuacaggugaggaagcagaggcugagagagguuaaguuacucaccaaagguuauagagcuauuaaguggcagacuuggugcacaaacacaagcuuuugguuuccuugugcugaggucuuaacacuuuacaucuaaucuuuaguuauaggacaugaaaggaaaugagaaaucacuuuuuccaccaauuuuuuuguuucuugcugucuuuuuaacugaaauugccaaauaagaucaugucuuauuggagcuguacagugauuucuagguugaaagugacauuuaaaauccauaaucaaauaaguuugugugguguuucccuuaaugcauuccuaaacauugccaauuuaaggcaaaacuaccauuuuguucauuuauauucccuguuacauaauuuugcgguucauuuuucucaaaucaauauuuuccuaacuuagacuacuaaugccaucuauacacuuaauuuaaguauggucucacucuucuaaauaacuucuggaaagaacguauaauauugguccugcuauuuauauuuauucaugccaagaaguguccauuucauuucuuuuuucuuucuuucuuucuuuuuuuuugagauggagucucgugcugucacccaggcuggagugcaauggcacgaucucggcugacugcaaccucugccuccggggcuuaagcaauucugcugccucagccucccaaguagcugggauuacaggcacgugccaccgcgcccagcuaauuuuuguauuuuuaguagagaugggguuucaccauguugcccaggcuggucuugaacuccugaccucagaugauccacuugccucggccucccaaagugcuaggauuacaggugugaaccacugugccuggcucccuuuuuuuguuuuuucuaccuuuaauccuagcucuacagccaaacaauagcuucaacccauacugacucauugaauguuuuaacaaauucccaucauuuacaugccaggcauguuuguccuuuugcaugacuauaauuguaguuagauaugauucucccaaagauaagucauauugcaucuccugucccucuccagguaaauuguuaaagcauuugauugaucauuguauccauacaaauuuaacuaacuuagcauguauguaauugaaauuugauaauauguaguuuagaguauuucuuuagaaacuucuuuuggguuucuuacucucacugaaaaagguauuaaaguuaggagaaggauugguuuagagaagacaaagcagauaguggaucuuauaagaagaaggaaugaaggaccgaugaggaauugggguugaacaguacaggaacugaaagugaaauuuugcuuauacuuccaagaugaauggauugugacauuguugaucgauucugcuugguuguccuaacaauuuauguaagugaccucacaucauuuuggaucugaugaucuuagcuuacagauuauguuacagccuauuuugucugccucuauauuuguaguuacaaaguaugggaauguagggcaagguuaccaguaaagaugugugugugugcaauuuccagcuucaagagcuuuggaaaaaagugcaguaaccaaaucugucacauucgaaauauauaauauuuccugugacuacuucugguaaacugcccuaucauagaaaacugaaggaaucagcaaauacccaugagcuuugcuuagaauuguuccacuaucauugauauccuguguauggauaugaaugacuauggaugguuucaguccaugccauuuuuuuaauauuuggacaaugauuugucauauaucagucugugccagauuagccuuucauaagacuucauuaucaucuuuacugauagauaauucaggagccaaagguauaucagaauuuuguuuaacagcaggguauuaacuguaccuguuaacuuacuauuaggaaacugucuguuuccaagcagcaacauuuuuuggcauuuggcagaccuauggaccauuuuuaagagacaguaucuuaaaaaugacagggauuggaauugggauacucucucagauuucuuucagcucucaaguuuagugauacuuugaaauguuggguuggaauuuuaugauuauaguguuuauuuugauuauauucuucguuuugaaggguuuucuucuugcuacuuuuaauacugauuuucucaucgaggaauuauauuaguacuuucugcuguucucuccauugguuucaagacuuaauauuauuauccucuucucacucccuucaguuucuguguccugccguguuuuuuuuuuucccuaauguccuucuguugcaguuuggguuccccagaaagcagauuuugagauggaaauuaguguucgggaaaguuuauuagaaaguguucuugggggccaggcaugguggcucacgccuguaaucccagcacuuugggaggccgaggccagcagaucaccugaggucaggauuucgagaccagccuggucaacauggugaaacccugucucuauuaaaaacacaaaaaauuagcugggcacuuugggaggccggcagaucaccugaggucaagauuucgagaccagccuggucaacauggugaaaccccaucucuauuaaaaacacaaaaaauuagccaggcguaguggcgcacaccaguagucccagcuauucgggaggagaaucacuugaacccaguaggcggaagcugcagugagccaagauugugccacugcacacuccagccugggcggcagagugaaacuccaucucaaaaaaaaaaaaaaaagaaaaguaaagaaaaaaaaaaagaaagcgcucuugggaucagccccuguggacgaagggaaggaaggaaacacuguugggccaagggggauguugggcugccauguagucucaaauaaaaucugacccuguggggugcuucaaagcugagaggccaccucacccuuguccccaguuggagaaaggggaccaaggcuuugucuuccacaugucaaccaaucuuuggaugugggcuucccugggaagggagugugauacugggugaagugaggccauccugaaagagcugauaguugaagguugucugcaggcagcaccacagcaguuggggaaucaguccuucaguccugaaaggagauguggguggcaugucacaguuuccauucaaucuuuuuugcaggggugcuggagaugggaaggaauggcccaggggaugggucagaauuuucaggaauaaggaguugcagcauacaguggucaggagcuugagagaugguagagaacaaaaguggauguagaauagguucugccaggcaauugacuucugacauugacuauugcuuuucuaaauacauuuuaaaaauucuauuuauagugaugcuuuucacuuuuaaaguuauagaaaccugaugaaaacucugagugcacuauacagagaauguauuuuuguuuuuuacccauuucccauuugccccaagaauacugcacuggcaacaagcagcacuuuuuuauucuaagugagaaauggguuaaagagauggguccugcucagucacacaggcuggaauacaguggcgugaucauagcucacuccugggcucaaacuccugggcucaagcaguucuccugucucagccucaugagcaucuaggacugcugguguguaccaccaugcuuggcugauugcugaauuuuuuguggagauggggucuugguauguugcccaggcugcucuugacuuccuggacucaagggauccucccacccguggccuaucaaagagcugggauuacaggugugagccacuguacccagccugugccauaucuuuauucaaauauaauuugguuuuauaaaacauacagauuuuuuaguuuuauguucuuuauaggcucuuuuuucucucuccauuucuuuaauaauuuaaauauacuuuuuuggugucuucauauuaaaaaucaguugagcacucaauuuucuguuuggcauauuuguuaauaaucacaguaaaucauuuucuccauauuuuguaaucucuaaauuuauaagcucaucuucauuggggauuguuuuuuguuuuguuuuguuuugguuugguuuuucuacccaaagaaaucccguggggccuuguuuaccucucaucacuuuaaaauaguuuuguguuuguuucuucuagauacuuuacagauuucacuggcccaggaucuaauuccuuagauuggagauucuuaauuuuuuuaccuaggagauucucauacaaauaagauucacauuucaaaacuguugugucauagguuuaggauuuuaauuucuuauagcauuuauagcauuuccccuguccucuucacccagauucucagagacaagcucucuuaagucuuaauaugacuaugagugaauuucuccuccccgacaccauuuuuuaacuaugaggauagaccuuugaagacagcccugguuuucuggaagaaucucaguaccaacuuuauaccucgugugcccagggccuccccuucugucccugcauaaguaucaggacugcuuuagaguugugaagguuuaauggggcuggaaauccagcagagugcuuucucucuugagggagcacuuucuucuguucuuucuccuucaagaggcaucuuguuaccaauuucaaucuauacuuaagugcugaagagacuccagugauuauccccauagcuccaguguuggccacagcugacaguguaugcuuuugugcuuacuauuuuggccaucaguucuggcuuugguuuagcaucagggaauuaucuuuauugcaaguaaagcuauguauuuaauuuuguuacacuuauuuucuucuuuucuuagugucuguagugggaagucuucaugagcucaguuggccauauuucuguaccuggaauucccguaaguuacuuauuaacuaccguuucucagauucuaccucucuaaaaugggaguaauaauggugucuguguauauagcguuaauuuagaccacacaguaagcuuucagucaaugcuagccaguauuauuuucaccauuuaaaacuuaaaaaaaaaaucaucuuaggcaagaguuggaaguguagugguagcuguguuuacuuacuuaacaagaggaggaaaucuuaguuaacgcccuagagaaaccaaaucagaaauuuuguuugguacaguacaaugccgaaacugacgcuuagagucccacccuuucugacguugugccaaaggucacuuggcacauaaguaaacugaguggaauggccucucaauauugccuggacgauugcuuagaggaguauuuccugaacuguguggguagguaaguuugaauuuguuaauauuuucuuugcuaaggagggcucucaaaggcguaauuauuauaaaggguauuuguagaccuugaaacauguagcaauacuuuuaguccaaguaagcccuuugauugcuuuuuaacuucccauuuaguauuccaaguggauucugaacuuggugaaauuagugguaacccagucuccucagggucuugccuccugucuucuggcuuacagagguggagauucaaaggauuucuuuccuuuaggucaugguauuuaagagaauaauuuuccccucauauuauagcuaagaagaggucuguugacuauuacagauugggaauccaugggcauaauauacgaaauguuuaaaaaauuacuuugaacuuaaccuuauaugcaaaacauugauuaucuuauaaauauuaacugcuuuggauuguuuacacaauguuaguuguacuaugaaaauuugcuuauuaaccagguuuagacuucuuagguuguucuuggcuuugaguccacagauuuaacacugccaaauuucuguguaaacauuuugcuugggaccuaaaauacaguugaauauguguauuuaaaguuuuuuuuuuuaaagcccauguauauuaauggaacuuguaaauguuuaaauagucaauuaauggaagcuuuuaagaaacaacucuuucaaaauauucaauuuuauaauuaugauguuuuaaauaucaaacuugaguuagugacaaacauguaauucauaauauauaaagaucuauaaguaguucuuauugauuuauuacauuuaaucuuacucagaaggaacuuuuuuguuauuauucugucacuaauaauuaagugcaaggcuauuuaaaaacaaauaagagcuaauaacauuguaacacagacuagauagagagcaaaaauaaauaacugauuaaguuacuguuuuggucuugggaaaugugguagguucuugaguuuaggugccaugguuauggcuguuuugauccuuuuuugaaauacauucuuggauguguugauuuucuuguaaugucacuauuauuucuuaagacccuuauauacuguaaagagcauuaucaauuuacacaaauuuuaacuacccauagaaauauuguauacagcuuuuuuguagcauaaauaggugaaguuccucaagauguuuauggccugguauauucuuacccuugcuauaaagcuuuggucagcuuuaguggccaaacucuaaggcaaauggcaguauuaauguggaguguaaaucuccauauauguucuuggaaugguauguaaaauauuuuguucccugauccaccuguccccaccuuuaguaagauacccuugugucugcaguagcuugaguuauaaaagagguuuccguuuuucagcaacuagacuuggaaacaaauuuuuucaguuuaacuuaagcaaauuguauauaagaggaaaugacuauggaggagauacgcugcuuagucucauuucuauguaaauaguucugacauaaauuguauagagaagucuccuuuguaguuuacuuuucagugaugucauuugucauuaaaucgucaagguagguaugaaccuuggaguuuuaaggugacaaaaaugaacucauuacacuuuagacuuuuggccagguucuguaacuuaugccuguaaucccagcacuuugggagacugaggcaggaggauugcuugagcccaugaguucaaggccagccugggcaucauagugagaccuugucucuaccaaaauaaauaaauaaauaaauaaauaaauaaauaaauaaauaaauaaauaagccuggcaugguggugcaugccuguagucccagcuacucaagagacuaaguuagggaggauggcuugaucccaggagacugagacugccaugagcugugauugugccauugcacuccagcaagggcgacagagugagacugucuuagaaaaaauucuagccuuuuaaauaauaguguaguugaauuguauaaauauuuuuugaagagaauauaauaagguagguuaucauguagucuuuuugaucauuuauuuauaggauauuucuaauguaaacaauccaguauuuuaaaauuuccuuuuuuuuagaguuuguuuguguauuuguuuugacuuguuuaauuugacauguaagcacuuaaaaauugacuuuccagcuacaugaagaaauuauacgucgguuaaauuuguggcauuuuuauacagaaucguguguacaaaauauauuaacuagguuuguuaauuugauuagaaaaaacuugugguaguuuuaaugcucaauauauuuucuaaaaugcaaaagcaauuugugaaauauugucucucuguacuugguaauguaagaucugagcugaaugaaaugugaguuucuuaagcuugucuuagauuuuguaucaacauuuguucaagagcuugguuuuaggaacauuugugugcauuuucuugauuauuaaaaauucuuugugucauauuuagauguaauuuagagcaauauuauuuaacuuugccaauuauauuauucugaucacuagauuuaaugcucugguaacaacucucugacaacucauuauuacucuaguauuagauuccauuggauucuuuaucuuccuuguuucuaaaaaaaugccuuuccucauuaugcaaguaauuuuucuuuauuucaccauuuauacaguuggccagaccaaaugacauagugaguaucccuuaagccaggggucccccaaccccugggccaugguucaguaccgguuggcagccuuuuaggaacugggccgcacagcagaaggugagcaguaggccagcaagcaucacugccugagcucugccuccugucagaucagcaacaucauuagauucucauaggagucgaaccccauugugaacugcacaugugagggaucuagguuacguguuccuuaugacaaucuaacuaaugccugaugaucugagguggaacaguuucauucugauccaucccgccuacuccugccuuggaaaaauugucuuccaugaaaccagucccuggugccaaaaaggcuggggaccacugcguuaagcagagccgugaauaucaaucuuggacacaaagccugggauuguggguggggaaagcccucccguugcucuggccuggcauuccaaagacucuuucaauucucuuaacuuauucaaagccuggauucuaaaagccaauugggcucccuuugcccauucauaauucaugcuacagucuucuggcuaaaaauugucaguagaguuuccauuucccauuauaugaaauucaauguccaguguguaacuuaucuuuugagucguguaucuuaauguauggcuuaagcuucuucuuuaugcuuuacaguuuccauuuccugccuuuuuuucuugacacgugguguaauuagaaagucucucccucauauucaaaauuuaccucauccuuaagguuuacugaccacugccauuaaauuuuucuugguuucaccuucuuuuuucugcauuuuauaccaguguuuuguguuccaucuucuguuauauuuauuuuuacauguguuauauuuuacuuccuuucuaaugacugaguuuaacugauugaauuacuuaaagucuaucucuuacuaugauggguuagaggugguuuugucuuguuucuucuagguugccuugcauucaguacaugcuuauuauaaauauuugguuacugaaaaaaaugaagugauaugacaguguuauugauuacaagacauuuuacuccuuuguuggaauggacauuuggggacaggggaucaacuggaaaucuaaacaaguguggcauggcucucugaaucaggcuguccccagcagggaaagcugaugaaacaauuaaggcugcagcuaagaaauguuuuaaaucauguugcauaguggcucaauacugacaggcaaaggacagcucuuacuagggaaagacuuuggacugauaggaaauugaagagaaacacaggcuuuguagauagugacuacauuucuaacucagauaacauuuucugugaguucauagugugagaauaaauacagucaauucugcuguaaugauuguuuugaaaaaugggaguuuuuauucuuucaugauugauauuaggcaacacuuugagcauaaugcaaauuucacuuuugcuuaugcgugauuucaccugagaaauaguaggcgugcacagaaaauuucacccaacuaaaaugagcugccuaggcuacacaaaguguacaugcacacaucucagacauugccuggcugucucacuuugccacauguuaugagccauauucauucauauuuuguauuauaauuuccccuccaauuucagauaacccaucuugcaccacuucccaauaauuuacaugcaaggcuuguggcugccuggaauagaaauauuucuuucccacaaauaacaauuauguuaacauuuuugagccuuaacuaugugcuaagcacuaugauaagugcuuaacauggauuauguuauggaauucucacaaaaccugauacaguagguauuauuacugucuuuacagaugaggaaagugaggcuuagagggguuaauuaacuugcccauggucaauaacucauaaauggcagagccaauucuugaaucgagucugauuuagaucuuaguguucucuuacuuuguagauuacagauaaguagcuuucacuuguguuauuucauaugcauuuaauaacugucucugauuggcaucauaggcuguuucgaucccuaugauagaugaggaaacaacgcuacucaggguaagaaugcacagaucaucauaggcagagcaauaacaggaacucauucucauaccuaaaucagaauuuuuuuccuggggcuuauacauaaaaggggaagaaaacaauuagagaauuagagauagggaggugaacugaacuacaaaaagaggaugaaaugauuguguuggaaguuggggaacaaaagaaggugaguuauaauaguacuucagaauuguaaggagagagucuaaugaaaaaugaacacuaggggacuuguaacucugugguacauaaagccuaaucaaauucuuacaaaggaauuaaaaccaccaacuucauuacaagauugugguaagagaaaucugaucaugagcauaaaucacuaguaguaauacgcucagaaaucagagggaagagcaaggcgauaccagaggaagacuucggaaggauuuauuuguauuuguuuuguagcaugugauuuuuuuuuuuuuuaagguagugaguuaccuuacaggcccuuacagauaagcaaguacuugauuaguguuuguuauacugaaagcuuaauaaauaguaaggagaguaguuguucaguuggguauugauuaaggugaaguaauaggaaaaguaaggguagaaucgaugaguaaugaugaacucaaagcagagggucagcaaacucuagccauugggcuguuuucuuucuacaagcugagaaugcuuuuuacauuuuugguagguuauuaaaaacaaaaaugaagaauauugacagagacuguauguggcccacaaagccuaaaauauuuauaaccuggcucuuuaccgaaaguuugucaaccccugaccugaaauacauaccaugaagaaaaaaguuagacuuguucccuuuuaggaaauuggauuagguacuguaaaguguaauauuucauggggcuacauuuucaaacaugugccuuuuucccacauggaggaaagaacugucauguauuuagccugcucuuuugcuauagggguuuugcauacuucgauuguucuuaaccuugagagauacuauaaccacuuuacaaaugaagaaacuaggcucauagaggcuaaguaagccuaaaguuuuacauuuaauaaggacugaaauguaagcuugucuggcuugcuaacuagauaucaaauaugggcauuuguauaaauuuaguuaguauguaaaauagaaaaaaaacuuguacacauagacaauagaguagguuggagaauugugucauuuuauuacaaaauuugcccaaggaagaauaucuuuggauaaguuguaaaaaaaaacauaaaauauaaagaacagaaaauucuagucucauauuaaaaauguaauauucaccuaaaagaaagaugagauucaagauguuuuugaaagaaaaugcaaaauacaaaaguguguuuugcuucaauagaaaguauaccagcuaguacuuuauuuuugaaaugcagauauuaagcaaauauuggcccaaaugucuaacaguaaagauuuaugaagagaauuucagagugcugugaaaacauguaauguagaaaucuaggauagauugggagucagggaaugguuucccaagaaggggccauuuaagcugagauacaagauuuagauaggcaaagauauaaaagauaauuauucuagacaagugugauaggccucgaggaaggaagaacuuggcauugucaaugcugcagugcuucccgccuugccuuuugaaucccagguuccacgcaggaaaaggcaaggccaggcuccuccccucugcaaaggugcaaacuugcucaggcuccaccccagugcacaggccggcaggagcuuugccagggauccccucccacuuagcugucucaaugggagggaccauuuuacaagauguuuaccauacugguuugcagaauuagagagaguaaccuuaggugaggagaagacugggauuuggagacagaaggaaagaaaauagauucagggucauucuugaauguuagccuucuuugaguuaaaaaaaaaauagcugauaggugguagcagcaacacaugugccucugauuguacaagaauuuaauaaugauacuuguguauguuuuacauaagcuuaaacuuuagugaacuuuaguuaaugauaucaaacauugaggguuuuaaugucuuucuacuggauaucauaagucuguuuuuccuuacgaaaaggguaauauuggcuagccguugagguuaguguuugcuaagaguuggaaguuuugaacagugaggaaaacaaugucacugggcucauuuccaagaggguauucuaacuauugcagucaacaacugauuugccauaaaaugucaauaacuuuuuaaaaggaagguacauucauguguuuauuuugcuuuuuaaaugaguguuaaguacuuuaauuagcaucauuuuauaauuauugauauuuuguaugggauuuaauaauggauuaguuaauuaugaaaacaagaucuaaauguuuucuucuccaauugccguuaaaauuuguugaaaucaccuuauugaacagauuuuuuuuaaaccccuuggaguacuaguggguguuauuuuguugaaugaauguuuuacccaaacuuauaugcauauuagauuguuuaaaagcucaauuaaaaagugaaaaauagacacugaaaauuuuuugagugauuucacauguguucaugaaacaauauaucuauuacaaaucauugaauauuuuaaaaguaaugucauguauucauuuucuuauuuuaucuccucaguagacugagaucaguguguaggggugaagcaaggaguccuacucuguuugacuaagguaaaaauuaagaaucagugagaaauggaauuugcaaaagugccugccagauaauguuagaacuggaccagaaaauaggaguugguauaaaacuagaccagcgagcuuuuuuuuccuucaagaugcaguucaguuuauugcuuuuguaaauuagagauuguguuucuugaucuuuauuaaaguagaauacaauguuaaccuacuucaaauuuuaaaaaauauacacacauguauauguauguguguguguauauacacacaggauuuuaaggacaguuuuuugugugugugugugcaugcgcacgcaugccaaggaaauuguuaaucuucuaguacauccccauaacagaggcagcuacaauaagaucuagucuuugccuuacagaccagguggcuuuaccugauaggcucacagacauucaguaguucauuuguuccucagauuucucuaauuauugugauaaaguugauauuaaauuuaccaacuuaaccaucuuuaaauguauaguuuauugucauuaaguguauucacauuguugugcagccaucaugaccauccaucucuaggaguuuuucaucuuccugaauggaaucucugugccccaaaacaauaacuacccauucuccaccuuccacagccccuggcagccaccauuaugcuuucugugucuuugaauuugacuauuccaaguucuucauuuaaggagaaucauagaguauuuguccuuuugugacuggcuuauuuuacuuaguguaauggcuucaggguucauccauguuguaguauguaugagagaugucuguuuccuuuuaaaggauaaauaauucccuuauguagauguaugauauuuuacuuauucaucugugaauggacaacacuuggguugcaucuaccuuuuggcucucgugaauaauguugauaugagcauggguguacaaauaucuagucucuacuuucaguucuuuuggguauacacccagaagaagaacugcuggaucauauaguaauucuaugcuugauuuuuuugaggagcugccauacuguuuuccacaaugacuacaccauuaaagggauauuuuaaaugaacgaacaaaaaaacccagcaggaaaacccucuauucuuacagucuuuggaauuuuacaaugaacuuucuaaaauaggaugaagauagcuucauuggauuucuuguguaacuaauaauucuaggaaguguggucucuguccuuagagguaaguggugggcagauuuaaaauuaauauaucgguuucucuuuggauaauuacggaguuuggagacauuaggggaauaacaaaggugagucuaaguuuuuccaaaaaaaaaaaaaaaaaaaaaaacaaauacauagagcagaauacaggugggaagauuccuauagaaaugaaagagacagauacaauuaucucaaauaaucaacuuugcuuccugaaagugucaacuucguucucugaucuagucugccuuccagaaugccugcauaguuauuuucuuaaacauuaguaauaugauuguuacuccuuaccaucuccuaaaagauuaaguccaaauuccuuuauaugcucuacaaggccccucacaaucuggcaucaagcuuuucuucaucacaucuucuuuucauauauucuguauugcagccacacugaauaucucacuauucccugaaauucauguccuuccauauccuuuguauaugucuggaauguucucuaauuaccuguaccuguaccaacuggugcacuccucacugucuuucaagaccugauguuacugucucuuccuauaugaaaccuacaagcagcuuccauagguagacacuuuccuaguacauuguucauacaguaauaacauuuacuaaaaugcauuguaauuaucuguuuguauaucuauccaucuugcugaacugaauguucccagaggagagaaaguauguuuauuauaugucaucaugcaaagcacaauaccuuguaggcauaaauguccaaaaaauaccaaaugaacuuauuuuucuuuauuuauuuuuauuuuuauuuauuuuuugagacggagucucgcuccaucaccaggcuggagugcaguggcgugaucuuggcucacugcaacuuccaccucuuggguucaagcgauucuuguggcucagccucccgaguagcugggacuacaggcacacgccacugcacccagcuaauuuuuguauuuuuaguggagaugggguuucacuauguuggccaggauggucucaaucuccugaccuugugauccacccaccucggccucccaaagugcugggauuaaaggccugagccaccgcgcccagccucgaaugaacuuauuaugugguuuugcucacucuauugaauguuuaccuuuaauaaccauuacgugcauaagcuagaauuccuuucauaauuucacuauuauuaauauacuggauauauauguauuggauauagguaaaauauuaagcaugcaauuuuuuucuucauauuuauauauuguauuggauauguguuuuggauauagguaaaaauauuaggcaugcaauuuuuuucuucauauuuaauauacuggauauauguuuuagagauagguaaaaacauuaagcaugcauuuuuuuucuucaguaguuugcugcugcucuaugaagauuuccagacacugaucucauagacauucauacauuaccccagaguccucuuauccuaggagaaaguaucucauaauccacacuuaaauguuaaugacauaauacauuauuacucccagaaguguuuguaguuuaaaagugcuuccuauggaugaaaaugcuuaacucaaaagaaugaauuaauuuccagugcuagaauuuuauucaccuugucgccuguguaaacgauagauuuuaaggaaauaggaugauacucucucaacccuaaaaucacacuggacaggcaggcuuccaagagcaccucugaaucuuuagcaucuccagagugguguuaacagggggaauauauucuguuuccuuaggcugcugcucuaagcacuuugcccuuuuggaauaaauuuguucuucuuauacugccuccuaauaaucugcacggcagagaaaugugguuuaucucauggugcuuagccugacucacaaacuacuuaagaauuucuuuuucacauguguagucauuuaauauuuaaacuaguuuccaugaaccaguuauaaauaugagugaauacuuauuagcugacuugacaucuaaaaggaugucuuucuacugaaagcaaaauauuguaagagucagauguuugaacucuuuuuagucuagauuacucaagaggaaacaaacagcaagaucccauuuaauugcuuguuauuuugaagaaggaaauguuauguuauuuuucuuccccuaagggccguguccagggcaguaucauuuugguguuuuuauaggucugugagauauuuccaauguuucgaaacuaaaaaacaagugagauugacauaaauguaucuggacaguguaauguuucaaagcuuauccaaguaguuguucuuucagauugaagacuugguauuauuuguacuaaaguccuauugauauaauuaguuacauuaaaaauuuuaaacuaauggaugagaaggacauaccugaauccaggcauggauuauguagaugugaaauguuaauacauaucuguauauguguaauuguguguguguguaugcuuaaguguguuuaaguuacuaucaaguauucuaaagggggaugagucacacauacagacauagcauagaaacugaguuugggcuuuuguguuggucugccugugucugaggcuuuaccauguacuaacugugauacugagcaaggcacuucugugccccaguuuccucaucuguaaacuagagauaaaaguaguaccugccuuuuagaguuaugcuuaucaauugaauuaaugcaugcaaagaacuuacaacaacguuugacacauauauggauuuaauaaguguuauuguuuuuguaaauuauuauuaaauauuggugacacaguugauucagagagagaaaagaauuaccuuuuaaaaaagugacuauuuugaagccaaagauauuaguuaauuuagcagauugaagucauaagguuguuuaucauuaagagacuaugguauaaagauggacacagguagguaguaguuuauucuuuauaauauaccuuacauuaccaauuuuugacuauuuuuaaagucuccuuucuccugaccguauguuuaugaaaauguucuuuacuuugaaaccuggcuggguuuagaaaauauauguccuuugucuauuuugugauagacuucaauuuugucuaaucaguguuugaaagaaauggcacuuguauggacuuccuuccaagaaaaacauuggguguuucaggaaguggucuuggugagucagagcauaguacuuuuuccucugagucaguuuugaaccuccuugauauaaauaggcaugcuuuuaccaaaaguucugcuuuucacauguuaaaaucaucauugauacauggcuacacuaagagcagugccuucauugguuuuucugcucaguuggcauugaggcucuuuuaucuaauugugacuguagaaauucuguggaauaaauuucuuuuuaaauuuucaauuuaauucuauacuucuaaauuaguuucuguuuucacaccaauuuugcuucagaaaggaguggagucaggugaccaguuauguaaauuuuagaggaauuuauauuggugauaauauacacuuuaaucauuagaauucuaugacuucucuuuuagcccacacauauaacucuuuauagcacaauuucaguucagggauuauuuugcaaaagacuguacuaguuugccacaccucagaauuguuuagaagauagaaaagaauacguuagagugguucuucauaaccacauuaaaaaacauuaaacaugauaaauaauugccaauugacuagauauuguuaacguugaguugguuagggaagaguuucuuuuuuuguuguuguuguuuuugagauggagucucauucugucccccaggcugcagugcagaggcaugaucucagcucacugcaacuuccgccuccuguguucaaacaauucuugugccucagccuccagaguagcuacgacuacacguuguguagcaccacguccggcuaauguuuguguuuuuaguagagaugggguuucaccauguuggccaggcuggucuugaacuccugaccucaugaucugcccacuuuagccucccaaagugcuggcauuacaggcgugagccaccgcaccuggccuaagggaagacuuuuaaaaaggggugggaauugaggaauugagaaauugcuagaugggaaguauaaaguaguggaaagggcauuuaggguaagaauagacacuuaaaguugggucagucaagauaugcucaggacaguggugggaaugaggguuuauauguaggaguauuugagagaauauggauuacuggaaaaauuauguaagccaaaauuauggucgagccucgaaugguacacuaaaguuguaugugugacuacauaguugguaacauuguuuaauugucauauauuucucuugaguuguaauugguugaauacaacugguuuuuagugaauuucauuuuauaacuaguauuuaaagaaaacuucucuauuucucuuaaauauaugauccugcaggaaaauaaaggaacugagagauauagaugucaaaugaucugugugugcuuuugcauauaauccucauaacaaucauucucauuuuacaggugaguaaaccgaagcugagauaggauaaugacuugucuaaggucacagagagauguuagucaggauuuacacuuagggcugcucaucuucauacuauuuucuuuucacuauggcaaaauaccacaauaaaagcucugggacauacucaguaaguuuuuauuauuuccaauagcugugaaaaagcaacucaaagguauuuuucuucugaacagaaguauuauuuucuuuuaggaauaggucuuuggacucuaggaaacugccuuguggguaagcuugcucuccuccucuuggggagcaguuuucuguaagguuugcaggggcagucacaucgguggagggaucauuuguagguuguggugagccaugcuguggaucaucuguccuuugcccauuuauauuaguagauugauggucauuuacauuuuuucaaaucugaagcaucugggccuugauuaguuggaaucuuugauuuucauucuugacauauacaacaauuacaagaauaugcuacauuguuuuauucuauuuccuucauaauggggaagcagucauguggcucuuggcaaaacugaccuugccugagguuucaacagaggcaguugagauuaaacaccauucuuguaaacacugaaucuccuaucuccuaaauuucaaacuggcauccuggaaaaauuucuuuguuaggaucuggaauugaacagcucaguucuuaggagggcagggaaagucaucauguuuuccccagcuaaauaguuugaaugugcuacuaugugccgguacgugcuauuccuggggcuucuuagcagcuaaauuuuuuuuuuuuuuuuaaagaggaugaagauuuauuuuuccacuccauuugaggaaaauaaggaaguuggcuggcaauaagagaggucaagauggagaggcuggaggagagagaugucuguuuacuguguggaugagguuaacuuaaagagcggggguuggggagucuaguugacacugcuuguucuuuuccuugaguaguucucguuagaagcuagagcugcugaauuuuuucuguuuuaacuuacuugguuaaaauauuuauuaguaagauuuuaaaauuacuuuuagaacauuguuuuauucugucuuuucuuauaagaagauuugagauaaacaucuccauuuggccaaguaauaaaauauucacaggcauaauuuuuuauaaaauauuuuagaaaauuguagaguuuuuccauuuuuccuuuauuaaacaguuucagaaagccuuuuaaaauacauauuucuuucauaaucauucauauguccccaugcuuuguaaaacauauguugccucaaaguuggauauaagagugucaauucuaguuuuauugauagcuuuuauacaacuggaaauauguucccauagagaaauuucuguaauagacaugaacuucauggaacaaagucaaggugaugccaugcucuuuuggaauuuggugauucuuuugucacuuuaguguccauugucuuuauucugguacuaucuuggccuuuauauugauccuauuucuaauaauccugaucaucuacugcuuggacucccuaaacuuucagaauccaguucccuuuuuuucuuacuuaucaguaaagcuagauuaucaguucuuuuuuauacagauguaggacuaucaucuguaauuuuuggcaaaagaagaaaaaaauccauguaguucuuuuuagaggucaugugagcaugugauuuuuggguaaaaaacucuagccauuauuuuccucuauguggcaaagugguugaauuuuaucccacaucuacuauuaauuaccucuuugacagugaacauguuauuaaacucuguaccuagcuuauucaucuguaaagugggaaugguaauuguuccuacuucaugaggcaguugugacaauuaaaagaaaaugacacauguaaagcagugccugcuaugccguguuuucuagaugugagccauugccgcugcugcugcuguucugccucuuccucuuccugcugucacugcuauuggcaguuuguaauaguuuaguuuuccuucaugcccugauuuuguaccaccauuuggcuuagaaugggggacagcaguuaugccauguaagugauauccaguuuauuuaaucaagagcuggaguuaauuugggggguuauuuagacauuuuaaucaguuugugcuugucccucaaguuuucccuucuucagucuauaggccauuuucccaaaucaguuugugcuugucccucaaguuuucccuucuucagucuauaggccauuuucccaguugguuagagaugggaacugugggaauagaaagaaagaaaugcaaaugcuggccuuacgauaauucccucuucaaaucuccucuucuuucugaccuaaaauagcuuacuuacccaaacaaaucuaucugaaauucccaaacaaaaaucuauauaaugugauccgggaacaugaagguucuuuggucacucucccuucccugcuaauccaaacaccuuuuuucacuuauuaauucacuauaaagugguguguuucugcuugguuuuaauuccacaugcccgaguuuaggaauguaauuccuggcaaauauuuuuggggguuuauagauugacacuggccucaaaguggacauguaaaaaaagucccauuucuucccaaguggaauaguaguucagguguuuuucucugaccuucugauucaucaaguccauguuuuuguuuuuuuauuugagacagagucucgcucugucgccaggcuggaguucaauggugcgaucuuggcucacugcaaccuccgccuccuggguucaagcaauucuucugccuuagccucccgaguagcugggauuacagguauaugucaucaugcccagcuaauuuuuuguauuuuuaguaaaaaugggguuucacgaugcuggccaggcuggucuugaacuccugaccucgugaucugccugccuuggccucccaaagugcugggauuacaguugugagccacugcacccggccaaguccauguucuuaaacuuggaaagucucuaaaguuaguguuuuauagauuuuacuguuuuauuuuuguguuucuucaucccuacugucuuuuauuuugcuuauguucaaacugcuaccugaaauauaauaaauaauagcauucucauucagaauuauuuuuacauauuuuuugucaacagaguacuguuucaccuugucuugaaacauuaaaaacacuuucaauaaaugcauaaauucuuuguuuuaaagguagacuaauuauccuggauuuuaaauagagaaauccugagagaacauuuucagaaugaaucucucagucccauacuuuugagaaguucauagcuagguuugaugcagucuguguuuguauccuuauaaacgcuaucuguuuuauuuuuacuuuuuaauaaauuaacagaaguugucauauuuauucuuuuugcaaccuccgccuccugggcucaagugauucuccugucucagccucccgaguagcugggauuacaggugccugccaccaugucuggcugauuuuuauauuuuugguagagaugggguuucgccauuuuggccaggcuggucucaaacuccugaccucaggugauccacccaccucggccucccaaagugcugggauuauaggugugggccaccaugcccugccucauuuucuuauuucaugcucuccucccucuagauuguaagcuccaugaagguaggaacccugucuguuuugcuaaccaugcacucaauauguagagcuacccugucuagugugguagcuguuagucuauaugugguuauuaacauuuaaauguaaacuaauuuauauguaauaaaacuuaaaauucaguuucuuaguggcacuagccacauuucaagugcucaacacuugugcucagcuacuguauugagcagugcuaauauagugcauuucuauuauucuaggaaguuguaugggacugugcgagagcacugaugggcacauucugguuacguaguaauuauuuguuaaaugagcgaaugaaugaaguaguacucagauuggcaggugccaauuaauguugaaugaaucuuguuugaauaaucauguuuaaaaguuauuuuaguuuuuaauuaauccauguugacauuuccccagccaacuucaaaauacuggauuuaucauuaguaaaaggaaaguauauaauagugguuaaaagcacaacuuguugcugaugucauggccaaauuaccuuuacuuauaacucuaauuuaaagucucagauucucauuaaaaugagaauaagaaguucuuuuuaccucuuaauaagaaguaagauaaugcauguaaagugcuugcacaguggcugacauaauaaaauacuuaaugagcauuauuuuuacaauaaugaaauagugaaauaugucuaaauuuaccucauucgugggugauuucaugguuaugaaaaaauuuacugcugguuuugagaacuucuauuauaauuucacaauuuucaaagguaaugcuauucacagucaaagcuuauauuuacugacuuuuaaauaugaaauauaauaggcucaauuauuuuuuccauuggaauuaacuuuucuuccuuuauuuuuuaaugacuauguaagcagguaaacucucaagaagagaguuucauacuacuuuuauaggcaacuugaauuuuaaaacuaauguacaaauaucucugcuuuuguuuuggaguaguccacgaauaauuuguucccagcuguaucaauuuaaaugggcuucucuuugggaaaaaauuaauaaagaauggauaaaguagugguuauuuaccuaaggaugaauuccagguuuuauuuaggcaccuaacucuguuaugauuuaauuucuagaaaagcaauuaaagcaagagcuuuucgugaacaguaaugucugauuuaacugggguuauugccucacguccaugcuuuagcguauuguuuuuucucugggauuugaaaacagaauuuguuguuauaauaacaauagguaguuaaacauauacuaccaaaauaccagcugacuuuaucaaauguaaauuuccuucauuuuuuuuuguguuacuuucacucugguuguuaugguaccuuuguuuuuaguauaaacuuguacucauauuucauaguccaccugaaccucucaaguucacauuagaggugacuugaauuuuucaucuggguuuuucauugacaaauauuucuuaauguuuagacaaugaaaauaugcuacagaaaaauggcagacuaagcauauacauuuguuucauuuuuugaaaaauuuuacuugaaguucugggauacaugugcucaaugugcagguuuguuacauagguauacguguuccauugugguuugcugccccugucaacccaucaccuagguguuaagacccgcaugcauuagcuauuuguccugaugcucucccuccucuugccccaccuccaucugacaggccuugguguguauuuuuuccccucccuguguccauguguucucauuguucagcucucaguuaugagugagaauaugcaguguuugguuuucuguuccuguguuaguuuccugaggaugauggcuuccagcuucauccacgucccugcaaaggacauguuuucauuccuuuuuauggcugcauaguauuccauggugguauaugcauuuauuucacuuccuccaaauaaaauaacaguaaagggauuuuuaaaugcagaaagccagugagacaaagggacucuauaaagccuguggauaauugugauuaaccuagaaguccuuacaugcugaaaccuaagcuacuauugagagacauugagaagcaaccuuauuuucauuucagaaccuccaacugacucaacagugagagugaggcuaagaauaguaggauuuauuagucauguguuuaaagugaacuuggaucccagaugccuccucacacuccaguaaaaccaguaguuuauucuguggagaaugugaacuagagaacucgguuggggauaccaagguacagacagagggugaaagaugaaaugaaaugcuuaguaaacaguaagacaacccuggcugacuucuuccacuuauugccaaaguuuuggcagucagcuuuacauucucuaaacauggaaugggaagauacuuccuuggagaaccugacugaucuaugcaaaagaccgauagacacugauggcuggggucugccagcaggacuucugugcagugaagcccacuuguucacaagccccacccauggacacugacuuucuugccaccuuuuuagggcuucaucuucaauaugaguaauaaccaguaaucaccugauauuuaaagcaauucagaagccaaaacaaaccuagcgaaaacaaggaaauugucauaaagagacaaugaagggagaagaaaacuuaaaaauauuaucauggauauucucagaaagaucagagaauauacuguaaucagaaaauaaguauagacacuaaaagaaaaggaagcuuuagguucuaaaaauguacuccugaaaaauggaacugauagaagaaauaagaaacucaaaauguuuuuugaauauaaagaagaggaagcuacccagaaaguagaaaaaaaaauuacaaaaugaaaaacaaaagagaaaauacaaaaguagagacuuagaccaggagguccuacucugagcaacugaauuuuuuagaaaaaggaaaaguauauauagcaaggaaacuaucaaagaaauagcaaaagaaaauuucccggacuuuaggaaaaugauuuucaaguuugaaaaggccuauuguguuuccaauaugcugaauuuuucaaaaaacacccauacuaauguauagcaccauaacauuucagaacaucagggguaaaaaugaagauccuagacuccagacagaagaaaacagacaggcucuauacaaaaaauugggagucagaguggccccuaacauucagcaggggucauugaagacagaaccacaagggcuucaaaauuauggggcaaaaaaaaaaaaaaaaaaaaaaaaccaaaccucuuucaaucuacaauuugaaaccaagacaaacgguccaucauguguaaagguaaaauaaacacauuuuucaucauauacaguuucaaaaauguacauuucuaaugcucuuucuuaggaagucccugaaguaugugcccuaccaaaauaaaaaaguaaaagcauggaaagagggagguccaggauccaggaaguaaggcuccaagacagggggaacgugaaggggauacacaagguggugaggaauguggaucccgugaugaaagcucuucggagccuuagagaguaaucaguucagaguggagcagucauauaucugggaaagaagccugcagaaagacagaaauguuagaguaaugauagaauggguggugcuucaauguauugaaaggagggcuccacuucuggugguguaaaguaauaaaauuaacgagggggacauaggaucacuaagaguuggggggaaagauaauuauuaacaaacagaagacaaauauauaaaaauggaaggguauucuuaguauacugugaauagcauuuacauagauucaauaaguaaacacugaauuuuagucucacaaaaaugugguguaucuguaauucguccucugugauaugauucucacuucaucuccaaccucaucccucauaacuuccugccaaacugcugacaguuuccuaaguguccaaagccaucuccugccuuugcucuucucuuuugccuucuggcuuacucagcuccugcaucacagccugugaaggaaggcaguuaugaaccgaaugucucccgcuuccagcccuaggcgcaggccuugcauacugucuuucuacuugccacauuguacuauaaaugauccuuuugaugucucucugccccauuauacuauauauuucuaaaagucauuaucuuucuuuuuuguuaauuuuuuuuuauugguagaaaugggaccuuacuauguugaccaggcuggucuugaauuccuggccucaagcaauacccccaccuugacuucccaaaguguugggauuacaggcauaguaaaucacugugcccagccucucuugccuuuuuuggucuagucauucuuucagggagauuuuauccucuagauccaccccuaaucuaguugcccuugaacuucacacuuugcugucuucuauugccuauaauguggucuuuucuuaaagaugcuuuuucuuuccccuaaaauuucuuuauaagcagugaagcuucaaggaaaguuuguccuagcuuuucugugaguuggaugaggugcuagagauuuguuuucuuaguaggauuaccuacugacaaucuggcuuguuuuuuuuauauucagccaaguguagacaguuaguggaacugacuuuuuuguuuggucuugacucuucuuuauugcaucacuuucuagcagccuauuaggacugccucuauucuugaagauaaaugaaaaauacuauuuugaaaagagugcauuuuuaucuuugugggcaaaauguuaagaggcauaggauaauaggaagaaggaacaguuaagaauugaggguuuuaacuuaccugcuuagucgugaacuuuucauagacauaaaguuauacauuuugcucuugauacagucugauaccuagaaaaguauacaacguauucuguuagaaagcaauuacauucccccauauaaucauucugcuggccauuggaucuguaaaaccauguauuacuaaaauagagcagacaaauugaaacaauggauaauccuugauaagauauaauaccucuguguucccuuaucaaaacaaucaauguuagaauauuauggcaggcaggaagagaggaaguugagauaagaaauagugacuaucaauaaaauauaugagaaguaguuuggggguaguguaaguaugugcauuauaauacacuagaaagauuuaguuaaccuuuaaaaaaauagaauucuuaugcuuuuuaaagagucccaugugguuuaacaauuaaguuuuuacuuguaguaauauucgggagauguauuuaugauuuagagaagugggaugaaucaguacagcaguugccuaaagauaccauuuuccacuucguauguuguaagcauuuauaaagauauauuguacacuuuagaaaagauugauccucuuaaggagcuauacggaaaugcagugagucaccugcaguauuuuguuugcugcuuaauguccuuugcucuaggugaugcagaggaagguaaucauguggugacagggugguuaaauauuaaaauauuauaucucauccuuggguuacagcucuucuugcuguaccuguaauguuuuaugauuuacuauuuuuagaugccauuuaauacaccagaaugaaauuugaauucaggcguuucagucucauuaaagaugauauuaccaauguuucucuucuccugguccaccuccuuccccaacucccagccucugcuaacuaccauccuacuuucuacuuccgugaauccaacuuuuuuagagucugcguauaagugaaaucucugugccuggcuuauuucacuuaacaauggguacacaguuucaguuaggagaaauaaguucuggugaccaauugcacagcacagugacuauaguuaauacuaauguuuugcguauuucaaaauagcuaacagagaggguuuuaaauguucuuaccacaaagaaaugauaaauauuugagguguuggauaugcuaauuagccugauuuaaucauuucauaguuauacauguaucaaagcacuacauuguacacuauaaauauauacaauuauuauuugucaauuaaaaacaaaacaaaacuuuuaaaaaagauguuuuuagaguauguuuuuccaucuucccacccagcugguuuaugucaggcccugguaggucuuuuucuguuugcuuuuguaaaguauguugagcuguacuaauuuagcauguggugcuguuauggaaaaaggauauuuagcauuaaaaauauauuuaauccuaguuuucucaguaaauacucuuccuuuccaaaaacuagcauuuuuaauaccuuauuuuaagaagaguugauuagaauaaagaauauaauugcacauccgagcaaauaaaacugaaaacuuuuggcaagcacacaguggucaaacuaucacacaaugguguaacuuacugaaaaaaaaaaagggauauaagucagucagaucagaguuugaguucugcuucuaauuuuagcuucuucuguuacugaaacaagaaaaguuccuuugucccccucgcagggcaugcaaugucgguguggcuuguuucuucagugccccgcugcucagaccucuaggggagcaugcagacuggcaggcugugagguuccaaucccacagcagugucuaggagugaauguuuacagaugaagcccccgugggcgaguguuacagggugcucuuuuaguuuugcugucuauagacagcuuguguuaaccagcucaauuagauccucuaccuuauugcaaggacaggggguuuucuguauccugggguuauugccuuggcguaugggaagaaucggaucacacgugggcuuagagaaugagugcaggguuuuauugaguggagguagcucucagcagaugggggagccacaagggagaaugguuuuccccuggaguccggcugccccugcuaaacuccaaauuccgcgucauucugcugguuaguggccugcagcaugcuagugccuguugguguguuccucugccgaugugccccucucaauguccagcugcuuaugugccugccugcuagguucucaggguguuuauaggcacaaaaugggggcguggcaagccaggcuggucuugggaaaugcaacauuugggcaggaaaacaaaaaugccuguccucaucuagguccauggggguggagcccuaaccagugaccccgccuuccucuacccagcacuuccuuuccccacuucuguauuauuuaaagggaccacucccuucccuuccguaucauuaccacuuaggcaaaugacuuaaccgccuugaggcugucaucucacccauaaaauagagccaauaacuagcugauaauguuguuuuaaggauaaagugaggugauauuuguaaaaugucuuaugaacugggggcucauuaaauguuuucuuucccuuucuccuuuguguucacuucugccuaugauuuuaccuuagaugcaaauaagacauuacuuuucagucauucaugguacuaugugauuuuauuaagcuucaaaauaccacacaaauggcagucuguuuguuucaauuucuucaucuauaaaaugagaaugaagaauaguacuuccuucaaaaacuaaugucaagauuaagacaauagaaugcauuuagcaugauaccugaugcagaguuaaaacucaauaaauagaagugauucuuuuuaaaauuagcauaguuucccaagucaguaaaauaucaaaacauuuugaacugagauauuaguaauuuccauguauaguauagcauccaguaguacaugugugcugaugaugucaucauagcaacucagggaauagacaagaacuggagggaaauauaauaguaguauuagaauaugucuaugccucuuuucuuuauuagcccuuccuaugaacaccaucacaauagcaaacauaauuagugcuaaaguaguucuuucuaaaguugcauauuaaauuuuguuauaaguaguuuucuucagccacuuguuaaccaaacaacauucugauuugaucauagacuuuucccaaaauuauguucugauuuauaaacagcuuaagaauuuugucauaaagaaagaggaacuaaguuaacuauuuuaagugauuuuauuguguugacuuaaaggcauaaaacuacuccauuuacauugauacugguguugagaaaauacuguucuucuauauggucuagaaauugugauaccuucacaggcauuaaccacauuauuguuacaagaacuuaauauccuuauuaguuuuuugaguuuauucacacauaaaaauucuuuguuaauugauauuugaaaaaauagcauagaaaaauacauggugccgucuuuaccaaugguacuggaaagagauauuaaaacgugauugcucuagaagacauugcaggagacaaaaugugugaugauuuaagagguuuaaagaagauuuuuuuuuuaauguuugaaacaaaaucauuguuagacaaugucacaaaguauugguggaaauuaaguuucacugaucuuuuagugaaaauccuaaguaaugauaauacccccucccacuugguuguaacuuagacugggagacauaaauuaaauuaaauugaaaccuagacauagauguuucaauaucauauccaaacacacaaaaacacacuucuguagauaaaaaaaucugugauauuuucugagaacacaagucauuugaaggacaguuaaauaugcagagaguuacuaauuauguggcagcaagauuggguaaguaguuuucuaauauugagucaugacuacauacucaucuaccaauuugaaaauugauaugagaugcaagcaagaguaaagaaaaggaaucuaaaacuuauauuugaggaucuuaaaaccuucugauacaaauuuaauuugcugaguuaaccuuauagccuuguuuauuucuucuuagucauuuuuuauauauuccauuuccuuucuuuuugaaaauuauaguguguuacauuuuucauucgcuuaacuuagaucuuaaauuuaucauuuguauccuucuaauugccaaagaauuuuauuuucuguagaaaauaaagauaaaauuauaguaacuacgacuuacuaaaaguguuuucauaaggaaauugaugcuguuacuuaaaaucaaauauagcugacccuugagcaaaugcagggauuggggugcugacccccacucagucaaaaaucuguguauaacuuugacuccucuaaaacauauacuaauagccuacugucuaccuaagaucauauaaauaguugauuaacguauuuuguauauguauuauauauucuaaaauaaaguaagcuagagaaaauacuuaagaaggagaaaauauguucacuauucaugaaauagaaguggaucaucaugaaggucuucauccuugucuucauguugaguaggcugagggagaagaaguggaggggucgguuuugcugucucuggguggcagagguggaagaaaauuugcuuguaaguggacucugcaguucacccuccucuuguucaggagccaacuguaggugguagcuauuaugauggcuuuaguguauacuuucagcagaauuauguaguuagugugauuaacugcauuugugagucauuaaacuuaaaagcgauuaaaaaaaccuuugucucuuuaguuuuuagguugcuuuaacaguuuauaaaaauaaaaacacuuaauuuuucaguuagaguugaucauuauuuuaaauuguguauauggguauaaacuggguaugucuuaaaagccuaauggaaaaaaagacaaacauuuguaauuguuuccuccgcaugguauacacugcaaucgcucaaauuggguauuugaaagccuccauauuugccacaugagccgccgugauaagugaaacugugauugccaaaugacaaaaaguuucuauauuuaaaauucaauuuagcaaauugccauuuucuauccccuuuucuaauguucucuuauucuaacagaucacuauuuuaaaacaaaagagagaccaugcauuuauuugauugucaugaagaauuaaacaugaaaagaugagaugcuguggcuaucacuuuucauuaaaaccagcugcugugguuuuaaaacgcaaaccagaucaaaaucagcacaaacccuggggguuuaauuuauauacugaaugaaccagcuugcuuugaaagaacacuucuuuuuuuuucaguuuuggaagaaacuugcacaucuaucucauuucaucuuuacacuagcacugugagcucggaagacgaagaauuaucucuauuuuacugacgaggacauugagacagaggccagaggcuuaauugacuuuccuagcccaguuagugccaggaauaguguuaaaauuccagacuaucucuaguuccauaauguuauuccaggccucuguucuggcccaaauuauagaacguagcaaugaugugcugcaguuggauccuuagccaaucgugaagaauuuaggaauuuuguaagcugcuguuaaaccacugacugcuugaaauuggccauggugggaauauuuauaccauggaaaacaauaagcacuacaaaucaggcccucugccuugucccacccugagaauugguuuaccagcacaccacugauuguauccaaguguaaacugaagaaggaaaacaacaaaaauggagcacagcaauguaauauacauguaauuuuauaaguacaugcauguauagggcagaggccgaucuuucuuugcuucuuaauuuauaaaugugcuuuuaagcaguggauaggaaagcuuaaauuaaaguccaguguuuugagggccauucuuacccauuuuuuuaagaacuaggucaagucccagcccuuccagaaaguaaugacagucuucauggccuuuucccucuccgaacuucuagcagauuuaaaauagagcuacauauguugggacuuaauuccuuacuauuuguuuuacaugaauuaacuuuguuucccuaagaauacaauaaacucuuugaagagugggacauggauuuccuucuuucuuucuuugaauaaauauuuaaugaacaccuauucugugccugguacccuucuucuuauuugaaaagcagaagucaucaaacaaaaauucaagccuuuugggggcuaagaguuuagugaagagucagguauuaauuuaaguaaaggaaaaguuaugaaugugauaaaugcuuugaaaaauugucuauaguauggagagugucugauagugggauuuuaucuauccaggacggucaguaaaaucuuccccugaggacauugugauugaacugagaucugaagaaugagacagaauuaacucgaagugaccagaucuugaauauuauuucuuuauguaggcuuucugugcucuuccaaucagaguuaaguucuguuauuauuugcauccguguuaugaugaauguucccuuuguaaugauaaguacaacuuaaaauuuuacacuuauucauuaucuguuuccccccacuagacuguuggcccuauaguugggaccaugucuguuugguucacuuugguggucccaauauccaucacaggaccugaaacuuaauaaucaauauuuguucaugcuuucacccccuuggcccauaaagcugggguauguccugccuaacucacaguuauugagaggacauaguaauauaauauauuugaaaagacaaaauucagaaaacuaaggcaggauccaggauagcuuagugacacaaacccggagaggaccaaauauccaggagugaaaagaaacaaauuggguacagcaauguuaucuagaagaaagaaaaggccauuccauuugguaaagaggaaguuuuacuaauuauuugucuuguuugaaggaaguuuguucaaucuguaaaauagauuuaaaaaugguuuuugagguuaaauaucugauauugauuuuuaaaguuauuuucuugugaaaaguaaaagaaguguguaaaugaaaaguuucuugaaaaaaggauguguccaugugcauuugugcauuugacaaagcacauguugucaaaugugcuuugaaggaaagaagaaauaaaagaaggaagggaggaaagaaaaccacuuguaggcaaaaagacugcaagguaacuguuaccugguucucuguaaaugauagggcucugggugauacuuuuugcuuuuguacuuuucuguauuucucaacuuuuuaaauuaaaugaguuuauauuacuuuuauaauggaauaguaaacaaaauaacaucucauaaaauugauaguugauuaugaguuugggcagaauguagaauuaugucuauaugcuuugagaacucagaacuauauuuuagauuuuucuuuuguucaccuaaaucugcuuauaauuuuagcauauuaauuuuaaaugccaguuggaucuuuguuuaaauguucaucuauaccucuggggccugagcucuuugaggguggagaucuuuaucuuugcauuucuacuauaauuccuggcagcaacacauauuuguugaaugaauaacuuuugaaacugagaugucuugaccuuuuuauugccuuuaaucuaugugucuuucuuuuuuuagaacacacaagugaaagacacaaugaauggucauauuucuaaucaucccaguaguuuuggaauguacccaucucagaugaaguaaguugaaaaguuuauauuuaauauguuuugggggaauuugauuuggugauuuuaauuguuuuauauuuuuagugaaaagauuacuuucguuguguaguucaguaguucauuccucauuaauauguaauaucuuuguuacaacacauguuauuaaaaguuuacuaugucugauaagaauaagaugguaaaguaaauagccuuaugauaaugauauugaucucacacuuggaagauguuucuguuucauucuaguacuuuaugcauucuugcuuuucaugguugaauauauaaucuacuucagagcuuugaauuucuguggugcauucuguuauuguuauuuauaaaauauuggcauuugagaaggguuaaaugucauuuaguauaaacuaaucaaguuauuuaccacuguguaaaacuagaaaagaucaggcaaacuaacaaaauauuuccaguggguccagguauaacuugaaaucauaacccugacuuaauuggccauugucuuauguauuacgauuaauguuauuauuugacauuggccauugugguauauauuuuacucaucauuuuuucauaacagguaauguuuacuauuuugagagaauaaaauaaaauguaauucuuaaucaugaugcuaaaagcccucaaucugccacagcuucuccagucauucgucuauucugggaauguuacauuaacugcaucuuuccacagacacugugcuauuucuugagucaguuccacguaccuuuuccucacuugauucucugccuguuuauagagcuucuuuccauucauuuagauucugcuugugucaaugcgguaguaaaguuuucuuagauauguugaugaagaguuaguccuucuuugauuuuacaugucauaucuauuaguuuuacccagauaucacauucuauuauaauuauuuuauguacuuauuuuauugacagcacccuguuucccccucccauaguccuuauucuucuagguuuugggucuuacaaaaauguucacugaaaaaaugaguaaaauucaaauaaagcacuauuuauuucacauaacauauuaguagcaagagguuagauagccuccugcauagcugggauuacaggugccugccaccaugccuagcuaauuuuuuuuuuuuuuuuuuuuuuuuuugagacagagucucgcucugucaccaggcuggagugcaauagcgcgaucuuggcucacugcaaccuccaccucccggguucaugcgauucuccugccucagccucccgaguagcugggauuacaggcaugcgccacaacgcccggcuaauuuuguauuuucgguagagaugggguuucuccauguuggucaggcuggucacgaacuccugaccucaggugaugugcccaccucggccucccaaugugcugggauuauaggcgugagccaccgugccuggccaucaguauguucuuuuaaacacguggugauuauagugcauuggaauuuuuauuuucuaguugaguuucuguuacuuauauuggacuuuaacccaacacaaugaccuuuuuauauuauuauuauuauuauuauuauuauuauuacaguggcuacggaucaucaccuaccuuuucccagacggacagagaacaugguucaaaaacaagugcaaaggcccuuuaugguagguuuguuuauuugauaggguauaauuuuguuucuaaccacuuuuuacaaauuacauuuucaaacucaugguuugaacccacacauuuaauauuguuuggaaugaggcagugauagcuaaauaaggauuauuuuaaagaagaguuuuuauaaaaacuaccaaagccaugaacucugcuugcuguuaugcauuuuagaacuacagaugaaauguauugcagugcuuucaaaaguccuaugcauggugccaaugcccuagguggcuuuucccauuuacuacuuguaauaauguuuguugaucuuugugacugaucuaguugguggugggcugacaggugacagaacguuuuccugauagcucuugaauuuugggggguauuauuacaguaugucuaauagauguuauauaauuucuuuaugcacugcaaaaugauuaugcuuuuucccugaucuuacuuccagugcccucucuggauugucucacauauacauacuauuuuuuacacuucagauacaaaauagaagucauaaguaacaagaagucgaggacuccugaaguuugccacauauguuuaggauggcauuuauuuguauagggucuggauggccacuuuuauuguauaacaauaaagaaugagaauaauauugugguuaauagcaaagacucuggaaccagacuuccuagguucaaauucaguuauuuauuaucugagugaucuugggcaaauuaauuuaccugcgugugccuaauuuugcuuaucuguguaauggggguaucucacaggguugaaaugagcauuaaauaaguuaguacaugcaaaauacuuagaacuguucuuggcaaguagaaaacacuguauguguuugcuauuauuauuguugauauuaucgauauuaugugcuauaggaaccaacagcauuuucuaaauugugaaauucuuuuuuuacauuaucuagaucugcaacuucuuggcuguuguaagaauaaacaauucuaagguuuugugauuguuuuucuaccuauguuagugaauuggcauuaucacugaaaucagacauucauaaaauggauuuaauaccauacaugccuauacuuuuuauagccuuauuaaucugauuguuguugguuucaguuuauuaaguauugugacauuauuaccauggucuaauaguuaugaauuguagaucuagagaauguauucaauaaauauuuugucauuaauauguguacagaacaggaccaaaaauauaugaucccugacuuuaagggacuuaaagucuggagaauaacuugaagauaacagaaaaagauuuuuuggauaagaauaaaauaauucagucuuucauuucuagacagauauuuauuaagugcaguauuuauuaaguaugcuaugccaugaucuucauagucuuuauuucuaugugcuuucauucauuucaaagaugacuaagagaaggcuguugccuaugugccauuuuggugcaauagacuaguaaacacauuguuauaauaaagggcuaaaugugcuuagauaguaguguguaggaggugcacuggugaggguugaucagaaaggauuuaauagaggaauugagccuugagcugagcugugaaaguuauauuguguucuucagcauuucaggggucggaggaugcuacagacaguaugaaacccuuuuaagcaggacuaucaaugcugugaagguggcccauauuugucuuguucacuucaggauucccugugcuuacuggcauaguggcuaguauauaauuuaugcucagaaaauacuugcagaaugaguguaaugaauuaaucagaugcaagcaauuugguguuaacuggagagugcauaguggugcauugggaaauaagacugaaaaaaugaacguagaccacauugggaagaauuauacuaaggaauuuaggcauuguuuacaaugaaugagcagccuuugauguuuuuuacucaggauaguaauaggucagauuuguucuggcucacucugguaguaauauugaggaugaauuugaugaauauggauggaaauaagugaaucagagauuuaaguaauauggcaaauuagacaccuaauaguagccuaaagacuuuuaauaaggagaaagaguauuaauccugucagaaauaccacagaucuaaaaucuaauuucagagagcuaagaaagaaauaagaauagaaaauagaacucaccuguaaauuuuaauguuuauguuguauuagaagcaacuuuguaaaaucuuagauccaaggaaugaaaaaucuuacuuuuuuuuuuuuuuuuuuuuuuggagacagagucucacucuguugcccaagcuagagugcauuggugcaaucucggcucacugcagccuccgccuccaggguucaagcgauucucuugccucagccuccagaguagcagggacuauaggugcaugccaccacgcccagcuaauuuuuucauuuuuaguagagacaggguugcuuacaccugugaucccagcacuuugggaggccaaggcagauggauuaccucaggucaggaguuugagaccagccuagaaaaucuuuagcuuuuaagcaguuaauuuuuauuuucccccuuuuacauauaaagcaaagugaggcccccuuuucaaguuagaugauuaucaaagucacauaacuuuaaacuugauaccacuguaacaauuuuguauacuguaaugaaaaugagcaguguauagguacaaugagauagaaauaaauggauugaaaggggcaaauccaagaagcauuuauagggaagagagaagucuuagcaauggauugggcuuagaaguaagauggcuuuaaauugcagaugugguuucuuuccucuuuguuucuaauacccaccacugucucucaacacacugcacaaagacauacacacaguaccuucccucugagaguucucagaaaaugccuauggaaugaauggacagauggauggaugacaagggagaaauauguucauguuuugaagauagcuuugcaauaaacagauucuaguugaaguuuuuuuuuagguagcuuugggaguguuuagcaucccagucugcauaguuuuaacuuauguauagcaucuguuaucacaugcuagaaguaugcaugauauaacaacauggaaaagagacaggcuugagauccggccacaugggaaaaagcagcccuaaauauucagaagggagaugaaucugaaugauuugguguaaagguaaggaaugcagcccccgaguuucacagcgcauaagcuaaugugcacacacaugauccuuugucaccaagaagagauuauauguaucuucaaaacaugaacauauuucucccuugucauucauccaucuguccauucauuccacaggcauuuucugagaacucucagagggagggcacuauguguguguuuugugugguguguugagagacagugguggguauuagacacaaagaagaaagaaaccacaucugcaacuuaaacagugugugcuggcagugucucuucuuaacuggaaaguuaguaaagaagagauuuaugauauaauuuguuuucucacaguugaugcaucuuauguaaaauuuauccuuuuacaauuuuaaacgaguugaaaucauguuccaagaauuaauuugccuucaugggugguacaugaacaucuuuguaauaggaggauacuguuuugugcacuggaacaugaauguucacacuguuuuuuacgcacugaccacagucuagauacucugucugaaguuucaugcagaguuuuucaugagaacacuuuucaggucugacacuauagugggccuccuggguugcuucuacugaaugugcucggaaaggcagcagggguuuuggaggccagaggaucugaaucaugguacugcuaccaaauggcugcugucuuucacaaaugauuggccccaguuuccucauuuauaaaauaaaaaugauaauaauucugugguaaguuuauaugagaaaacagaaguaaugacgccaucaugggaauggggagugguacuggagagucacuuucuguccuggguccucagauucaucaagauucucaaauguaauauuuugauauuaccuccaaaugauguuagacaauuaauuauagugauauuuugacagaaucaagaggugacuuucauuauauauuuuaaaacuuauauuccauaugucacucccuauaaugcucuagaaauauuuuuuauaagugguauaauuguauugugaacuaugcuuguauaugacaauaaauuugcuuauuugaggacauauuaauuuauucaaggaaaauggugaaaauaugcugccauuuuaauaacuugauuuugccauuuuuaaauuaccauacaagaaauuucugagccagcaugugaaagacucugcaucauuauugucacugacaccguaacacuuacuuaggaagauaaauauuaauuucucucuccuccaguuauaacaguaacauuuuacuuagcuacuguuaucagaauacuggaaauuuuauauuuuuuuccaacuaggcuguuugucaaagccuuuaagcacuaaaauuuaaaauuguuuuuaagggaaauaauuguaaaguauauuaaauauucccuucgcuuggguguggcagcuguaaucucuucuuggggacaaaggaucaugcauaugcacauuagcuuaugcacugugaaacucagggacugcacuccuuaccuuuacaccaaaucauucagauucaucuccuuuuugaauauuuagggcugcuuuuuccaugugacugggucucaagccugucccuuuuccauguuguuauaacacgugagcuucuagcauggcuucugguaucuguaggcugggaaacuagauaaaaaauguucuuagugaauagguucuaaguggggacuugagagucuuuuuuuuuuuuuuuuuuuuuuuuuugagauggagucuugcccugucgcccaggcuggagugcaguggcgcaaucucggcucacuccuggguucacgccauucuccugucucagccuccugaguagcugggacuacaggcgcccgccaccacgccuggcuaauuuuuuuguauuuuuaauagagacgggguuucaccguguuagccaggauggucucgaucuccugaccuugagaucugcccgccuccgucucccaaagugcugggauuacaggcgugagccaccacgcccagccgagagagucuuuuccacuagagucuguauguuaaaauaugcacguguuaauguauagacaugguggcaucucuaacaaacgcucagaggacuucauuuauuuaaguguggguauuauucuauguucugaauagauagacuuuccagaaagcuaacuucucuuuaaauuagauauugcuuaauuuggaaugugaucauuucauaaauuaccaacugcuuaaagucauuuuaucucuagaaaacucauuucauugaauuaccaauuaguaauauuuuguugucauuaccaacaccuacaguuaacuuugagauuuuauuauugggaggacaaauaauauugggucaguaugauagaaagguacucuuuuaagucucauuuuauuuuuauuuuuugagauagggucucgcucuguugcccaggcuggagugccguggcacagucucagcugacugcaaucuccacauccuaguucaaguaauucuccugccucagccuccugaguagcugagauuauaggcgugugccaccacaccuggcuaauuuugguauuuuuaguggagacagccuuucgccauguuggccaggcuggucuugaacuccugaccucaagugaucugccugccugggccucccaaguacugggauuacaggugugagccaccaugccuggccuuaagucuuauuuuaaccuuaaguuuaaacugcucugugauguuaacaaguaggaaaauauauuucuguuuuucuaucuuuguauuuucuucucaaggagguguugguaagaauugaguauaaguaaccuauaaacugcauggugaauuucuguauaauuggguuuacuauaaacuuuaguucuacacagugcuugauucaacucuuuuguagcaguguuccugaauuuuucuuaacacauauccauuccauauguuguccuuuucauaccuagcuuucuuucucuucuugucuaucuccugaucuugguuuggagcuagucucucuguuuaauuuuuauaauuaaagcccaagcaauuuuuuacacauucaaguaguacuuaagaguuaaaaccuguuucucuuuugcccauccuuauuuacaguguguauuuuacuuaaagaaaacauugaaaucuuuuuuuuuaacagaacaaauuuuuuuuugaaauucuuaagauguaaauggcuucuaauucauuaaauaguaucaggaaauugagcuaaauguuugagucaaaaguucagcuugauagaauguggcagaacaguugacucaaaaagacaguucggcaguuuucccaacuuagcugaaaauuuuaaaaguccuuuuuaccucauggaaucagccauuuuaauaauuuguugaacaggccaauaaaauuaguucuuaauguaguuuuaaagaaaugauuuuauuuuucauaaugguauguugguucggauacucauuugucaagcugugauuguaguugccugauauugagagcuuguaauuaucacucagugcuccucacugauucccauuaagcaccucuccccuauggaauagauauacuuagacacuaagcuagugggaaaggaauucucccuuacugugguugaaaguuuuuguaaguauaaaguaauaugaguucuagcccauuguuuuauuuagagagaggaauacucagcagcugcuuuuauguuacuuuuuucuuguuaauggccaaauccuuacucucuaaggaacauuuuuguuuuuagagaaagagaaaaaaaauucuaaauauuagcuguaucuuugaauauuagccguuucaaauguuauauuaugcauaaacagcaaugcaugugaaagggaauuaaguguaaauaccaacaccuggaugcuuuuuauacuuguaguucaacuaauuaacaaauuaaaugaaaccuaaauuuaguauuucugaucugggaguugaauaucaauuuuugcaauaguguaugauaaaauuguauguaaauauuuuucaucguugguuacugaauucauguaauucugucuguuuggaguuguacauucuggaccaugacauaaaagcuaauagacaaaauagugaaacacaaccagugguucuauagccaaguaaguuucauccuaccucuaauugauucugagcgagaaagagaggcaggggccagaauaggaggggaaauagacuuagucuuauguuaggaguugagcagcuuguacuacuagaaaccuaaaacccuacugccauguuuauucaugaauuuauuauuuaauauaccauuugacgauauuuacauucuuaauuuggaaaggaaaauguucugcuugaagagauaguauauaguagaugaguugcacacuguuuuauaaaguucauuccaacaugcagccaaggaugagaaccacuguuagcaaaaguggugaauuucauuagaggauucaucuugaguaguguugagagauuuuaguuaggcuuuuuauacuguuuuaaggcuuuggugagauuucuagcuuaggagccuaauuacuauuuauaccaguucuugugaauacaugugauucucauaaaaaagaaauguauuauaauugccuuuuaggaaaugucuuucaaaauugccuauuaaaauguuaauauuaaccuuuauggauugacuuaaaaaucacuggaacuacuaguuuauuuauaaguccauuuauggcauuuauacauuuuuaggaucuuuaaaagguaguuucuuauacaacuuauuuauuguacaacauagagaaagcagcuuaggaauuccuaaaguggauucuuaauuuggaauauuagaaaugacaccauaucuucuaggcacucagagugaucgguuaaugucauacuguuuaaaaugcuaucagauaguuuuucuucucauuucuguaaauuauguuucugugggauugggaaacuauggguuaggaaaucaagaggucagggauaaauucuuaauacuucauaaugagaauaucuaaauagaaacacacaguauuucagaucuucaacuguuguauuugccaauaaauuaccugaaagacaaagcauuugaacauccaggagcugccauaucaugacugggugucauggcaaccacugccauuucuuuucuguccuaaggucagaucaaagcaagccgagcccuccugcucugaaucuaucguggacaguuguguuagaauauggugaaccagugacucugaaauagugauuauuucuagaugugguuuugugaaauauauuccugaauuauauauuguauuacaagagucauaacggcugucacagggacaauuaucgauguguuaauaucucacacugauuaauccucaacaacuaaucagaaaaaucacagucgcucacuuuuuaaaaauauguagaauacagucauguaagugaagguuuauguuuuguuauauugggagagaaaauuuuaggugaaaccagaucuuucuuuuugaugacauuauuuugguaggaccagauggaucauacuuccucaggucaucauccaaacaaaaaaagaaagguagcacagagugaauuuuguagugcaucuguuuuuauuaaguaauuuuaaugcugcaaaagcaaaaauggaguguauuggaauaucagaguaauauugauacaaggacauggagauuuuaaucuaaauuuuaaaaguaaauauaaaugaaauucauauguguuguaaaaugaaaauuuauuaaguuuucuuaaaauucuguguuaauguucugagucugcauauguauauaugcacuuuauauuuuuguacuugcucagcuuuuauguucagcagaacuuuccaaacaacuuaucuauuauagaauaucuauacuaacuaaaagaaauagguuuacauuuacaaaaaaauagguuguugggaaagcuaagguauaucuauaugucagaauguuaauggcuuaaaggccuuuagguuugaccuuguuuaauccuuuuauuuuacaguaagggugcugaggcccaggguauuaaguuucuugcccaaauuuaguuuccuacuuagugacagagccgaagcuggaacaauaaaucuuauaauucccucucagaguuauuuuucaucauagcauucuguuuagaagaaauagggcaacucugaauuuacaaauaagcaaguugcuugauuagaaaaguaacaaauagugcucacuuuggcagcacauauacuaaaauuggaaugauacagagauuagcaugaccccugugcagagauggcacucaaauucaugaaguguuccauauuuuaaaaaacaauacaaauuuuaaaaagagaguaacaaauaccaaauauugccgacauacauuuuauauuuuaauguuauuuuuuugguuuugcagcauuucagaaaagaaaauuaaagguuucuuuuugcuuuuuaaguaguuuggugcaauaacuuucuaccugacuuucuuguuuuuccuaucagcuuauauuuauaauucuaaguaucacauuuguguguuuuguagaugugugaaaacuguuaauauuuaauggcaagccaugugauugaaucauguuuuaaaucuccucuaacacuaucccaauuuggauauugcaaaaggagauguuccuuguaaugccuauuauuuuaauaauguagucuaacucauauaauacaguaucuaugacaauauuugcaauuacauuuugauaucagugcaguaacagaugaaauuuauaagccaguuguaauugacuugucaaacaguaggucccugacugauaaauaaaaccuuuagaugaaauaacuuuuuuucuuauaauauuuauacucuuguuaaccuuuggaauucuaaaaauggauaguggaucaaauuguucuugccuauuauuuagacuuucuugugguuuuuagauuuacugcgaauaaugaguguuuucagauacaccacacaauggcaacuugucagcuacuguauuuauaugugagauagacuaguuuuagagauagccacaugauaccaacauaugaacuucagucuauuaggggacaaaucauggcuuuuucaauuucucuuucagaacaaaggaagaauuaugcacgggacagugucagcagugugucagauauaucucaauaccguguugaaguaagaugcuuugguguuugcuaguauuuagagugacccuugaggaacauaaaaauuggaaguuaaaucagaauucuguuuuauuucauucuuaugauguauuuuaaguugcauugaccuuuuuguuuagauuuuuuaaaacagauauuacauauaaaguaucuuguuagucuguggucuauuuucauaaagaaugauuuaaaaucauaacuacuauccauuuauccuugccagucuuauuucacuuauaauagaauaauggcuuuuacuuuguacuauagaaucuucuugaaauuaagccuuugcuaguuucagugagcaauuuaguuuuuaguuuaacuaaaguuauugccaguucuaguuaaauaaugguucuuuuuuaguuuuugcccucuuuuacgauauuugcucuugauuggaauuuaucugguugaccugugcuuauaauagaaaauauuuaagcagggaaguaauuuuuaaauugcucuuauuuucaguuuucuaccuaugucaagcaugcuuaaucaaauuuaaacaguuuuguuucaguaagugguuuuaguggauugaauaguuugacaguuccuauagacuagaauugugcuguugcuacaaucaguguccauaguuuugaagcucccauacagauagccugcuguuuaaaugcugcuauguucagcauuuaaauaaccauaauagagugucaaauaggggaaaguuuauuuuaagagaauauuauuuaagcuguuaagaauuuguuuuaaugucauguuuauguaguucaacauggcuccguaugaaacagauuuagguaucuuaugagucaaaacaccauuucuucuauucaaaaaaaaccuugguuggcuuuauucucucauuaaaauagucaugaaguuuuaagaguacuuuguguuugucguucucugcuagcugaccucagguuauuugauuuucuuuuggaaaauguauacuaagagguuguauguguuuguauguguuauaaaucuuuuuccuuuuugccaauuguaagcacuugacuaccuuuguccuggaucggaaagaugcuaugaucacuguugaugauggaauaaggaaauugaaauugcuugaugccaagggcaaaguguggacucaagauaugauucuucaaguggaugacagagcugugagccugauugauuuagaaucaaaggcaaguguguaaaauuuauacuauuuuauuuucaagaaacuccacaaauauuaauguuuacaaucauuucagauuguuugaaaauggauggaaguuugacaaaauaaaauguucacuuuauuuauagaaugaacuggagaauuuuccuuuaaacacaauccagcacugccaagcugugaugcauucaugcagcuaugauucaguucuugcacuggugugcaaagagccaacccagaacaagccagaucuucaucucuuccagugugaugagguuaagguaaaagaauggugaaauuuuuguuucuucuuuaagcagauugucugggagcuuuugaauuaccuauuuugauaauauaucugcauauuaguuacuagauuuuuaguuucugagcaucucguaaggaaaacaaauaccuuaguaucuucucuaggauuuccauggcaaguaaauaaagaaauuagggugauguuaaucaaaucaguaguucacacuuguaaucccagugcuuugggaggccaaggcuguaagauggcuugaggccagggguuugggcccagccuggacaacauggcaagacccagucucuacuaaaaagguuuuaaaaauuagcuagaugugguuguacacgcuuguagucucagcuacucaguuggcuaagggaggaagaucucuugagccaggaguuggagauuacagugagcuauaaucaccccucugcacuccagccugggcaacagauugagauugugucucuuaaaaauaagaugcauucuguuuauuuuuuuaaaguguagauaauauauuaaauucacaucaaaugccuuaaacuuauaauuaaaaauugauuguucagaaaucuugcuuuguggacaguaaauaaucauguaauuugaauuuauucugcacuaaugacauagcauggauuacugcaaugaaguacuuagacauuucccacgauauugauuuaaaguucaccauuuaauuaugugacuugauucauugcucaggauuuguaauucccagaugauaugugaaaauaguugagccaguaauaacaggcuauauccugaaaguuucuauuucaaaguacaguguaauuucaaaugauuauaauuugugaugcuuuauuggaccuuagaaguuaucuucaaccuugaauguguuuauuuccucaguuguuuucuuuaaaagagaaaucauuuuguguuaauugguacuuugccaaagcagugauuuaacauuuugaugauauauuauaaaauauccauguaauuuuauuuuauaaagaaacucuaggagauuagcacaguuacuugaucuuuucuguguuuuuugacauuuaaagaugauagauaaaguaagauugacuguaaacuguauuuuauaauuuucuucuaauuucaauuuacgucauggaugacuuucuaaaaaccuucuucuaaaagaacuggcauuuagguaauuuguguaagugauauucaucagauuuuuguauagugccuuuugaaagucauaguauauuauaauuuuuguaagguuagauauauucagucaauaaauauuaaagggaauauuuugcuuuaaaaauauagugaaauuuaauucaaacauuuuuauaaaccagaggccuaaguugaaaaacauuucaaauuugauguuuguaucuguguucuaaaaagccccccccgggagcuaaaaguuacuaugcugugaaaaguuucuggauuuuagguuugggaacaaauggcuugcuuuacuugauauggaaugguaaugauaauggauucaaaauguauuuacugaauauaguuuuguccuaaccccaaaagcucacauaccacgaagcacuguaugcauuuacucauuaguuucauacucugcauaugagacauuuuucgcuuggcugguuaaaaauauagaggcaaugaaaaacgcaguuucuuuuauauggcucauugugcaauauugcuuuugauuuuuaaaguuucuuuauuauaggacuucaugcaaugcuccugcccaccuuugcaguaaaauuuuucuuagaaauauaauagccccaguauaagaaguugaagauuccuaggcaucuucaguuuucauuuuggguuuuuuuaaauaauuauuuuuaauuaaauaucuuuucaucuucaguuuuaguauccuauguaacagaaagccuuugacacgauauuuguaaugucuuauugaaacuaaaugcucuuaggaagucacacuggacugggaugcauuggccucucauuuaacuagcaaugugaccuuggccaggcccuuuuauacaaguacuccucaguuuuauuaauuagaaggaacugaugagaugcucuuuuaaauaucccaucauuucuaaaguuuuaugauuaucgaugcuuacuguaaaagaaauacaacauacauauuugagaaaacauuacagagaacagggaggcccaaacauagauggugcaucucaucaacauucuaauauagaguaaugaucacuggcucuaaacaaacuuugcaaccaaacagaaacuucguaucugcuaaucucacguugcuccccaagaaaaaucuaacugaauguucuggaaaaguaguggaaaaguuaauuguuugcagaaaguuaacuuuuaccugaagugacaaaauaaagugguuacccaaagggguaaaaccuagcguuggaguuuaucuuauggguguaguagauuugccuuaaacucaaagauuuguuuugcuggguuaauggguguccaguggaucuugaggaugagaaagggaaggaacucuguucuaugugugggagccucuaaccccuuaauuucuacccaauuagagauuuuuacucaguuucauuuuuagcguguacauauccuuucuaucauugccuuuauucaaggauaguuucccuuuaagauaaucauuaaaaauuucuucaguuuuuaaaaucuuaucauuauauaguucaccauuauaaaaaccacaagagucauguuuugcaagauuuuuauaaaaagacuuuuuacaucaagauacuuacugauucagacaaggaacaaucccuuuuucuguuuuaaacuacauaucaagacucagaaaaauccauaaacuuucagguaacuugugucucuuugcaggcaaaccuaauuagugaagauauugaaagugcaaucagugacaguaaaggagggaaacagaagaggcggcccgacgcccugagguaaaagcauugaaagaaaucaaggaguggaauugauuuguuucuaaggcuuuuuuccccaaagaguuagaaaaauuauuuucuauggaaguauauuauuguauuguauagaucauaaccuguagucucaacacauuuguucucccaaguuugucaguguguuuacuccucuucucuccauauuuuuggucuuucucugauauggcuucacuuguguuggaagucacagagucaugaaagaugaguggcauuuuaagagaagguauccuagggaaauacaagcuagacaguaggauuguaauuguuccauggcccuuucaaaucacauaagacucagaaggaaaaucaaccuaguuuucagcugacuauuaauuuuuuuauuucauaugcauucauaaauaugcauaauguguaaugcuuaggaaauccuuauugucccuugacauaguucuuuuugaauuuuaauaacuaguaccacaaguugaguuaauugauauguuauagaaauagagaugguaaaaauucuauuuguuuucaucuuuuuaaggaugauuuccaaugcagacccuaguauaccgccuccacccagagcuccugccccugcgcccccugggaccgucacccagguggauguuagaagucgaguggcagccuggucugcaugggcagccgaccaaggggacugugagucuuccuagaauuaauacuuauugaacacuuacuuuggguugggacauaguucuugcuuucaaauucugaugcugauuucagaacugaagcuugagguuaguuuuuaaaaaaucaacucuggccgggcgcaguggcucaugccuguaaucccagugcuuugggaggccgaggcgggcggaucaccugaggucaggaguuugagaccagcaugaccaauaugaugaaaccccgucucuauuaaaaauacaaaaauuaggugggugugguggcaugcgccuauaauccuagcuacugggaugguugagacaggagaaucacuugaaccgggaggcggagguugcaguaagcugagaucacgccauugcaccccagccuggacaacaagaccaaaacuccauuucaaaaaaaaaaaaaaucaaaucuuagauaaaauaaaguuaagccuugaauuuuguuaagauuauuaucuguaagaguuuagacccaccauuuaauaaauaugguauuaggguuagagucuuuuuauuuuuuuaaugcuaagaggaaguuuuacuugauugacaaaaagauggcaacaaaauauauacagguuuuucuuaaagauugcacuuaacauucuuuccauuuuuuauuaucuaacuagagucccuuuuuggacaaguuugucauauucauggaaagguugucaggacagugguuggcugcuggcaguggagaaggguaaaagguauccaucauaugacuguucuugucaagugggcccuaugagcguggcaucauuucaccuuggcauucuguuuaaaaacaauuauaacauagaacuuaguguuacuuuuuauauguuagaauauuuuacuagaaucugaaauguuuauaacuaaaaaaaugccuuaaaauauguuuggucuaguaucuucauuuuaaggacgaauaaauugugauucagcaggcuccaaucugaugaacucuagagccucauucuuuugccgcuacuccaguggaacuucuuaacuucuuauucuuuauccaguaaaguauuauucacacaggguaucuggcacuauaguuaaacgauauaacucauuuccaaaaaugagucaccucggacucuacuuuggaugugcagaguaaaaguuggacucugaagcaagaccugauaugucuaccuguguggucuugggaaguuaucucucuguacuucggucucaucucugaaauggggauaauaauucauggguugcucugaaucugaaaguaaauaauguuuaugguaguaccuacuacaaaauaguaagcauaauuugugguuuucauuuugccaaauugaguucauuuucuuucugaauuguuuucuauuuuguuuagguuucuuguauucuuaaagguuuuuucagagguugaaauguaagccgagcuaccaaagauaugaaaaaaagaauucuuugaugcauuuauuuaaaaaaaaauuaauuaacagagauauguaguuuaauuuuauaacaguuuccguuuucauaaguuauguaaauuuguauugaucugcuuuguauuuaaaauguguuuaaaagacaguaauuuauuguauucuauacuuuuuguguacuuaugguguuuuuguuguuacuguuucgaugaagagggucugaaguagaggaaggauaagacaaguuuacagacauucugaacaaaccuguaaaaauauauguugaaccuaauauauauaauauauauuauguauauuauauguugaaccauauauauauguguguguguauauauauauauauauauauauauauauuauuuuuuuuuuuuuuuuuuuuuuuuuugagauggaguguugcucugucacccaggcuggagugcaguggugcgaucucagcuuacugcaaccuuugucuccugguucaagcgauucuccugccucagccucccaaguagcugggauuacaggcgugugccaccauaccuggcuaauuuuguauuuuuaguagagauggaguuucacuguguuagccaggauugucuugaucuccugaccucgugauccucccgccucagccucugaaagugcuggaauuacaggcgugagccaccaugcccugcugaaccuaauauaauuuauaacaaagacagaauuuaucccuagggguuucugagcuuucauuaaauuuuaucugaaauauuuucugcaaugucaucuguuuaagugagauaaggcuuucagaacuucuaauuuaccacuagccuaaacagaagacuuauuauaucagguuuggccuggguccaguccaguuuuuaguuggaaagccccucaggaggaauaucuuuuugguuccucuggaugcuccagcugacucaggcugaacugcuucuccguugaaucccugaggcauaucuaccccugacuuccaaaggugaucucuguggaauagcgccaguggcacuaggguuccuagucguguuucagaccugacagagcccaagaaauaccauaucucccccucacugugcccuccaaaugauauuuuuuggggccucuguagaguuccuaauagcuauuucaaccucaacuuaguacuuucugugguaguccacuacaaccaagguagcagcuaucuauguguaaaauaguagcuaacuggcaagauuucauagauagaaauuuuaauuaucuuaaaguaguuaacagccgcuaauuaaguuucauaagacacgaugauuucuucuuucuuuuuuuuuuuuuuuuuguuggcaaguguuccaguuacagguaaaguuaguguaaaggaagaauagcaauacaaaguguccaauuuuuuuuugcaguucucucuauugaacaucaugagucacgaugauguaucaugaguuguauuuccauuugugguguuacguuucuguuguuccauccauauauuuugaaauuuauucuaccaugagauaucuguaacaacucucuguguuuagaggcaguauuaacugacucauaccaggaaggaguucaugauaauaacuucaugauuaacaucaugcuguagccaacugagcaaccuuaauacccugaauggucuuaagacauuuauuuuuuaaugugaaaauuucugucugcuuuuaaagcauguagcuuaaaauuaaugagcccaacauuguggguuuuaagcuuaauuacacuagaauuuuaagaagcacucugcugucagaacuccgaaagcuuuauuguagucacaguguuggaauguauaaaaauuauagcucuguugcauuagaacuuaguugaccagcuuuugagaaguaaaagcuugacugcugguuuauauuucuggcuuguguaggaauuaaagggugcuaaguuaagguugguucuacagguagcugacucagggaagagagagaauggggugauauuacaagguaaauuaacaucauaaaguugagaggacuaauacuuaagcucugcucaacugcuccuguuaguauugacaaggaugcauuucauggcugaugagcacaguuuugacuuguguauccaguggagguguucccuuuggcaaaugguccuccuuuuuaacuaauuuuuauguuuuaauugucuguauugguauugugggaguaaaagauugaaagacuuaugauuguccuuucuauaguugagaaaccaaggcaguaucaugagcaggaagaaacaccugagaugauggcagcccgcauugacagagaugugguaaguacaggagucgccuuuagaucacuggcuuuucuuuuaagaggaaaaagaaaacuucauaagaaaaugaagcugauuuaaauagagauauuuuauggaaaccauguuuucuguuaccugugauggcuaugcccuuugaauuugcccuuugaauuauuuucucguuaaacauuuuugccuuuaugccaauauuuaguuaguagacuugggcuaugauagaagaaucagcuuauuaacuaguuuacauuggaacuuaggcugaauuauuagauuucaggaaugguacaauuuuuauuuuauuaucguuuguaauucauaauugaaauaucuuuuuaauaugucuucuuggcauuuauuaacaauguauuuuagaauaccuaagagauaaaaguuaaguggcauuuuuaaaggauagauuuguaaaucguaaagcuuuuauaaaagauaaugcuacauuuguuuucuuuauagugauuuacagaaugagaaugcuguaaaugcuuuauuauagcauuuucauucuuuaaaugagaucuagaauaugauguuaauacauuacuuuuuauaccauauacauguuaccagcuuauugagaaacaaauacugaaaggaauuugaaauuucuaauucaauuuuuacagcacacuauuacauguuauacuuaaaaguuuaaccccaauuuguagucuuaaauuagaagaaugucaaguuucacacauacuggagaaaggcaacuaagacuauaguauauaagauaaucaaauucauuccagugaucucugaaagcauggugcauuauucuauuuugucauguggaaacucuuauuaaugcuuaguauccuagacuagcuauuagguuaucacaacaaucuguauaccuuuaauuccaugaaguaauauugucagugcuuuauugggacauuuaucaguaaagcaaaaaugucagugcucuucuaacaaaaccuauuuuagaauuuuccuccuaacugugugggagaacacugagaaaauuagaguaauugaaaauaauaaucugagcagauauugugaaugcuuccuugaugacauugaaaauagagcaaaaguaagcuaaagaaaaauguaaaugucagaauauggcuauagguauauuuaguuugauucuuguaauuaguaauaaacuugaaauuggcaugugggcugcuuccuuuucuaaaaaaaccuuucuauuauuuacuaacagaguacagcuaagguaaaaauaguuuuguuuuauauuuuauucuauaauuucuaauuucagcaaaucuuaaaccacauuuuggaugacauugaauuuuuuaucacaaaacuccaaaaagcagcagaagcauuuucugagcuuucuaaaaggaagaaaaacaagaaagguaaaaggaaaggaccaggagguaaguuggauuuucuuaaucuucuaaugccugguuagaucuccaguacuggcugggcgcaguggcucacaccuguaaucccagcacuuugggaggccgaggcggguguaucaucuaaggucaggaguucgagacuagccugaccaaugugaugaaaccccgucucuacuaaaaauacaaaaauuagccgggcaugguggcaugugccuguaaucccagcuacuugggaggcugagacaggagaauugcuugaaccuagcaggcggagguugcagugagcuaagaucacaccauugcacuccagccuggaaacuccaugucaaaaaaaaaaaaaaagaacucugguacuaggcagaguuuugacccucaagaacuacuuagcaaaacuucauugacuguggacuaggguuccucuucuaguuuugggguagcacuugagauuuaggcaaagaguaagaugaacucagggaagaguccauuuugguuauaagucagcuauagugaagaaagauccuggaauguuuuaccuaaaucacagagacugagauucaggcagugaccaucuaucuguaguuuucauuaguuauuguaaaauuaaguaucuguuaaagaaagacauagcucuauucuuguaguuggauuuauucuguuguaaacuagaaccauauuauuuguuaaauaaaaggguugacuuacuaaaauauuuaaaaguuucaacagauuugaauuuuuuaucacaaaacuuuaaacgguacauucaggucacauacaaagucacauacagacaauuuugaaguaugcugcaguucagcuauuuaaaauggccucagcuauauaaaauuaaaauuauggaaguaauguuuauacuuccucugacaaaaugguagagauugaaagauauaaaauaguaaauaaauaucccuuucauuacagauaacuuccaaaucuuucuguagcacauauuuguauaaugagcauaugaccuuuggcuuuaucuucugcaugugaauacauggaugugcuuccucuccacauauucugaaauuaaguacuauugcuuccugguaucuuaaaccacuuauuccuuuugaaauucucuaugaaagguauacuauccucuugaucacccagauucaaaaccacagauucuucugugacuucauucucuugcuuauagccaacaucaauuuuauuuucucaacaucuccuguauccaguuuuuucccuuuucauuuucauaucuaguucaagcuacuaucauuuuuuuuaacccugcuuucgaagcagucuuuaagccucuacuuuuucaugcugugagaacaaucuucuuaaagcucucagucacuucauucuucugcuguaaagcacgcuaguuccauguucuauugauuuaaguacaacuguucgcccuggaaaucaagguuauccacaaucuaaccuugaucuacccuuccauucucauguuucucuccuuuuguuuguuguuucguauacaugcaauucccccuuuccuuguuuuugcuuaugcuguuuuuauccaaccaugauguuuuucccaccacaucacccuggaccaaacuuuuucaaaucccaucuuauaagcuacuuucuccaucuaauaccuuuuaaguauccauuuccuuaucucccaaccagguaagucucuucucauaacgauugguacuucucuuguuauuuaucugauucauguauuuuauuagcuuuuaaggcccuuagagcagggcuugucaguuacucacuugcacaaugucugccauagagaaaggcuacaauguauguuuauggaauuaaaugaguaauuuguagugccuaaggauagagcaauccauuuugaaauuuguaucuucucaguuuguuacagucagacuaugagauguagcacgguaacuagguagcaugucugaugagaucuucaaacuuuacagacauaaaugugguuuuuguuuuuccauuuaauaaauuuccuuggauuuugcucugauccucuccucucgcuuauuucauuagaggguguuuuaacgcugcgggcaaaaccuccaccuccugaugaauuucuugacuguuuccaaaaguuuaaacacggauuuaaccuucugguaagugaaauuuauguauauagaauuagaagaaauaaauggaaaaggugaaaaucuagucaggauguuucugauuaaauuaagaaauaaaauuguuuuuauagauuuuguggggguguguauguuuugauuugccuucaguuaaaacagcaaauuuuaaaacauauauaucuaagagacuugauugaaaaacaaugacuucuauucucacucuauccaugcuaaagaauauauuaaaacugaaucuggugguaaagaccguccccucugugucuauguuggaccuuucugagugucugucuugcuugauaguaaucuguuuucuguuuucuucauguugcaggccaaacugaagucucauauucagaauccuagugcugcagauuugguucacuuuuuguuuacuccauuaaauauggugagauuuuauuaguuuaagaaagaaucguucuuaguauauuuuuuaaccccaagugucugucuggauuaucuagacugcuuuucuucauuaccuugcguggguacuauuucuuugccauuuguguaaacaucaagaauguaaaauuugagaauuuaaaagaacccuguaaaucaucuaguuuaagcaccuuauuuuauaguugaggaaacugguaucucugacagugcuagggauaugaaaagaaauaaagauuuauuggauaccaguauuucaacguauacuaguauauaauauccagugccuugaauaacguagauguuuuucucauucucacaaaauaaucaugagaagucuaguucuugauggaugguuugcuccaugaagucauucagagacccauguucuuuuuaucgagguguuccuucaucucuugaacugucucugacuuguuuauucauuuaugcacugguucuacaaauacaaauugagagccuucuaugugcuuggcuuuauaguagcccaucaggaacaaaacagacaaaaauucuuaccuucuuagaacuuauauuguaacauagugggguagccaauaaccuaaauaaaugucugcauaauacaguagucuaaaaaucacgugcuaugcagaaaaauagaggagugaaggaaaacugggaguuccccagggggaugcacgcaugugucuaugugugugggaaacggaguguugcacuuuuugaguaggguugguuaaaggaagccucacugagaagaugucauuggaguaaaggaaguaaggaaugggucauguggaucccugaaagaagagaauuccagacgaagaauaguuaacguauaaauguucugaggugauaacaugcaaagcauguucuuggaauaaguagagcugugacuucaacagaaugaagaaaagauuagaaagagaugauaucagcaggguaacaggaagacacauccuguuggucuuuauaagggauugggagaccuuugacaacugaagaguuuucagcagaaaaggauugcccuggcuauaauguuuagaaauuuuggggaagaaaaagcuagggucauuauuaaaauaauccagaugggggauuauggugcuuggaccugguagcauuggaggugaugagaagucugauuugguuauaaauuugcugcuagauuggauauacugugcaagagccaaggauagcucccagauuuuuggccuaagacuaacaggauggagugaugauuaacuaagauggggaagacuggguagagcagguuuuuggagguuggugaaaaauucaguuuuaaacauaucaaaauugaguuguauccagauggggaaauuugaauugaucguugaguauaugaauuuggaguucaauggagaaaucaggccaaggacugcuugagcccugggcauucgauguuaggagaaugggaagaaccagcaaguaagauugacaagaggcaguaagggaggauaaaucucauccuucuuuccccagggauaaguagacaagaccugaauuagaauaugaaaugaguauugcuuuacaaacauaggaaaguaaguaacauuaucaacaugaaugucagaagcuaagcaauaagggacuagaagaugaaaguccaagaguacaucaauaacuuaugaaugcuccuauauguuguugcuguauauggagcaucagauuucuacuugccuaauuauuucugaauaauucuugcucuauaaaugcuuuuaaaaaauuagguggagaucaaggacauacauaugcaaagaaacugauacuaguucauuaacaaaauuuguauuccuuaguuuuuaacauuuuugaugcuaucuuagaguauuuggaaguauuauuuauaaagaaguuuuugcugccuccucuuauuuauuucacacacuuucagagaucauauguagauaucuagucauuacacagaauagagcuguaacauaacaaggcugguuucccugacauauacaaauuggucuuugugaucagguuauguaccugaaaacauugguuuacuugccaauguuuaguaucucugcuuuucucaaaaauuacaccuuauuaauggucucuccaaucauaauauuuugcugguccauuuaauguucucccuacagggccccggacauuuuacuuggacgagggagauggggaggaacaucuauucagggccugcuacuggccagcaugauguaguggcuuuacaccugcgaguugcucuccucuucccucagcauggacauguacacacgagcguagccacagcacaugugccugcgcacguucuugagagggaaccauggcucuuaaccuuucauuuauacuuucuuucauuuuauuuccucuuccuucuguuaaaucagguauuuuuauauuccucuacucauuuucuuuaguuuuacuuuucccucuuauugcuacauauuuauuggaaaugcguucgagguuggaaguuaaaaauuacugugcuagauaggcaggguagguuuuguucucaaauaagaguuagcuuuccuccguuaucugccaucuuuuuucauucauuccaguaccacuguaucaucugcaguugaaagucagauaagucuuaguccaacuccucaaggaggggaaacugaaaagccauaaauuacaguguaauaguguaauguguuacgaauaugcauaaauuacaguguaauaguguaggguguuacuaauaugcauaaauuacaguguaauaguguaauguguuacuaauaugcauaaauuguuuagaggacgcaggcuggggagugguacaucggaguuacacugugggguuaacacaggcuuucacaagaguugggaccugaguagaguucugaauaaugggggaauggccuucuggggaacugggaacagcauguacaaauacacagaggccuagaacaguauagcaugcugagaacaccuggaugauuggagccauucaaaaaaucuccuaucuucuugugccgcaucucugagaagguaagauuuuauaaagagacucugguuucugcucuaggagauaacuaccauuuuuuuuuuagccagaaaauagcucauaagaaguaaauuuagagcaguuuuugaacaucuacuuauccucauuuugcuuaucagagaauugcaccuguuuguuucugcugucauuaaauuauccauauuaaaucagaggaauuuucuaaaaauaauucuggggaaaaguaccauagauucagaguaccaguucucauuccuguuuugccuuccuuccuggauccuuuuauuuuuuguauguguguauaggcacagccauagacuguuaacucucgauaguauuguuucucuugauaguacucauuucgggaaccgcauuuuucaaguuuggcauaauagauuugccaguagagaaacacauauuuaaaacaacaacaacaaaacagggguaguaaaaucaccugaucuagaauucucugcauagccuuugguaucuuccagagaaacuauagucauaugcagcccauaggcagaugcugugaaaguuguuaaauuguuaacuuucauuuagguuuuaaagcacugcugggcugggcaaguugauuugacaagcuuuucuucauucaguagcacauugcacagcaucaaaaguuaauaugacuauuaaaaaguagugcuuguuuuugccauggguuuuuguccacacauuuugaaaauacacaaagaauaguaaucuucuugcuaaaaaaugguuuauuaucuuagguggugcaggcaacaggagguccugaacuagccaguucaguacuuaguccccuauugaauaaggacacaauugauuucuuaaauuauacugucaauggugaugaacggcagcuguggaugucauugggaggaacuuggaugaaagccagguaagcauuuaccaccuauaaugccuuaaguaccauucuuuguuaauuacauggaucuaaugagacauuuauuuaaccuucuacauacgaaggacuaagcgucauaggaugaaaaaaccuaaacccuuaaaggcuagaagucuaguggaagagauagaaguguauguaauauaaggcaugauauaccuuaggagugagucauaaacaaaaugcuguugguuggcaagggggaccagucaggaagaggauuuagacaggaggguaguuagcuuucaaagaagagcugucauuuaaaaucgacagguacacauaggguucacacacacauacacaugcgcgcgcgcgcgcacagugcuugcuaguccaugcacuuuacagaacuacucuuauuaucccuauuuugcagaugaggaaaguaaggcacagagaggauaaguaauuugcccaaggccacacaacuuguaagugacagagcagggaugugaacucgugccauguagcucuggagucaguguucaucauugguuugcuaaacugccuuuuagcagguuggguaggauuuccacaguuccauaguagggcaagggccuguccagguagagagagaagcagaagugaaggcauaagguagucaagagaagaaaggaugaagauguguuucucuggaauauggacuucggguagcagaucauuguggaagggcgggaggcggaugguauuaaaaugagcauauagagaugagcauauagagaugagggcuggauuaugcaggcuuucagugccaugcuaaagaguuagagugugguucuguaggcuguggagaaccaauaacuuugugaauagaggugugacauaauuacaucuauguuuuagaaaggucagucugguaguugaggcuagaaaggacaaggacaaaaguaacuggaggcagaggccuuuugagaugcuaauaucguaggagaggcuccuuauaaaucaauuuucuucaggacuagagagucacaguggaacugaaaaggaagaguggguaauuuuaagaaaugugcauuugucaauaaagugauuauggaagacagauuauuaacaauuguaguacuaaugcuugcugagcaaggcaagguaagaaaauauuucuaauuucaugauuguaaauaaaucauuuuugcuuugcuuauuuaucuaaaucuuuuucuuuauuucaccacuuagaauaaaucacuuaguauggccacuuagacauuugucuuccuaaugcuuuugaaugggcuagcuuaagagucaugggccaauucauaauuuuuuuucuccauuuuucuccuauugaaacauauacaaacuuuuccacuuauuuucuggacuuugacaguggcuuguguuggaauauaguuaagcagaaaauucuuugaaagcauugcaguuguugcuuuuaaauugaaaauauuuacauuuauuuauauuauuuauguacuaguauagcauaguguaugcuguauaauaguguucuuguuauacuguauaaaaacugguuaaauagaucuuuuuauuuuuauaauuuuaauugauacauuauuaauaguuguacauauuuucaggguacauaugauaguuugauacauucguauaauguacaaaggugaaaucaggguaauuaggauauccaucaccuuaaauaucuuaaauauuuaugcuaggaacauuugaauuuuucucuucuagcuauuuugaaauguacaauagauuaguguuaacuauagucacuuuacugaucuaucuaacacugggucuuaguucuucuagucaauguacguuuguauccauuaaucaacuucucuccaucccccugcaacccugccucauccuugucagccacuaguaaacaccagucuacucucuaccuucaugaaauccaguuuuuuagcuuccacauaugagugagcuuauuucgcuuaauggaauaaccuccaguuccauccauguugcugcaaaugacaagauuucuuucauuuuuauggcugaauaauauuccauuguagaucacuuaaaucuauuagauuuauauagguuaugauuuuaugauaagccucgguggcauccuuuaauuucaugaaguuuauuaaauugaucaggucucacauuacaaauauagcucaggcucuuuaauuucuuuguuuaggguucuaucuuaaaauaagaaaauuaauuaacauucaaaaaacuacaucaaaacgaaauauauuguuagcuguuaacacacggaaagggucauuuuagauccugauuguuaagaguauuaggaaaugaauguacugacugauuuaaaaacucauaaagguaaaaagaaccaugaaagucuauaacaaucugaauaaaauggcugauuucaucauaguagaacuauaacaugaagaauuaaauaugaaagaugaagcaacauauucuagcaaaaaugaagcccucguuuuuguccuaguuauuuuugugguucaugaaugauuaggaucuuacagaaauaaguuucacucagugucauuaaaugaugaacccauaugauugugauuacagauuaguuuacugauuaaaacagagcugauacauuuaauuuauaaaacuggccaucuguuucaguuuaggggacuucauaaauuuaaaaaucguaaucuuaacuugcugggcuguuucucuuuugaaagauauaucuaauaccaggagguuucaauaaugaugggaggggagugaagggaaaguugagaaucugaaacuacuuuaaauguuagagaaguuugugcucuaaauacuuaucacacuccuagcuccauaaucccuucuuacacaaauuuuuaaaaaccuauauccauguuacaaaguugaguuuaauggagaaaugaggcaauguugggaaaacagaucaugcaacagaauucaaucuuucuuucauuuuauuaaggugugaaauacuggcauaaacauguuugcuuuuucuuuuuggguggauggaagacagauuaggucuaugugcuguuuuuguuguuuguuauuuaugugugugugcguguguaugucuagccuuacugaagauaacugugagcauggauacauuccuagauuuuauuguuuauaugccuucauucccuccugcagagcagaguggccaaaagaacaguuuauuccaccauauguuccacgauuccgcaauggcugggagcccccaaugcugaacuuuaugggagccacaauggaacaagaucuuuaucaacuggcagaaucuguggcaaauguagcagaacaucagcgcaaacaggaaauaaaaagauuauccacagagguaguuuuuuuuuuaacauugcccucuguagacaguguaauuaucuguguauucucuuguaauucugauugcaaguucucauuuuauucaacugaaaauuguucuagaaucaaagucugaauguuacccuguccugaauuaccucucucucuugccucugucauuuuuugugacaguugcucuguuccuccgugaagcccaaccccaacccaaauugcucuccuauagccugucagcccccaccccuccccuuguugccacuguuuuccuggcucuggcgauccuaagucagcuuuuuuaggaugacuuucucuccuugucagggaauugcacuacugcccuuuggcuuauuucuuuauguuuuccucucccauuaucaggcccucaagacaguucccugaaccuagauccucuaaccugucuuaagcagcuguuuccugaauucccccaguuaauuaauuucucuccuucucuucacguugcuuugccucucuucuccucuguuuguuuucuuucuucccuuuugccuaguucuaaaacucuggaguccuaucagccuugcuagagggcccaaguucuucugcacucuaguccuuaggcucaaaugaucauuuauaaaacuacaccuugaggagaucuuaacauucauuuuaucuuuuaaguauuuaauaauauuuagaguauaaccuauuugggaaucaaguugagggaaugaaauugaguaugcuguuuugucacauucccuaaaagugauguuucuaugacucuucuuguuuguuggaaaagaacauugaacauugauuaaagcuggaccaaacacaaauaggaugaucagaacccgaagaguuaggugaaugagaucuaguuugaagaagaaacaguaaaugaugacuagaucuucccgaaauccuauuauuuuuauuuaauuccuuagauuaauuuucucagacuaucauagguauuuauaauguggcaaauauguuaugagggaaugaauugucaaaccaugguguauuauauccugugacugcuuuuaaggggaaauguuuaucuaaauuaaauuuuaaaaauuguucccuuuguggacuauucuuuggacaauaaaaauaauauuauagaaguuugguugaauuccugaaacuuuaaaaauaaagcaaacauauuacuuugaaauuauuuuuuccuaaugcaauuuuuuuuucccucuggcuguauuauaagggaagagguggauuccaugccugucuuucccucuaaaugaauaauuaagaugaccucacugcucgguuggcaagcauauaccccugccuguauuucauaguucaggccucaucacugugaauuuucuuuccauuuaaaggguaguuuuucuagaggaaagaaaauauaaucaaacaugaaauuaugauacacuugcuguugcuauaguuacagcugacuauuuuuacaucauaaaaauuucuagcuuauagccuucauaccuuaaauaagaaaauauacucacuuuauaauguaugccucagaaauucacuuuugugauuucguucucaauuuguguauuuaagaagagaguaauguguucugggcucccaggauauaaguuugucuacuuucacugaauaauuaauuuuaaaagaggaauuauugagaauccuuacuuguaaugaguuauuauuuuccuguuauaaacuauauuucauuuuauggcugaaguaguuauucagagguuuaaaaaaaugaaaaacacauucuagcaguuccagggaauuuuaugccuugagauuuuguuggaaaagaggccaaguaauugugacuuaaaaagcaaaaaaacguaaucaucccuaaaagagauacuuuauuauacuuuauugcuacuauaauaaaugcauuuacaacaagacuuggguaauucaggaucugaugauuuuuguuuaggauugaaagacauaggugacuuggagugacaaauauggguggcaguacucagcuuccuuacuuccucugaacccuaagcaaacuuugguagucaucacaguuagucauuugucaucauuucucuucucccuuucaguauucgcaguugcucucaggacccagugauuuccuacugcugacuucacuguuauguucagagcugggcaaaaggugugggugcuuccaacaguuagagcacuccccucuuuagaacagccuuuaauuaaagauuaccuaaucuaauguagugccucuacucuuucccagggaaaugauaaacugaauuaauugagcucagauuuuuuuaauuuaaauggcugaaacuuguuuauuuuuauuuauguauuaauuacaguauccugauaaugucaccugcuuuguccauggauaaacucagcccuccuccugaucacuuugucauuagaauuaacugugguaaccauauguccaagaauuuucugaaacauucccaguuucaauauuuugccccaaugaauccauaaacaaauauacaaaauccauaaugaaaacagccaaggaauuccagugcuucagugucuaucaugcuuucuccauaccucauuuucauauaaagaaacaaaguaaaggcuuuggggaguuuuuauuuguuuucucccaaucugagcauguauucucuauagcagggguccccaguuccugggucguggaccaguacuagugcguggccuguuggaaacugugccucacugcaggaggugagcagcaggccugcgagcauuacugccugagcuccaucuccugucagaugagcugcgccuuuagauucuauuaggaggaagaaugcucuugugaacugcacaugcaagggaucuagguugcacgcuucuuaugagaaucuaaugccugaugaucugaggaggaacaguuucaucccaaaaccauccccaucauccccggcccugggguccauggaaaaauugccuuccaugaaaccaguccugcugccaaaaagguuggggauugcugcucuauagcuuuaaaacugugguccucagugggaccuaugaaccucaacugucacucuugguagcucccaguagucuccugucugaauuaucuuaacugcaaaagagaagugacucuagcauucucuuauccuggacucuugacugucaagaucaguuuaguugugccuuucuguguuucccuuaacaguaaauaugauaauagugcugcuauuuuaaaaauauugaaaauacuauaauguucuguguauaauuuugaaauugagaaaaaugagaagccgguauaauuuuaaugcauaggguucaguugauuuucaugugacaauauuuacuuugcuagaguggugaaaguuucuugaacagagagagcaagauuacccuuugcacuaaugacuuuucuuauuauaaguaaguauuugacaaaaaugugucacucccauuugauaauguguuaacauaauggucagucacuugaaaaugaaaacuuaucacaauauaguugagagaucuuguugacugaccugagugcugauucaaauaguauuuggugauucuuuaaucugccccacuuugucuuucagcauuccaguguaucagaguaucauccagccgauggcuaugcguucaguagcaacauuuacacaagaggaucccaccuggaccaaggggaagcugcuguugcuuuuaagccaacuucuaaucgccauauagauagguaacauuuaaugggcacccuuuggagagcuguggauaaaugucucugaucuagugcuaacagaggugacagugucuguauugucuacugcuucuuuaaacuuuccaucuguuaauuaguugauaaaguuucaguuguuccuuuagagaacugguuuugaucaacaaaagaugucuggaccuucagucuguaauucccauuuagugcaaaugccuuuggaugacuuuccauuuuuuaaaagauacuucggacaaaauguguacauuaagaagaaagaauugucuugaaacccuccauuaguuuguaccagauggucucugaggauccuuccaguucuguagcuuuuaaagaaaacaguuuccaucuuuaucuucacccaaugaaaacaaauaaaccuuccuuuagacagauauauuuaaacugaauauaaacuaaauauuuaaacagggucaaugcuuuauuagucauucuugccauuucaucuuuuuaucuugacuuuccaguuuuacauuucauuuauuuuucuauaucuucacucuuaaaaaauuuaauauaggcagagauggagaauugggaugagaagaaauaaaggaacuggaauaaguucuuuuuuuuuaauuuccaaucuuguuuuuaguaaaugagaucuacauagagccaagccauguagaaaagagaaaaggagguaaaaucuugguaacacgguuauaggagaagggucauucagugaacugggaauagagaacucggccuaguacuuuccugccucaaaagccucucuuaccacaagaguuauaugcccuuuacuucuuuucuguauacucuuuucuuaauauaaucugaagaaagugggauuuaaaauuuuuauucuuugucagggguggugacagguaaugcuuaaguaauugcuguagaaauuacacagguauaacuccaagggcaccagugacauuaaauugaguacaaagaaaagucagcaaugaauaauauauuuuuuaaaugccaacauaugagaauguuuuaauuacauaauuaauuuucaguagauacaguugaaaaucaguuuugaagcuuaaacauuauuucauugaaauccuuaacuaaguauucaucuuaauauuuucuuuuuucuuucugucugucuuagaugucaauauuuuagaaaucauuucagauuaauagguuucuuuuuguuuuaucacuccaguaauucagaugauuuuccacagcuaaguagcuagaaaaccacuugaguacauauguagaguacauauugacacuagaaaacuuuuaucagguuccauuugaagaccacauuuagcauacuguggucacucaguaaguguagauuuauuugauugauggauuggaugaauaagugcaugagaguauaucuaguauuucagagucacuacuucccuguccuucaccugcauaucuauaagggauaguauuacugauggaauaaccucugccauuuauuuugggcaccuuaccacagagucuuuuaaaagcuuaccuugauuuuuaugaucuuuauagaauaucagggcaguauaccuuucauuuauugauuuaguuauaucuuuguaccccuucugcuuccaaaauagauucaguuagcucacuuaaauuauauguaguuaaagugguauuauuauugaaaguuaaauaaugaaauaaaauauaaaauuaagaaguuaagagggaagaugagaauuuuuauaaaauauaaaaguugacacuauuauugaauuucagauuugucuuucagauuuuuggcugucagaacaaaaagagaaacauaaucauuggcugacauuaggaaaaggaauaaguaucaguucaucgggauaaaaaaugcuuuucuuacuccuaaauucucaauaauauuuguuucaugaaacuuaauguaggaugggauaggugaugucagggacauuuauuuuuaacaauuuuuuuuccucaccacagagaaggcuguggugaauuuuauaagguuucuuuuuguaaccuuugauaaauagaaauuuaaauaaaauauaaaaauagaaauuccaugaagggauaauagucuagaguggucagaauuucaccauagaaagaauuuuuuugaauaccuugagugguggguagauuuuauaucucaguuguucuuauggauucugucucagcuggacuuaauaggagcuaggauaguugauaaauacaugaaucauugauguucuauguugcuaagaacauuugucaucauuuugaaaaacugucugaaaauuguggucugauauaaaauacacagagguuuggaauuuguuuuuauaaauaauuauuguugaccuuaaacucuauuacauaccaggaaugcaguagauacuguuaaaagaaaaacuucacacaaauuaaauuuaacaguuuuuuuuuuuuuuuuugagacagagucuugcucugucgcccaggcuggagugcaguggcgcgaucuuggcucacugcaagcucggccucccggguucacgccauucuccugccucaaccuccugaguagcugggacuacaggugcccgccaccaugcccggcuaauuuuuuguauguuuuuuuaguagagaugggguuucaccguguuagccaggauggucucgaucuccugaccucgugaucugcccgcuucggccucccaaagugcugggauuacaggcgugagccaccacgccuggcaaauuuaacaguuuaauugaacaaggggaaaaaaaaguggcacaugaauugggcagcccccagaaucacagcagauucagagagacuccagagaugccucauggucagagcaaauuuauagacaaaaaaaggaaagugacguacagaaaacggacgugagguauagaaacagcuggauugguuacagcuuggcauuugcacacaauuugaacagucagcagccugugagugcuugaaguauggcugcugggauuggcugagacucagcuauuguuacagaagcauacuccuaaauuggguuuucaaugugucuaccuacuaaauuagguuaugauucguccacaggacucaaguauggaaguauagaggguuucucagaacauauuuagcuuaacaaugccauacgaaguauauucacuguucugugaaauugcuaugccauuagguagaacauuuguugaauuuagagcccacgccuucgaguuuuauagcuuacugcugucagaugcaauuaguauuuuagagaaguucucaaauuacugcugucucuaugucugcucucuaucaaguggcguaucuauuauuccuaaucagaaacugagcccauacguuuuguuacauuccauagcuguuaagaaacuuugguaccucuuuuuuuuuuuuuuuuuuuuuucgagacagaguuuugcucuugucgcccaggcuggagugcaauggcacgauaucggccuacugcacccucugccucccuguuucaagcgauucugccaccucagccuccugaguagcugggauuacaggcaugugccaccgugcccagcuaauuuuguauuuuuaguagagaugggguuucacgauauuggacaggcuggucucaaacuccugaccucaggugauccgcccuccucggccucccaaagugcuaggauuacgggcaugaaccaccacgccuggccaagaaagucuggcaucucugaaaaauuacaaauugugauugucuguuugauaacuauggucagugucauauccaugcuuaacauauagagggcaaaaaacugugagccauaaagauuuguaaauucugaagcacuucagguaaacacuucugagaccugcaagauaacaaaaaauuuguuauagacccuuaacucuccauuauuaauagugauuaucuugcagaucauaggagaaaggaaaauaggggaagagaggaagauaaaacacuaaaauuacuguuuuccuaauguuugggguaguugaaucucuuuuaucugccaaaugaaaucuuaguagauuaaaugugaauauauaaaguaaaugaaagcagagcuauuccaguagggauagggaugggaaauccauggaacacaguuuuaaaauuauuauuauuaauaacauaauuacuucaccauaauuucaccuuuuccaccaauuuucuuuuuaaugugcuaaaaauagccaauaagcuguucuuacaugcuuaucuguaagguguucuauacuggucaucuuuuugcuuugucccugucucccuccuccaauggaguuacuaccuaagagguaacaaaaaccuaugacaggauacauuaugucuacaacuguccugcaggcccugguauaacauuccagagaacuugguagacagcaaaaagaauggcaacuuuacagggguaggaugaccuaacaucuuuagucucuaccugcuauuucccuuguagagauguguaaauaaaugugggaauguaaauggaggagaagacuagggaguaaaauuaauaaaggguuaaaguaauuuuauuauugaaauauaugaagaaaauacaaauauuuaaugcaucaaguguauuauguuacauauaaaaguaaucuuuaguuaaguuguuaaaucuauuaguacucauuuaaugauuagaagagguauuugguuuuuuaaggaaguuuuauuuuaaaaaaaugaggcccauacacuuuuuaaaaguuuauagugaauuaaauuauuuacuuacuuauuugcaaguguuacuagucucauacuuaaugcauaucucuuuuuuuugcaauuuagauaacugggcaaaguguuucuaaaaacuaaugccuaguuauaaauuuuaaauuuauauauuugguuacugaauugcagacauugcuugaauuagugaaaucaacauauaacuaaaauuaccacuauggaaauuaucuucagucuccuuuaacuuuaugaaaaauacuaacauuuaucuuuaucuaguucuuuuaugguagagaugguaauuaacauaauauccaguauguguauuuaguagacaaagaauucauagacuuggauucuggauuuggcuaaguaccaccuggccuugugauuuugcauuauuuguuuuuaucccuggccauaauuuguucauuuuaaaagcaagaacuuuaaaguaacuuuuauuuaucauaauguaaaauauaauaaaaugaaacugcuguaauuuuucagaaaguuuucugguaggauuuggcuugucucaguguuuuccauuuuuauccuuuaggaagagcuagcagaauaauaaucuuuuuucuuucuuuuuauagaaauuaugaaccacucaaaacacaacccaagaaauaugccaaauccaaguaugacuuuguagcaaggaacaacagugagcucucgguucuaaaggaugauauuuuagagguaauauaauuuuuucuuuuuuauacucuuaauaaaguaguuuuauuguauuacucuuuugguauauaacuaaacuuuccuucaaaaguauuauauuacuaaagacguaguauauuagaaauaucuacaucuauuuaguagggguauauagauacuccuucuaaggggauagcuuuagaauacuccuuuauuuguuuuuuguggggaguggcaggguggguuuuuuuuuaacuuccuuugcucucuuccuugcccucuuucuucuucugauauuuauucauuuuggagucaagacuaguuaacaauucagauguggaugcacauaauaguucaauaagagacaacauucuuuuuuuaauccuauauccuugcacagauauacucagcagucauugagcuaauaauguuagggauaauccaccacaacaccaacuucucuuuguuagauucuaauugacaguucaucuucuugaauauauaaggugaauuaucacaauaaauuuuguaaggaaaaaaaguaauuuuuauauacuuuuucuuucuaucaccaaaauggagacaauggggcuuuccaaaagagucauuuuaguccuuaaguccuuuaaguacuuuaguccuuaaguacuucaaauaaugcaggcuguucuuuggagguaaaauggaccuuggguagauucaccauaaugauaccuuaccuacuguauacucauaaaugucuucuuaguguaauuccugagaaucauucaaucaacacuauguugaugcugaguuaauuaucagaaguagaaaaauuuucuuuguugaagucuagggaacuucuuucguagaauggcuuuuauauggaaauuauaccuuuauuuucuuguacaugacagauacuugaugaucggaagcaaugguggaaaguucgaaaugcaaguggagacucuggauuugugccaaauaacauuuuggauauugugagaccuccagaaucuggauuggggcgugcugauccaccuuauacucauacuauacaggugagcaugauuucuuaguaaaauguaguauguacacauuuacgaaguuaucacucuuaaguaggauuuaaacaccuuuguguauugaucauuuugagauguaguugguuauauauuuuuucuagaguaauuggugggggaguggcaauggugagagacacagggaagaauuacacauauguuuucugauuuacuucuagaaauuguucaagauguuuagcaguagguaccugauucucugaaugcuuuuuuuccccaaucuguaguauuucugacauuugaagaaaugguauuucugucuuuuuacccacagcucugcuauccaccaggggcuuccucuugauagaggauggcacugauaucacggcaugguguccagcaguucaccuucaccagcccuugcuuucagucucuuaaauguucugccacugaccagccuugaacuugcacucaucucaccuuacacuaauacaugaguaccuguucaccuggauuacaauauuuuuccucucuugauuuuaagauuaaaagguacuuaggauauagauuagauaggucaggcucucucuucuuguucauugaaggcccaugaagguccauucuuauggcccaugccacauuuucaggauuucagugacccuggucagcucauucacccuaacaucugaauuaacuugcucuuaaacuccggaauuuuagaccugugccaggcucucuagaguuaggucuguaaacaaagacagaauggauggacucucucagguacagccagugaaccugggguggcuucucauucccccagaaagaacucuuuuaauuuucaaagucucgagaaaaagaucacaucugaccucauaauaaugucaugaauuugaguagaagcugcguagaauaugcagugaaauaguuaauuuuuaugccagaucuaggcuuaaaaaaauacagauuguccaaagcuggaauuguggucauacuucugcugccgugacaauuuauuucaguacuuuuggcuccucaugacauucaugccuggugucaguccugugcuuauccagagggacuuggccuuacuagaauccaugaaucaagcaaacauucaaaauaaagaauuuguguauaguuucucuaucucgguaacuuaaagugauggcaauggaaauuauuugcuguguuauguuuuggcuggccucaugugcauauauauauuauguacuuauuuuauguucaucauuugucauuagcuguugaugccaaagaaggaguuugaguuauucaagguauggucuccuccauuucccauggguuuuugaagugaauuuucuuaguuuuuauaccuuuuucuuuucuuaguuccuacuuuucugaguuuaauaucuguuuaccuaauauaauauaugcuucugucugguucaugaauaccaguucuucauuuucuuucccauagagguaguauaugcuugaaaccuauacuuaaaauaaugguagaguacauaccuuugggcuauaucaacuaauuuuaauaugcaggucaugguaagcuaugagaagcacuauucauaaaggauaucccugauccccauaugugagcaaaaggcaagaguuuauauuuuaaguuuugaaaacaauuauccaaauuuguuuuauuugugugugugguugcuaggaauaagcaaacugcgauaaaauaaaaaacaugcaaauaguaugaauucuauaauaggaauuuucuccuaccugauauuccugaaaaguuuaauaucucuuaccuuuugcuguuuacuguucagucuugucuuuuucuuuaauucugauucuuggcuugagccauaaguugacuuuucuguuuaaaagguugcuucugucuaaaacugaaccaaaacuauuaauauauaucauacgcagggaaaguauuuucagagaaugucaaaccuauuccuccuuucuuaaacagaaccucaucuuuuauuuuugucaacuuuggcacaacccaagaaauguuuuuaagaguucacaaguuucaggaguuuguuuugcuacuuuauguaaauagaaacuugugguucuuauagggauugccuauuuggcuauuucguuuuaaacuuuucaacacuauccuacucucuucuuaaaaauucggguugcaacuacaaauguagugguguguguagaaauguguacagaagcuuucuguguguaugcagaagcguaugcuguucagguugagggcccuacuuugaaaauguauuaaaaacaaucugcuuuuuaacaccuccugaaaauuuugggcugagcucaacaaaaccacuaagaccuuguaaaauuuuaauaagcaagcuucacagucugcuuugcuaucugcuaucuggcauaaauccuacucuaaaaggauuccuauucucaaaacauuuauaauauauucuuuaaaaaaagaauagaguaaaauggaaaagaaaacauccuuggaaauaugugccagucauuuuucuaucucuacaacaguagauacccauaucuacuguuucauaucucuacaacaguagauacccauaucuacuguuuuauaucucuacaacaccagauacccauaucuaaaauaucuaaggaagaauccugcaacuuauuucagaaugauaauuaagauaccaccauauuuauguagauuccacugauccuaauacccuaaccuuauaaaacucaacuggauuacaauuuuaugucuuacucaucuuuuuauucacucauuccacaaauacauauugaguacuggcaucucacacacuugguaaaaagaacaauagaaagccuagcgccgagcagauccuucccgaaagccugcaugaguccacaggucaucugccauggcuuugcuccuuccugcaugcuugcuguaucaagagcagcgugacccucuuucuccuccucagauauggcccacacauuuguuuucucuuccaucugucucuuucauccagugauaucaaaacuuugaagaaauauaaagaaacuuuaacaaaaauauuuuagauuccugcaccaugcugccaaaaggaagcaaugauucauuacuuaaauuugcuucacauucacagaaaacaacauucacagauacuccucucuagagaagauaugcccguggccagugcucaugcugugccaggcauuguuugagcacuucgcaaauccaaauucauuugauucccacaacaaccuugugaaggaggcacauuuuuuuguaggaaacuaagguguaggagaaauaauuugcccagauuuauacagcuguaugaagccaggauugggccccagcacucuggauccagagccugugcuguguugcauucugcuguucuagagaauagugauuauaaaagguucucauuucgggugggcacaauggcucacgccuguaaucccagaacuuugggaggccgaggcaggcagaucacuugaggugaggaguuugagaccagccuggccaacauggcaaaacccugucucuacuaaaaguacaaaaauuacccaggcaugauggcacacaccuguaaucccagcuacucaggagacugaggcaggagaaucgcuugaacccaggaggcaggggaugcggugagccgagauugugccacugcacuccagccuggcgacagagcgagacuccgucucaaaacaagaagaaaaagaagaaaaaacaaagauugucaucucuuuuuguauaaacccauaguuuuucucuguauuaauguuuaaagugauauuuucucagaauagcuuuacuuugcauuauacugugauaaaaguugaucugaucagucacaauccuuggaauuugauuuuugcuuuauguauccauucacuggauuucaugguauuguucauuauuuuauaauuuaggaaaauaacccaaauuauaugauuuacuuagaauaggacauuuuuguaagugguggaaauaagggaauuagauguaaacuauuuccaugcaacaucugugagucaccaaauacuuaaaaaaagggacagucaugacucuuauuuuuauacccuuacauuuccuauaaagacauauauauaaauaauggcaguuucugggugaagggcacaagugcagcucuugccuauuguucacacacuuuuuaucagagauucuguucugaugacagggaugcucauaccaggcagugaauagguguugaauugccaccuggugucccugagagucuaggcuauuuaauauccucacauuugaagugauuuuuaacagcucuguaaagacaaccauucccaccuaauguauuucccccauggcuucagcaaaguuuuaaacauaaaagagaaaguaauaaaaauuuacaaaagauauugacacaaaagauugaauaaaccacagagaaaaggaaguaaaugcugaggagagauuauggagagauaacaugucuugauaaaaauguuguagagcauuccaaggcuuuguaguauuuuagcugggcagcagauggacauccaggguucuuucuccccaccuggaagcuacuugccacauaaaguuuccugaucuuuauuuugacuugauucucugaccucuagcccugugacugcucgucugcuagaauuacccuuuugcccauuuaaauuugcaagguauaugccaagagcagaaaccaccuccucccgugauguuauuuauuauauauccaauggacugacuaaagaagucuuucauauauucuuaauuauuaucuaugcguuuauuauuguuauagguauucuuacucuaccaagaugcaaguaauuaugaauguccagucucuguggucacgugaauucaacaaaacguuucccauauucuuuauugucuagcaagagauacuguaauaugauacugugugaaaagccccaaucuagguauugguaggugaggguucuaguccuuaaagagagcauuuuauuuuucuguguuccaauuugcuuggucaugaaauagaaggagucaguuaugugaucucuacaauccagucuagguauaaaaucuucucauucauuauauacauguuuaaaucacccuaaaauaaaaguggaaauguuuuguacaggugacuacuaaaccgcuaacacuacuaauuucagccuauguuauuagugcucuguuuuuuaagcucaguacagacauuuagcuacugcuggauagagugacgauuuuaccaaagauggcuuauauucuuccagccaggccaaccuccugauaauauucaguucuucaaaaguguuuuuuaaaaauuaauaucagaagacucugcucauuaauuauaggcaugguuuuuagacaaagauguuuacuuuuuauucugucacauguauugacauuuucccagagacuucuuaaugauaauuugaauaauacccacuauaaauauauauauguguuuuuauacauauauaaaguauugauaauuacugucugacaugcacauguacauaauuuuauuaaauguucuauguucaggcugcuuagaaaguuugaaacuaaagcucauuacaaucacacgauaaugcaugcaguauuaccuucuguaaaaucagcuaauuaaacaagaauaacucuuacauguaaugcauucuaauuguauucuuuaugagcaauaggaauaaaauaaaccuauaucuuaguauuuuacuugaauauacaaauaguuacuguugaaguacuuuacacgguuucuacuauaguagaaucuauaugauuaguuuuccauggcuagauagugaugggaauuaauuauagauuuacaggcuccuucacugguugauugugggcauguaauuuuacugucaggcuaauuuacucuuucugauauuugaugugaauuauaauugauauuauuuuaauuccauuuccuguauuaauuuucucauuugaugugauuugcuccauuuuccuaauagcaauuacuuggcgagcugucagagguaacccacauucguucccucauggcacuucuuuuuaauauaauuuuuuggauucagucucucaacuuaacacccuccaaauguuccagcugugcuuaguuuucacugcagaguucccaaauaaccaaauuuagaggaaaaauguguaauuuagaguagguuaaauauuuaagaacaguucaauuuuaauggcuuuguugcgcuuacuugcauaauuuccccucugaagcagcaucuuguaugaaucaggaucuuaucucucaauagcauucuuuaauucuuuagaauuucuacucagcuuaaguugcuaaagaaaagugacucauuccaacuuaauuaucaauaggaaaguaaauuuccuaugaggucuauuaauucugccuucuuucagagaaagagagacaaaaagauagauuuugcuuuuaacagaacuuuguguuugugggcuaucacaggcaagaguaaggaagugacaguugggugcaaaaguagguccacaccaggcugaccaacccucccaguucccagcuggggagucugagggguuugugaagauguggaacuuucagugcuaauuacugggaaagucucaggccaaccaagaacaguuagucagaauuucuuuuuuggauuuggagcuucaguacguugguucaggagaaaaaaguucagagugcacuucuguucuccaagacauuacguaaacugagauacguuggaaucauuaacucuguagcuucaacaaaaaauagccaaaagacagacauaaggaaaggaagaacaguaguuggguguuagguaaagaggaguagagaagcuagggagggagacagaaaagugacguuaggagucagugcugauucuuuuucuuccacaugaagaauuucaaaccaguuuccauggaagagcugucuagguugccauucagaaccaguugucacgauucaaggaagguacuuugccccuuuuaaugucagagguuggaaacauggggcaggaggagaggacuaaggaaagaggaaaauaugcaaguaaauauaauuuauggcauacauuuucauauggguuucuuuaaucaaauauguauuuuaaaccuauuauuuugguaggucauacugauaaaguugcauuauguaacaauggcaugaaugaaauaaagcacagaacauuuggugaguuuguuuucaggcuugauugugacaguaacacaguuuauucacuuucucacaauaguauuugaugaauagcaaaagcaaaaauuaugaaucauauggaaagcagggcucauggcauuuuuguuuguuuaggcuuuaaaaacaauaauugaaacuaugaugcuuuugaaacacuaaugugagaauucauuugcccuucaugaaauuacgugcagaggacauucuugucaagggaacauugcauauacauuaaucagaugacuuuggugugugcuaaguauuacauucuggugauguuugcuguauuuugacugcuuuaaguauuuuauuggcccaaauauaggaagauuguuuguggggaauaauaauaacaauucauucuuucauucuaauacaguauugaauacauuaaaaauauuucuaagccuugaaugcuaaggggauuagcaacucaguuucugucccaccuaacuccuucucuuacucugagaaucuuacccuuuacucccuccuucccuccuguccugccucucuccuccuugcccuccuucuucccucagcaucuaccagcauuauaaacacuccuuucagauauacuuccauccuuucauaauacgcuucccacuuccuugaccccaucccacuggucagugaguaguagagcgagcugaaaagaaugagggcuccuucccacaccgguuuccacagguguuagucauuugccgugaaguggacugaugaagguugauguguuguuuuugaguaauaguuuaauuaaaaagugaugugucugugugugguguguauuuuuguuuuugaucucuguggaaauugggaggacucuguuaaaaucaauacuaccugauauuugggccauuuuagaauuuaaaaguaaauacuguucuaaucaaaggaccagauuaccaaaaggucuuuuugcauguaauaugcuaauccuaaauuagaauaauuaaaauugugccagugcaguaucuaaacuuugccuuaauuacaaauaauuguccuguaucuuugauucuaaaaagaaaaugugccuuuugagaauuuggagacucucacaaugcauuaucuauuaaaauuauuuuacuuagauuuaaaguguuaacuauuauguguguuuuaaauagggaauaugcacaaaugcuguuuuauaaguaugccuaacaaucaugauuuuaaaauuauuaaaaagcauuuugucacaccuaccuuuuuuaauacaaauggccacaggucccuuucuaguauucguuuguaaguugcaaucauaaacauuuaaagaccauaccauuacccucacaaccauccaccccgugacauuuccauuuuaacaagggaaauuucuaauuuuaauaaauuagcauuaagaugauggcagaaaaaguuaugccuugaacaaaauaauaccaauauuuuaaaauuauuuauuggaaacaaaauuaaaaaucuuugaauauagcguacauuuaaaaugaguaagugaugcuuuaugcuguugacauuuagacuuccagugcaauuggaaauuauuauuagcauaaauuaaaaaauaauuauaaaucuuucugccuccccucaucuugugugauuccaagcccaaauucuguuuucuugacauuuauuacuauaauacuacuauuugcuauugacguagccuugugacuccuuaacuaauguuuugacuuugaacaaauuauguagaauguuuaaaauaugauuuuuaauggucauuauaccauauaggauuacagauaaaugaguaauggguuugcaaguaaguuuaaaaauagccaacaauguccuaucaaaguauaauuuguuuuccuagccuagguuuauauuuuuuaaauuuuaaguuaauuauuugucuuuuuauagaaacaaaggauggaguauggcccaagaccagcugauacucccccugcuccaucaccuccuccaacaccagcuccuguuccuguuccccuucccccuuccacuccagcaccuguuccugugucaaaggucccagcaaauauaacacgucaaaacagcagcuccagugacagugguggcaguaucgugcgagacagccagagacacaaacaacuuccgguggaccguaaguuucccagggaggcaaaaaaugucuucugcaaauuaaaagcacuacuaaguaaaauauuguuuacugcugauucuacuuguauuaaaguccuuuauacuugcaugguacuuaauagauugcaaagauuuucaccugguuucucaucagcuacguaguucugagaaacaggaaguauucucuccacucucuaaugcaugccuuucuacuccuuuuccaaucuguuaugauaauugaaugcagacucuggagccagacauccuggaauuuguauaccaaaacaacacuugccagcuuccugaccuucaaugauuuaauuauccucucagcacuucaauaucuaaaaaguggagaaaaauaauaguaucugcuucauaggauaagugugaggauuuaaugagauaaugcauagaaagcaucuacuucagugcuucucagccaggagcgauuuugucuucuucuccauccuucugaggacauuugauauugccugaagacauuuuugguugucaaaacuggggggaugcuacugaugucuaauggguagagaccagggacacuuagcaacaauuacaaugcacaggacaguccccagcaacagaguuaucuggcccaaaauaucaauggugcugagguugaaaaccccugacugauuuugaccccuguaugacacguaauaugcagucacuaacuacauccugcugucgccaucaucaucaucaucauaaccuuccuacuucucuuccucuuguuugcuauucacaguagcugcacaaucacacuauguuaauauaaucaccugccaauaguagucucagauuuagccuccaaauucaaauuucaugugacuuacacuucagugccauauuuucauaacuugaaauuugauguuucauauaaaugguuucuaugaaaaccauauuuaaguaaacuaaaaagacacuaugaccaacuuuggauuauccuuauuuguauuauuggugaauagcaguguagauauuuugaaaacugaagguaguuuuaagauaaauuuuguuuaaccuuguaguauauggcaugucaauuuaaucuccaaauuugguguuuuaaacguauuauaaaguuacuuggcuuuaccuauacuugauguguaaaaacucuuggaaaaccagagcuaugaagauauuucauauuuccccaauaugacaaaaguauaugaaguguguguguguaugugugugugugugugugugugagugagagagagauagagagacagagagagagagauggauaucuaucuuucccucaaugugggccucucuuaggguucugccuucguuuuccacauaaacauacuuuuacuguaguucauucuauuuccauuucuuucaauacuauuuauauuguugggaaaagaaugauucccaaauuagucaucguauuaaaacucaucucugacauccagauaccaguauggaacuauuaacuuuauagcugagauuggaugcuuucuauuuauguucaaaacuaaauggcugaaucuuucacucccauuuucauccuacuguuuuucucacgucaguaaguuauugccacaucuguucaguuguggacauucuugauaaaauaaaaaauaaaaaagacacuaaaacuauuacuauuuaacaauucuaaaaauucugguuaaaugcaauaagcauaagccuacuuuuacucauuaauuuuucucccacgguauguccaauuuaaaugacugucauaucuaucuugccaggaaacuaaaggaaaaaugaaguuuuggaaaagugauuagcucuuucuguacagcaaaaacaacugugugcgugaguguguagaaccauaauaaaauagaauaugcuacuaaguuuuuaaaauuauguggaguuuuuaaaaagaguuuucuuuuucaaauacacuaaagacauaguuuuaagaugagaaauuucuauaaauauuuuuauugaguucccuaaggagaaaacuuccucuuagaaaugacuguucucuucuuuauucuucccacaaguuuauagcauuucccuccguagagacgucagcacagucaucuuugacacggugggacucuuuauccaggccuagcuaggaucaaaguucaucggccuccaguccccauuuggagcaguguguggguuaggacagucuguucuuuguucacgcugagaaaccaagaauaaccuagugggaaagaggcauaguuugcauacuuuuaaagauagagaacucuccugauaauugugacucaucauguugaagucuguuuuucauaaguaaaaggguggcauugguguauaaaauauaaacaucucucccaaaauuaacacacauacuuguuuccuuagaauauuaaaaaucuuacaauauauuugcaacuuauguaaguuccuuuuuaaaauaucucaaaaauacaguuuggcauuaaauaaauauauuucuuuuuauaaaacaaauauuucuugauaacuuuauugcagaacaguuuuucucugaaugaauguuggggcuuaauguucuuuuagaaccagacaguagcacauauuucaguguguguuuauugauagccaaauuucucucaaaauaugccuacucaucuacccacauucucugcuuacugccuaaacuucugguaaaaauaaaaugaaaggaacuaggaaguaaauacucauagaaaucuaucaaguagcagcuaugaacaggggaaaaaagccaacaugccuguuuuuacaacguagcaaguggcaagagugaagcccuuuuguggaagucuguguguugccuauucaaaauaacugugaagccuugugucauagaagcuauucaggcuguuuuaucgcaggaucccaaaagguucuccuuuuaucgcuuuuaagaugccaaacuuuaguugcuuuguauuucucccauuuccuuugaaaugguaguccuuuuauucgaauuuaaucuuuuguaaucagaguguuacuuuagaaagguguaaaguuauucugguuugcuguuguguguuagaacauuggaaauggaaagcaaaagcccaggaacauguuagguggagguuuuuuuguccuuccuggaagaaaacuaugcuguggacuggugaugauugauauacugacuaagucagcagaugagaaaccaaaucuuuuaguguggugauacauuuuauuuuuuauucuuuugagaugcacucauaugcuguuugacaguuuguuguagugauuuuuuaaaagguagcuaaugaaaugcacauaauguauacuuaaauguaacaaucaauaguauucucucuuacucucucuagcacccccuacuccucccucccucccucccuccccuuuuccccuuuuuugauuacuucaaaagauuuccuagauacuugaggcauuaaaaaaaauuagacugaaauaacacuaacuauucacacuuucccuuauuucccaggggcaccaaacacuuucuaaaacccuuucccuaggggggaaaaaucauagaacauuggucacaaaaagcucccuaagugaccagguuauugucacuugccaacuuaauuagauuguucuuauuucuugaaagugaaaacaaacaacgaacauaauguaccuauguauauauacacacauauuuuaaaauacacagacacaugauuccccuuccuguacuuuuaugccuuuccuauuuuugucaugacaguauguucauauacacacacaucuuuuccauuagcauaaauggcuaggaaaaaggaguagcuagggaaguuaaucaaaggugauuuuaaugacuuuggcuauaaaacagcccucugcugaaagucagaagauccaguucuagcuaaauuauucuacuaauugaaaugugacuuugacagaucauuucucuguuuuuggccuucauuuucuuaucugguuauguaagggguuuguacaugaugauucucaaagucucggugaaaaagucagcagaaugccucauucauucauuuauucaacaaguauuuauugaauuaaagcaccguuccacguauuaggauauagaugcaagcaaaaaagggaagcauccuuuuucuccucaggcuuauauuuuaaugaaaggagguagguuaaaaaacgauuaaguuggcugggcgcgguggcucaugccuguaaucccagcacuuugggaggccaagguggguggaucacgaggucaggagauugagaccauccuggccaacagggugaaaccccaucucuacuaaaaauacaaaaauuaguugggcaugggcaugguggcacacgccuauagucccagcuacuccauaggcugaggcaggagaaucgcuugaacccaggaggcggagguugcagugagccaagauugugccacugcacuccaguauggcaacagagugagacucuuucucaaaaaaaaaaagaugauagacaaaacuaucuaucaagaaggugguaagugguuuggagacuaauaaaacuauguggauagagagugcuuuuggggagggauugcaguuuuauauacaucaggggaaauagaaagguggggaggaguaagcuauguggagaugcgggggaaagcauuccagacagagcagacuagaguggccuuuaaauuugaagagcaccaagggagccauugggagcaagagugaagggcuccagaagaguuguggaguggcuuuagagugguggaggucuuguagggccuuuuacugggaguaauuaggaucacuugggaauguuuugagcagaggggcugcaacaucugacuugcauuuuuuuuuuuuuuuuuuuuuugagacggagucuugcucuguugccaggcuggaauacaguggcgcuaucuuggcacacugcaaccuccgccuccuggguucaagagauucuccugccucagccucccgaguagcuggggccacaggcacaugccaccacgcccagcuaauuuuuguauuuuuaguagagacuggguuucaccauguuggccaggauggucucgauuucuugaccuugugauccgccugccucagccucccaaagugcuuggauuacaggcaugagccaccuagccugacuuacauuuuaaaagaaucacuuaguuguuauacugagaagagaaugaagagaaauggguagggugguagggaguggaagcagagagaucuguuaauaggcugguaacucagaccaagcuggcaacagaaaaaauacagugaaaucauuggauuuuggauacauuaugaggucagacuaacaggaucugcugauggauuggauguaguauaggacaggaaucaagugcagcuccgugguauuuugccagaacuggaaagauagaauugucauuaagugaguugagaagucuaaaaagcaagucuaagaguucauaaaagcaagcuucaggaagaagaucgggaauucagguuugggcaugcuauauuugacaugcauuugagcuauuuaagaaauacccaaaugaauauaucaaguagacagcauauaugcacccaaguuccgaguaagaggacuggaaaaauaauuugguaaccaucaucuuuuaaauggccaugaaccuaagcacaguggucauugauggagguagugcuggcagagaugagucucaggaguguccccuagagcaccuuaauauuacuuaguuggagagaugagaauauucagaagaggauccagagaaggggaguccagaaacaugggaggaaaaugaggagacugugguauccuggaggccacagggagaaaauguuucaaggaggaaucuucugcuucaaaugugugcugauagguuaaauaagauaguagcugggaaagaauuggcuggaguuuagcaaaguguaguagagagauggggggaaaagcaaaauugaauuucggcgacauuaagagaaaauaggagaaugggaauuggaguccacuaguacaggcaacuuuucgugaacuuugcuguaaaaggagcagaaaaaugggcaguagcugggaaaggacaugguaaaaaggacuuguuuaaagguaacagaaaucauaaaauaauagcauguuugcaggcugaugaacugauucagugaagaaggaaaauuaauaacaggauaaauaagggagaaaugacucaguauuugaauaggcagagaacuugaggccuagugcauacauggauaguuagccuugggagcagggaaacagcucuuauauaacauaauaggaaggcaggcagaacauauggggaaagugcuguuaggaagaacuacuagaggaacuuacggagguuuucuucuaacuauuuuauucauaaauuaggaaaugagaucagcucaaggugaggauuggggaauaggguuagaaguuuguagagagaaaguagaauauauucaauacuugucuaagacagugggcaguuacaugaccuuaggcaggacuucuuggccuuugaggcuggguuauucucugcuguaggagaggcugacauuauagaauguugugugcaucccaggcuucuacccacugugugacagcagcagccuuuccccuuuuucucccucaauugugacgaccaaaagugucuccagauauucccaaauguccucuggggccaaaacuguccccaguugagagccaccagucuaaggaaauguaguauaauugucaggaagcauuaacagccaaguuaagguucauaaucaugaauuuaacaugagaucauucagcauuguuguguuauauucagcugugcaggugcaggcacagaauacgcagaaaguuagguuuaaccaggauugggguuuugccaaaggaguacaaugaagagacuagagaagagccagggaguuauuuuaauaauugaucauggcauuuauaccaggcgaggauaaaagugaggaaagaugguaggaacacuagacuguagguccuacuggggucaaggauuauagagauugggguucuagagagggugauguaauauuagggauuuucaaaaagaaccuacucccuguuggugucuaggaaggaaaucucagauggaggaagugcaagaugaacucauccacagacugaccauuggucggagugccgcucagaagaaauuccaugugccacggcagaacgugccaguuaucaauaucacuuacgacuccacaccagaggaugugaagacgugguuacagucaaagggauucaacccugugugagucucucugugaauacuuugcaauucuguguguacaacaugcauuguuuucaauuugcuuaguuagaugucacagauaacuguuauaaaacauaagggcacagacugcauacuuugugccauacucaagaacucacuauagcuguucauagcugaaaaagaacuaaaauaagcauaaauaauuauucugaugccaccccauuuucgaauugguaguaucuguucauuauuaguucuuuaagcaaacuauuggcagcuuugaggcccaguagcuucuuuucuccaucagauuacugugauguaaccuagguaggaccauggucuuagcugaacuuccuagaccacauaggacauagagcauaagcuuuccuccugcugcaggauauagugucucuggcaaauaaaaaauaguguuaccuagcaucaauuauaaucuuaauagaacuuuuccuuuaauaaacccauaguaaagguucuauuuaucuaucuaaaagucuauaaacauuucauauguauuuggcacaaugaacuauuagaauaauacauauucaagggaccuugacauauuauaaacucaccuacccagcaugauugaaaaaugagauacaaugguuagucaauugccagguuacuagaaaguuaucuauuccuucuauaaaacaccaaaucccaagaauugguauuaaacaaugacccuaaaccgaauuggcucauuuuugauacuuuguaauuaauaaucuguauagccucagggucaucaucaugaaagaaacuugucauugcccuaacuauaaagacuguaguggcauuuaauaaggguuccaggguauggaacgcuuagaaaagagaaguuacuagcaggaacagauaauuuucuccuuuguuuguaggcaauauuuuuaaugcucaguuucuuuuuccuuuuuuuuuuuuuaggacugucaauagucuuggaguauuaaauggugcacaacuuuucucucucaauaaggaugaacugaggacagucugcccugaaggggcgagagucuauagccaaaucacuguacaaaaagcugcauuggagguaugacuugucaaccuaaggugguguuuuucugcaaauugaaagcucuggaaacaacuauuuauguccauauuggccaauuucccuuucuuaacagagcugaauuaaauuuaacucugcuuuuguaaauuugucacugagaucaucaaugacaguuuccagaagguuaauuuguuauaaaugcucauaugaugugaagcuugagcacauacuuuuggaaacuugacaaaaagcauaauguucucauuuuauauguauugacuaauucuauaggaaauuuaauuuugacauaacaauggaaauuagcuucugagugaguaagagccuuaagaggccagaauccuugccuauucuuaauauuuuuuuuuuuuuggagauucuaauaacguauagguuauaagauuguaaaacccuggcuguguguguuaggucuaguaauacaucucaauaaucgggaaagauacauuagguagagaucacugaaaauagagagccuggaaaaguauuuaaucacaauggucuguaugaaagcaggagagucauguuuucuagauugcuuuauacuuaagcuuccaauauccuauuuuagacuuaaaaugugcuauauacggguaguaguuuccaacuguuacaucucacagcucuuaauaguuucaugaaaauuauacuuggacucaaaugaaagaauguaggcuuuggcaugaaauugauccauaaucaucucuagcagguauauucuauaaauucaacaguuaaauaauucaggguaaaaucacuucaugcguaucaccccguagccauucugaaucaagagaaaccauauuucccuuggagguuuucccuacaacauugaucuugaaggcuccauauuaaaguuugauuugauugcuuuccauauguugaauauuaauaaggauuauauauuuuucucaagcaguuuuauuaccacuauauuuaauuuuguugagaguauauaauuacuucuucaagguauguuagaaaaugccauauuccuaaaauucugaauuccuucaucccacaccugccuaucauuauugucauuugcugucaccacccacuucaggauggucucuugcuucuuguucucuuccuauucucugcaugggaacugaggcagaggcugacuaccugagguucuucauguuccucagccaccuucuaccaccucacccuuuccuuggaucuaguuaaucuuuuagauuauuugccuguguugccagagacuucuguugaugggaaaggagaaaagccagcauggucggagggucagaacuauauggaggggaaacugggugaauucugagcccacucuggccugaguuaaaaucuucuaaaggcagaucaguaucuuguuugagcccaaaagaguccuuugauaauuuaccauguuauuaugcuuauuguacacauuuccucuuucucucagcaaaccuagaguacuauacauacauuauugauuuaucuuuaucauguucaaaugaaaggccuggugagugaauugccuuaacagacuuuacaaaaugaaaaauuauuaaugugauauauuagugaagugcagaagcuucacuuaaaaaguagagcuguuagcuuuccuaaagagauacuagaagaaaaccacaguagaauuuuauccugagccauuucaugauaugaccugcagccugcacaagucaguaacuaucuugucugaacuguuuaucuuucaggauagcaguggcagcuccgaguuacaagaaauuaugagaagacgacaggaaaaaaucagugcugccgcuagugauucaggaguggaaucuuuugaugaaggaagcagucacuaauuuguuuguuuguauuuaaacuccauuguuuuuggcauuauuccaacaugcuuuguuuuaagaagccuugaagggaaugucagauucauuuuucuugauguaauuuaucaccauaaaaaaaaacccaugcaaaccugagugagcacaggauuugcuucuaggcccauuauuuuuauuaaaacugaaaaaauuuaaacugaauuuuuugaccuuggaaaauauuuuucuuacuuuaccaaggugaaguuuccuuaauuagacuaauuauuuuauccccaucccaggguauaaacaggaauuguuuugauagugguggaguuauucacugcaacaaagcaacaauguuguccaugauucaaaaucuaagcaguuucgauuuugccugugaauauggugucugucauucagggcauagcucacuguaggcuagccucugcuuacuuaagucucuucucugacauacucaauggaagaauauuuagauuuauuuaaaguucuuaaugccaacaguuuaaaaaaaaauuaaaacauuugaaugaacuguaaaguacagccauaccuuggacaugcaaauauaaaucuauggagcauucucaagagaguuugucauggcucuguugauugcaacuccuuguauagcuuguauuuugauuuaguuuauauucugcuuauuauguauacuguguucuuauauaugagaaagcacaaaugcgaaagaggucaugucuucucaaaaucuagcaaaggaaguagucugcauuggugugcauuacaguauuuugcuuaaugaaagccucaguucugaauguugauaugaguaguuaaaaggaaguggggccauuuuauguguuuaucugugucaaguauuucugguaauaagaagcacuuaauuuacacauauuuuaauccugugaaagauuccacauagagaaaagaaagauaccuaaccuucaacaaauguuauuuuuggaaacacaauuuuugucauuaaauguuauauuauuucacauauauaaaacagauguuauguaagaauguuguauauuuuaacauaaaucauuuagagaaauuaucuagauucauuaauuuucauagugccuuuuucacaugagucagcuggaaagucugcaauaaacaguauuugcugucuguuaauaaaugguuucugucucauuagcaaaaaggaucugugcuagaucggcugaggauucgaguugaaugcaaugggaaaaaguagagauccacauuuuaaaaaaacuauauauuauucuauuucugaguggguagagaaacucuagaauacuuuuuucgguuguuuuucuucuuuucgccucuuguuucaucaucuuuuccuucuaccaucuagucauauuugguaaugguaauggaacuaauuuacacugcgcuuacgauugcuaaaugcuuccauauaaaugcuuuccuggauauuuacaacaacucuauaugaauuauuacagaugaggagauuuagcuuccuagaagcuaauuuuccccagauccugaaggaugugggaguuucucaucuucuaucucucggucucucuauaacacugcccuuuggauaaaguggaacaaacaugagcaugauaaaggugaauuaguuuagaucuuuuacauuucauaaggacugauacauauguauaauuuagccuuuauugaaagggauaagaugaaagaaaauaagauccaaaaguuaagauaa

SEQ ID NO: 14951 - RNA, 1357 nt, Homo sapiens
ccucccuccccaagauggcugcugaagaugaguuacuguugccgcggcuccccaugcugcucgaaacaggcaaacagcuucuggacgaaguagaauuagcagcugaaaccaccgguuaccagauaguccaggagaagguguucaagggccugggccuccuugagaagguucccgaaauguuaucgcagcucgacuuguucaauugaaaugaagauuuggaagagauugcuuucaccgagcugaaguaccuguuggugccagcacuucaaggagcccucaccaugaaacaagucaacccuagcaagcgucuugcagcgggcucgagaacauuuuauaaacuacuuaacucagugccauuacuaucacauugcaaaguuugagcugcucaaaaccaagaacaacucagcugaaaaucacacugcuaauuccuccauggcuuauccuagucucguugcuauggcaucucaaaggcaggcuaaaauagagagauacaagcagaagaaggaguuggaccauagguugucugcaaugaaaucugcuguggaaaguggucaagcagaugaugagcauguucgugaauauuaucuucuucaccuucaaagggggauugauaccagcuuagaagagauugagagcauugaccaggaaauaaagauccugagagagacucuugaagacagucauuagcuucuaacucaucucuccaggagaggccuccagugaaauccuucauucucacgcggaacacagcccaagccaaauuauuuggagcuaguuauccaagucuggcaacuaugacagugagugacugguaugaacaacaucggaaauauggagcauugccagaucagggaauagccacugcaacaccagagaaauucagaaaagcagcucagcaacagaaguaucaagaagugaaggagggagaggaugaugaacacucuacagaguucgggagugggauaacuggaaggacacccauccugggggcuauggcaaccgacagaacaugggcugaucuucccccaacacgacaggacugcagggugcacaccucccccaccaaggaaaaccaugcaguguuccccucccugggcucccgcuucagcuguguacaacgaaggcaaagaugcuaaauauugcuuugcauucaaugaagugucaagugauuaaguaagugcguauuuguacccuagaugaugugagccagcaaucuuguuuuggcaucaucauucucaucaugcuguauuccaauuucuuaaauggagagaaaagagcgcugagaaauggcucuguuuaaucaauggcugucugaauucucugaaaaaauaauaaaagucccuucuauuaaaaaaaa

SEQ ID NO: 14952 - RNA, 713 nt, Homo sapiens
cacuagggaaaugucgagucaaaggaggagaaaggacagauugggggagaaauaaggugggcacgcaaauauuugguucuguauauuaagaguguucucagcuagagacagauuuggugccauucuggaugcaggugaaaccugaagcucuaauaggauaauuuguuuagcugguuaagggagaaagaacagauacaaaugaaacacagaagaacaaggagagcaaagcuuuaucaaagccaaaggagaagagagagaaagaagaaugaagggaucaguuguauaaaauguggcugagaaauuaaaaagguugagcucugaguaaaguccaaaaguggucauaagugacgauaaggagguuguuggaugggaaaaggagccagcuuguguuggaauaaggagugaaugaguaaagaggaaguagaggcagugacugcuaauuucuaaacgacugaacaaaugccuugcauaaucagugcauuuaaaaguuugugugauuuauauuucaaagcucaccaauggugagcaagaugagacauuuaaaagguuuucagaggcagugaaacaauaauuauucaaagguuuucagauguagugagauaauuugucuaugagaggauaguuggugucagaauucuuuugguggagagagaaaaguuaaaucaucuauauguuaaagaauaaucaauauaugaagaauauuuuuuaaauga

SEQ ID NO: 14953 - RNA, 580 nt, Homo sapiens
ggucagugaaguauaccaagauggcugggugaaaacuugcucuaaaaaccauugacuggguagcuuuugcagagaugauaccccaaaaccaaaaggccauugcuaauuaucugaaauccuggaaugagacccucaccuccaggcuggcuacuuuaccugagaauccaccagcuauugacuggacuuacuacaaggccaauguggccaaggcaggcuugguggaugacuuugagaagaaguuuaauguccugaagcuuccuguaccagaggauaaauauacugcccagguggaugcugaagaaaaagaagaugggaaaacuugugcugagugggugucucucucaaaggccagguuggagaauaugagaaacagcuggagaagaugaggaacuuaauaccauuugaucagaugaccauugacgacuugaacgaagcuuucccggaaaccaaauuagacaagaaaaaguaucgcuauuggucucaccaaccaaucaagaauuuauaaaauuaaguccaggaagaagcccuggcccuuauaguacacauucuggacauuaaaaauaaaaauaauuacauaggu

SEQ ID NO: 14954 - RNA, 580 nt, Homo sapiens
accuauguaauuauuuuuauuuuuaauguccagaauguguacuauaagggccagggcuucuuccuggacuuaauuuuauaaauucuugauugguuggugagaccaauagcgauacuuuuucuugucuaauuugguuuccgggaaagcuucguucaagucgucaauggucaucugaucaaaugguauuaaguuccucaucuucuccagcuguuucucauauucuccaaccuggccuuugagagagacacccacucagcacaaguuuucccaucuucuuuuucuucagcauccaccugggcaguauauuuauccucugguacaggaagcuucaggacauuaaacuucuucucaaagucauccaccaagccugccuuggccacauuggccuuguaguaaguccagucaauagcugguggauucucagguaaaguagccagccuggaggugagggucucauuccaggauuucagauaauuagcaauggccuuuugguuuugggguaucaucucugcaaaagcuacccagucaaugguuuuuagagcaaguuuucacccagccaucuugguauacuucacugacc

SEQ ID NO: 14955 - RNA, 319 nt, Homo sapiens
uuuuuuuuuuuuuuuuuuuuuuaggauuuuuaguauuuuaauacagcacaaaucagugugucugguucauuuuaguuccuucacugccaaaccagggggcagggacuacaguuuaucugccuucucuuugucagugaugaccaggguguaaagguauuugcugugucaaacuuuaaacuucacauuguccuuauuuuucuugaucuugacggauuuggcauccuuucaucggacugugagcagaaaauccuugauuuccucaauuuuccgaggcauggcgacgaggcgaacugggagcuggcacggaccgggacagcga

SEQ ID NO: 14956 - RNA, 595 nt, Homo sapiens
gcucuuccuguucucuaucauggcggaucaaggugaaaaggagaaccccaugcagaaacuucacaucugcaagcucugccucaacaucuguguggaggagaguggagacagacuaacccgagcagccaaggcauuggagcagcucacagggcagaguccuguguuuuccagagcuagauacaaucagauccucuggcaugcagagaaaugaaaagauugcuguccacugcacaguucaaggauccaaggcagaagaaauccuggagaaggaucuaaaggugcagaaguaugaguuaagaaaaaauaacuucucagauacuagaaacuuugguuuugggauccaggaacacaucgauuuggguaucauauaugacccaagcauugguaucuacggccuggacuucucuguggugcuggguaggccagguuucagcaucacagacaagaagcacaggacaggcugcacuggggccaaacacagacucagcaaagaggagaugaugcguugcuuccagcauaaguaugaugggaucauccuuccugacaaauaaacccguuuccaucaaaaaggccaauaaaaaguuuuugguggaaa

SEQ ID NO: 14957 - RNA, 595 nt, Homo sapiens
uuuccaccaaaaacuuuuuauuggccuuuuugauggaaacggguuuauuugucaggaaggaugaucccaucauacuuaugcuggaagcaacgcaucaucuccucuuugcugagucuguguuuggccccagugcagccuguccugugcuucuugucugugaugcugaaaccuggccuacccagcaccacagagaaguccaggccguagauaccaaugcuugggucauauaugauacccaaaucgauguguuccuggaucccaaaaccaaaguuucuaguaucugagaaguuauuuuuucuuaacucauacuucugcaccuuuagauccuucuccaggauuucuucugccuuggauccuugaacugugcaguggacagcaaucuuuucauuucucugcaugccagaggaucugauuguaucuagcucuggaaaacacaggacucugcccugugagcugcuccaaugccuuggcugcucggguuagucugucuccacucuccuccacacagauguugaggcagagcuugcagaugugaaguuucugcaugggguucuccuuuucaccuugauccgccaugauagagaacaggaagagc

SEQ ID NO: 14958 - RNA, 2427 nt, Homo sapiens
uaagacaaaauuggauuauuaagauuauuauuagugagggcaaaugacaucuaagauagccauguuaaaaguggaguaucauauuaaaaagacaacuagaucccagggaacaucaauagaguuuaaguccauugaacagauacugaauucuuuuucauaaucugccaaaaaaagguuagcuugaaaauuuucuuuuaguuucucaaauaucacacugcugcaguacacgaaccuuuacucauuaauaacuaagguccugauuuuuuucauaugcuuugcucgaagauguaguauuuugcagccauagacagucuucuaagaucucuccuaguguuaacccaccuauccucaccucucccuugagauuuuucuuuauuuuuugaugaacuaucugggcuuuuaaacuuuguuaaccuuuuuugaggauacggucacuuaaucucaauguaauuuuacuuuccacagucaaaaacuauuguguaauacucaugcacuggauuuaaaugacugcugccucuccuuccuuucuuuuuauacuauuguggucuagguaaggcugauucuuccaucauuugaaccaacaggccaggcuuggguucucauaaagcagaccuuccagcaggagcgaccaaaggaugacacugucaccugaaauuggacugcuguuguaccugacuugggaacaucuuugaaucagacaguagaaguggcugucauuuucagggacaguagaaaguauguuggcucucaucugccaaguaggcaaacacaaucuuuuuuuuuuuuuuuuccuuccaacguucuagggagcucagccucagggcuagccgcagccccccacaccccggggcugcggugggcugcgcgguggaucagccucagcagccccugcuccagccuguagggugaaccggccgcuuucccagcaaaggagcaaucgagcugaggguagcgccuccuccgcaggagggggcgggagcucggcugagaaagcuuuccuagggaguugccuuaaagaaagaaagcggaauugucgaucacuccaguugccaguuuuauacaauuuuaagcagucgucgccacucguuuccccuuugcaaaacugcaaaucaccaccaaccuugcaucaaauagaaguggggagggaaaaaaaaagcaaaucuccuucucccuucucacccucccuuucuucucacccucccuuccucucuuacucgcuccuucucccucccucccuucugcggcugccgcuagucucucggucuggcucucucuccgacgggacuuagcaacuucuuauuucucagccccuuguccauuuuuuuuuuuccauccuuugccaugaauuggauugacagaggcgggggaggcuuugcuuucugccccagggaauggcgauucgcguccuggggccgugccggggagaaucggccgaggagaaagaaagagugauagaaaaagagcugcaggaaggaggagaagggagaccuccaucugccgcgggcccggcgcgcugcagcgcagcgcagcgccgagcugcgccucggaauggcccggagcccgcccugcgcccccggcuccuccagcgucagcggcuccugcgcgcgggaugcauugggcaauuuuugaaauccugaaguaggaagagaccccggaggauauaagucggggguggggguggagcagagaaucugugaaagauauucaaagagagaaaaggggaauccugaucguuucugcccgugcuuguuuucaacuugagcgugcuagccuuuaacuugaagaagucucauuggagcaucuagcauucuccaggaguuauucgaaagcugaaacuuucaguggauugugggccuggggagaagaaggauuccgaggguggaauugggaagagcgugcgugcgugugugugugugugugugugcgcgcgcgcgcgugggucggggcgggggcgucggggggccacugggaauucagugaagagggcacccuauaccauggcagugcccggcgacgcugcacgagucagggacaagcccguccacaguggggugagucaagcccccacggcgggccgggacugccaccaucgugcggaccccgcaucgccgcgggacucgggcugccguggcugcuggggagaccuggugcugcagccgcuccggagcucucggaaacuuuccuccgcgcugugcgcgggcucccuguccuuucugcuggcgcugcuggugaggcugguccgcggggaggucggcugugaccuggagcaguguaaggaggcggcggcggcggaggaggaggaagcagccccgggagcagaagggggcgucuucccggggccucggggaggugcucccgggggcggugcgcggcucagccccuggcugcagcccucggcgcugcucuucagucuccugugugccuucu

SEQ ID NO: 14959 - RNA, 5344 nt, Homo sapiens
gggcuauagagacuguuggagagaaggaacuggacuccucaagcuaugcucuaccugaaaggggcacguaaguuccaaauauuucgcucuuccuacaauaauggaagaccccuaggagucaggaacagauagauggagaguuauggagagagaauaaugucgaguuuauucccuuaaaucaucgaggccaucaaagagaccgguaggugagggaggggugggagaggggaagagucccugauuauuggaaauccuccauccuuauuagaaauucuccauccaaaacuggaggguugcuucucuugguccaaauggggacucggguugccugggaaauaucucaguaacccgaccuccgcuccaaagcgcccuugcggcguccggucaggcgcggggcuuuccuccagagcuccagggccccuggcucagcccgggguugcgcugggagcgcuggaaacucggcagccccgcgcgacccuauccuggagcaaccugcccccuccccacgcccggggacugcgcugugccgggaggagcugagguuuaagcccggguugucccgggccaggcugucgcugagccccaggucucguuuuugcagagggucgccgcuucaucuccgaccagagccggagaaaggaccucuccgaccggccacugccgggugagugaccaagggugcaagggcgcuaguccugcgcuuuuggaauaggauggggcgggcagggcuugcuccgcgcuggugccgaaagaaagcgucuccucaccggaaagacgcggcucugaggcgcccucagauacaguccgcccgagggcagcccggguuggcagcagcagcagcuggaugccgagcgccggagcugggagcucgcgcguccagccccgcgccaaugguggcaagggcggcccaggcuggcgcugcggcuccccaagccuuauuggcuugcggcuguucagccagcccucuggcugccagggugugcagagguccccagggaguuaggaccugaggugcagcucagagggguaaggcgagauaggaagaacuaugcaaaugcuucuagaaauguaucugcgcguuugugcaggaacuuuacucagccuccucuuaaacgcuguuauuauuaaaauaagaacuuaccuaggaacuucaaauguaugcuuuuguuugacuagaaagaacuaucaaagguucaaaaucaaaagaguaacaugcgggcaguuaaggaugggaccggggacuguucuuuuucaugauaaaccuuuccaucguauuguauuaacaaauaacaauacaauuugaugaaauuguaaagauugaaaugcuaaaauuaaaaaguauacuuacuuggaaaaauaccaaacacuguugaacacauaguaggugcuuaaauuuuuguuuaggcucuucaaacaugcuguguaauugagcuuauuuauuuuaugagguuaagauuuguuucucaacuucaguugccccaaauuagaaaucauguuuugugcugaaucagaacaauuugucuuuuuucaacuuagauuugaaauaacuuugaguucuuagcagauacuccuucagucaaauaauuaccuuauauuuggccgcaaagguuaaauuauuaucuaaaauucucuuuggcauauaguuuaacauucucuuccauacccuguuuguaaacuugacauaaccaauuguaagucauuuccaaggcaauugugacauguuaaaaaauuagucuucuguguaaguaguccuuuguugaggggucaaaaucuauuucauagagguuuuucuaguauugcugcauguuagaauaggacuuaucuacaucaauauauaaaugcuaagagaaucuguauacauuuuuguuucugcagaaagacgaagcccaaauccccaacuacuaacuauuccggaggcagcaaccaucuuacuggcgucccuucagaaaucaccagaagguacuagcauaguggccucuuucaccugcauaacagaacagcuuugcuuacuuucgggauucuguguugagugcaacaccccucccccagaauuucuuggccuuaggcccagaaauucuaauucuguacugcuugagugaggcccaagaaucucuguccuuaagaaguucuuccacauuauucugaugauuggucagguuugaaaacaggaacuucagagcccguuaauaaagguugaaaucaugagaauggagauaccuucuagggcuuagauauagugggaaaagggaagacaauaaaacacccaaaaaucaagggaaauggggggaaauaguaccagugaagggacauuaaaaggagcaagcagaaagguaagaggaaaaucagaauaagagaguaucccagaauucauucaguagcugaugcuacugaucccgcuccucuugaaacuuuccagggauggaaacuaucagaaugguuacuauagcagaaugguuaguaagaauacagaacucaggggacauuaaacagugugucacaggacuuccccccaccuccugcccagugacacagcuugcugcugcuauuccauaucugaaacuuuguuuacagaaugugauacaagaaaguaaacugcaaaguuaagagaaagcaggucucaggcucuggagagcuggcaugacucucagaacucuugcagugaaaaggugugaaauaguugaauaacggguagaggaugcuguauccaagguguucuuuuuaaaacccaagacauggaacccagcgauuuuuggagucaguacgaaaagagcucugauggagauugguugauagugacguuuuagauuugauuguugggaaaaugugcagagccagaaaggaaagugacuuauaauggacaagagagagcuaauuuuaaagaggagagguaucuucauuagcaauuugaggaaaggaugugauuauagguccccaucucaagucuuuuuuggaaaauaaauauguauuuuuuuaauuauugaaguuuucuaaguggauugucucugaagaugaaaugacuaauuuuauuagucuaaauugauagaaaaguuuuugauucccauaugauaaauuaaucacuagucuucuuuaguauuuuuauucuauacuaccucauuauuauuuagaaggcucuuauuuagugaauuaugguuucaguggaauuuauacagggacgccguucugguuuuguuuuguuuuguuuuguuuucuuccuucccuuuaaagagaagcccauuuucugcaaugguuuaaagugugcuagaaauucagguuaagauguaacccaaacauucaaauuauauugcaacuaacugaaagaaugugcuuuuaucuagaggugaucuuagaagaaauuaguagaugcacuuugccccuggccacugcuucucccuaccguauuguaacuuuuagucauucuauccuauuuuuagagucccaggaaccugcuauugucuaacucuuuaaguauccccaccucagaagugauaccucaugcucuaaaguuucgcgaucccagccagcaaacgagugccucuucuuuuugucucauuuccuccccagaacucuagcuccccuaauaaaagaacauuugcaaauguguucccaugucaucuuucccgagcaagauccauuuuaacaggaaauauaaagagacaguccuuugaugcaagugaauuauuuuaaugguggguauuuuagauauaagucaaucugugagagcaagacacaugacuuuugagauuuuuaccagacauaccauacuguaguuucagucauuauagagguucagauguaaaauaugaauuccccaaugugucccaagcugagaaaaaaagauuuuaaacugagcaaaucaaagcccauauuguuuaaauuuucaguagcagaguccauaaguuaacauagcuuagaaggcuaaauguuuauuuccugagauucucuuugucuuaccuuuuccucuauuaaaacgcagaguguauauuuauuuuaaagaauuuuuuuuucuuacagaugaagaaaaaaacuuugaucaaaccagauuccuggaagacagucugcuuaacuggugaaaauauacuggauuauguuuaauuaugguucuauucucuuugaaaacaugaaccaugugaauaaaaccuuuggacccuuuuauuccauuuguaaucuuaagaacacacacagauaguuuuauucuuucagaaacaaaauauauauaggaugcuuagcugagaacaucaucuucuuucauugcuucagguccuguuuagaugaccaaaaauguuuucagaucaccuugugucuuacucuugaguuucuuagaauauuuauaauuauaaggcugaagacuaaaguguucuuuccuuuuaacuauagccaguaccugucuugaucuuaguuguguuuuuuuuucauuuuguuacccacuugcauuuuguuuucacucagcagaaauucuccuucucuguuuuccuuuuaucccauccccaagaauguggaaggaaggugagaaacauggcaggaugggaaauaggagaguaugacucucuauagcucauccaggaguaaucaauuaagaagauaaauuggaugacuguggagaagcucugugauaggaacacuucagugugguugcugagaggagacagucauugagguagaagguuugccaaagauccagagcucagagcucccuuugugcucuuugggaauuaccuugcauucaguuuagaaacauggaucuaaaaguuacugggaaauaagcagauggagacacacucuguuguuuacguauuggaagaagggaacaagccaguuuuguuagagguaacucauuuuccaugaccaaacagacucaacagauucaaguacucugcuuacucuaauugacuagacucuagguuuuauuugacaucauagcauuacauaaaucacucugauaacauaagugcacaguaauaugccugaucucuuccuuuuuaaaagccaacuugaguucaguaccaucugaauacacacacaugcacauauacccacacacgcauacacacauacuccuguggcaaacauaauaauguauuuauuuagaauuauaauaugaccaucauguuaauuauuuuuuaccuaaucagaguuguuauugacaaaugucauaaguggaaaguauuaauucuuauugucaucaguauuuagccauuauuuaguagcucaagaauaucuuuaugugaaugucucuguaacuuggaauugcaauuucacuguguuaaguaaucagaacucugcuuauaagauuuaucuguaucuuguuucauaauuuaauaaugaaacuaaauucaaguuaauguaa

SEQ ID NO: 14960 - RNA, 22515 nt, Homo sapiens
cagaagcacacuacaauaguuaauuuuauuuguucaagagcucagauugcaagcauuaaaccaagcauaggcuuugauucugugagcccaaauucacauauugaagaagaucaaagcaaacugugauccauguacauggaugaaaacuaaaggcucgaguuaaucacauuguaguuuuuaaauuucuacagccuagagcucacuagucacaggucuuuuagguccuucuggaugucccacaggguaucugcacuuuucuugagcugagcaaccucaucauccuuuagcuucugguugauaacgcugguuaauccccgggcauugaggauacauggaaggcucaggaagacuucauucucaaugccauacauccccugccagaacaacaaagcaucgagauuaagacaugaaacuguaaguaaaaaugaucaaagacaggaggcugaggugggaggacuguuugagcccaggaguuugaagcuucagugagcuaugacagcgguacuacucuccagccugggugacagagcaagaacuaaucucuaaaggggggaaaaaagagaauaaucaaagguccgauguuccaacagaaagaauuguagaaaacuugauaggccugaacucauucccuaaucuaauuuucaucacuuacagguccacauuuccccaauacuuauguuuugaauuagguuuuauacauagaauaugcaaacauacacuaugagaaaauuagauauuuguaaguaacaaguacuuauuuaauuuuauuauauacguauuuuauugaacacugcucuauuuaaauacacuuuaauaaauuuugauauaugagucuucaaauuaaauugcuuuuaauugugguucuuaauggauuacuuucuaugaaauuuuaaguugcuuaaagacuuuuaguuaggaagaaauuucaggugguagccaacuuaugagguccuggguaauaguuagagaccauuaaaaggcaagaugcuuggaauacccaagaauugcuaaaaaaaaaaaaaaaaauacaauuuccaaaacacuuuaccaguucguguggguaauuuauucacagggucaauuuaacuauauaacuaauuauauuaaacauaccuuaaugucaguuuuuaaacuuuuaauuucaaaaauuuuguacauacacaaaaguagauagaauaaacaaauuccuauguauguacccaaagacucaguaauuacccaauuauugacacacuugauuuacacugacuuguggaaaaugagucaguugucuuacaaaauauuuuaauauaauuuuaguuuuguuuaaaaaaucauuaauuucuaccuguuuugugcauuugcuccauagcuuuugaauuaaacuguauuugcuaagguaucaagugcuauaugaaaggcaaucuagaguuuaguacaucaacuuuaaaugaaacucuauuacacuuauucaaaugaucaauacuuuaagaaugugcuaagauucagaguuaauauuuaauuugcaaaauuauauaaagaaugacaacaaucuauugaaugucuuagauucucuaaguuuucugcccuugcuguccaagacuucuguuggaaaaugagaauaguuuacauaaaacuuugagagacagaaauaaccuugaacuaugauuuuaucuggucugagccucuuuaaaugaaucuuuuuguagaauacaaugcgagaaaucauauuacauuuugugguaguuugucuuaccuuuaccauuguugacacgggaugaauccuggauagauuuuucaacauggauucaauaagaucagccacacuuaauccaauagcccaguugguauauccuuuuagcuugaugacuucauaggcacuuaaaaaaauuauaaaagacaucacugaaauaagacucaaucauuauugaaaccagaccugacuuugacuacugcucugucucuaacuauaaucuugggcaaauuauuuacccuuuauugccuuaguguucccuuuuugaguguuaaaugaauuaauauauauguaaaaugcuuaaaacuguaagcacuacacaguaaacacuauauaaaugcuugauaacuuuaguuuauuguauaaguuaagauuuauaaagucacuguggcaaaaauauacauuuuccaaucauuguaacaaaucuguaaacauauuuccaaacacauaaaaucaggaaacaauaaaagugaaagaacaaaauauaucucaauugugaggucccacuugccacugucaccuaacauaaucaacuaacuaauaaaagggauaagaguaucuugccugacaguuuuuucagcacaaauuguagcucuuaaaacccauaaaggcccuggcacuugagaagcagcaggaauaacucuagcugaguauuggaaaauuaggauuuaaugcaauugacacccaaucauuagaagaccuuggaccaguuacacuaucugggugagccauaguuuucucacuuguaaaauaaagguauauguuaauugaaauuauaaagacucuuucaacuuuuuuaagguuccuuuucuccacauauaguucaaauuccugaaaaaaaaauuacuaaaauugaacaaaaugauucuauauuugagacaucaguuaguccuguuauuaaaacuuaaacacuguuagcaaucagcaagcaaguuuauuuauuuggggcaauuaugaaaccaauaguuucuaaguuuacuuuucuaaauaaaucaaccuuauuuguugagagguggcaauuugaagacucuucucacuuguuaauuccacauuuugcuccuguuaccucuacaauagaguuucucuagagaaaauauuuacuuucccuagggagacuggcauagcaaguuugaccaguguaaaagucuuaucaguuucaaaagauaacagcugcauaauuacuacauuaagaguuuaucugagcagacagccauggaaaauguuuauaauuuuauuuaaguagaguugaaauuaaucaucuaaaaucaaguucccuuucacuuaccuuucaaccaccaucuuaugcacuuccuuccaauuuucacuaucauugucaguucccauuucuggauucaauuccuggagagaaacaccugccacauucacaccacuccacacagccacuguuuaaaaaaaaaaaaaaagacauugcaguuauuucuuacauuauuuuaaaaaauauuuucuucuuuuagugcaauuucaccuaugaugcaaauuacugaauaccaacuggaacugcuccaauaagugacucuccaguagauuccaguauaguuccccaaaaaggcugacguuugccuucaaauagcaacaugucugaccuuuuaacuuucaagaauuuuagugcaaagcagaauugcugugucauaguuacagagaaaauaaaauucuuugcuucucucuaggugugugaaaucacagggauucuaguuggggacuaugcuaaacuuuugguuugaggaauguuuaacuuuucuccuccauauuuuucuaauauaugcuccuuuauucuacaguaaagaaaaaaaauccuagaauaagacccaaauaaagcauaauuaugaaagugggguaaaaauuauaaauaagggucuacuuaauuuaaaggagaagaguaucagaaagaacuacacaaaaugggccuuugaauuggaccuuaaaaccuaaguuauauguuucuuggagaccuuuggaggaguacauuguagacucuggaaauaggagcaaaagugugggguagaaucuacuaugacugaaacagauaugaagggaaaagcuauuuaaagccaaauaagauccccuauuaguccacaacuucuggcaaguuaggguaauuggauauuuuuacaauuuugaugaaaauuaugaaaucugcauaaucaugucuagugagcaugguuuaauucucuuucauuuuacguacacaauauagaucaacaugaaaaauuuuaaaaagauguucugggaaaaauaacagccauaauguaauagaacauuggacgggaaucagaagacauaauucuagugguagcuauggcauuaacuaacuaaaaguucuucaauagcuacuucaccuacuuugccuuauuuuuuuucucacuaaaauuaaaguccugaacuagaggacauguaauaucacuuuuucucacuaaaauuaaaguccugaacuagaggacauguaauaucacuucuaucaccuagcaauguauaacuacaccuagcauuuacugaacuuuuacuguacaccugacauuguacuaaguacuuuuuacauaguacauagguggcauaauuaucuuuauuuuauagaugaggaaacagguucagagaaguuaagaacuugcuagucacauuaucuuguuaagaagggagagccaagcuuaaaguuauggaguugacuugcuaaaaacuuuccaugcucaaauuaaucugaucaagagagacacauaggaccauuacaauuaaccagacaaaaauucagaugagucccuggagguaaacaauucuugaauaaagugauaugugucagaaaaaagucagcauucuuauauaaaaaaucagaaauaaauuaugcuacaacuucaagaacaaauucuuauagcaccaagauaaacccuuuacuaaaauugcauuucaaacucccacugaauucaaaggaagauuuauacucugagcuuauugggagaaaauaguccuuuacacagguggcagaaaugaauuuaguaaaauaaaaauauuauuuaucaucauuauuauuaauaaaauauuuuaaauuauuaguuucaauauuggauuauuuuauuauuuuuuuuugccaugagcuuauucaauauauugugguuuaauaaacagauuuagaucuaugaaacagaaucaaaauuguucaaaaacaguuuuacauaaaauuguucaaagaauaauuaauuuaaaugagaaaaauauuaauuuaaaauaaaacauuuauaauauaguuuuaaauugucugaacacgaagcacuaaaaaaaaguguaaugugauuuuaauguugcucuuuuugaauuacuaauuuauguacaauucuuuacuucaauuuaaguuccuaaagaaacuauuuaguuuuaucauacagucucuuacuacuuaaauaauugauaguuauaauuaauaguuuauuaaaaauaagauuucauuugagguaagguuuauuuuacauuauagaagaguagauacaaguuauuuauaagcuuuuguuaccuaacucauuccuccuucagcaaauacaauggauguaauagcucugucuacucaaagggccuagaagcaaagauauaccaguagcacaagcacaccuaugcccugauccugguuucuaacuaccauuccucacuaaaaggaaacagggcucauuagggaaacagcugauucuagugcugggaaggggaaaguucaaaaugaggcuggugcaauuuauugugcaagacagugcucaaaaaugaugggacauguuaaaaaaaaaaagacguaagagucaguuugaaaagccugggacaacuugagcauuacaaaugauagugacacaauauuuugggcaugagauaaaaauccgaggccacauugauaucaacaaauaaauaaagagggaagaugaaaaauuucugucuuacaguggaaugcaacuaauacagaauaaaugauggaauuaguagaucauguuugacaacuaucaugguaauuuauucaaccacaaaucauuaauagaugcuaaauuuagcagagaaaaauugaugaggagucagacauuuuccuagucagcaucaaaacaucuucccacaaauuacucauaaauuacaaaggaaaagcaguaacuucacacagaguaaccuggcaaaauacaaccuuaacugaguuaucacaguuagugucaccaauuguuggccacacugacauuacaugccuuuggaugugaugccaugagaaaacuauagggucauuucugugguauuugcaccaaaaguucauagcucaaccuaaugauaaagaaacaaucagacaagucuaaaaugaugggcauuccacaaaauaacucaccugacuuuucaaaaaugucaagaucaugagaaacagagauagacugagaaacuguuccagaaugaaggaggcuaaggauauauaguagauguaaugugugagccuagaauggauucugaauuaggaaaaaagcuuuagaggacacuauugagacaguugauaacuugugaauaauggacucuggauuagauaauauuguuucaggguuacauuuccugauuuugggaaguguacugugguuaugaaaaagaaaaucuuuguuuugaggaaauacacaguaaagaacuuaaggagaaaaaggugagggaauugauuuaugcuuaauugaucaagguaaagauagaugauagguagauagagagaugagagaguaaaugauaaagcaaaauggaauagaauagaaaaguaacuacuauuuuugcaacuguucuuaaguacaucaaagucuauaaaaauaaaauuugaaauaaaaugaaaaauucaaaauggcaaaaccaacaucacaaguaauuauuucuuuuuuuuuucuuuaccacuugagucgccauguucccccaaaauccauccauggcagcugcugggaugaaugccaaguuuuucagccauaagguagcgaaaucuagcagaauccagauuacauccacuuccaaucacgcgguguuuggguaauccacuuaguuuccagguaacauacguaagaauguccacuaaaaauuuuggaaauaauauauguaaguaaaccaaaaccaacuucaacuguuaggcagcuuggggugcccuggcuucccuuuucccacuuccccacuccccaaaugagauguggccagaaagauuaaaguaaauacuuuaacuuuucauuguuagagauaccaggaaugacagugacaaaaacaaacuuuuaagccuuauaugaagauugcaagacaugaaaaaugcaauacugugcuuuuacauuugcauuauuaugugaaacaagaauauuuaagaaccuugcagauuaauuaacuuaaaguugaaaaaaacaaaacagguugaaccagguugucaguuaaguuucccccaguuguaacauuccauaauuauaaugauugucaucauaaaccaagaagccuuugauuacuaaacuaccaaaucuugcuaccacaaauuuuucugggcaugagguauucuucaguaaacaacugugauaauacguaguauuaaaaauuucuauuuaauaaaagaacaucuaugucagaaccuuugcuccagcguggcauagccuuaaaaccacagacauaaaacuuuugcugauccagauaggaucacagcacuugcaggcuaagcuguaaaaaguaaaaaaugugcacacaaggaaggugaagagcugaaaguuaauccugcagccuccacccccacacuaaucuguagacaauggcuaagauaauucaaggacauuugggacuggauaacuuuuccuugccaacuuugauuccauggaagugacucccuggaaaauccagcugugaagcuauauguagaaaguugcauaaucauuuagugacgccugccugaggcacaggaugcaguaacuuacuaugugcuagcuacuugucauuccuauucuacaucuaccuggcacauauauauuuaugagaaguuuuauauauaagacugaaccauuuaauaaacuccaaucuugguuugcagaaguaaaaauauggaaauaaccucuguccuugcuggcucucaacucucaauacucaagauacuguggggauuccccuagcucuuauucacaguguuucucuaugggaagugugagagauaaucaguccaguuucuuuacuauuuucucaauguaccugcuaugcucaccaacaugcaguaauuuugguggcaaacuauagauaaaagcaguauaucaaauagagcauauuuuagcuguuaaggcuaaaaaagugcauucuuucuagucagaagguuuaauguucauccuguagaugucaaguuagcaaggaaagcaauuuuuaagucagagcauuugguguuagcauauauuuguccaucaauucagucuauuucuaucuuuaaaacagaauuguuuaauggcuuucuuauaugcuucuuuucaaaguugaucuguuucaauucuguauaaugggauuuuccagaaaauaaaaggucaaauaugucaaaauguuucuuacaaauugaaacuauguucgaaugcuucauucuccaucccaggauaaucuuuauaaaaaaguuuuaaaagccuucagaaucuauaaccaagccagaugaagcaaaaacaugaaauugcuuuagcuaaaacucuugucacauuuuuugaacaucuggccugggacagaggcauuuguuuugcaaacaccacuauuuagggccaaugaaagaagacauguaaacugcuucuguaaaugaauacugggacugauuuuaguccaaaacaauaacaacagaaacaccaaaacacugaacuuaacagaacagagacuuaaaguauacaauaauaccuggguuggaaaccacaauuaugaugcaaucaggacuguacuugacgaucugaggaauaaugaauuugaagacauuaacauuucucugcaccagauugagccgacucuccccuucuugcugacggacuccugcaguuaccacuacaaucuuagaauuggcagucacagaauaaucuuuaaaaagaaaagcaaaaacagguacuuuaaaugcaacucuucauuauaacauaaccuauaugacaugcucuaaaagccuaaccauacauaagcuucuagaacauauaugugaauuaaguuuucuguauuguaagggcuugaaguuuaauguuccuguggcuucuuuuuucucccuugagcuacacugcaauaauccaaacaucaaacugccucagaaaauaaagaugacccgaaaguauguuuuuggcuaugaauucaaugaauugucaggaauaaaaugaaguguaaacagugacuccaauagguagacaucaaaaaaaaaaaaaaaaaaaaacaaaaacaaaaaccaauuuuaaguuacuuuuaucuuaaaaaguuaaaauuuaggaagggaaggaaggcagugaaguguuugguuuugucuggaaacuaaaacuuggauuucuaauacucaauauuuuuaggaagcuuauuugcuuuuuagcgcugcaaguuucccuggagauuugauuuuuuucuuaaggaaguguguccuuuuucgaaauauauggauauugcgauuugaugugaucauuugacucaacagcuauggaugauucacauaauuaaacuggguuacagugcggcuuuugaugauugguaauacuuuguaagguuccucucccauaaaauggcaguaauuauagucccuacauuucauaagguuguugcaaagaugaagucagaugaaauaauaugugcaaaauguuucacacaguacccagaauguuaaaaauuuauacauaauagcuauuauuuaguuucuucaaggcauugaaauuacuuuguacuguggggaaaagaaagagagaucagacuguuacugugucuguguagaaagaaguagacauuaagagacuccauuuuguucuguacuaagaaaaauucuucugccuugagaugcuguuaaucuguaacccuacccccaccccugcgcucccugaaacaugugcugugucaacucaggguuaaauggauuaagggcugugcaggaugugcuuuguuaaacaaaugcuugaaggcacaugcuuguuaagagucaucaccacucccuaaucucaaguacccagagacacaguacacuauggaaggccgcagggaccucugccuaggaaagccagguauuguccaagguuucuccccacgugauagucugaaauauggccucgugggaagggaaagaccugacugugggaagggaaagaccugacugucccccagcccgacacugguaaagggucugugccgaggaggauuaguaaaagaggaaggccucuuugcaguugagguaagaggaaggcaucugucuccugcucgucccugggcaauggaaugucucaguguaaaacccgauuguauauuccaucuacugagauaggagaacacugccuuagggcuggaggugggacaugcuggcagcaauacugcccuuuaaggcauugagauguuuauguauaugcacaucaaaagcacagcacuuuuuucuuuaccuuguuuaugaugcagagacauuuguucacauauuuuccugcugaccuucucuccacuauuacccuauuguccagccacaucccccucuccgagauacgcccgauaaugaucaauaaauacuaagggaacucagagacuggugccggcguggguccuccguaugcugagugccgguucccucggcccacuuuuucuuucucuauacuuugucuccgugucucuuuucuccagucucucguuccacccgacgagaaaugcccacaaggguggagaggcaggccaccccuucauuguaccaauacuuuuggggucuaaaacaugcuaguucucagauacauauaaacaaggcauuauaauacaauagcccaaaauguuacauaucaaauguguagaaggucugugggagaggguuaauguaagugauacuugaguuuaaccuuaaggauaaacuggacccagaugaaaagaaacugccaacaccagauucaccaggaugggaagacuaauuuuauaacagacugagggaggagaggagaaugaugagccaugaggaaaugcagguuauaucuaaauugagagcugugcaggcccugccagagguuuuagaauacagacaaagguuuauaaaaagauaagaaaucuuuaaagaaaagaaugcauucaaacuuucauuuuagggaaagcaucuguuuuaggauaaagauaacuaguguggcaguguggaguguggaauacauaaccauuuucuacauacacuuccaaugggaaaaugucaauuugcuauguguacauuuuagcaguagcaaugaguuucuagaaacggaugaaagaaaauuggccuauagaagaaacgugguaaaauaagccaaacaaugcgauaaauccaauuuguuauuuccuguuagugacauaucagugaucacuuacggcuagcaaacucauuuuagguagcuguccauuaauaagugaauauaaaauauuugagaaauaaaaaguagaauacaguagagaaguaagagcuuuuuauaaaaugaggaaaaagagggaaacauuuuauaauuauauaacaauuuugcaauaaucugaauuugcuaaacuacauuauaaauaucuuauuaacaguuauugaaauaacuguuccaaaacuucaaccuuuccuacuuacaaauaaaucuauuaugcuguaagaugcauuccaaauguguuuuggggccaugaaaaaaauauuagaucacuuugggcauuaagugaaauuaccuuuaucugccacaauuuuaggugucugaagaaauaagcucccaugcugcagauccaucauuucuccuuuaagcuuaucuuccaaaacauccacaagagcaaguucaucagccagagacuguaaacgcaaaaacaggcauuagaacccuaagccacucuaggaugcgucagcucacaaucuaacccaaagaaagaucuuuaacauggcuaagcaccaaagaucuaaacaucuugagaauuuuaccauggaguuagauacucaaugaggauucaguucacaugauacaaacuauacuuuaagaacauguagacuuaaagauucauuaggaaaccagcuuaguucaagaguaggccuagugaauacaagucuauauuaauggagagggaauggugaaaacaaaaauacacucaggcccagaaacaaccuugggcaauguguccauccuugaggucaccccaauuuggaggcuuucugagaugguagauuuggcuuaaaucaccaggagugugaguuuacuuuagaguaggauuugaaacccagguugaagcuuggaaucuucaggguggcucugauccacucaaaugucuugguggggaaaggaagaugaguuuuauggacagaggaaucuaggauugggagguuuuuucaugugaucacuccaaaucugugccugagacuugcccagucucagauuucuuuuguuuucuauuccaauugucauucucugucccccauucaaaauacaaucuaaaguaaugaauauacuauuuaaucuugaucuggagucauauuuuuuuuugagacggagucucgcuccguugccgaggcuggaguguaguggugcaaucucggcucacugcagccuccgcccacugcaaucuccaccucccggguucaagugauuuuccagccucagccuccugaguagcugggauuacagguacgugccaccacacccagcuaauuuuuguauuuuuaguagagaugggguuuugccauguugccaaggcugguaucgaaauccugaccucaguugauccacccgccccggccucccaaaaugcuggaauaggcagugcugggccuggaaucauaauuuuuuaaauuuucucaauaucuacauaaaagugaaagaaaggaaaaaaaaaaggugguuggucuacaugcaucuaagcaaccuuucagcuaugaaauuccauuaucuuauggaagucauaauuuauaaacuguuuauaaagugguuaucccuccuauugaaacaucaccagaguccuugcucuuacuguuuuuauggcuguuagcaaaaauaucagcuaaguagaauacaucaauacuggggcccaguuaaaaaugccaauacagucauuccucaauauacgauacucaagggauugguucuaggaccucugaguguaccaaaaucugggcauaaucaaguauacagaaaggacaguauucaccggaugcaaaagacucuccauauauguggguuucgcauccccugaauacuguauuuucaauauacuuuugguugaaaaaaaaaaucugccuguaagugaaccagcccauguuguucaagggucaaccucuucuaagaauaguagugugaucagcuacacaggugaaggguauuaaugggggggaggggccagguagguagguaacuggaguucaggaagcacuuugaagaauaagguggaauaagguggaguagcccaggcagcaggggccaccagacggagaugcagcaaagagcugggagacagucaauaagaaaaguugaccuacucagcuuguuagauaaagcaagucuccucccuggaauacaaugaauaaacacuguccucuguugcuaaaaucuaaguggcugccuggucucaugaagugaguuacagugggcuugcuugugaggguuucucuaagacugaagcuucccgaugacugaauguguccuuagcucugagcaaccaaauuacuugcagauuuuugaaaugaucauucugugaguuggggaucacguacaaaacauuuccucauuuccauguguaucaaauacuggcguuaauuuuuauccauuuuuccuuaaacacguuuugacaccuuuaaggcugcuuuuguucuuugcaaucucugacaagaacacacaaaauucucauuuguauuuuuuaaguccuaaauuaaugcaacauaacuuaauaauagcuauaaugguucuauuaagguacugagcacugggaauaucacucuuauuuuaguaacaucacaugugugcugcugaaauccacagggcaaaacaauuuagugcuuaaguagaaaaggaugucacaggaugucagauccugucucuguuucaguggguguagagaauugccugagaagugcauauucggcugaaaaggaaggaagagauccaacacuuaaauaauaauaauuguaacacugaauuuagcugcauccgcagcacugaauaucccccaaauggagaggcgugaugugugacuaaguacuggugcuauuguuuggcuuaaauaaaucucccucuguauucacauauuuuauacaaugaauuuuccauauauauauuucacuuaagcuguaagcauguuuaaaauguuugaaacagcaagguuuagauuaacugcaaaagcaguauucuuauuauggaucaaggucacuuagauaccaagaauaccacuguugaaagcuugcuuaauguaucacuaaaauggcuuuaaaaaaaccuauuuauuuuuacucuacuccugugacagacuuaaaaaaaggcuuuuaaucuaaaguccuguguggaccagacacagccauauauucugccucuuccuccuccuaaguaauaaauuacuaccaccagugccuuaauauuugaugguuucauuuuuauauccaaguguuggccaggggugguggcucaugcguguaaucccagcauuuuggggggcugaggcaggcagaucaccugaggucaggaguuugagaacagccuggccaacauagugaaacccugucucuacuaaaaauacaaaaauuagccgggcaugguggcaugcaccuguaaucccagcuacucaggaggcugaggcaggagaaucacuugaauccgagaggcagagguugcagugagcaaagauucugccacugugcuccagccugggugacaguaagacucucucucucaagagaaaaaaaauacacacacacacacacacacacacacacacacacacacacacacacgucucucucuccaaguguuuaguaugcauaaaauuuugcgggaggaaaagguauaaccuuucucaaauaauuaacuaaauggauaugugccaucuauucaauaguuuguguuucuuccccucugaaaugcuacuucuacauuauuauuaaauacuauuugagcauguuucuggcugaaauaccaaagguggcuuguacaaauaccaaauuuucauuauguuuuacuuuuaagcccagucuugcacugcaaaaacuacuuugcaauuugucguuguaccuaccuugcuccuccuaagagcuuuguuauauacuguguuuguccacaagaacauggcuacaguugacugaagcaaagauaaacacucaaaccaaagacagacuuagaagcuaaggauuuaugauaaucuugccucaaagcucuucaugacccuuacaacaugaugaguucgacauucagauccuccucuugguaguuaaaaugcagagucugagauggauaaugggauaaaaguaaagucugguaguagaagauguaaaaaaaucagaagccaugaccaaguuugacaaaacaugagugaagcuuacaaguaauagcaggaguauucauuuauuuaucauguaagugccuggcauuauccuccuacucagguauacaguuacgauaaagucucugcugccauggaacauaucaggaaggaaauaggaauuaaacaaacaacaaaucaggcuaaucucugaagguagaagugcucugaagggcauaagacaaggagauguugaagcuacugggaaggaaguuuauuuuauaucggaaggcagggaaggccugccugaaaaggcaugcauuugcaguaagaucugaaugauaagaaggggucaacccuguggccuagagaagaacauuccaggugaagggaaaugcaagcaaaagaguuuaagcaaaaaugagauuggcauuugggaggcagaaagcaaauagaagagaugaagucagagaugguaccaucauguugcacuggcaggucugcugccuugguguguauggugccccugcaguugugugcuccauugcucugcucugagaaacaggcagggaggauuugugaggccucaugggauuuuauguauguguguagcauaugugcacuguaaaaugacuggagaguuuuaaguagcggagccacuaguuuuacaaaagcucucuaugguuauuauauaagcaaugggcugcagagagugggcaaaaguagaagccaaaaauaaucaagucuucauauggugggacacuguacaaaggggccuuagugggcuucgcgaaucuggcuaaugcaugucccuccucaaccucuccaaugcuaugcuuuuauuuaacuucugggggcaagguacaccaucuaugagcucaaaaaggccagaucuggcacuuacuaucugugugaucuuagguguuugguuuuuguugauuucagccauaugauauagaugacaauauccucugacauguuacagaaaggaauaaaugaaguaauauacaaacaccaacaugcaguuauauuccuuucucuauuaagcuagugggauuucuaaucuuuaccauguauuaacauaauuuggaaccacuuuuaucuuuaaccguuaaaauaauauuuagacauucuuaauugguaaaaucaucuuucaacaagucagucauucuuuccugcauuuauuuuuucaaaaauauucauuagauagucuccacauaauuucuaagaaaauguacuccauuuugcaaaagauaaagggaaaagaacgcuagauugaaaaacagaaaucauagucucugaaucugaagaguccaacugugguagcagcaggggcuauucucucaagcccuugaguugagccaaaguguuauauaacuccaggcacagucucaauuaaacuacuuacugaagaagauuuaaaauuuaugauuacaucauagagguacuucuuauagaaucaugauagcucagauauaguuuccugaaaggcucaaauuuugagauuaacagaagguaagaaaaaucucuagcuaguauuuaauuaauacauuuauuuuuuucuaaaugcuuaaauaguagcauugaauaaaaagaaaauugaaaagucacuauggugaagaguucagagcccuggguucaaaauacagcuccaccacugccacaugugagacuguggacaggcucuuuaagcaucagccaucucauccaacagcaaguauaugaacaguuccuaucuccuaagguuguuuaaaauaaaguauuuuaucuuugaacauggcacauacucaaugucuuuuucaaaaugauguaagcugaaauaguuuuuguuuuuauuggcacgaacagugagcgugaaauugugguuacuucaauucccuguaaucuagggagcugccaucuuaaaugguaguuaccuagucuauugaaacuagcuagaaggaaaugcaaaaggauagggagcugcuauccuaaaugauaguuaccuagucaauugaaacuagcuagaaagaaaugcaaaaggauagggagcugcuauccuaaaugacagugaccuagucaauugaaacuagcuagaaggaaaugcaaaaggauagggagcugcuauccuaaaugacaguuaccuagucaauugaaacuagcuagaagcaaaugcaaaaggauaaaauguucaugggugugcacuacguuuuuuaguuuauuuuuuugauaacuguuucuuaguaaagacucaguuugcugcuuuagaauuuaaauuuugaaaaaagacauggcuugguuagggguuauucaggcagccuuuacauaugauacaaagggacaguguguucuccugaaggcaaggcagcauuuuuguuguuguuucuacauuuaaggcagccaucagaagaaauaaggaauccauucagugaaauaaauaagaaaagggcuucuuuccucaagucuucgagaacuaaagaaagcuuaacugugguuugaacuacaaaggauacauaugagguaaggcaaaaagccuauggagguauguaagaaaaauugaaguggaaggugauaauagaaugguauuaguguuaaaucuccugauguugauaauugcacugaugaucucagaauauguccuauucuuaggaaacguacucuaaaacagggguccccaacacccaggucacgagccaguacugaaucuagagaaucuagccaaugccugaugaucugaacuggaacaauuucaucccaaaacuauccccucacacaucuguggaaaaauugucucccacaaaacugguucccuagugccagaaagguuggggacugcugcucuaaaggacauguaaguaaagggcauaauaucugcaauuuauucucaaaugguuccagccaucuauagauagauauagacaaauacgucauggacaucuauguauuucuauagaucucuguaucuauaaaucuaccuaugaacauacacauauauauauauacacauauauguauguauauauggugagagaguauaaauaacaacauguuaagaauugguaaauguaggugaauuauuuaugaaaguuuuauuuucuugccauucuuaaaaauuuucuguaaaucugaaaucauuucaaaauaaaaccauuagguaaaaguuucaggggcauaacagaauauucccacaaccucacaaagccaugcauggcacagauuacuuauuaauuaaaagagggaaagggaucuuugcaguggagaaggcuugcugugaccacuugaaccaggggauuaaguucagcaguaaugagacaaguugaacaucaugugucuccugauggucugcacaaagaaggacaugacaucaccuaguuccaaucccacccaaaaaauucaacccgagcugaauuacaagaaaacaucagacagacaaauugagggacauucugcagaacucaccuggaugcuagaaaaaugucaaugacacaagaaacaaagaaagguugaguaacaguuccagcuuaaagaaugaagagacguaaguauaugagacacaugaucuuggacugaggugaaaauagcuauaaacggcaugauuuugacaacauggagaauuuuaaauguuaauaguguauacuggaugauaguauugcaucaguguuaaauucucuaaguguaguaacuauuuauggucacauagggagaauauaauucuuuuaggagauacaugcuuaaauauuugaaagugaagugggauuacaucuacaacuucaaauugcucaggaaaaaaagaaaucuuuuaaagauauaauaaaauuccaaggugcccaaagaaacuguguauacaugcugaacuucucuaucaucuaugguguucuugaaauguaccuuucccagaaugcugauagcacacgccauaccaacuuguccaacacccacuacagugaucuuauuguuuggaacuguugccucuucuuccgcaacuggugcaaugaguuuuuccuuaagaguugccauuuugcacugcaaggaaagaaucaaaacauuacacguauaucugcauaugaaauccaaauagaaaucauccuuaaaauguuacuguugcaauuucgaacugaaguacaacuuaaaaugagccuaaugauauucuagaaagcagaauauauuuuaaagaaccaugagacccggcugggcaugguggcucaugccuguaaucccaacacuuugggaggcagaggcugguggaucacgaggucaagagauugagaccauccuggccaacauggugaaaccccgucucuacuaaaaaaaagaaaauuagcugggcaugguggugcaagccuguaguccuaacuacucaggaggcuaaggaaggagaaucacuugaacccaggaaguggagguugcagugagcuuagaucucaccacugcaccccagccuggcaacagagcgauuccgucucaaaaggaaaaaaagaaaaaaaagaaccaugagacccauuuaauggaagaauucauuaagguaaaaacuuucaugaagcccauuagaauuggauuucuuccuucagccuaugauuccaugugaguauuuaguagguuguuaauauuucuggcuaaaaaccugugaacauuuguuuaaauuagcuaauuuguuuguuuccucuauuaagaauguauauguaacuauguaaacuaaguuugggucuaguauugacucauacuuaagcuuggauaaaaagaauaaauggccaauuaugaacauaauuucuacuacuaaugguuaucauucuuggaagauagggacugauucuucuacucugucucacauaaaauguguuacaguguacuggacauagaaugcauacuuaauacauagugacaauauaauggcaaugaauaauuuuuauucaaagucugcaaaaauaucaaccugaauuccuuuuagggcaccuaagaagcuucuuggaaaguagauagacacuuaauacauugucguuucaggggaucacauuaggagacuaucagucucugaaacaguuucugucuaaccauccaaacuaaagaccccuaaaauguaaaaaaaaaaacaaaaccgaaaccuguuggaaaaugaacgaucuguacaguaacaccaaauguacuugugccaucagauaaccagauguguuuucuagauaacugaaaaaaagagcaaaacuuaucgaaauaaacaucaauuccauggcaauuuauaguacacuaaauauauaccacccugucuucuugaacagagaauacagauggcaaauaagccuuuucuucacaauuauuacuuauaauuguaguagcccauuguaauguccaugauuuucacuuguuuuuuacuuuuuaugucgcaucugaggucaccauaccugucucaaacuguaccagagcuucccagucuaguuuuuaauucuaaucugcaauggacuaagcaauaagucuagucuauuaacuguauacguaaaguaagaguuagcaggacucaaaguuggaauaaagcaucugaauuuggagacaacuguguaacaacuauuuuaucuuauaguuuuuuuuccaaaaaauauuuccucccaucuguaaggauaaauuaaaaggagauucuuucgccuuuacagaucacauuuacaguuuccuaguggacguuaaagagagaagaugcaauguugugcaagugccuccacaaauagaugaccuuaaaaugaaauaaauucagacauggccugcauuuuaaacaggcucagaagaaagaaugcugcaucucuuuuugaaggacgacacacaugaauaguuguucugcacuuaaguuuauuguuguuagauggucuguuuacgaccguuuugguauacagggggcccaggaagcaguggaaaaugaaaaugaagaaacaguggcuauauaaauacagauucguuguucugauagaccuuuuaauuuagaaaacuucaggaaguacaauuuaaaggcucgaaccagauuuucuuucagauauuucuggagaaagugcuuuucuucaauuuuuccuuaaaaagaguuuuaagaaaugagaagaaaauggucugcaugauauacaggccugugccaacaucagagugcaggcuguaaggaacaagaacgacaaacgguaaaaaucucugagucuuggucccuuaugucuccucacugcuguggauauaaaucauuagaaauaaaggagcgccuuaauuucaggaacaaagaucuucuuugcagaaucuuucucaccguaaucuuuuaaaaauucagguuuugcuuuugaauuccuccccuccccccauuccccaggcccuuacugcagcuuguacugcucgcggugcgcacaaaccaucuuuuccucagggcaccggcagcaaagaacagcagaucacgagggcaugcagaagcuagagaucuccccgaguaaggucuguggggacaagucuaggacuuccuuacucggagcacccaaggcugguaaaguaaacgaagccccuaagcauccagaaaagaggcccugcaggaaagaacuggcgcauggcuccuggaaagaccgucagagccggguaaaaauaagugcagcgccaaacgugcuggucaucuaggugccuuucuccucaucccagcgagugcaagggcauuucucuauuaccguggcaauauauucaaauauucgagguaaagaucguccagccuucauaggccaccugguuccgucccccucccccagcuacucgggcacgugucccgacucccgccagcaggccgugggggugauguggccgccaugaacccaccaaggacaaguagggccugguuuuagcugcaaaugcaacaagucucuccgcugagccgcagcugcuacccucugccuucugcuccuccgccagggcacggcccccccugcgccccaaacugagcggcaaagucagggcccgcggccggaugcucagagcuaaaggccgcggaggacagaugugcuucuuccuccuucccgcgucuccccauacaaguacuaccccgcacgucccaucaggcuugccugugggccaggauucaggguccugagccgaaaccuaccaggagagagaaggcucuggagaccucuguaacagucgugcggagaagacaaagucagcugcgugcgucuccuccggcgccggcucugcaaggagggagg

SEQ ID NO: 14961 - RNA, 13027 nt, Homo sapiens
uuaagacaggaaacacaaaaucaaucaucuugacuuuauugaagcaguguguaauucucugcuaguauguaguccacagagacagggaucaguuccaucagccagcagggcccugugaaaugggagccauucuguacaggaauaaggaggaauggaaggaagcaaggaaagcaauagagguauccuaacugcucuagaagguugauggugaaaugacagaaugagaauguagcacugggaacgguaugagcauauuaagaagaguuuuuuaguucuaaccugcuuguuguaaucauuucacaauguaugugcauaucaaaacaccacauuacauaccuuaaauauacacgauuuuuauuuguaaaauauaccuuaguagcguugaaggggaaaguucuaaccguauuuagaagacagaggaaauaauucaguugagauggagagguugauuuuuuuuuugaagaggagagauccacuuuggaacaugaguucuuuaggauaugugaaacagcuugucucaagauacagaggggaagauggagcacuucuuagaauggcagcaaggaugugauuagaagauguaaagaaaaagguggugagagauggaugcagaaagccagacagcuuacacugaugcuuugaucuucuaaauaaguaugucccaccugugucagauuacccaggaguacuagguaaaaauucagccccuggaucacucucaucagaacccaggaagcugugauauuagugaacucucuggguuauucuaacuaaagugugagaaccaauggcucaaauggaguagcagguuaucuacacagugugucuauaugauugggaaagcauuagugccacccauauuagaagauaugggugggcgauggaagaaaggaauugcuaagcagagcccauuuggaaguugggaagcaggaauuuguauuggagaggcuggcccagcuccagauaugguugaaugugcuuccauggcuucuucuaaguuaaagugaaucuaccuaaagacccuguuauuacuucuguaucaggacccagggaaaaauugauaaagcaggcuacuggaucaagaaagcaggcuacuggaucaaggacaugaagacaacuugagagauuucccuuccuucuggccuugagaaacauaccuuucugggcaggcagagucaauaaugcugauugcuacauacaauccuguggauuuguguauucagaacuuuaauuucacauaauuaugaugagccugccaacaugucaggccagacuuuccucugcuaguuguggcucaguuuauucuuugaugcugcugcuccaccugcauauaacccaagaugggcagcucccauggugaaaggaauuaaaaguugcaaggcccuaaucuaggucauugcuuuucucucucucuacccuucucucucccucucuuucucucucucucuuuuuuuuaacuugaguguauuagcagccucuuaccuggucuccaggcuaccagccucuuccuuccaagguaaucuucuauucuauuagaguaccuuuuuuuuacacagacugacaguugccauaagugcuguaagcagucacugcugugaagauuuccugucaccacagagugauguucuaacaaacaaaacagauauaagacguuuuucgaagaaugccuugucuucagccacugcugccgccauuagcaccuccuacauucuagggacagggaauccuugucauugccucaguauauugcguacucuugccuguaaccaaaguaucccuucgaguuuaguugcuguucuuucuguuguuucccuauaagaaguguauuuaaauguuauucccacucuguagcuuucuuggaccacacucccucuuuccaggcagaauuauuuuuuucaucuguauuccauaguacuuuauacaaguaucaacauuguauuuagaacauucuauuguacuuauuuguaucuuuguuucuacaacugcacuagaauuucauguaauccaaacugaaagaacauaggaaaguagaguucuuuggagcaagcaauaugggcaacucccugcaucauuuuguaauaguaacaagcuuuccuuuuuccauguaauauuauaguuguagcauugaugaaucugaauauuuauagaaucauagaauuucaguggggagagguaucuuagaagugauuccuuugauuugcagaugaagaaaccagucuugugguuauguuagaccaccuaaguaccuuucaucaaaaucccagccaacaaccuucaggaauuuaugagaauuaaaccguuuuccauuucaggcaaaaacguucugggagagaacaaauguauaaugcauuuuaguuuagagggagccccauuaacaaauguuaacugcguuuuaagaaguuggggucagggaaaaagucaggcuauuugaugagagauaauugauaaguucaaggaggauuuuaaauacaaauaaaguguuuuucauguguuucauugagaugauuugagguaucagggccaccagaagacaacagaguggguuuuggugaguuucuuuuucucuagguuuaauugaacaguuuuuuuuuucuucaauagguuucagaaccuucugugguccagaaagacauuuguggacaacaugaaaauuuauaaccacaguuacaucuacaugccugccuuuucuaugaagacaggaacagagccaucuuugaggguuuauuauacacugucagauguuggugccaaucaaacagugcuguuugccaaccccaacuuucugcguagcauuggaaaguucuggaaaaguagaggaauccaugccaagcgccuguccacaggacuuuuucuggugagcgcagcucugggucucugugaagagguggccaucuauggcuucuggcccuucucugugaauaugcaugagcagcccaucagccaccacuacuaugacaacgucuuacccuuuucuggcuuccaugccaugcccgaggaauuucuccaacucugguaucuucauaaaaucggugcacugagaaugcagcuggacccaugugaagauaccucacuccagcccacuuccuaggaacaauggaagaagaaaggacugaaccaggguauuuuuguuagguuuucuaugugacuccaagagggaauggucaaguuguuucaugaguuugcaugggcccuuggaaaaacaggaaaggagcaaugaagauccaagcaaaacuuuacuuucagcguuggcuuggaggacaaauaagaaaugaaacauccuaugaaauacuuuauagcacauggcagauuugcaacuaguaaaaugcuggugaaaugcuguugguaaagcacaugguucaaaucuagaagaugcaguucaaaaacaagacagacucgaguuguuagggcugaggaaccaaucaagguagaacaaagaaaauguugggguaaaaguguugcugauugucaacacaaacuggcuuaauaauauuaauaagaaccugucuuauuaagacuggcuuuagaaccguagguuuuuuuaaaaaauuauuauuuauuuuugcccucuuuggggaaguggguggguagauuuaaaaaaucccuuccugaguaauaaagauacaaaauguuacugcugauaauugugauuuguugagccacgucuauauuaacuauagcuccccucuauuuuuaaaauuuuacauaagaauugcuucuuccucuuuugucaaguccacagagacaaugugaagcauuauugaauuuagacuguguugcuucauagucuggauaacaggagccacuuuccuuccucagaauuuaggacauaaacccaauuuuaggucugcauuauguaagccuguuugcauugucauuuuuauuuuagugcaaaagacuaccaauaugagugaauuauuuguuuguaaauuggcauaauugucuucauaauuuaauguucagaaaugcaguaaagcacguugaugaaaagcuuagucucuguggaagacagaccagaagacaaaucccuuuucuaucuacuguggcauauucacugcaagguaaaggacauguaugcauacaugcaagaaugaauugagcgaaacuuugaauauguuuccucuuuugagcuauuguuauuuaguaguuaccuaaaaaagaauacauuuuuacuaguauaccauuaaaaauguaaaaggcuuaacauguaugcauacauguagacacacauacacacacacaaaguuaaacaaagcucauuacugugcaacuaugaaagcugaacucauaugaccugguauggcaaaaauuuguaaccaguguuggagaaucacaaauguguuaugcacuauccauuacauguugauauaagacaaccgagcucacugguugccgcacauaauacccauagcagcacaagaugcaagucuuacccccaaaugcuuacccggaaugagcagaauugucuuacucauccugauuuuacccaaaaucucaugaaugggcuugcuguugagcguggucacacaagguauaguuuguacaaguaaagaaaugugaauuaguagcuauuuauuuccuuaguagcagguaggacuacuuagcuuguuacaacagcuuugauacacaguaagaaaacucuacugacagauuacaagcagccaaauguguuuacauuucagagaaggguaagggaagccucucguugucuucauacuuuggaaugucuuaagcuaaaaugugacacuagaguucaauuucuuuuuuauuuuaaaugucacuaaauuguagguaaacuguaccaaaaaguucuaguuuaauuuuaacaguaaaaacucagcauaccauguuaccacguaaacaauaauggcugguauuuucuguggguuaauuuaacaugacauaaacauaggaaagcccuuggcaaaauucuacaucauugaaguagaccauuucuaaaugcaauuaaauagugagguuauuauaaaaauuagaauuuaaaauaugacuuguugauagugcagauuauaauguuacuuagaaaguuaagaauucgagaguaaugaugcuauuggagaacugguuugcuauacggcagcaaaaacauaaugagaauguaccaugaagaaauuguguuaaauauucacuuugagugaaacuuuaaauauguuuccucuuuugagcuacuguuauuuagcaguuaccuaaaaaagaauacauuuuuacuagucuaccauuaaaaauauaaaaggcuuaacaaaaacgcauauaaaaguuaauaaaauguuacucagauuaguacuuuaauuguuaaaauguaauuaaugagcuccauagagcccauacaucacaguuccauugaaaauaucaucuggacuagaaucucuuaaacccaggaaguggagguugcagugagccaagauggugccacugcacuccagccugggugacagggcaagacccugucucaaaaaaaaaaaaaagaaaagaaaaagaaagaaaauauuauguggaaauuuuucaucuuuuuaugaugccugggauagauuuaugcaguagauuuauauauaauguuuaguuuacaaacuugugaaacuauuucauguggguucugaaaggcaaaacagaaauggccagugcuggugauguuugauuagaccagcucuucucagcuggggugauucauuaucccucucuggugacauuuggcaaugucuggagaccagagacauuuuuuauuuucaugacucaagggugcuaauagcauguacuuaguagagguuagggauccugcuaaagaucuuacaaugcacaagucagccucucacagcaaaauaauuauccaggcugagaugucaguaguaucaagguugacaucucagaccuggauuagaccuggauuagaccaaaaugaaauuuugauuguuccaccuugucuucacuuaaagauagauauacaugcucacagcauucaaaauaugacuacaauuuaaugaaaauauuuucuuaugguagauuacaacucacuagauacaccauacauaugccuuuuggacauaauugguuagauaggaguguguguguguguguguguguguguguguguguguguguguguguagcaugaaguuaggcaucucuauccuuaacugugcuauguguuccuaaguaaggaccucgcuagaaucauccuguagagugcucuggaauacucuauuauuaagaucuucaauucuaagcucccauuaucuuucuuuguuuaucugaaauuaagaccuucagaauuaggccugguacuuuuccagauuugaucaguuacauuuugauauaacugacucuuaaaauucagcuuagaagacauucaauaagaaaaucuuuaaucacuuuuggugaugcaccugccaagagggggcaucacuuuguaccaucagacuaauuaaaaaaauuguuguguagucauaaaaauuaggcugauccauaggggcaaaaggaagggugaagagacuaaaaacuaguacccugauagaauuuuaguuuuuauuagccucgauuugagaacugcauugauuccaaagaucaugaagguaggugaaggauuaagucauuccauaauuaagaaaaguaauguuuauaugaaagauuuuuauauggacaaugacucacagacacauaugcuuuguauagaggauuuugccaaaaguuuauacaaaauugcacaucuaaacugcauaauucucauacaagaaguuaaggaagugcucacuggauuuugcuucuguauaguucacuuuuaucugucuucacaaggguaggaaguaaaugaucucaaauggcacauguucagacaauacuguguuuggcuuugugaugucucaugucuuucucuuggcuaaaaaaaauuguuuaggcuauauauaacuuguaccugaagcaaucuggacaacauggcuuaaaauggaaaauaacugaaaaaauccugggauuuuaaauuugccaaaaauacccuuggauuagucaaaggcuuuacaagaguguuauagaugauccaaaauggaaacaauauugauaacauuucuuuucgucagcagcuacauauuccaguuuuauaacuuuauuauauacauuuuuugauuauuaauagaaagucagccauccagaguuuuaacuucugugguugaaauauugacuuugugaaauuuuucacugacaaauacuuguuaggagggaccuaagggggaggggaauguuaccaguccacugaaaacuuuaggaaauguucauuguguuguguaaauacuuucccaccagcaccagguaauauauucucuauguuuguagaauuccaaagaucaaaagcuguaaggacguuuaugugaacuugacgcaaacuuguggaggaauaaggacugagaguaauguugugcuuuuucuuuaucuucccgucguauaggucgacucucagguuauaugacuuuuauugggcacacgucagggguggaagugguagaaguggguuaacaauuucaaggccuggcaaccuaggucaaaaccucuaauaaagucagcaguaaacauaacuagcaacuucauuccacuaugugcuaggaggagggugaggcaaguugaaaggagaugacccuauccccacacucucaggauguaaaagggcagagugcucucuacccuuaaccuuggcuuuuuagcaccgucagucucuguccucucccaggagagcugccuuggcuccagaguugagcuaguagcauugugacuagagagguaguguggaaauucgcugaggaccucaaaauuuuacacugccuuaaacuguuuuguuuuugcuuaaacucgugcugucuaaauguggguguuuuguggcagagucugaucaccccgaccuaguuauagcccugccagugauucuaaaguggaacuuuucccccucauucauauggauagucugaguccuugaagcuagggagauaucaaauauucuaccaguuccuacauagcuucuuuaaaaguccuagagacuaacucacaggaagucugaagcccagagcgucuguuuauaaacuccuaaauaugaggccacaauauuuagguugagcacuagaaaauuucuauuuugcaaguggaaggagacuugaaucuauaauugcuguagcuuuuuuucccuucuaucauaagaaaauggauaccaucugcuuuacccucagcccagacuugucuuuugaauuuuuuacauacaucuuaggggugagagauugaaacaagugcaugaaugaaaagcuuauugaaacauaacacagccccugcucaccauuucaguaagggaaaauacauguuucuguuucccucuaauuuguuuucucuggugccaacauuucugauuucuucugucucuaauacauaaggaauaaauaccauauuuuaaauugacuuacaugccugcgagcauuugccagauaaucaaagccuaugacucuaacuuuuuaaagcacagaagaggaauuauauuuuauggucacuccucuguguuucuauugaucucuauauugugcuaaaauucuuucagguaauuuuuuucuuguugaagcugugggauauaaucaaugaugccaagcugucugagaauuuuauagaauaauauccaaauauauugauccugccucuuucugcuucuauguaauuaaacuuucuuuugauguuuauuuuuaaaauguaugcuucacacaacaccaauaaacaucuaagagaugugauauaauccaaggcaaagaaaaguaagaaucaguuaaugucuauuuuaucugcacagcauuacgaacagaaaauuguaauaaaaaaagguuuaaccaaacugaaaaaaagagagacaaaaucuugguuuuaauuugaaaagaugauugggagugaucucagaagagaguucagcaggaagcaaggaagaggcuguugaccuugagugcagccucaagaauggaaccuuuuugaaauauuuuaaaggaaauaucuugucauccagcuguuaugguuaauaaugaauaguuuucucugggugaagcuuauccauugcacaccugaugugcuggccccugcgauuuccccaaauguuggaauguugccugcauaauuugugguaaugggggacuguguuccugcuuuuaccugguuacaaaaaacaaaacaaaacaaaacaaaacaacaaacagaaaaaaaaagagagaaaagaugcuagaggaagcagugugacagacagaucaugagaugcugacggagagaacagagugguaccuguuuacccacuuggaccaugacaguaucaaggcuccaccccuugcugucccuucccaagaggugcucuccugggaguuugaucacagugaaacaacacucccguuuucuuuuuccuuucuuucuuucuuucuuuuuuuuuuuuuuuuuuuuuuuuguugagacagaguuuuuugcucuuguugcccaggcuggagugcaauggcgugaucucggcucaccgcaaccuccgccucccagguucaagcgauucucgugccucagccucuggaguagcugggauuacaggcaugcgccaccacacccggcuaauuuuguacuuuuaguagagaugggguuucuccauauuggucaggcuggucccgaacuccugaccucaggugaucugcccgccucagccucccaaagugcugggauuacaggcauaagccaccgagcccagccccacacuccuguuuucauagcccuuuuuugucuguacuuugguacauauuccccaaauaagauuauuauuuacaucugucaugaugaggcagugauagcagcaagugucacuuugacccucacccuuggaaagugggcuaugcauagcuagaguuagaacaggagguucuaauccugcuuccacaauuacuucaguaacaggcuuuuguauccaugauuacuuaagcugacuuagaugcauuuucuacccuguauucuaguguacacaacacaaacacacauaagcccuuuaccuguggagaagagggagaugguugauucagugggaguggggaguggcagagggugccuuaacuuuuucuggcuugaccccuacuuccuuauguguuuccuucauauaccucugucacuuuagagauguaaucaugucuguuccaaguuguaucguuauuaucaagaaguccuauaaauguagcaaaugugacuauuuuauagaaaugcacaauaguuuauaggccuuggagaagucugauaauaguauguaaauauccuucauugaagucauagaaccuucuaguaggaagcuccauaggugauaacugcaagaggauuaauguuuguuucuccaguaaacaccggaagcaaggaaucaaucugucacuguuuaucauucagucuugagcaccguuggguguugauagguuacuauagacacuccccuuauaauuaauauacaggacucacaauuuaggaugucugauggccacuaggguacaucauagagacacuagagagaagagaacaaauauagcuccaucaaaaagccugcuuaaucuuuaacaagucugaaauauuacuaaaauuccaguuaccgugcagcauagucagucuaaaaagcacuggggaaaaaggugucuuuuuggucucuuuaauucuauuauggcacauuuuaauauuauuccacaugugugcaaacuauuucucaagagcaaaguuugaggcuggaguuaagaaaauagaaaaauuaaaacauuauuuuuucucauauaauauaaucugacuacuaguucauggauauaauaauucugggaaaaauuuuagauuaaacuauaaaauugaaaucaccuuugaagaguauauggaauugcuucuuucuauuaaagccaaccuacauuggcaaaaaguguggagaaaaucagugugcucaauucuuuuuguagaguuucaucuaaaauguugcagguaaaaaagaaaacuuuaauugguacuuucuacggugugauuagaaaaauuaguaucuaucucuguugguucugcugacuugcuucuuuccaccgaaucuaaaugcaaugucauaggaggagguuugcuguaaaaacaugucuuuuucuuugguguauucauuguaauuauggcuggcagugagaagguucgguaagucucaauuucucuaccuccuuuacuuggagaaaauuuguaaauguacccugugaauaaaaugauuuuuuauagcuugugaagucuuuucauuuuccagaauuaaaugggugacgcucuuucaucuucuauuccugcuuuguuuuguauccauaucagcuacacugauauuuuuuucuuacagaugaaaagucaugagacuuagugaggaaaucauuuuagaaauccugaauuauaauugcuagaauauaagaacacuauugguacuucuuauguggaugaaaggacuaucuauagggcaaacuagaaagaaaacugagcauuuauuuaauaugauuaauguagauaagccuaguuuuuccagugauaaaacuucuccuuuucgucaauaucaguauguguguccaagagauacuuuaauacauuccuaacaagaugcaauacauuuagauuccccuucugcacauaugggugacuuucaaaacccaagugugccuuuuagucugaauuauuuagacaauugcuucaaacucccauuccccuugggcgcuguuggcccaguucugccaaacucuuccucagagggagugacaucaggaaaagugaccuugauucauccuuuguuauacauuucuccucagaaauugaucaagguacucuguacagaucuccuuauuaauucucugacuucauucucacacgacauagcuuuuugggcuacagcuauuuuaagaaaggacauucuauuaccuaauggaaaaucuacaugguguuuagcugaaucacuuggaaacaaaugcaauacucuaguauaaauguggguuacccuaaccuauucucagacgauauaaggaaaacagacuuaacuuguuuucaccaacuaucauuaaguccccaaaucuagauuugacagaguccugcucuucuacuuuguuucaauuugagcauucaaaaacagauauuaagacuucaaaggcauuaauuacugaagaauucccccuaaaccuaaaaggaggauaauuauaaaucauagacuauauuuuuacuugaaaacuuauuauuuuggauauacgguuagauuccugaugauaugaacaauuauagauguaggaggauugacuucauuuauaauuuauauuauuccauuuuaugagcuuuuagaaguauaugaaaacaaguucuuuguuucauuuauauacauagaguaaaaguuauuucuuuccuucucaauagucaugaauucugggccagaauuaaaaagucagccucaauacuugggaacuuuuucaugguaaacagugcaaucaaauguuagguuaaaaggcaaucaagaauuugugagucucaagauagaugccaauugagauuccaaccuuugcauauggaggcaagggagacaguaggaauaagguacaaguguucauugggugggaccacuauaauccauuuccuaccaggcagauuacugaucucuacaaagagaaugcuuuucuaccaaggguuuaacauuagccuuugcuauuguugguugggcacuuggcagugguggaagccagauuaucauuagucuuugauauuaauuccaugcauaaccuccaugccuguuaccaaaaccacuuuguauagaaguccauugagaaaguaguggaguaauugagaaaagagaccagcuguuacccacucaacacauuguuuagucugggccucuuauaaagguuaugacugcaguagugagguuaauuucuggagugguuaucaauguguucuauccuggagcacauaacaauuuauucuaacugaacuagacauguauuccagauuugccuuuccuguccucaaugcuucugccagc

SEQ ID NO: 14962 - RNA, 712 nt, Homo sapiens
ccuuacuaugguauggcuggcaucuuuucuaggcuuccaccucuuacagauaaaagggggaauuaagcaagugggcugugagagcuagauaguuaagagagcaaagaauccuaaagcuaagccacugggaugaaucagagauguuaggcagaaaaaggaaaaaaagagacauccuccuucccccucuuuucccugccuccuucucaagcuaagccacugggaugaaucagagaugucaggcagagagaggaaaaaaagagacauccuccuuccucacugcuuuauuuguacggcucuugaggaaugggugauacaaacagccuuugauuuuaacaauaucaaaauagaauaaaguguuaauucaccuauacaaaaugaaauuuuaucauuugcgauucauuccuuugcaguaagacacugcaauauaagggacuaucaggcuuugacuugaagcccugaaugcaaauguggaucuuaccacaaagguucagcacaguaaggaaguuugcgagucccagagccagacagaccauuuucuaacuauguaacccuaaccaagguccuuaagcucuuuguggcucaguuucuccaucaagaaaaugaugaucuuaacauccacaaacauccuuaaaagaggagcugaugcauaguaagcauucauuaaaugcuagcucugggcauuacugacugccuaacugcccuuagguaaaua

SEQ ID NO: 14963 - RNA, 279 nt, Homo sapiens
gucacuccauuuuuuuuuauacaacaaggaaggaucguuuauuaugcuaugaacaagaaguccagaggagguuaauucaaaggugcaacaauaucaucaaauaccccacucuuucccacugaauauggcugucacugacacguuggcuuucuccucacgguuacaaaauggcugcaggauagcagggaucguauucugacaggccaaaaagcacaauauuaaaagaggggcugucuuugucucuuuaagaguugaagaaaccuuugcagagggccucca

SEQ ID NO: 14964 - RNA, 96370 nt, Homo sapiens
auuucacagaaaacuggaaccaccacacgcaccuguaccccuuccaaguagaaaccagcuaauuugguuuuacgaaucacuaaaggccgacugaaaacgcucuucuagcagucuucgcugcuacuccaucuaucacagcccauccgaaaagcggcgguagcagcugggaaggccgcggccggaggcugucacagagcagcacucgcgcuucggcccgcaagauggagcguuucccuccagggaagcagcgccgcaccuauccacagcccccacucgguggaugaugcaggacucggcccauuucccugcccuccagcuuucucaacgucagccccgcccccuuaucuuuccucggcgaguuuaguuucgccccgccaagugggcagagcgccgaacgaucgaugcuuucuuccgcgccccgagagccgccauuuuugagagcgggggaggagagacaagcaggggcggcagaggcucaacgggaugcugacuggguuuugcuuuucgucccagccuuguggggccgggacggaagaacccaucaaagcccuuccucccgccgccucuccggaaugaggucucagcacccgcgcgggacagcacccuuccuccugcgacagugaguggcgacccguggcgcgacugccgggcgcccgcgcgcgcccccgcgcgcuccuucgcugucaguuaccccgcgcgccuccgccccucucccgccggccccgcgcucggcgcagacucguuuguuuguuucugcaggagcccaagaagaggccgaaaccgagaccaugccagggaagcugaaggugaaaaucguggccgggcgccauuugccagugauggaccgugcuagugaccugacugaugccuucguggagguuggugcaggguccugccccucaaaacacagggagcgccaagcccugugaaggaucuacccaccucgcccccagccccucagccuauuccccccucgacugcccucccuucggccgugguuguccagcucucccacgagggaugaccgccgagaccucagugugugcgaugggugcacggcuugcaggcguccgcggcacaguccgcugcgcggggaggcuuguacuguugugcaugcgggggugacccugaugucaggacucauuaacaggccaccugccacucaggagaucccaaggcguggccgcgcagccaccgacacacucacacacauacacacacacacacacaaaugccggaaugacucugaugucaggacucauuaacaggccaccugccacucaggagaucccaagguguggccccgcagccacugaaacacacacacacacaggcacacacacacccuuggaagggguggccagagugcuggacaucauguuuaagaaggugcaugaagcccuuuaugggcacuuggagucccacagugcgaggaaauccacucucaugccuaacauuuugugaaucugccaugcacguucuaaaacacaacugcaacacuuccugcucuuguauaggcugguaggucugaugagguguuucaggguaauuuagcgccuugagguaggaagucauuuaauugccauggacuuaaauugcaaaauugcuuuuuaagucuaaugauuaguuuaaaagucaugcaaauuaguaaaggccuacggccggaagguaauaacccagagucugaaagaagccaaguaaagauuguaauaaaaauuggcgugaugagccagagcauuagagcagcaaucauuugggcuauuagugcuuagaauugauggauagauauaucauaauauauagcucgauuucaucucaauauuccugauguuuccuaaauguucucuaaccgaauaauuacaguucacugccuccccugcccauugucauggugauucuuaaucacuucauuugagaaaguucuugagugcucuugugccagauguuaggugauaggaauccacaaauaacuaaaacauaguguuugcuuuccgguaguucagacauugacccacacagccuauuuaauaacuaauagguaacguguugaauuuaauaauugccagaucuguacuaaguacuuuuaaauucuuaguuuucacaacaguccugcuauaggaguauuguuauugucccauguuacaguggauguaacugaggcccaggaaggguaaauaauuugcuuaagguuacauagcuugcaaaccuccacagccugacaguuuguucucuuaaccacucugcuaauacggccucaccaaagugaugaguauuguauuagaauauggaaagaauucugucucugaagguugagaaaggcuucuugugaaagugacauuugaagugggccuugaaggacacccaggauuuuaccaggcaaagggaacaucaaaggcaaaggcauagacugggauauauaguauguucaggaaacugccuuaguuuaguacgugucuggaggaaaggguaugagauauguggguaguggagcuuguuagggaugaggcuggaaagccccauuuucuauaaaaccucauuuucuguaauauuuauaaggagcgacaaggaagcugaaugcaggucacugcagccuccaacuccuggccucaagccauccuccugccucucccgcuucggccucccaaagugcugggauuaugggccugagccaccacgccuggccaggggaguuuuuuaagcagaaauaaaauaagaucauguuuguauuaguuuguuucuuuauaggauggccugaauggggaugcuauugauggacuagacagaugggaaguguggcagggagaucaguuaagaaggugguaaaauuauccagguaauaugugggaaugggaauaggaauggauuugaacagaaagauuugugggacauuucuuagguuaaaauagucaggccuugauaacuagguggauuuugcuggugaggaagggggcugauucagggguuacuuauuacuuccuucuuugaacaaauugagugucugccguuugccaggcucugggcuaguuacuggucuagccgauguauauacauggugaauaagacagacuugguuccuucucuuaauucagcuuauauuuuagugggagagacagauguuuaaaagguaaauaaauuauuaaauauauaguuacaaguugggaugggugccaugaaagggaacaauagaaagagaacaacagggaacaccuacuuuagguugaguaaucaggggaggccccugagaaaaguguuugucaaaaccaagaucugcuggaugagaaggagccugcugcugagggagcauauuuguguguguaggggaguggguggacagaagguaacccggagaucucauguagagauuugguguguuuuaagaagugaaggaaaaugcguguggcuggcacguagucagugaagggaagaguaguauaagauaaaguuggagaguuaaucaaagaaccagucuugcaaggacuaaggccaugauuaagaguuugaauuuuacccuaaauucauugagaagcccuuguuaagaugagcacuguuauauggagaauggauugaaggggaaagaguagaaaucaggcaguuaggagauucuauaauaguucaaauaacagguaauguuauccaaggugauggauuugguaaugcggacaaguggaugaauuccagguauauuuugaagauagauuaaaagaugacuccuagcuuucugaaguauuggguuuucugauacuccagggggaugguaaagauugaggaggaucauuuuccauuugagcauguuagguuugugaugucuuuagggucuuuaauuggagauguuaaggaagugauuuaugacuauggcauucaaaaaaaagaggucugaguuaaaaaugagcacacaagccaguguuucucaacugugagacccaggacucccuuuagauagcugguauuuuggaaucuacccuuucuauccuggcaugauauuuuuuaguuaauauauccuuacaauuaaaaaaucaguaccacgguuuaacuauaacaaauagaaguauuuguuuuuguuguuaucauuauuauuuuuuugagauagagucuugcucuuucacccaggcuggaguguaguggcacgaucuuggcucacugcaacuuccgucaccuggguucaagcgauuguccugccucagccuccagaguagcugggauuacaggugcuugccuccgcgcccagcuaauuuuuguauuuuuaguagcgacgggguuucgccauguuggccaggcuggucuugaacuccugaccucaggugauccaccugccuuggucucccaaagugcugggauuacagaugugagccaccgcgccuggccuguuguuauuauuuuaauauggaaguacuuuuucaugaccauaauagaaaacaugaaguaaucagaugaaucaaugaauucagccuuuguauguauuagacacuguacuggaugcuggggauauagcaauaaauuuaaaaaaacuucauucacggaacuuacauuuuagugggaggagagaguucauaaauaagguaaguaaguaaaagauacaguaugcuggauggucuaguuuucucuagauuuuagcauauaccaaaaauuacuuaagaauaauauauggagaaaauaaagcugggacacagaauagggagugccucgccuauguuaaaaccacgugaaugugacugcuucucaaacagagugagacaguuguguaguuuuggcaucucagaucuucauugccauugguuaucugauuuuucaaaauagucaacucaugggaaaaagcagaguugccucuugauuuacaugaugguuguaguucuugacaauuauguacauugaaacccgauuguaauacuucuaucuguaaaacugagguucuagguaggguuuuuuuucucuuuuuuuuuuuuuuuuuugagacggagcuucgcucuuguugcccagguuggagugcaauggcgugaucucagcucacuguaaacucugccucucagguucaagcgauucuccugccucagccuccugaguagcugggacuaccagugcaccaccaugccuggcuaauuuuuuguauuuuuguagagacaggguuucaccauguugcccagacuggucuugaacaccugaccucaggugauccacccacauuggccucccaaagugcggggauuacaggcaugagccaccacaccuggucuucuagguagguuucuuacccaugugauuaucuaguggcacauuugaaaaucaugacaugguaaaagucuucauuguugggaacucucuugcauugaagaauaccuggcaucucuggcccuuccucacuuaaugcaauuacuauuuuccccaaaaccacugcuagaaaugucuaaagcuucuuuaggaguuggaguugguucugucuuuuuugcaaagcuuuaggaguugguucugucuuuuuugcaaaccugugacuuaggggaagggagagaaacaggaugaauccuugaaaaaacuugauauuaagagguuuauuagaagaggaggacuagaggaaggaaacugagauugugagccagugggugggagaaaaauggggaacauaaugucuuagaaggcaagagaggaaguuucuagaaagaggaaggaagcucaauugucagaugucacugaggucaaguaagaagacagaaaaauuauuggauuggacaacauggggguugugacaagaggcaugaugaggguggaaucccauccuguagugauuuaaagagaaaguacaugggaagugaggaaguagaaagaguaugaauaggcaacuguuucaagauguauggcuaugaaggggggaggaaaaauacugugguguuugagaaguaguuuuaguacuuaaaaaauaaaugaaaagauacagaaccuauuugugugcuaauaggaauaauccaguagaaaggggaaaaauuaaugcaggaaaagggggauaaugaaggauuacaauauaauaaagggauaaaugcuugauacagacuuaaguucauagaagagggagauaaugaagcgugggcuugucaugagaaaccuuuauccugggccuggaggaugguaaaauuuacaaaggcagagagaaaaaggaagaaaaaauuuucaggugacuaggacaaacuugauaaaagcaaaagaacagaguauguauugauguaauugaauguauuucaauugaaugaauuucauucauaugugauugaaaggaagauucuuguugaauagaagugggaaauaaaucuggcuaggaaagggggauacagauuacugaguaguccaaaaauuaggaggagaggucaauacaguugaagcugucuuaacaaccuccguuaagugacucauugcaauccucagcguucugcauccuuccauaaagcguauucguaaauacuccucuggguaagacuacucuccagugugucuggaguuucccaucaguuggcugauauacuuuaccaagaggcaguuguguuuauucccaaaucugcuuaugucaacuguauuucuuacuauauuuuauuuaaaccuuauauaaaugagugaauguaaagacauggaaaugguuacuaaaaauagcucuugaauuagguggagaaaagacuguaaaaaauagaggauucuuuguucguacuuuuuaaagcaacccaaacuggaaaucagagaugaauguggcuuaugcaaaaaaagaugacuaaacaguugacuuuuacacaaagaagaggucuuagccuuacauuaaaagacaggaaugaauguuuguuuauauguuuuaucuuaaaauguuuacaguuuguauuauuuuuagugauccucuaauuuaaccaaguuauuugauuaacugaucaaguauugguccugguugcauugauugagagaauuuccacuauauaugacgucaggaguguagggacccagugaagaccaaauaauucuucaagacgaguagucuugcaggaaucucuagaguaagaugggguucuguacaagcgaaguauuaauggaaauauaucugaauguuaauguguguuaccaauuguuuggcuaaacuacauugucaucuuguguuuuucuaggaaccuuugagggaacagggagaggaaaguaaauauuuaaugaauauuuccuaugugcagacauuuugcuaggucucuacauguguuauaucauguaaugcucacuuacaaucccacuuuucagaggaggaagccaauuuaaauaacagguuaauaacuuucucaagguaauuuagcuaaugaguagguaaagagaaugcuuuacuuuacugggggaaaucuccauuaaaaucccugauguucuuuaacagaguuauaaggcauucauuuaauugcugaguaauaaaauguccuuuuaauuaaauuaagacuaagugaaccgagauucuucuguacuagaguggaaaucauccaauguuggcaaaauacacacuccagccuuuuucuuuuuguuucuuguccuuuauuuguuuucuuguuugaaagacugggucuugcucuguugcccaggccugaaugcagcagccuugaacuccuggcuucaagcuccucuugccuuagcuucuugaguagcagggacuccaggcacgcaccacccugccuggcugaugacuuuuccuuuuuucuaaagucuuuuuuguuuguuuaaagcaguuuguggacuaucggaucuuuauuuagaaugaacaguugcacaacaacaaaaaggcacaguauagcacaacuguuauagugggacaaaacuguagagugcucuaaacuugucacuuaaaaaaucauguacuacuuuuggcaguugagccaaaacccuuaaguauauugcuuuugaaugauuuugaauguuuuuauaaauccuaacaguauuuuacuucauauaaagcagcuuuagauaaauuaaacaauaaguauuuccaucaugccuugaauauuuaaauggaaugaaaauuaaauuaguaauuaaacaagaaccucuauucuuccuuuuuccucauuaaguuucauuucuuuaucauugugauuaaaaaaauuaugcaaguaauacuugaaugcuccccauuaaaaaagauugaaacacucaaauauaacucgaaaaccccuuacuuucuucuuacaccacuguacucuauuuccuacacccuaucagucccuucuucagagauaauugcugucaguucuuuggcuuauguuaaucuauucuucauccucuuaacaaauacuuguauaucuauaucacauuuuuagaaacaaauauaaucauacuuuauauauucugcuacuuguuuuuucaguuauuguguaauaucuucuagugacaguacauauagucgacuccauuauuuauagggcacaugauuuguucagucacuuuccugcugaaugacuauauuuuugguggggagggcuuaugugaaaguacuucuguagguuaaauuccugguagcaaaccuaggauucuguaauuugaaugaaaauaaaguuauugccauuuuuauuuuaauuuuugauguuuuugaauuuuaaaauaaugcauuuaaaauagguaguauuaugcaugguucaaaauucaaaagguacaaagugagucagcuucucuuucacagccucuccuuuaaccaaccucuucugcuguuuguaguggccauuguuacuauuucuuguauauacuucuagaaauaaugugcgcauauacagacauauaacuauuauaugaauucugucuuuuuuuuuuuugugcugaagaaugccauauaucugcaguagaaagauguaucuuggaaguuguuccuuaccagugcauggagaacugcuuuauucuauuuagugcuacauuguguugcuuuaccauaaauuuaauuaguuccauauugacagauauuuaacuuguuuccaagcuuuugcuacaguaaugcugcugauauaugccauuguguaccucugugggauaaauucuaagaaguagaauugcuagcuuaaaagggauuuaaggcauuuaaaauuuugauguguuuucaaagucucuguagagauuguucuacaacuccuaccagcaaagcaugacaguaccgcaccaauucuguuuucaaaucuuuuggucuuugccagccugauaaguaaaaauauuuuaguuugcauuucucuuaguaugaaugagguugaucaucuuuugaugugguuaaagacagcuguauuuccauuucugugacuuaccugaucauauccuuugccuauuuuuucuauuggguuguugaucuuuuauugcucucuauaugcucuuuagaaacggaggaaguuaguucuuugugauguguggagcuggucaagcagagcaaugggugauugcuuguuguggguauuauuauuagucuacaaucuuaccuggauccaucuguaccuucuucccuuugucccagaggauaauagucuuuuguccccuuuaugguuuauccuucuauugguuggcugacauuaaaauuuacuuuuauucacauuuuugauauucauaugugaauaauuucuuauuuguuuuuagguaaaauuugguaauaccaccuuuaaaacagauguguaccuuaagucacucaacccucaguggaacucggagugguuuaaauuugagguaaguuuuuaaaugucagcauuuuugaguguauuuuuuugaggugacucuuuucccucaggaauaaugagaaccuuuuauuucaggcauaguaguauuucuacaucacaaaaauauuuucuuuucugcuuaccuaggaauauugagucuaaaaaaaguuguauuacauuuaagaaaauacaguauaugauaacacauuaacaaaagaagucuucagauguauuauauuauuauuauuguaguuuucucuagauuuuagcacauaccaaaaauuacuuaagaauaauauauggauuaaaauaaauuuuuaaaaauuguaguacuauauauugugaauauugccauuuaaaucauuuguaaguguacaguuugguagcauuaauuacauucacaguguuuugcuaccaucaccgcuauuuccagaacuuuuucuuuauccuaaauggaaauuguguacucacuaaccaauaacuucccauucccuccucucccuagacucuggugaccucuaaucuacuuucugucucuuugaauuugcuuaugcuagauauuucauauaaauggagucauauaauacuuguccuguuguaucugcuuucuuuuacucagcauaauguuuucaggguucauccacacuguaacauguaucagaauuuuauuccuucuuauggcugaauaauaacccauuguauguguaugccacauuuuauuuucuaauugaguuauuuuuauugaguuguaaaaguucuuuauauauucugaauauuaacuuauuaucagauauauaauuugcaaauauuuucacucauucaauagguugucuuuuuacuuucuugauaauuuucuuugaugcgcaaaaguuuuaaauuuugaugaaguccaauauauuuauuuuuguuuuggugugaaaucaaagaauccauugucaacucuaaggucaugaagauuaccccuauguuuuuuuguaagaguuuuaugguuuuaauuccuauauguaggucauggauucauuuggaguuaauuuuuauaauggagugcaguaagaggccaacuucauuccuuucuuuuaauagacagagucuugcuuuguugcccaggcuggagugcaauggugcgaucuuggcucacugcaaccuccgccugcuggguucaagcgauucuccugccucagccucccuaguagcugggauuacaggcaugcgccaucaugccuggcuaauuuuuuuguauuuuuaguagagaugggguuuugcccuguuggcccggcuggucucaaacuccugaccucaagugaucugccugccuuggccucccaaagugcuaggauuacaggcguuagccaccacacguggccccaacuucauucauguauguagaaauucaugcauguagaaauucaguuguuugggcacauuuguugaagagacuguucuuuuaccauugauugguaguccacauagagacaggaggugguuauguucaaauggcucauggccuggugaucugaggggacuucuccaaaaggagagccucccaucuccucacccaggucucuuuucauuccucccuucuucccacuugugcuuccuuccuugaggcccuugaauguagaggucccuaucacucauguucuccucuugugcucuucuuaggaaguccguuguguuacuguuaggaugucuguuuuauguugcgcccagccaccucccugcaguuucugcccucuuucucucuacaucuguuuauuuuuucauggguugauuuggucugucggcaugccccaauccuccaggagauuauagggacuguacuaggcuuugagaacaacaagaugacauacaaaaggagauacaguucucauuuacagacugcuuauuauagcccagacgcuggugaagugcuuuacauguguuaaccucauucaauucucacaaugccgugaaggcaccuuuuauuuuaagaugacucagaaguccaacccagagcuagcuaagugguagagugagguuucaaaccgaagacugccugacuccaaagcuauuaccagaccaccacaccuccaucuuacauucucccauucuacccaccacccccccuucccaaguuaaacaucuuugucauuuauuguucccugugccagcaauguuuucccugcuuuuuuuguucuucuucacugcuauguccucaacgcccagaagagcguguaauagacucucgguaaauauuuaccacacauauugcccauuucucugauaccacuuccuucaccccucagcuggaacugaaauuuucuucuuuggaauuuucauuggacuacuuaagaaccuugugaggaccaauuugguuuuucuuccccugcuauuucaugcuggcccuuauauugggcagcauuguggcugcugugccuuuucugaggccuauuucauaaccauuauggagccuggguaaaguuuagcucuugcaggguaaggugucauucuucagugaaagagaacaagggaaggaaaguauugauuugcuugaaagaugcuuugaucaugcuggggaaccugccaaacugauaccugaagauggaagaaaugacacuacgauuuuuaggcgcugcuuugcuuaugguuuauauuaggaccgugaucuuucuuuuaguguuggaaggcacauucuguagugguugggauacugcauagcugcccucuauuggaaaagcuuaaaggucuggauuaagagaaaacaaauucuauuucuggugccugcuaauuugcagaugaccucagacagccuuaccauuuggagccucuguuuuuuuucaaacaugaauucuuuccagaguaguauugagguggcuaugaagcauguugcuguauguuaauaugaguugcacuagucaaaaaaaagagaauaauauauguaaacuuuuuuuuuuuuuugagacggaguuucacucccguugcccaggcuggagggcaauggugggaucuuggcucacugcaaccucugccucucagguucaagcgauucuccugccucagccucuugaguagcugggaguacagucaugcgccaccacaccuggcuaauuuuguauuuuuaguagagacaggguuucuccauguuggucaagcuguucucaaacucgcgaccucaggugauccacccaccuuggccucccaaagugcugggauuacaggcguaaugcccggccugggaauaauauuuuuaaaucacucagcauuuuggauagacauucagcguuuggcagaaaguggguuuaaauauuagcauuuugggguauaucuucuguucuuucguuaauguauaguuuaauuagucugagugguguaggugugcuaaaaaaauagaacugcaguuugaaaagcuuuuguugcuaaaauuaaaucucaguuuguauaagaaagguguaccucgucuguagacucagcauuuauggacagugacagcuuuuauuuauuaucucuguggaauauaacuguguuucucaaaauuacgaccucaucagaguagcuuggcugugucucagucuucugucaaaaggacucaguuauagaaacaguuauucuuaaccucccaguagcuuuuacccaaagguuuucaagcaaauggaucucucuaaggaagguaauuucuaguuucuguaaacuccuccucuuuuaaaauggacuuccauguuaucugcuagaacauugaacuggaagucaguaaauuguuuaggacuuuaccuuugaggcaaguuaaaaaaaaucaguuggacauagauguaaggauuuauuuccgcacucucaacuccauuccauuggucuguaugucugucuuuauacuauuaccauacuguuuugauuacuauagcuuuguagugaguuuugcaaucaggaagugagaguccuacaaauucauauuuuuaguugauauuuucauggugaaauauuuugauucucuucucauuuucuuuuguguauauguacaaauuuuucuuuuagcugcuucuaaaaugccacuaucuauuuugaaagacccguugcacauguauugagucuauuguggcauuuuaaacuacauuauuaagguaaagguguggaauauaugugucaaaaaauaaucagaguaacuuccuuacaugauuucagauggauuuagaauuagagucuaucuucauuacccaggcaaaacacugggauguuuauauaguuuauuuugauagccuuucccccccaacuauaaccuagaaaugguuaaaaacgaauaguuuucauuacauuguuauuggaauggugggaggaggcaagcuucaugugucagaguaauuuucaugauacuaggaaauauuaaaaaaugauauuucauuuuaaugaugaugguaauaaacugguauuuuuuaaagcuagugaguacucaagcagcuuacuuaacaauaugaaaaauaauauauuuauuuucugaaauaagggauuuaccaggcaguucccuuaaaauuucuuaaguuaguggcugggugcaguggcucacagcuauaaucuugggacuuugggaagccgaggcaggcgaaucaccugagauccaggguucaagaccagccugggcaacagagugaaaccccgucucuacuaaaauacaaaaauuagccgggugugguggugugaaccuguaaucccagcuaugugggaggccgaggcccaagaaucgcuugaaccugggaggcagagguugcagugagucgagaucacgccauugcacuccagccugggugacagagugagacuccgucuuaaaaaaaaaaaaaaauuuaguaaguuacuguuuugacuagucuucccgaauaauauauaugcugugaaaaauguacuuaaaacuuuguguuuauaguuaacauugauuauguaguacuuuuuuuaacccuguuuaucaguuguuaauugcauucaguuauauauauauauucaguuuuaaauauauauacacacacaguuguguauauauauauacacaguuguauguauacauauacacauaguuguauauauacaguuauauauauacuguauauauauacacaguuguauauauaguuguuauguauacaguuguguauaauauauauacacuguguguguguguguguguguguguguguauauauauauauauauauauauauauauauauauagcacucaaauacaugucuuaagcaaaauagauguuuuucucuuaugugaaagaaaugucgugccaggcaguguaaggguagugugguugcuccacgcagucauuugggacuccaucaucuauacauagccugugguuucucuuaaagugauucaagguccuuuuggcuccaguuuagcaccuggaguuccagugagcacaugaguguuccaggcuggcagaaggagcuagagugaaggggaguccaggaggaggagcugaugaguuaacauaacaguuucagaugagcaagccuucuuuaacaaguuugcccccucccuaccaagcucucuguaaugauuuaugcuuguaucacauuuaguugcaagggaggcuaagaaaugcagucuuuuggcagugcauauugcuaauuuaaacauuuaaaacauuucucagaaagucuuaauuuauaauauuuugcgauuccagauaggcuucauuuacuguacuaaauauucuuaauucauuaugauuaauucuugauuuucccuguuauucaucuuguuagcuaucuauguauguaucacaagcuauuuuuagucacuuaguuguuaguauagcacccccuaaugucagggaagggauaccuuaguguaccaugagaaaaaauaauacucagaggugaauguacaggugguuaaauaaguauauacagagaguauuuuuaauggaguuagaaauuggggggaaugucuuagaguaaugguuaaugguuugguuuaugauucuuucucuucuguuaaauguauacauaacaauaguaguggagagaaugccauuggaugacagaugauuuggaauggauugggauucaaaaugaucauuuuauuuuaacauuucauuauggaaaauuucaagcaugcacaaagauagauuaguauauugaaccucacccaccuuuaacagcugucuacguucuacuguucuuguuuugccuuuuuaacuccugcccaccccgguuuuccuuguggggauauuuuaaggcaaauuugagauguuauaugauuucaucugugaauuccaaauuauauaccucuuauaaaggaggaccccuuauaaauaaacaaaaccuuagaucacauuaucacacuaaugauaucaauaauuccuuaauauucuuuaauuuuuaaaauaaucuucagaggcuggauuauuagcuuaacaucaacaauaaauuaaauaggggauagggaaaggcauaaauguuucauauccaaguuuaaaaaaccaaccagaguauaaggguugcagagcuaucacuugaccaaagcauauguaagaaugauacagagauuuuagccaaccacagacucagucuuaauaguaugguaugucugauguaaagaagaacauccauggacugcauuuuaaaaguauaauuuucuaauuauagaaaauaauaauccuuugguauucugucccaaucuuaauagugucuauaauauguucccuucuggccacuauauuugaugaaggggacugguaaauuagauaauggcaugauauccagaagguggcagccaaaauagugaguacgucuuccaugaggaaaucauuuugcacuguucuccauuguaaaugccucuguuuggcacaguguuuggcauaugauaacaacucgauaaugacuaaauaaaaggagagaggguagauguuuauaucaugaacuuaauuugugaacuuagguuguuuuuucuuacacauaauguuaauuuugcuuaugguucuguucucugaaaucgcccuuagaaauuguggugucauugugcucaauuagcauucuucucucuauagauacuacaugaacucuaauaugacauuccuuaggcauuuuugcuauguaucauaggcaaaguuguaaaacacaggauaauauguaaaaaaaauugagauuuaaauuuuuuuguuguuagucaucccagucuugugcugagagauaaacuuuuuuucuuuagaaagaugggauauuguguaggaaaaggagcuauaucuuuuuguguguuaauucuuuucuuuacuuuggugcuuagaaaucuguaagauuuuauuugcagaugugucauccuuuucauuugauauagguauacauuugugguaauuaagauuuaaaaacuauaugaguuuuaauuuuaagguauacuuguagguggaugaugaagacuuacaagaugaaccuuuacagaucacaguucuugaccaugauacuuacagugcaaaugaugccauugguaaaguguacauugauauugauccuuuacuguauagugaagcugcaacagucaucucaggaugguuuccaauuuaugacaccauacaugguaaggaauaauaagaaaguauuauaaauaacaaucuuaaucuuuuuuauuuguccuuaaagacauuugugcuauauuugcugguuuaaaauauguaucuuuaggcuaggugcgguggcucaugccuguaaucccagcacuuugggaggcugaggcggguggaucaccugaggucgggaguucgagaccagccugaucaacauggagaaaccccgucucuacuaaaaauacaaaauuagcugggcaugguggugcaugccuguaaucccagcuacuugggagggugaggcaggagaaucacuugaacccgggaggcggagguuguggugagcugagaucguguccugugcaacaagagugaaacucuagcucaaaaaaaaaaaaaaaaaauauauauauauauguauauaauauaucuuaagaugaugccuuuuuaaaaauaaauaauaguaaauuauuguuaguaaaauuguugcuucucucaacauaauuugagauaaugcuugcuaaauuuguauaguauaguaaguaaaugcaugauuuaaaacugaucuaguauugauacuguguuucuaaaacacauuuucaaacugauuaauaaugauuuuuguacuuaaaaguuacuuaaaaguuuuuuguugccugaagcagggccucccgggcaguugcgauugcaggcacaugccauugcaggcacaugccaugacaccuggcugauuuuuaaauuuuuuguagagacacgguuuugccauauuggcuaggcuggccuuaacucuagagcucaagugaucugccugccucagcuucccagagugcugggauuugcuuucuuaauauuuuaguagguaaauuauugagucaguuuucuuaagucuuccaccauaaguaugaauuugacaugaagucaggacagucaagugaaaauauuuaguaaauguuuagagauaagaucugggucauucuuauuuaucagagcauguuuugaaaacccuuauucuuggaauuuuuuauuuacuuaauuuuuuucucgcuguguugcccaggcuggucucaaaccccugagcucaagcuguccuccugccuugccucccaaagcacugagauuacaggcaugagccacuacuccuggcuuggaauuuuuuaguuagcuugcuuuaacuuauauucauugaaaagaauaaaacuucuuuuguuuuaaaucagauucuugcauuguuaagaauauauaaucugggaucauaaagaucugaauuuuaauccuggaucugccacuuaacagcuauugacacuguaaauuacuuaauuuuuauuaaaaauuucuuccuuuguaaaauggggaugauacuaccuuauuggguugaugugacugcucugagauacuaccuguaaaguguuuaguacaucguguaucagugcucagcaaauguugucaccauaaucauuaucaucaucaucaauucaaaugggacuccuuucuaauuagucuugggucaaaguggagacuugugaaaaugaaaauuauucauauucuaaugcauacguguugugcuucagaaaauauacagaaacuacugaaaaagaaaauaacuaggaaacaaagcuggcauuacuauuaugaucaacacauuacagaugcaccuugauuugugauggcguuauauccagauaaacucaucccaaguugaaaaugcauuuaauauaucuaaucaaccaaacauuauagcuuagccuagccuaucucaaaugugcaccgaacacuuauauuagccuacaguuggacagaaucaacuaaaacaaagacuauuuuuuaaauaaaguauugaacaucucauguaauucauugaauucuggacugaaagugaaaaucagaaugguuuugcaccaugguaaaguucaaaaaauugugaguuaaaucauuguauuuuaaaaucauuauuuagcauuaauuugcuucauuauuuaauuguacauuacuuucuuaagguagaaacuugauuuucuuuuuaaauuuauagguauccguggggaaaucaauguaguugucaaaguagaccucuucaaugauuuaaaucgauuuaggcagucaucauguggagucaaauucuuuugcaguaaguaaauacauucuauuacucaacaggaaauguaauaacuguuaaauaugagaaaucaaguuaacauuucagaaggcaaguagaaaagcuauuguacuugguuuuaaugccaaagagaaaauuguuaauuuucuagaauaguuacaguaguucugauuugaguauaaaugauaucuaguuuuugaaaauuuauagaaauuuuuauuagaaaaauccagugacauuucacuguaguauaggacacuaaaagaaaggagcagaacacuacggcuaagcacuauggugcugucccaaaauacacaggcuuuuauggguauugggucuagggaacuccaugaaauauaugggucugaaaugggcagaucuuggugaucacagcccgccugcaguaguaggauugaaaucccuaaguaguugacuuagcuucagugcaccaauguuuauuuuaagagacuaauuugguacagauguauucagguucucucucuccuuuuugaaucugaacuugacuccucagguuaugucagaaagguaaugguuugauuuuugaaacugcuaugugguguacagaaguacuuuuacaaagggcuuugaauaauuaaagauuuaaaaaaauucauuaucugcuuucuaccuauuuauauaauaauuagcuagcugacuuaaauuuugauuuuuuaaacuuuguauugaauucuguuuaaggucuucuauagcuguuuuccaaauuauacaaaugcaguuuauauuuacuuugcuuacaugagaaaggugagagccuccaugaaagacaauaauuauuucuaaaaaugaaauagaucuuagaagacuggaaguauuauuauaauuacauugaaaauauuacaguaaaagauguucuuguauuauguaucuaaaggucagaaaauugagauguacauuuuuuaaaaauugaguuuuaccuuuugauaaacagaagcauaauaauuuguuuuaacagcaacgucuauuccaaaaugcuauagagcugugauaauucauggauuuguagaagaacuuguggucaaugaagacccagaauaucaguggauugaucgaauucgcacaccaagggcaucaaaugaggccagacagagacucauuucguuaaugucagguauuuaaaaaaaauaacuuuauuacugacugauuuaguacucucuuaaauuuuuugcuuuccuuugacaugcuaccucaacuuuacaaugaaggcuaugaauuauaagugacugcaugccuuccccugggccagucuuccugaacacacuugcauugcccucuuuuaacaaguggaaaugcaaaucagaagcuuguaguaaaaggaaauuguguugaugagguaguguaguggaaagagcgcugagcaaggggcguucaggaaggaacccugagugggaaccuggauucuaguuuuccuucaucuaccauuuauuugucagagcuuaagcaaaucaccuucuucugucucucauacuuucuguucagauguugccuuuucacaguuccucccuagguacuguaguucccucuauccuuuugaccacuuucccugccacucugaccucauucccuuuuuaaauuuuucuuugaaaaacuuguuuacuguuuuauuuaaaauuuacauuuauauuaagaguuauauguguauaugugugaauauauauucauacauguauuucacacaaaguaucaauguuauauuuauauagcaaauauauuuguuuuuauucuauauauuugugcuguauaaguauauauuauauuuuauaauuaugcuauauuguaauagaauuauguucuguauucuguagaggcuaaaccagauuaucuuuuaaguuuccuucaaguucugaaaaucugugauuuucuuggucuuuuuuuuuuuuuuuaccacuaccauguccagucuuauaguauguaauguaaagcuacaaagcaagaaugagauuucccauguuuuguaggugagcugcagaggaagauuggcuugaaaguacuugaaaugagaggaaaugcaguugugggguacuuacaguguuucgaucuggagggcgagucuggguuaguggugcgagccauaggaacggcguguacucuggauaaauuaaguagcccagcagcauuccuuccugcauguaauuccccauccaaagaaaugaaggaguaaguaugaaucaaugaaauuguucuugcuaagauuuuuaucuuuuaucuaugcuuuuucauuugauuugaaacauuuuaguaggguuguucaacauuuucucugugaugauuuuuauuggugaugacugucaaaauuuaaaacuuaaaaauauuuaaauauuccuaauauuuuauuuauaccgucuuauuuauuuuuauuuuuauuuuuugugacagggucuugcucuguugcccaggcuggaguucaguggcacagucuuggcucacugcagccuugaccuucuaggcucaggugauccucccaccucagccgccugaguagcugggacuacaggggcaggccaccacgcccagcuaacuuuuguauuuuuaguagagaugggguuuugucauguugccuagccuggucucaaacuccugggcucaagugaucuaccugccuugaccucccaaaaugcugggauuuacaggugugagccacugugcccugccuaugccaucuuaauaugaaacaaauuaaguaauauaaaauuaaacuuauuccagauauuuagacacugcauauauaaagcauaaaaugaauauucaagcauuguguggcauuuuauuuucugaggaauacuuaaaacccucuaccagauaauccaauuauacuuauuaauggccacauaguauauaaagcaggaaaaauugauuugugcagaaguguuaaacucaaaugucuagaggccagggaguuuauaugaauaaacuaacugaguguaauuaaauagaguauacugcugcuuguaaagccaagguuggcaaacuuuuucugggaaaggccaauacuuuagggucugcccauacaaucucuugucuuuauuuacaaaaaaaggaguuugcugaucccuauucuaaagaaauuuagagucaugcauuuuagaaaaucuaugugugauccugcaaaacacuucuguuggcuugauuuggccugugugugucaucauugugucagaggcagagauuuucaacaugaugguggucaugacugucaucacagaguguuuggaacaagauuuuucagucauaaugauuagggugcuagguccuguuggggacuaaaaacgcugacuaucccgcacagcaagggacaacccuauacaaugaagacuuguuucauccuaaaugccuuuaguacuucgguugaagaccacucaucuagagauucuucuaagucaaggguuggcaaacuuuuucugugaaugaccaaaugguacagguaaaugauuuaguuuuugcugaugcuacuucauaacugccauuguagcacaaaagcaaacauaaacaguaugcaagugaauacagugugacuguguucaaauaaaacuuacuuacaaaacagaugguaggacagauucggacugcagucuguaguuuguggacuccuguccuagauaaucagggagucagaguuguauagucaggaaaccuaaaauguuucccaguucaguagucaggagggguugaauagaaagguaucauaguaugaaaaaacauguuuuuucaccaucuuuuuuaaagugaaauuuucaucuuuauccuaagugcauucuuuuuguuagccauuuuauuucugcuggccauuagucauuuggguugaauuuuauucauaagaggaagcacaguguuacauacugcuuaauuuuauuuggaaacacauuggcaaaugaaauaauuguuuuaaauaaaucgaagaaugaauuugcuuuauauuccauuuaaaauaucuccuagaaagauaagaauugccagcugccagcaguagagucagauugcagguuuagcuuuuugagguauucagauuuuuuucccucucucuguagcaaauuuaaguaaauauuuacuagcaaauuaaagugcaaguuuaagcaaauuuaaguaaguuaccuaguggaaggagaaugacaaagcuauauuaccuguugguuccuuagaaugaaauacagagagcaaggggauauguuuugcaugcauucaggaagaguucuauuaguguaaaucuucugggauuguauacguuuucuccuuuucuaaucuuguuguagccucaugauggacguaaguuccuuccuuaggauuuucuaaaaggcaucuuacuaauuaagucaaguuauuuuuuaaaaacccucaauacucaggcuguuuuauuucaacuggcuucauuguauuuuuugagaaugaagcaauuuggguucuauuucaaagccuauuuuaugauucagcugauuauaacuauucugguauuuaauuauguaauauuguugauucuagacaggaauuugauaaaaggugguuuagauuauguuauugacugacuggaaaggaauauuaauauuauaaauaccacagguuauuaugaggcauccuuucaugcagagagacugaucgaaucagaaaacuccaagaguacauuauggugauguuccaguguauuugaauuuuaauuugaugccauaguuugaacauuuuacacuguucauuuuaguuuuuucauuuuauuuuaccuacauuaaugguguguucuacuuccuaaguuuuuuucuuuuugauguuuagugucaugcacacuauaaaucccuuugguguuuuccagcuuaacucucuugacaauagaaagugcuuuuaaguaugaguuauugcuucuuuacuuaaaaaaaguacuacgagacaaauucuccuguguauacuacugauuauaauaaauauagcauuguuuauuuuuaagucuuggauuuuuuaauucuuuuugagaauucuuauacuuuuucucacuucaguggagaaauaaaaacaaaaacaaaaccuuacucauuuuuugguguaaaaguagaucaccaaugaauuguuugauuuuuauccauuauaguaaauaccuuuuaauuucuauuagcaacaaacguagaaacaguucuccuauugcaaaaucaguaauauuuucauaaaguagucuguagaccuuaggaaggacuauuaugaucaguuagugauagcucauguuagaaccuugacaaauugugaauuggggaauguuccugggcagucaguaauauagcaauggaaaagaaagaaaagaucagguaaaguugggcucuuugccugccuuuaauuugcguucuaaaaaauggggaugauaguuuuucagaguguacucacauaugauucauaugauucuguuucccucauuguguguaagcaaaggcauugcacagugaaauaauugcugauauuaaauucaggauucuuauuuauguaguauaccuuuuuacaacauucaauguaauccuuuuagccaaauuuuuucuuaaaaauuucaaaucuuauauaucaauauauacuuguauaacugcucuaaguauacacacacauagauaugguuuauuauaggauauauguugauaucuuauaaaauuuugauuuggaauauaguuuauaugauauauucuguaugagagccaaaguuauugacauuguuuuaugaagaugucuuuaaaagcaagguccccuuguuuuguuuccaguguaaccugauuuuaagcuauauauuugguguauugaaauacuggaauauguuuaucugcguauauccaaucaguucacucauuucucuuugugccaucaucucucauauucuuaaauaccccuaucuuaguagccuagacaguuauuuaacuuucuuuauagaaaauauaauuaauuauaucagcaauucauaucucaguuucaaagguaauauaagaacuuuauauuugacuuuuuacuuuuaugggcgucccuccccauaaauagugcauaguaaguucuauugugaugaaaauaaugacaaauauguuaaggaaacuuaaaauacagaucuuagucuuguucucauuuaauuucauugacuauucugcuugcuauuuucuuauucacaauuaauaaauuaaucacaauuaauuuauuaaucggauacuuuaaaacuauguauccuaacaaauuaauauuuagcuauuuuucaauuucaacuuguuuuuugcaugcuagggauuaaaaaaauaaguucucuucccugacuaaagcuccuuugaaauuauuuuaacauaacucugcaaucuguuguauguauuguuuucuuuucuuccacuuugaccacaaauucccucaggucuccgcugguucauccuccaagccauggaugccgcucgacucacaacagcccaauucacacugcuacuggcucacgacuuacucagaacuucucugugucuguucccacucucaucuauacugguacgagacugcucagacuccagagcuggggagaugcaggccacgggcagaguggcugcagaggcaggcaggcagguaguguaggcagguaccauaaaucuuugcuucauccuuuucuuacucgaaguccagcugcagugaggaacuucuguauuuagcugccacagagucucuaacuauauggaagugaagguauucuuccagcuuccaaagucucuuccacagauccucaaauaaugcuauuuuguauguguguacugugaauuuuguggcgaauccucccauauauauuuuuauaauuauuucugcauuuguuuaaaaauaaaauugaugauuagauucuaaaugaaauagcugccaaagcuuccaauuugcuuauuuucuuuauauacaaaaccuauuacaguagguccuauuucauucuguggaagagagcuauuggagaacagguaagcaacuauucugcauuaaaugcaauguuucuguguagcuguauucauuuuucucucugcuguguuuuuagcuguggcacucuugcugcuauaggauaaggaaacauuuuuuucuuuugaggauaucugugugugugcaaauauaaaaacaauuaugaauauuuacacacaccauuuguaguuaccauuuuucuuuuguaacuuacagcauuguuuauuugaaaauauuuugucauauauucuuuuuauuucuccuuuugauauuuuuuauccccuuagucugucauuucaugcuuuuuugcuuuuucacuuggcuuauuaacuguuucaaugcagauaauauuuaucuggagagugaugaaugguuaaacagcaauugguugucuuuggccucauucccagcuccacacguaagaaaugacugcuggcccugccccaauucuuuccugguguuuggaucaugcugccaccugucaaguccuuuggcacaugauuacuuaauauuucuccaccuucuucuggcaggauucccuucaaugaagaucccaaucccaauacucacucaucaggacccucaaccccucugaaaaaccaaacuuauuccuuuucaccuuccaaguccuacagucgacaguccucuucuucugacacagauuugaguuugacacccaaaacugguaaggcgcuuccacccaccuuuuauuuuuucuuuuuuaaaaauuuguuucuauuucuuauuagcuuuccauccaaaucuuuccucuuguuuuuggcacuuaaguuaaaaagaaaaugugaauacugaccauuuucaguuacugcaauuaaaauaugaaaauuuuguauaauucagaaauuaucuuguuuacauuucauugauuuaaucauaguguagauaucaaaguccacgauuuauuuuggcauguagacauuuuucauuuuaugcucgaauuaaaaggaauaacaucuuaaaacauuuugacuaaaaaguaacacuaguggcuugcaaucaauugcauacaagcauuuuugaauuuauuauuucugccuauuagugaauauaauucuaagauuuuauuaugaaaaaacuuuaaaccacugaaaugguuauauuagaguacaucuaucuauuuauuaacuggguauuuaaaauguuugguuuuacuagucuuucuagguuagaaaauagcauuuuuacuuauucuuaaauuuuucuguucauuaaauuuguauuuucuauuguauuuugaugaaugauuucuggguuuuuaugaauauguuuuaugauaaaaaguugaugaaaaaucagauuaguucuuuauaccuuagaauagaauuaacuuauuuaaaucauuaaauuauuauuguuuagaaaaauuuaaaauaaauuuaaaaacuuaauagugaugaaauuuuuauaaauaguauuuuugucugacaguuuucccaucagaugauuaaaacauaguucuuauuuguuauuuuuaguuaauauuuuuaguagcccuauauguauguuagaaaagaaauuuauaaaacaauccuagauuuugugaaaacaaggaaaagaagucuaaauccaaagcagugcuacuucuaaggaaagaucauuuuuuaaaaagccuauagauuuaauuucuguuuuuauaaaugaagucguaaaauauaaagauaauuauaaacaccuguuuucuugaagauaacagcuucaucuuucuagauaauugugaauaaugucuacaaauaauguaguuauuugacaguaauggaugcuuuggaauuuggcaccuuacgagguuuaugccauaaaaauggaaccauccagauuguagugaaaaaagauuuuuuuuuucagauaaagaguaagaggcucuggccuuaaaauucaugacaaucaagacaagaaagacuuacauuacuauuugaguaauaaguuuaaaaaaauauuuuugagacuuugguccacagacugcauauuccaggccuuuauuuauuuauuguuauuauuauuauuauuuuauuuuuuuugccauaccacagauaaaguuuggaaagcauuuccuuggucuuucuguuucuuguuucuuguuucuuuuuuuuuuaauuuaccaaaaaggccaagccuaaagaagauugucaaggaauaaauaucaaugaacuugucauauuuuaucuucuggcuccaaauuuuuaguuuaaaaaaauuuauucucaaaugggguguuauucucauguauuccuauauuuauaagcuaccucuaaauaauuuuuuuccuaaaauuauuuauuacuucaauaguuuauuuauauaauauuagcaguuuucagccccuuggccuuauauuaugagucccuaaauaucucuaaauuguccugaggagcacuccuauuucucauggagacuucaaauggcaaaauugugauuguuauaaaaauucuaaaacuauaauuucagccuguauuucaugauuuucugccuucugauuuaccuauaucagaaucagugucuugagaaauaauggacagagauaagcugauuauaauuuauuugggaauccaaaaguagaauaaaguuaauaacauuuagacugagaaaguuguuuuuuuuuuuuucuguuuguaguuaaagcuacauuaucuguauuucugguaggucucuuuuaaaaaauuuuauauuucuguagauacuaauuuuugacauuuacaagguuuuauuuuuauauuuuuucccaaguauuuaacuaauaguggaauuuuagauuuacuaguguuagaauauugauuugacaccugauuuuagcuaauuuuuuuuagccagucuuuuaacuauguauaguuuuuauagaggguauuugacccuuaggguacucacgucucuguaaaugcaaauaauacuaugaucagaguaaaguauuaaacauuuuagaggaaaaagaaaaguauuaauauauaucucaaaacuggacagaaguuaauauuaaaauuaauacugacaacuguuuaccuaauccaguacugaguauuuuuuauggauauucaauuaaagugcccauugaugcuaucuuuuaguuaguaacauuugaaguacugcaccuuuauaacuuuaaauaaguguuuauauuuuaggcagcaagucuggcucuaaaaauuugaaaaugggguacauuugaaucuuacaaauucuuaagccaaaaagggcaggcaaguuaaguauuuugaagacauuaauuaaaaguuauuagaaucacauaaaauccuaaguuagugauuuaaaaaauuuuaaugaaugugaaguuuguaaagguuuuguuaaguuuuagacuaugccuguuauuuucauuacgugggauagauggucuugcuagugacuucucauuugcuuaguguaauuugucuguacauuuuaaaguucauuuuuauuguuauauuuugccucaucauugcuuuccuuagccugcauuuucugaucaucuucugaaucugcaucuuuucucugcuacuuuccuccacagcaccuuacccacagggaccuaggauuuaccugugucccagcucccccucucucucuugugguucccuucaucuuaaaaaguccugucuccuccucucggaaucuagccuuaccccucaucauucuagccuugucagcccaguucugaggaaaaguguuucuuucagugaagagcuguuccuggcugcuucugguaggaucacauuaugucagcuuuuuaaucccuuuauuuuucaugcuguaaaaaauuauuggguauuuuauacaagaugccuuucuauuauuuuucuuacugguagucagaguuaaauaauuggaauuauaaggauauaauugaggauuacuugauggcuaaucaugaauauucugccaaauuauuuuauauauuaaaaaauuauauaaggacauagaucuggguauuucuaauauuauuagauucuuauuacuacaguuucuguuuuagaugcuuuacuuucuuucccuucauaccaacuccauucacauuggaccugugucaucauguugcuaaaccauaugauuacauuaguaaauuauucuguuugaaucaguuuaagucucauuuuggugauauucuuuuauuaucuuuuuuucugucuguugcauuaauuauuaaauuuuucugcucuauuuucugauauuucaauuaucacuacaaauuuacauuuuauuuucuggcuuuuaauaugcuucguauaaagaucuuaguuucauuucuauguuuaguauuguauagucucuaaaaauaauguucagauuacuauaagaaaaaccauuuuuuuguuuuuaggaacagaaugggacuauacauaugcuaaccuuuguuuccuuauccaagaacagcuaaaaauguaaaaguuaauuaguuccuuuuuaagucguugugguaaauuuggcuguaugcaucuuacguuuugaaagggaugggauuaacucuagucuguagagcacuggcuucuuaccuguccccugcuuucuaugauuguuugaccauaguugaucuacuggcauggucagaacaauaaaauaagguagggaaagaaauuuaaaauuaagccguaaaaaauacauguaagagcuugggaaagauaauucuuucauucauaacuauguacauuugugaugugucuauuacaugucugugguuuuuuguuuacuuaaaaaaaguuuauguugauuuuugugaaugagcguugacauguaugaaauuaauacuguuuugucaugauauguuuagaaaugggaaguuauaagaaaauagauuugacuauauuucagacucaccugaauuuuauguuuucuagagaauuuuggaauauuuucagugagcacaaguagugcuuuugucucuauauuuacauuuaaucagacauuuuauauuucucauuuguuaguauucuuaaauuguuagcauaguaauuguuauuaucuugauuauuuuaauuaaaagacucagcuuuuaaaauggaauauuaugcaaagauucaucaccuuuacauacuuuuucuuauaauuuucugaaaaaauuaaguccaaaacuagcuggggucaguagggcucugacauguugcaucuaaagaaaacugugaauaaaaguagaguaaaauaugugcuuuauuugucauccccagugcuuuaaauguuucgaucauuuuaucacauuucaacucaugauguuuaugaagaugaaugcaauuaaacuuuguuucuauaguugcuuuuuugguuguuauuuauguacugauguucuguaggaaugggaagugguagugcuggaaaagaaggggggcccuuuaaagcucuuuuaagacaacagacucaaucagcguuggaacagaggguaagauucacuugauauucuuuguucuuacacuguuaauaugacuuuguuaucuuaugcuuccauguacuugcauguuuucaugaacuguuuugguuacauaucuauaauauugcaguuuugaaguccaaaauggauuuaaggugucaaaguaauuuguuuauggauaauuacuguugauuuggaauaauuacguaauaauaauuuuugucuuguuuaaucuuuuaucagaaauacuauuuuugauaauaccuauugaaugcugaaguaauuuuccauuacguuuaucauuggaaaggagaugguaaacauuuugcagaaaaaaaauuccaguagcauuuuauuauauuaaaaauaauuccuuagaauauaaauauauuuauuugcugagauuacuuuuaucauugaccaaucucuuaggaauaagaaauguacagauucuauauuucuaaagauuaauauaaauaaugugguuauucaguauaaugcaucuauuucaguuauuguaaguuugagauuuagcuauauuuguucauugggaaaauaagcaguuacaguuuuuggaugauuucucucucucucuuuuuuuuuuuuaaauaaacuucauugcuaagggaggaucgccucauagguucuguagaaggcggguauguuucugaaaaaugugugagagccuauuucuuguauugauagcuuucuaguuuuaaucuuggucauuuaaauuuuauuuaaucuuagcaaauguugacagcguuuuucuuuucguaaugcaaaguuuuuuuuuuauuuaauagcacugugagacucauguucuuuuuucuacuaacuaauauggugcauguuauauaugucaugucaguaauuuuaagacauaguucuauagcuuucauuaugucugauuuggaagcuauaagcauuuacagaauuuucuuuuacauguucuauauuacacuagcauuugggggaaaaaaggugaaagaguaaauaccuguaaaaaggauacauuucauaaaacuaaaguauuucuccucuagagguugguacgauuuauuuucuagacuuuucccuccuuaugcugacaguaucuguguaugcacuguuuaccuagagaaggcugaagagagcagagcugaacuaagcaaugaugaggcuuuagcucauuuuuugcuucaugcucuaucaagcagcaguuaccuuccaacuacucucgcaccuugcaggcaaaccuacaacugccaccaaaaggcccaccuaaacauucaaaucagcuauuaaaaccaaauauaauaaaagacugaaaacguugaagagggucagagugaagcuguguguguguguccacuuaccauuuuuuuuaggccagaaugcucuuuuucccugucccauuauuauguucucuacagaguuuuucacaagaggaauaugcuugcuuauaaugaaauuaccauucuggaauucacaucaacagaaaaauguggguucccuugaaauucgauauaauaagauuuuacuuguauguugugccugugacuuuauugucuguaccaagaaucuuuaaaaaccaucucacuuuaagggaaaaaaauauuaagcagugaaaaccauuuugaauuaguuuggauaaaauuuguguuuucagauaugcauuuaaacauucuuaaaauuuuggacacauuuacacauuggacauagauuacuaaauaaacuucauggaauuaacaguaaagguguagagaacuauaguuuucauuuacaaccuugucaguccugaguuggcaguacaucuauaucgccuguccucgaaguagcaguuacuuaaguuuaugagaguacuucucuaccuuguguacaaaguaagcagccaaagcauuaucaucuuuggcuuuccuauucacuugcgacugccauuaguaugguuucuguuuugggaaaagcaagaaguaugaagaauucucuccauauguguucagauaugacuuaauucugcuaaucugaacacuagauuaugucacugacaugaucuacuuauaugauguuuuauauuccuuucuuuaauauucguuucuaucccuuugguaaaccacccuuaauaaauuauauggccuuuuuuuuuuuuuuuucuugaggaaagagaaacuuuauuugcccaaucucuuuuacggauuauucaaguaguaguugucaaaauugaaaguguuauucuuuacuccacagaagcauugcuagguuuucgggagaugagaaauagagauaaaaguuuuauuuagauuuaaguuccaccuaugaauuuuuugauguaaaguaaauagauauuuaauuaauuaauuaggagagagccucucucuaugaugcccaggcugguuucgaacuccugggcucaagugauccucccaucucagccuuuuagagugcugggguuagaggcaugagccacugugcucagccagauuuguuuuucaauaagacuuuuauuuuaccugugagaaaauauggaaguacuuuuuuaguuccuucagucaagaaaccuagugaacuuaguuuaaccuaguauuucgcaaguacauuuuaccauagaacuuuccuuuuaaaauaccuguuagugaggaacacauuuugggaaacauugauauaagguaaacucuugaagaauuuugaucuuuuuagaagugggaguaaaauuguacaauaaaccauggcagaaaucuguuauggauuuuauaucuagaaaguuuagucuuuugcaauaauaaaaagaguauuugauuuaaagaauaaacuauuuaaauagcuccuaagaaaaauccuauuuaaaucucuuuuuaaaagaauacucccauugugcucugaugauuuuucaacuaaccugucuuugagcacacacuauuaaauauuuuuaugcugccugcccuuggcuuaugucaaagcaucagcauguaacuuuaucuagguaccacagggaaagcuacuuuaaauaugaagacuucuggagaaaauuucuucugcaguuccugaaauucacaucuagacauugaaagcgggaugugcuugugcugaucuuaaggaagcuauucucuuuuuuuuuuucauugagaugaaguucuguucuucuugcccaggguggagggcaauggcaugaucucagcucacugcaaccuccgccuccaggguucaagcaauucuccugccucagccuccugaguagcugggauuacaggcguccgccacuacaacuggcuaauuuuuguauuuuuaguagagacgggguuucaguauguugaccaggcuggucuugaacuccuaaccucaggugauccaccuaccucagccucccaaagugcugggauuacaggcgugagccacugugcccggcagaagcuauucuuuuaaacagaagaaaaaucuauaaauucaucagguguaauaaaaucaaauccuuaacucuaaaugacagugaaaccagaugauaaaguuuguugcuuauaaagaaucuaggaauaaaaggcccuuuugacuucaguuuuucauauaaaaaauggagauaauaguacuucccucauaugggaaagguuauacagcacaagcuacagggccuggcacauagaaguacuugacaguaguugcuaguuaugguggugaugauagguacuuaacaaucugcuauagauuucagcaguagcucuucucaugagagaauuguaugaagacggaguuuugguuaaauaacaaugacauuuuuauuuauuauagguuaaauuuuguguuuuagagugaauuggugugccgauuaggugaacuggggacaugugagguggagagugggucguggccucaaugggcagccaucgcccuguguguuucuuucugaccagcucuaguacaaugcuugcccucguuucuuuaucccaaacaaagaacuuuggggagaaggguaaagaacccugaauugagaagucauuuagguucauuuauucauacuuauguaaaaucuuauaugaaaauauuuucuaauacauaauuuaccuauuucuuuagaaggaaaaaggaaguacuaucuuccauuuagcuuacaaaaauguuauuuucaguaucucuugucuagauauuuaaaagauuuaaggcugggcgcgguggcucacgccuguaaucccagcacuuugggaggccgaggcggguggaucaugaggucaggagaucgagaccauccuggcuaacaaggugaaaccccgucucuacuaaaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcagucuggccugggcgacagagcgagacuccgucucaaaaaaaaaaaaaaaagauuuaaguauaaagauuacauauaaagugauuuuuuauucugugagaccaccacaugccucagauauuuugaggaaauauuaaaauuuaagugauccuaacacugaaaaaaaaaucugaaagaccuaacuacauuauuaauaauauaagcuuaccuauacguuucucauuuaaaacucacauuuacaaaguucaaauguacuugcucagugauuaccgaacuguuuucccaacuucuuucuuaauacuuauauuguguaauuaccccgugugugcugugccuaacaauaaauccauucgaauauuuuuaugacucaaaacuucauuuacauucaaauuuccuaauaauaaauaugaauucauuaugagguaauccucuaguuuguacaauuuuuauuagauuuccaggaacaaaacuuagaggacagaaaaagaaguuuaaauggaaauaaggaugcauuuugacuaaacauauuauaauacauuuauuauaagugacguacucuccuuccauccucuuccuuauuuucccucuaccuuucugcugggcuauaccuaaccacuuccauagaccaguuuuuuacucuuuucuuacauagcauagauuuuucuuucucuuguuuaaagauuacuucuaaauuugaacugaauuuauuucuaaauaaauuuuagaaacuuuuuuauacucaaccuucauggguuacugaggugcacaggacugauagcuuuugugcaaaaugauuccaaguugccgugcuuugugaucaugcuuuugugaguuuguauucuccaugcuugaagcagccagugaauaauucuugcugcuuuuaauaagccugcuucuggugguauucuguaucucuuuaccagcuuuuauuuguugcauuuaaucugagguggucuugaaaaugagaucaugauaaauuuuagaguuguuucuuuuuaagauaaaaauuuauaacuacuauaauauaguaugaauaugaucugugggagucuccuaugaauaaaguauaugagcuuuagagcuugagaccguaacaguucuuuugaccguugagagcccuguuuugcuuauuuuucucaauuaugcucaauuauguucuaaauagcugaggcuacugguaagugauuccaguuaagugagcuacauuaaucuugcagccagacaggucaaacaucaaguuuuccuuacuugcauccaauuuguguaaugugaggggccuccauguuuucacaggagcuccguuuucuuauuggguccuauuucaaugaauuuccuuucuuggcuuuuucauuugucuuuuuuguguuucucuuugucucuaaguugaugaauuuuauucuuuaagagagaaggauagaauaaagcuugcaagaacuuguggaauuuuauugccuuccuagcuguuaucuauguaccuuucaacuuuccuuaauguaccuuuaugcacuuguauuuguuccugccacauugguguugauagaguaaccucacacaaugauucucuacccaucucaacuugauauuugccacuauccucuuucucuuaacccacacugcuuauccucucacuuauccuccuuuggucccacuuucauuuagaucccuuggccccagguuuuuagagucuuuaccagugucuuauacuggguguucaugugaagggggugucuaaaccacugauagauaaaggggaagagggauagggcaguucccucaucucauugagaaguuccaucagaguuggagauucagaggaaggaagaguguguuucaaauaucuuaaauugaaggaacacuuuuuuuuucuucauugagaacugaugaaaugggucuuuggauucuguauaacauuguauauauggggaaauggauuugaaacucuaaacauuuaauuaaacuuuuaauuacaaagcaugugugauguguaauggguggccuuuuauuucaagggauguaauacaguugcuauggcaagcuuuuuaauaagcaaauuuuuuacacucuacacacgauaaguuguauuuuucccuuauucuuuccacuaggaauuuccauuuuuuaccuugacggcauuuccuccuggauuccuuguacacguuggggguguaguuagugcacguucugugaagcuuuuggaucguauccacaauccugguauguucuuaaaaaguuucaauguuuccuuuauuuaaauugugguuauuaaaauugauuuuuaugauuuuuuuaaagccaaaucuaacugaaaagagaaaugaaaagaaaguauaaacuagcacguuacuuuaauauauuuguagucaucuuaauuauaaauaaacuaaguguauuuuaguuacuuuucuguaaaaaaccaauugauuuauuuuuggucacaauaucacuuuaaggaaauccuuaaauaacuuuucuuugacccaggggagauaaacauuuuuauaaauugaccauuauggccauuaguuuaagauguuaguucuuuucauuagcaguagcuuuuuauagauuacuuauuuuccuuguucuuaaaacagguauuuuuaaaaauguaauuguaaagcugggcacaguagcaugugccuguugucccagcuacucaggaggccggggcaaggaggaucgcuugagcccagggcaacauagccagacuugggcaacaaccugggcaacacaacaagaccuauguaaacacugugggugucauaggaacagauagguagcagagggaaccaaaccaguccaugggucaaagacccucuugcugagcaggcuacuggagcugucauuucuuagagcucauuguguaacuugaacacacugggacugucuuugaccacggccaccuguccccuccagucuacccaggcagcacucaggagacacagaacccagaucccagcacugugcugggauuccacucugucauugguggaauccagcaugggcaacaaaguaauuguaggcguugucuagaguagcuaagaauugaaaaacagaugagcaaacuaacaucugguccuucaguuucuuuuauguagcuauuuguuauguuuaagcaaacgaguaagaauaguagcuuacuucuuuaaaacauaggaccauaauuauaaaagcgaguaggcaucaaagucccacuggauucaggcccuuugaucagaaauccucuggugauuuuucuacgucuaaaauaagcaugaugaauagugggaacuuuccauauggaauguguucuugcaucucucauugacuagaugcucaaucaacauacauuaaaccugaaguuauauuaguauucuuauuugguguauagacguauauauuuuugaaaauuuuaaauugucacauccagugaccucuuugugaggcuuguauugacagcuauaaaaagaaggguggccggacacaguggcucaugccuguaaaauacuaaaaauacaaaaaucagcugagcgugguggcaggcaccuguaaucccagcuacuugggaagcugaggcagagaauugcuugaacccgggagguggagguugcagugagccgagauugugccacuacacuccagccugggcgacaagagcgaaacucugucucaaaaaaaaaaaaaaaaaaaagaaagaaagaaggguaaaaaugcuuugaaguuauuggaccaaaauauuguagauaaugacuauuuuugaggauacagagcauuacuauuuuuuaaaauuuuuuuaaaguuuaauuuaugcccuguaguuugaugucauuugaguuuauuucagagaagaagacuagaauucucuggacccugaaugagauuucagaaaaacagugcgagucaggauuauuuaacucuaaaacugggcaaaugcaucuucuaagcacugguuuucucuuuuuuuccccuucuuuaguuuuuuuuccccccguuucuuauuuuuguggucaauauaagauguuuucuccauuguaguauuuguguacaguacuuaagaaaaauucagacugaugccaguuuaauguauugggaucuugaagacuaugccaaauucuauaucuuuguguuaaggaacuugaauuauuuggaaaaugcaaggaaauacugaguuaaaauaccugacaucacccuugugacccaaggcuaguuaccuguguuucuauggaccauugacucaaauauuuuaauagauggcacccacugaucugauaguucgaaacaugguuucaggaguauauuuaauuacuagaugucuucugcuuacugaaaaacauuuugggcugggcacggaggcucacgccuguaaucccaacacuuugggaagccaguuugaggcggguggaucaucugaggucaggaguuuugagaccagccugaccaacaaggugaaacccugucucuacuaaaaauacaaaaauuagcugggccugguggcaggcgccuguagucccagcuacucgggaggcugagacaggagaauugcuugaaaccgggaggcggagguuguagugagcugagaucgugccacugcacuccagccugggcaacagaaugagacuccuucucaaaaaaaaaaaaaaagaaaaaaaaacauuuugauuuuauuuuguugcuuccauguacucugaguaagcuauagagucugggagaacaggugaaguuuacuuaaauaaguuuaaguagagaguuguauuuaaaaugucacuacuuaaaaaaaaaaacgaacugcauuuugggguuuauuuuaugugccaguucaugcuaauugugcaagaaauguaagaauccaggcccagggaagaaaagaaugauuccuauuacagaauguguuuuguguauuguaacuaccagcucacccauucucugccuuuccucccaguuuagaguauuuucucagcucacauuuagaaauucucaguuauuaauggauuauuucccaaaaggucauggacauauacauauaagugcuuucaauggcguaugaguuauauuuucauuuuguuuuauuuuuaguuaaauauguguaauuauucuaaugguucuaauauuauuuugauuuaaaguaucacauucugacugggcacgguugcuuacaccuguaaucccaacauuuugggaggccaaggcgggcagaucgcaugagcucagggguuugagaccggccugggcagcauggugaaacccucucucuaccaaaaauacaaaaacuauccgggccuggugguacauugucugugguccuagcuacuugggaggcugaggcaggaggaucacuuggacccuagagauggagguugcaguaagccgagaucaugccacugcacuccagccuaggugacagagggagacuccaucucaaaaaauaaaauaaaaugucacauucuucggauuguuuuauguauuauuacgcacuaaaaaggaacauuuucuugagaacauuuacugaucuccaggccucuuaaguaauuauuuaugaagaaauuuuaauauauugaagaaaagcugaauguugaaacaaaacaaaacucuagauuaacaucuaccguaaugaugauguuuuaauuuugugacacugaguuccucugcugagggagacuuaacgauggauugagaugcaugugcuaauguuaaaaauguuguguuugcauucucaaaugaguuuugcagcuauuuuuugaccggugaauaugggaaauuuuuguuucauucucacuauagaagggaaaaaaucuuauuuuaaaaccacuaccaccugcuaacuauggauuauuauuuuggaggcuuuuuuaaagaacauccuccuuugguaaauauugagcaaacgggugacuacaacaagggaaagaauggggugguuuuaaaaaucaagguaauuaaauaauuagauuaguuaauguuagauuacuauagcaugcuccuuucccccuuucuauuucuacuucuuauuaacucugcugucuaugucuuuccaguuccugucgagugguguugucaauugcguucuuguuuguaguguuuuuuguuuuauuccuacuauucugcaccuaaaacugaucuacuaauuugcuguuuugaacucagccuuugucggaauuauggguaacacaagaucuuacaaacugcuagacuggaauaguuucaauucagguauuuuaauggucauucaguacuacauaugcugacaaaaauuauggcagcucagugaaguuuuuagaaauguucuagaugaaguagguuuaaggucaauucaguuauacagauaauauucugugcuacguauguaauaacucuuguaauuucaauggaaauacaaauauaaaaauguguuaacuaaaaugaauuaaugaaagccauagaaauaccauaaauuaucaaugacuuuucuuaggugauuaacuucagaaugaucauuuaaaauuauauuuauuacauuuuggaugguuuucuauaucagguaaaugauguaggcauuagcuuuaagauuaagcaaauauuuguuaaauauaaguaauguuucauaaaucuaaaaauaaaguauauuuaaaugcacauuuagauuugaauagauuuaguguucuauaggcuacuguaaaaguguaacuguuagcauuuuuauuuauaauucuagaaguguuccaaaauuagauaacuaagaauagacuuuuuggggauuaacagcuuucuuaaacuuuccuccuucccuuuccacaugugaauauaauuuuuaaaaaguaauuuuacauaugaauguaguuuguagcuuuuaaauaaacagacuacgauagugagcuuuacagcugaugauguguuuuagagucaaaaguaauuaauuuuuuuuuuugauaaaaacauaauguacauuucuaauuguuuauauuauauuuuuuagaaugaaauaauacaaccauuuugauucagugucagaagcugguauguugccuaaagaaauuuuucaguuauuugucucagaaaguauaucuuacagaaaagcaaagacgccacggggcucagaauuuuagauaauaucucauaaucuuuucaauauuguaaacuuuuuuuuguucuuaggaguucaagauguaaguuuugauguaaguaaugcauguuugacuaugaaguaaaucauguucaucauguagauuuaccuaaauucagucugguaaaccauaugauaaguccaacauuuacagauguagauugauaucaaucgguaaauccauagggaaauuuccuauccaaguuuuuaccagccugcugucauugauuagaauugaaaugaucauuuguuaguguaauauuuuguaauuguuuuuuagugagaaauugaaaaauacuuuccuagguugauuucuuaagaaauuuuaaaacauaggcagauuaguauaguggaaagauauauagaaaaaggacauugagagcauauugaccauuaauaauauaaggaacugaaaucuugucagggcaaagauguuuagggugagauguguguuggucaaaugauagaacagucuuggaaauggaaauggcaguaauuaaaucuuauagacauaguaaggacguugucccacguaagcagaauuacgguuuggcaaagaaaaacaugguugaggaagcaguauaucuugccaucauuuaaaauaaugucacguuggaagugugugaagaaaaaagguagauauaaguuauagaauguuaaaagaacauaaaugaugacaccuuguaguaugcuuuugauuaauuagaaucuuucugguaagacuuaguauaucuucagaaacaacugauuuucauacuuguuuaggaaaaauaacuugauaauucugaagaaaaauuugauauagguaaauauaugcaaaucauuuauguauucuuaucuguaaauugagaauauuuagccauugcucucauauguagaaaaucaagaacuaaccauguuaggaaaagaauuguugauaccauuuuuauuagggcuagaauugcucauuuacacuguauuuccuggcugcuuuguaccauguauuauaugaagcauuaucauuuuaauaacagacuuccaagaaaaagaaaaauauauaccaccauauuaaauauacuuauuaauuauuagacauucuuauuucagaaacauuaaaauauggaaaguuauaggaaaauguuauuauacaguaauguauaaaauaugacagaucaugcaagcuuauaucagaauuuauuuugugccacgcaauuugcuaggucuaggguggaaagauugccagucccccugccuucaugaagcucauauucuuggaggauagacagacauuaaauaauuuacugugugguauggugugauacaagauaaagaguuaaagaagaaggcuugauuaacucuguaugagagaaacuuauagaagugguaauucuugagcucagauuugaaggauagaugggagaaucacauagauuuguauuuugguguuuuuggacccauguuuaugcauacuuugagugugguucucaaacuucuagcauuuacaaaacaauguccuagccaguacucauuugaugauguuuacauaguuacuucaugcuuacuacguugcuugccacagaguacaaaauaucuugguuaguuuagcuuuuuuuuuuuuucugucuccuuuucuccugcuuugcugccuuaguuuguguuaacuacagcguuagaauuuuuuguuuuggagauggaaucuugcucugucacccaggcuggaguucaguggcgugaucucagcucacugcaaccuccgccucccagguucaagugauuuucaugccucagccucccaaguagcugggauuacaggcacgugccaccaugccuggcuaauuauuuuuuuguagagaugggguuucaccauguuggccaggcugaucucgaacuucugaccucaagggauccaucugccucagccucccaaaguguggggauuacgggcgugagccacugcacccagaccuagaaauguuuuuauagagcaggaagaagggaacucaauauuagaauuuauuuuuaaaauguuaccuuuacuuaucaugcugcuuauguuucuggcuugguaacagacuuugagaaaugccaggcaggugaguguugcugcuaggaagcagauugcagcauuuacaaaucuuaugugugacauucuaggauuggaagugcauaagaauuaggguagcccaugggcacauuugcauuagaucauugacuauaggguggagaaugggcuuaaaggcaauaagacuagagacagggagaccaguuagcagacugugugguaaccuuggcuacauagguaaccuagguuuugguggugauaggagagcuacacugaucaagaacuuauuacaugccacguacucuuuuaagugcuuuauaauaguagaccauuuaauccucaaaacagaucucugaggucgacucuaauccuguuuuguaggugagcaaagugaaacaguaguuuuccaaaggugaauaguuagaaaguggcuaagccacaauuuguaccugaguacucuggcuucagaaccuguacucuuaacuauaaauuaaugagauauuuugaguauaauaacagcaggaccuaguaacuacugaaauguggcaaaugaagcaugcucuugucugcuuucaagacaagagaaagaaaggggaauuaucccacauaccuacaguucuaaaauucuacauagcaauugaguucuacccuuuggaaacucaaguuuauuugaguguugagaugggaaaauauuuaaagagcaaguuuuaauaguccuaacucauuuuucaaaugaguaugaucuuuuauuuuuuucccuugaguuaccacuagaaguauuucugaguagcucacauacauaauuuuuaaaucagugauaaucuugauaguugcggauaauuuacuauuuuuuccucuguagagauugcaugucagcuuagauuuuuuuucaggaaguggcaagaagaaguaaagaaguuauauagcgugguaucaaaauguaauuguuuauuagugggagauagcuucuggacguagacaaaauuugugaguugauauuuuaaguccugaguuaguaaaacaaguguuuaacaccagauagccuuuuguugguuuuugagaaaauuuuuaaaaggguuuuuaaacaaauuuuauuuuagacagauuauagaucuuaggacauauuauacuuaaguuuuucucaaucauaaacuuuuacuagugauaagcaagcuuuggauuaauaguucaaaauuagaaaauauuagucuuuuuuguuugccaucagaauuauaguuguuuagaaaauucauuuaguuuaggagcaaaagugaguaguuauguccuauaaaaauaaguauaauuacuuuacaaaauauuuaaugguaacaaaaugugggucagcugauuauauagggauauauuuauagaauguacagaucagucugcucaucugaaugaacuuuuuuguuuuuuuuaguuuaaguuucaauucagucacguuuuuauucaguggauguuuguggagugccuaccauguguugcacacuguguuggguacuggaaacauaauuguuaagccaggcagacguccuguacacacccagucuaggguaauucuuacacuauuuuggugugugcauauguguguauuaguuaaauggagauaggugguaggcucucuuggaacuuuaauuuuacugauaaucucagcaauuaucauuuucccugagagauacuuaugagcagaugugcaaacuauaccuaaaguacuuauacagcuuuugguuuucaguauuuuaauaagguuuucaggaaguagauaaauaagaguucaagaugcaagauggcauaaauacagcaugcgugauaugugagcuuuucuauauuaccaguaauuuuagaguaaugaaaauccaguuacauuguguguguguguguguguguguguguguguguguaugugugugcaugcguguauguagugaaauuucacaauuauggaguagauugcacauuugacuuucuaaauuuacagauaguaaagacuccaguuuggucaaacauggauuauaucuuaguuucauccuaacaucacaaaugacuaggucuugacguuugcucuguauuugcacaugacuuccucuauaaugagaaucuucuuccuagucuacugauccccacccaguuugagauuauauacuccuuugaaccugaacucucuaauuucuuuuucauuaggggaaauuuaucuucuucaagagguuagcaguuggaauguuacuuucagguauuugggaauauagcuuuuuauacuguccguuaacaugauagauuaucauuguauuaaccuuuauuugauccaaccuaacauuuuaucuccuuuuguugauuuauaaauuagauugaauaacuguccauuuuaaaaauaauuuuuauuuuuaaacaauauuuguuuguauuuaugggguacauguuuuauuuuguuacaugcauagaauaaugaucaaaucaggguauuuggaguauccaucaccuugaguauuuaugauuucuaaguguugggaacauuucaaguucucucggguagcuguuuugacauauacaguacaguguugguaacuauagucacucugcuuuaaaacauuagaauaauuucuuuuuucuucuaaccguauuaaaagaaucugcaaggcagaguuauucucucccagagcuauauaaaaaugaacugaacuuaacauuucagguaguugguauuucuuaauugccaaguguaugauagccuaaaaucucaaagagguugaguuuaauaagagcauauuauguugaguuguucacauuguuauuuucugauauauaaacugccguuuuagaauuuuaccaguuucaccugcacuucagaaacaaaauguuaaaaagauggcaagauaucgagcuguggccaugcucuaggaauguaacguaguaaaaauuaaugaauucugaugucaaccuaagugugcugacauuaccccuaaaagagacaucagugaggauugauuuagugcucaguucaugccugcaauuaaaaggauauauuaaaagauuugcgauauuaucuacaaagaguuuugacccacagaagaaaaacauaaaauaguauaaaauauaacuuguauauuaaacuuauauauaaaauauauaauuuguauauaaaaauauauuaauuuguauauaauuaaauuuuaaauuuuccuaaaauaauaacuuuuauaauuguaaauaauucuguagauuaucagaagaaauguguuuaaggugaagagguuuguuucuuaacaucuuugaaauguuuauuuaauguuuauuaaaugaccucacaucucagcuguauauccuucagauaacuaaauuguaucauuucaugugucacauacauaguugccacaaaauuuuaagcuagacucuguuugcauuuauguuaguauaguauccucaauuuuguacuuuuuaggaugaauaaaauaauuccaauucauuaguguguuucuuauaggaaaacacaauacauuccuauaagacuguaguuaucaguuuuuaaaccuuaaacauucuauuauagggauuaaauacugugauaucucugaauuuuuauugguaauaggauaggcugaaucauaauuacugcuugaagauucucuaggucaugucuggcaugaguauaaaauaagcuuuggagauaaauuuaacuuuucuuuacuguuaaacaaauuaaucuuaauuuuguuuuaauuaaaugcccccuaaauuuaguagccaaaaauuuuuccuuuagucucuugcuuacaguuguagauaauuguuaauauaauuaccaguuugugauuaagugcucccuacuguaugcuugccuugcuuucaccuagaaucuagggccauuacuuucuuguaaccauuucagugagcugccauaguuuucagucuguacugucaccugauccaagcaugcgccaaaauauccacuguuucuggcuccuguaugcugaaucugcuuugcaaacccuucguucuuugagcuuuugcuuuagccaaaaaccaaauuuaagaaguuuucuggaguguggacauaugccauuugcuuccuuagcucccauguuauguaacucuuuagcuuuguauuaaacuuguaaauacuuauuaaauacaauaauggcauccucaugugcaauuguguggcucauguguuaaaauaaaggcugcuugugaauuugucagaagaauaugaaugcuccacuugcgcugcauucagcuuuuuuuuuuuuguucguuuguuuuuugaaucagccacuuauucuuucauaguguuugguuuaauuauuugauuauuuuauguguuauacuaagguaaguuuaacguaaaugaacuuuguauucuaugugguaucucauaggaauuguuauaacauacuuucccauuuagacauguuggcguuuuaaaaauaaauauauguagaacuuaaguagcuuccuccauuuuuuauuaauuucuaaaacacuguuuauggauuacuuucuguaaaauucauuuuuaaaacaguaaagccaccauguauuacuugugguacagaugaagaaggcaaacccaaugugagaaaaaucuuauaaaaacauaguacauaauuauuugcuuuagaaaauaauauuuuaaacuucuagaaugguuuaaaaaguaaacaguagguuuuauuagugaguuuaagaaaaguuagaauuuuauuucaugcaauuuuuugggaaaauagguauuuucuaaacugaaauacauuucuaugguugugacaauuauuuucucagaaucauagucauuuaauagauuagagcaaccacuugaauaauaguucaucuuaugauagaaaaauucucuuuuaggaaaggaugauguuaaauggauguucagauugguccguaaguguguaugucuuagaaaaaagagaguauggauuugaaaguguauuuuugcuguuacuauauacauuucauuugggaauaugaagaaauucuuuaacacaaguaguauuuguguaaaauagguucacuuaauuguucacacauuucuuaauuuauaacauugauugcuaauaccauauuguagucuuuucuauuucucuuccuuauuuuaucuucuacuuugaugucuuucucaguuuccugaauucugcauuucuuucuucugaaagaaaguuuuaagguagcuuugucuuggaaccaaaacuuuaauucaagaacuggcuggcaucauuuguaguucuggcuuuuaucuccuuauuucucccuuuugcugauccuccucccuguggaggagacaaaaauuucaucauaggaaugugagcuauaacacgccucuuaaccuuucuuuacuuugcugucuucacuauuuuacuagugaguauaauucuacuuauucuacuaauuuugaaaaacauauuuugaaaauuggauauauacugcaauucaaaaauagaaacuuuggauuuuuugguuuuuagauuuaauaguggcuuuuauauggaaaaauuacaaugagagcuuagcauucuaucuagaguugauuuuuuuuucuaucucaaguuauucccaaaugagaauuggccacaaaaagaaauaaauuaugauaugcuaauuauagacuuucuguuuuuaacacauuguacauaaaauguuacuauaauuugcagcugcugucaccaguaguuugcagcuaaaugcaagugauuaggaaauauguaugacagaugcuucauuuauagugcuccauuacaagcaauauuggacuucucugguaauaaaauagaauucugugacucuaaaucauuuuuuaaaauuacagaccaauacauggaguguuauaucugaaauuuuuccuuauauacauuaccaaauuauuuguguuaauauuuuaagugugcuugcuuucuuucuuuuuuuuuuuaaauuagucucuaauuucuuguauuuugccuaaagacccacaucucuguagaaggauggcuuacagauggcuuucucucuuuuaacauugacaaaucuuugccuuggaaagaacccacaauauagugaguuauaaaaauagguaccaagaaaugaaaucagaauuaaaguuaaauuuauggauauaacacauaagguguucacucagugaggugagauguagaauauccucuuagucuaauucuaaaauucuaaucauagcuaagauuagaauuuggaaacucugggucuacauuuaaaauuauaucuaaucauauauuccuauagauaucuguuaaaguaauaaagcaaauacagauaggugguuuguuuuccagcaauugaguuuaaaagguuaaaucuuaugccuuuugagaaguagcauuuuaaagaugggaaguuuaaaaauccauuauagaauaaaacuucuuuacuucccauaguauguuuauuuuaaacauuucauguucauauauauaaugugcuauugaguaauaaacugauuuaaaauuuauuuuucagaugaaccagaaacucgagaugcauggugggcagaaaucagacaagaaauaaaaucacaugcuaaagcauuaggcugucaugcuguagugggcuacagugaaucaacuagcaucugguaaaugauaauaacaacuugauuuuccagacacuaauuuagacugccaucugaaaggggaaaagcuucaugcaaauaaaagaaaagagaauagcgaaguguucaggagcaugggccuuggaguacauuagauuaagguuuauaugccgucuuugccaguuagugacuguguaacuuugagaaaguuauuuaacucuucugagccucaauuuguacauuaaaauggagauaauaccacagaucaauuaaucauuuacaucagugauuaaaugagaauauaauacuggcacacagcaaauauuaacucuaggcuuccuuuaguauguaacuguaucaacuucuuccacuggaaccuuuggaacccuugaucuacuguaaacgaauugcaaugugucuuuaaaguuuguccauaaacucauucugccuccuuuuaccuacuguaauguaacguuucuugcuaacaaaucauucuuccuaauacugacaaauuaggaaggggcuuucauacacuugguucucaauuccuuuuucuccuucccuucauuugaacaaucuccuccuuuaaaguacaugccacgcuacuguuccauuaucuacuuccaaagcauucgucugccuuucuuaguuacuucgcugcucucuccuccaguuacauaugauuauguucauccuagcagcuggcauuauaguuucuuauucucaagucgucugaccccacuuaacuuucaaccauauuuuggaccucaguaucacuugaaacuguuccgccuuaaaauuuugaaacuauaaaauuuuacucucagaucacaacuuaacguuuuucuaccaauaucauuugcucuuuuauaucuaguuuguuuugacccuuaccuuaaccaguuguuuucucagcuccuuacuuaguuucuggcuuuuuuuguucuuuugccauccuugaacccuacuuucagcccuucagaaguuuacaguugauaucaucuagaaacuguuuaaccuucuguuaucuuauuuuucuaccaucuauucuuagguaauucuuacuguuagauccucugcucuuguggugauccuuauuguuagggaaaaagaauuaaacuguaguaaauguggucauuacagagccauauuauuuaaucuucugugggcuuuucuuuuccuuugcagaucauguguuauacuccuagacuguuuauucccauaguagcgguucuacucuuguuaacuacuaacuuugucaagcuuaucuugccuuacucccuaguugucuugccacauugaugguuuuaaugucauaaacuuugaggccuuagaaaaauguuuuuuguuguugucguuuuuuuuuuuguuuuuugagauagaguuucacucuuucacucaggcuggagugcaauggugugauuuuggcucacugcaaccuccaccucccggguucaagugauucucccaccuuagccuccuuaguagcugggauuacaggugccugccuuccugucuggcuaauuuucauauuuuuaguagagaugggguuucgccauguuggucaggcugaucucgaacuccugaccucgugaucuguccaccucggccucccaaagugcugggauuacaggcguaagccaccacacccggccagagauaugguuuuagaaggcauaguucuugguaucacauuuacauucuacuggauaauuaugauguaaaauaaauuuuaagauugagauauaggaugcuuugggauccuagagggcugaaagcucaaaguagaauuggaagaaaaugucaaugaaguaacugaugcuugaguuggauuuugggggaugaauaugaauuauauaaauaaaaagaagaggcauaaggagagguuucaaagcuuacaagaugcauucaacacuuaaaagaguagcaaaaaaaagaaggccacaggauguagacucaggauggcugaugauaggucacagauggaggagucugcaaaugaguucaguuaauuuaccuagaaguuugaguucaucugacagaugucaucugacagagguccuuucuagaccucaaaaacaucuguguauuuaaauuuuaacuaaucuuuucuguuccagcccaugcuacuuucuguuacuggauuaaacucucugaaaugcacuucugcucuuauaacuucuugauucgaagacaucagugguuucauguuauuccuucugacauccuuaauuccuaccuacacuuuaagccuggucuuccuuuauuuuauuuacaguucaagugacuguuccucccuuguucucuuaggcuucuguuuuauuuuauuucuggguuuuauuuauaccugguuuucagcaguucaucccuagguugcuacuuuucucauuuguuuaggugaucucauucaauaauuauguugauuguuuaauuuuuuagcuuucaaauugggugacauauaauaauuuaaaaauuauuuugaauaucaguuuucuguuauaugaugauguaguuuaagcuucauuuaguauauuuuguauauuguuucagaaaccuuuauaaugauuuaaauuuagauuaagcuauauaaaucaccuauauagagauauuuacauaguugugcuuuuagaauaauuuuaauaaaacuucauauacauuuaaagaguauuuuaauauaguuucauugauuaaugcuagauucagcaauacaauuuauuacugcuuauauuuugaaacauuucauucuuucagccuugccauauuuuaaaugaaguuauugucuuuaauauuaauacuuuuaucuuuuuucaguuuuuaauuuaugaagaauucuuucccuccauucaaauaaaguuacuucuguuuucuaggcuagguuuaggagguaaaccucguaaauauuauuuaauauugaguagagucuaacuugaacuuaaauugucacuguuauaauuauuuugauauuuagcauuucccaaaguuauacggucugaaaaauguuaacuuguuuguguuuuuuccuuuauagugaagaggucugcauuuuaucugcaucuggcacagcggcuguacugaauccuagauuucugcaggauggcaccguggaaggcuguuuggaacagagguugucauggcagccuggcuuauuuucuauaagggcagagaagggagaggucgacuuuuuuucugagaguugggauaauucuucuccguaggguggcuuacagggguacaguguagaaaucaggaccaagcacuucacuaauuuuuaacuaacccguaguaacagaggaguauuggauucugcacuauauggcacacauuauuguuucuagugucuugauaagugacauguaugauuaccaguugaagaauuucagguguccauuuuuuuuugcuuugucaugauauagaaauaaucuuuggaucuuucucuuccuuucauuucccugugucucaccuccaaaaacagaaagagguuaugaaacaauuuuuauaaaaaacaauucuuaauuuacaaaauaguaaaaguacugcauuuuaucaagauuaucuguagauauaauauauaugguccuuccguguccauagggaauugguuccaggaccccuugcagauaccaaaaccugcagaugcucaagucccuuauauaaaaugguauaguauuugcauguaaccuaugcacauucuccccuauacuuuaaauaaucucuagauuauuuauaauaccugauauaauaccuguucaucauuucauuuucauggauucaguguaaugcugagcauguggcaaauucaaguuuugcuuuuuggaauuuugugggauuuuuuauuguuuuccuauuuucaaccugugauugguugaauccauacaugccaaacccauggauacggaagggugacuguauauuuaaauauauauauauauacacauauauaaacuauuaguuugguaccagagucuaccuggauaauacagauuuuaauuaccccuuaugccacagugugccuauuuacuuccccccuccccaguauuaauauauuaaguauauauuaagaaaggaagcaaaggccaagugcgguggcucacgccuguaauccuagcacuuugugaggcugagguggguggaucacuugaggucaggaguuugagaccagccuggccaacauggugaaaccccgucuccacuaaaaauacaaaaauuagccuggugugauggugggcgccucuaaucccagcuacucaggaggcuaaggcagaagaauugauugcuugagccugggagguggagguugcagugagccaagauggcaccacuguucucuaaccugggcaacagagugagacucuauuuaaaaaaaaaaaaaaagcaaaaaaauucuguaucuugucaaguuuaguauaaacuugcacgcauuuauaacuaagauauucuaguucugguauucacuagaggaacuuggucaguuucuuuugucaguauuaaaauggauauugacuauuaugaauuccagagccuuaaaggucauuguaaauaggaaagugaagguggggcauuuugaagcacaguaaauaauuagaauauucuauugaggaaacucucuuugucagugaguuguaccagugauacaauauaguucuuacacgucuguagauuucauucuuaaguugauaggaagccuaauuuaacaaaugaccuuuuucauguagcuugguuuuuuucuguauuguggcuuggacgaauacaauaaauucucuuauauaguaguucaauacaauaggugccaccccuaguuguaaaaaaaaaaagaaaaaaacaaggaaaaugccuuuucuuucugcuauaaaaauuauuacugcuuauuagaaaaaauuuggagaguuccuauaucaaaugaugcuagauugccauccuuuucaaauucuuauaugcuuuguaagauuuccuacgucuugccuugaagucagcugucauuuuucaugcuaauucacuaugcugccuauagaaauucuuauccucauuuguuugcuauuucuuuguuuuuuuuuaauuauacuuuaaguuuuaggguacaugugcacaacgugcagguuuguuacauauguauaccugugccauguugaugugcugcacccauuaacucgucauuuaacauuagguuuaucuccuaaugcuaucccuccccccucccccuaccccacaacaggcccugaugugugauguuccccuuccuguguccauguguucucauucccaccuaugagugagaacgugcaguguuugguuuuuuguccuugugauaguuugcugagaaugaugguuuccagcuucauccaugucccuacaaaggacaugaacucauccuuuuuuauggcugcauaguauuccauggugucuaggugccacauuuucuuaauccauucuaucauuguuggacauuuggguugguuccaaguguuugcuauugugaauagugccgcaauaaacauacgugugcaugugucuuuauagcagcaugauuuauaauccuuuggguauauacccaguaaugggauggcugggucaaaugguauuucuaguucuagaucccugaggaauugccacacugacuuccacaaugguugaacuaguuuacauucccaccaacaguguaaaaguguuccuauuucuccacauccucuccagcaccuguuguuuccugacuuuuuaaugaucaccauucuaacuggugugguaugguaucucaucgugguuuugauuugcauuucucugauggccagugaugaugagcauuuuuucaugugucuuuuggcugcauaaaugucuucuuuugagaaaugucuguucauauccuucaccuacuuuuugauggaguuguuuuuuucuuguaaauuuguuugaguucauuguagauucuggauauuagcccuuugucagauggauagauugcaaaaauuuucucccauucuguagguugccuguucacucugaugguaguuucuuuugcugugcagaagcucuuuaguugaauuagaucccauuugucaauuuuggcuuuuguugccauugcuuuugguguuuuagacaugaaguccuuguccaugccuauguccugaaugguauugccuagguuuucuucuaggguuuuuaugguuuuaggucuaacauuuaagucuuuaauccaucuuaaauuaauuuuuguauaagguguaaggaagggauccaauuucagcuuucuacauauggcuagccgguuuucccagcagcauuuauuaaauagggaauccuuuccccauuucuuguuuuugucagguuugucaaaaaucagauaguuguagaugcguggcauuauuucugagggcucuguugucucuuuaucacaauauugaguaauaauugccauucacaaguuaauucugcaguuuaaggaaggcuuaaauuuugcaucuuuuucuuacacuacacacucuaguucuaccaacauucucggcauuuccuuaaaaugucauuuaagaaauauucuauuaaaaacaauaaauuaaaugagcuucugucuuuaaaccaaacugucagugauucuaaaaucaucagccauucauuuguauaggauguuagagagcagauguuuaauuauauugaguauuuuccugaaaggaaaauaaaauaaccuaaaugcacagguuauaccugugguugaaaaaaugcaaugugcuaguccucagcaguuguauuuauuugaagucaugacugauagcuaaugccuugucuuggcuuauaagaaguugguuuaaaaugaauucauuaguuuucccuuauguagaaauacugguucugcuaaugcucuggcacugauauggggaaaggaaacuggauuaggauuaaagcuucaccucuagacuuuccugaacaaacuagagugcagaucagucaggaaccaacgauacgagagcaguguaguagcugggaaugagugaccacagugaacgggcugaaguagagcugucccuuaagcaaaagcuucagagugugcuuugcaguguuuuuuuuuuuuuuuuuuccauucaagccugguuuuaaaaagacaggauaaguagcaggucaaaacuagggauccuaaguacaggauucucacuuuauuaaguaacccaucccauagagaaauuugaauauaagauguguauuaggaaaaccaggacuuaacaggacuuaaguauaauaacuuugguuauuuuagaaauguuuugauagcuaucugcauuugacucguauaaugcuuaguugcaaaguacuuguuuucuucauuaaauuuuuaaaaugaaucaaaaaaaaauuuggagaauguaggagaguagaaggaagagaagauuccuuaugaucucacuauucagggauaaucccuguguacauuucauauuuuaaaugcuuucauaaauuuuaauacuuuuauuuuuaugccuuauguauaccacuaauauugaaauuugugugagcuguuuaguuaaaaauugcuucaguuuucauccuuuuguacccucuuauaacacauuggcuuuggauucaaacaaacugaaauucaaacaugaggccugcuacuuagugcuuaguaugacuuuaugaaauagauguuuugguuuuucaaaaaaguuaaaacuaucauaggaaauuagaaaucuuagaguaugccuguuuuugacuuacuauuuuucuuuuuuaauacuuuuuuacauuaaauuaaaaaauuauuacacuuggauuuuuuuuaauuuugggggguaccuaguagcuguauauauuuauaggguacaugaaaauguacaauuaaauuaucaauuauagucaccuuguugugcuaucaaacgcuaggucuuauucauucuuucuauuuuuuuguacccauuagccauccccaccuucccuccagccugccacuacccuucccagccucugguaaccaaaauauuuuuuucuuugggaauuuuuuuugugguuauauuugucaaccagugggaaaaugucaucauuaucaucuaaccauuuuuuaaaaauguuguaucccagagaaaaaacuuuggggugauagugauguuugucaggugguaagucaucaaacaaauaaauuggugcaaaaugacuuugcaauugguaagucuuuucucucauaggaaaaauguaugguucugauuucauggucauuuucaauucuuaucagccuuagugguacuuuuguagccuacagcaguagaaguuggauaguucguauacaaguacuguguauguaauaucaguuacauaauuauuuuugaaaaaauugguacauuuuuaaagaauaucuuauuuuuuuauuuauuuauauaggcuugaagaaaauuugccuacacguuguggauuuugucauauaccauaugaugaacugaauaugccauuuccagcucaucucacauauugcuauaacugcaggaaacaaaaaguuccugauguucuguuuacaacuauagaccucccaacagaugcaacaguuauuggaaaagguugucuuauucaagcaagguauguuugugaaaacaacacucggugucccugaaaaaguaugagauagggagccguaaaccuauuuuuaagugucagcuuuacuguuuccuaccuguuugauccugcacaaacuggacaauucugcuggaacuuuguauuuuauugcauguaaaaaaaaaacccucuguguaaaacucaaauaaguuuguguacaaaagcaguuuuuaacuuuaaauucuacacaaauauuugucauuuugggaauuauuaaccugccaaaggcuagggaugugacuaaguauagauugcuucaauuacauucaauauguaacacauuuuagaaguugacucucuuuuuuucuuuuaaagaacagugccaugaaguguuucuuuuacugcuuuaauuagcugguaagaguuccuuuuaaaaugcacuggaguaggaaauccuaauuggggaacucaugacaacagcugccagguuaccaaauccaucagguacuucuguccucaucuuaguucugacaucucagcaauagugacaccauuaauuauuuucgccuugaaauuccuuugacuucaugaugcuacaccuucuauguuuuccuaccuuuauguauaaucuucauccuccuugaugacuucucauuucuugauccuugagagccauggguuuggacccucugcccaaagcucucuccuuaguugaacucaucaacuuauauagaucuaugugucugugacucccagauuuguaacucuaguccggaacuuucuuuugagcuuuagacuuauaccugucuacuucauaccccauuuugauaagccauaggcaucucauacgcguuccacauugaacugcugauuuucuucacuuuucuuauuagccuuuucuguuuuaaugaaugguaccuuucucuauccaguucuucaugccaaauuugguauucuuuggcacuguccucuuucucaaccuccccacaucaaauuuauuacaaaguccguugauuuuucuucuaaaauguauuucuaauccauuuauuuuuuucccucuugaaucuuagaccuuccauuugggauuguuuuccuuuugccuuaaauguacgcuuuaguauuucuuuugauggucugcugguggugagcuauuuuuuuugucugucugaaaaauguguuuauuuuacuuuuaucuuaaaaaauauuuugggcuggcagcuauuucuuuacagcacauugaaguacucuuucaccacugucuucuggcuuucauugcuacuguugagaaauaaucuauuagucuaauuacugucccuuugaauguagccuauguggcacgaaguagaugcucaagugacuuuuguauuuuuuuuaaugacuaacauuuucuucugcuuuccauuuauauugaacacaugcaguuauaaaaccuaagauuuuaaaugauauucucuagugauuuuggucauuauuucauuuuuagagauuuuaagauuuuuuauuuuucuuuauugaaauaugauucuuuaaaauauuuaauuuuuguggguaaacagguguauguauuuauaggguacaugagcuacuuugauacaggcauguaauacauaauaaucacaucauggaagaugggguauccauccccucacgcauuuauccuuuguguuagaaacaguccuguuauacucuuuuaguuauuuuaacuuguacaauuauuauugacuguagauacccuguugugcuaucaaauacuaggucuuauucauucuuccuauuuuuuuguaccuguuaugaaauaggauuuuuagugcaaguuuauacaaugacaaaaagcagaacagauuauugauauaacucaguaagcccauuagaaacaaguaaauguuuuauucagcacacuuuuagcaaguuuuaaaauuuggacauuuuuaaaggugguaccaagaauacuguucacugacuuauuuuccuuuacagguuaugucgcuuaaaaaagaaagcacaggcagaagcaaaugcuacagcuaucaguaaucucuugccauuuauggaauaugaagugcauacucagcuaaugaauaaacuaaaacucaaaggaaugaaugcuuuguuuggacuaagaauucagaucacagugggugaaaauauguugaugggcuuagcgguaaguuuagauguuuuugguuuuguuuuaugauuuccuuaauuauaguagauucuauguuaugugauucaaauagucuuuucaaaggcuuaucuaaagacuuugacauuaagaccuuuaugggacgaggacauuuuaagaagugaaaaaucuggugauagguuuucacauauuuuaaagggacugugaucacaacuuuaauaauucuauuucuaaaaauuaucauuugucgcuugcuuaauaaguuggccacaguuuuucuggacuuuauuauuguuuacauauugcuaaaacaggguuccuccaucucaguacuagggcaggauaccucuuuguugcagggaacugaguugugcauuguaggacgcuuagcagcauccauggcaauuccccacuauaagcuaguagcauccccccaguugugacacacaagaaugucuucagaaauugccaaaugucccuuggugaguggagcaaaauuaccccaggauguggauuaaucuuuaguuuugauggagaagauaaagcaaaacaugugagacacuauuggacagacaauuaaacuuuaucauaaaugugcaccuguggccagugguagacuguguaauaaaauacagguguuucuggccaggugcguuggcucacacccauaauuccaacacuuugggcagcugaggugggaggaucacuugagcccagaaguuagaccagcccgggugagaccacugucucuauaaaaaaaaaaaaaaaaaaaaaaauacaccaggugugcuggcaggaagcuuaagugggaggauuaauugaguccugggagguugaggcugcagugaacccugaucacaucacugcacuccaaccgaggcgacagagugaggcucugucucaaaaaaaaaaaaaaaaaaaaaaagguguguuucuuaagugccgaugaaauaugagacaagaaaaagcugugucucagcuuaauguucauuuuggcuuguuagcaaauaaauucugacuggaaagauguuaaugaggaaagccagugcugcuucuauaaguaguguaggacucagagaaccaggugccugcaaaaaguguauugaucauauggaaucugaugaaccacguuuauggaaauucucucauuuucuagguacuuugcuaaccagcauuuuggcuguguuauuggcaguuuucaaauuugaauucucuugccaucuuuuugagagugcauagacauuuaauuuuaagaaauuuauagaauuggacuuuuuugucucuauacauuuguaggucagaugcacauuuguuuccuguuucaucuuucuuuaagagcaaaaauguaaaguuuuguauguagaggauaauuguaugaugaugauaaacuaauuagguauuacaguuuucuaacgacagaaauuuguaauaauuagguaacuugguucauauuaaaauauuugauacauaggccgggcauggugacucaugccuguaaucccagcacuuugagaggcugaggugggcagaucguucaagcccaggagucugagaccagucugggcaacagggcgaaaccccaucucuacuaaaaauacaaaaauuacccaggcguggcugcuugugccuguagucccagcaacuugggaggcugagaugggagaaucagcugagccugggagcuugaggcugcagugagccgugauugugccacugcacuccagccuggcugacagagcgagagacccugucuuuaaaaaaaaaaaaaaaauuucuuuuauacuuagaguaacuuggggaaaagugguuauuuuaauucaguggucuaaaaauuuguaugccuagugaggacauuacauaaauguauaauuugugcuugaugcaagacuguaaugauuggugggugccuaugcaugucaauuaagagcuggauucaaauugagggguuuaaaaaacauuuugcuagcuauaacaaacguuuuugaugguugagccccaggaaacuaguuuaugacacugauguaauucaagacuugccucaaauauugcuuuucugauucauacuaaucuuuucuuuccuucuugaucacuagugcuguuaacuaccacuguuugacauuucaucuuugugcuuuguuauaguuugugcacuuaaauccuaaguucucaagaguagcuucuuucuuaggugaucucugaugagugccgacgaggugucuggcacugugcuauucuagaaggaaugugauauuaucuucacuuuacaggaggagaaacugugugcugugauagguugagacuguaaagugaugugguuacauguguuagaaauggauuucaaaucaggccucucugaugccagagucuguguucucagcuguucagggcuguugcuucguuaaugaguggagcuaaaacacauuagaggugguggacuaaggcuucauauggcauagagaaggggguucccugguugaauauuagagauugggucauguauacagugauggacacuaaugaacaaaccaggaguaagcacucuugaggaacaauuuuaucuacuaugcagauuucuucaucaaucccuuuuuaggauugguguucacaaaauuggcaguugauuaauuuaaaaaauaauaauaacaaauaucuagaguuaaaagaauucuuuucuguuucccauuccacuccuuugauguuaacaauuugauguuuaugcuucuauuuuuuuugcuuugcuuauauuagcauauuuacacauaagugcucauaaggauauauauaaauguuaccuuguuuuguauuucccaugauaguuuuccaguacuaaugaaauauaguacuguuucagagucagauauuaaauaguaauuuaauuagauauuuaaaauaaaucuguaucuaauaaacacuuuucucugcuaauuaggaagguagggcaauauagugaaaugcguuuggguuuuagagugagaaacacucaguucagaucguuuguccacauuuauugacuuggcuugagaaaguucccuguccuuucugaauuucagucucuugccuugcaaaaguuuccucuucacuuuugccaccuuuaaagauagagcaucugcucauucaugaaaaauuuauuuuuuagcaaccuuuaauuuuuuuuuugcuauuuuuaauucuaauuauauauuuuuuuaaauuaugagguagguccgggcccagugacucaggcccguaaucccagcacuuuaggaggccaaggcaggcggaucaauugaggucaggaguuggagaccagccuggccaacaugaugaaaacccaucucuacuaaaaauacaaaaauuagcugagugugguggugggcaccuguaauccuagcuacucaggaggcugaggcagaagaaucgcuugaacccaggaguuggagguugcagugagccgagaucacgccacuacacuccagccugggugaaagcgugggacuucgucucaaaaaaaaaaaaauugugagguagaaacauaaaaaauauaauuggguaugcagugaaaaguaaauccgcauuucguaacugucucccaccuacccaggguccuccccaaaagaaaccaacgcuuauuaccaguuguuuuugugugccuuuccagagauguccuauguauacccugaugcugauuauauucuuccuaaugagcaaagaucacauucuuguuuuuuuuucccuuuuuuucuuuuuuuugagacagagucuugcucuguugcccaggcuggagugcagaggcaugauccugacucacugcaaccucugccucccggguucaagugauuguccugccucacccuccugaguagcagggauuaugggcacacaccacuacaccuggcuaauuuuuguauuuuuaggagagacgggguuucaccuuguuggccaggcuggucucaaacuccugaccucaagugaucugcccgccuuggccucccaaaguacugggauuacaggugugagccacugcacccagcuguugaccacauucuuaaauaugaaaacuuaaggacuguuauucuguagauauuuuuucugauuauuuccccauuauuuuuuacaagucugccacagguguguauuuagcagcuuuaccaacuccuggugguauucagauugcugggaagacuccuaaugauggcucauaugaacaacacaucucucauaugcagaagaagauaaaugacacaauugcuaaaaacaaagaguuauaugaaaucaauccuccaguaaguaaaacaaaccuacauugugaauguaucaguuauuguuuauuaguauauuuuuagguuaucuuauugaggacacaagauuuuuuuuucacuguuuagcucuccuuauuacucauucuuucaccucccuuuaugucuuugcucaacugucuccuuuucggguaagccuacucuaacgauccuauuuaaaaauugugacuucauuuuugccacuuccuaugacuuuucccucuuuuauuguuuucuauagcucuuaucuuugugagugugugugugugugagugugugugugugugugaguguguguguuuuguuggucuuuugccuguuaguacugguagaaugaagcuucaugagggcuuuguuucuauugccuagaaaaguuccuauuggugguagucucuuaguauuuguugaaugaugaaauaaaugguuuaaaauguucuuuguuaguaaaaagagauucuuauuggugguaaaaaugugaaagaauauaguuuuucaguuacaguuucuuuuuuuacaaauuugcucccagucauuuccuuuaaucagucuuuuuaccaacuuugcaauaaguaucacaaugcugccuccucuguggaugacugauggcaagagucugaauugaaagaaaaauggguuggaauuagaaugaaacuauuuguuuuuaugagucucugauaaugaaagacuuucacaaaaggaaaguauaacauucacacguauacauauguaacaaaccugcacauugugcacauguacccuaaaacuuaaaguauaauuaaaaaaauaaaaaaagaaaguauaacauuauugcuuuuauuauuuuaaacgucuuaucuaauuuuggcuggucuucuggaacagugugucuggauuguugcgucacauguauagcuuucaucauauuauucuagcauaguuguuaauuugggaggaauuuuaagguuaugaccuacagcugcacuauucauuauucacugugguagccgcuggccacaugugacuuuugaggacuugugacuagucugaauugaaauguguaguaaguauaaaauauacacuggauuuuaaagauuuacugugaaaaaguaguguaaaauaugaauauuuuuguauugauuuugugucaaaaauuuaauauuuuggauauacugaaugaaauaaaauguuuuauuaaaauggauuuuaucuguuucuuuuuacuuuauuauguauguggcuugcuuuauauuucuauugaacaauacugacuuagggcuucuuuaaaaugaaugcaaauguugauguguuaacauauucauauuugaaaaauagacuuuguaaaaguucucugugcaccacucuacugacugcuuauuuuuauaguacauuauuuuuauuugguaguuauauuuugauauuugaacaucuguuuauaguaugccacuugggaaaaaugauuuguaaagcuuuguguuaggguuucauauauucuucauuuauuauuucuaaugauaugagcugaacuuuuuuacuuacuuaauaguguuucucaccucuguaaauccauccugaccucuaacaggaagaauggacucuuccuccauuguguacuuguuguaccuguauguacuuguauagaaacuguuacauauuauuguacuuaguuuuuauauaucugucuuccuuuacuauaauguaagcccuuuggagacagggauguguuuaaauaagacuaugaauuaaguuacuucauccauucaguacuuauugagcugcuacuaugugucauacaguuuacauuuggaaggagggaguaaaucuauuaugauuuuaaaaauuuuaacauauaugaauuucauguguugaggaugacuguauuuucacaacaguacucaucaguuuaugcaucuucuaauaugucuuuccuuauuguagauacugacuacauuauagucuuuuagcauaaucucucagcauuuuuuuugacagagucaguguacaagguugauuaccaggccacuauacacauuacaguguuguguuauguccacccugaauauguagaucagaguguuccuucucuuaggaugauagcccucacugaaauaaaugcugcuguuuaaauuuuuugucaauacauuaaaaaauguuucuaauacaaagguguaguaccacuuaagcuuuauggagauaaucaaagguaucaaaauaagaugcacaucucucagaauaacaguacuagugaugaaauuucaguaugaaucuagaacauauuaaauaccagacaguuauauuuguuaagucuguggcauugugaacaaaggcauaacagaauuuaaaacuauuguaaaauuauaaaaaguagugugguaucuagugggaauaacguugcacugugugucaaaagacugaccuagacuggcucuacacuugcuaguuuuccaaauuuaggcagacuacuaauuuacuucugaauuacagcucuuuuccauuuuguaguuauuauaauguuaacuuuauagagggcagauuaauuuggaguacaaauaagauaaauugaugugaaagugcuccauagaucauuacauuaugaaauugugcagugguagucuuuuaucuaaggugcauacuaccaaugaacauuuaaaacuauauauuuuugaaaaauuuuauguacaauuuccuuguuuauuaaaaagacaauucuguugcaucagcaauaggcuauggcuuuugcuuuugcguucacguauucauauucuuccagcauuccuuguggccgacagacacuuagaaccccuagugaucuuuggcuauguaacagcaaaaagcucacuaagccauacaguauugcaccauacacugaccuuaaaaagaucauuauuguaaguaccaauguuuauuuagcuuaauaaauugaauagcaaauaugugcauaguauaaguauauauguauucauacucauacauugaucauauuucacauuuugcuauauggagcuuugaaaguggauaagaaaauauauaaaagauuagaauucuuucuaggaacauaagucuuuaaauuuuuaaggccuauuaggacuuuuauaaugcugaauagaaaauaugcacacacagcaguacuggauuucagagcuguaaggacugccaauuccauacacauuguaguguccuguguguacacuagaugucaguuuuaucuuguuaugucugugacaguuauauauauuuuucugauucguguaucauuaaggcugccauaucugcuauaaaaguuuaguuuuaaagguuauacuuaaguacggacuucacugaguauauuuuacaggcuuuuucuccacagguaggugucuacuaauauaaagauguaaaauuuaaacuggaaaagacaaucucauaugauauaaaacaauuauauuucuuuuaggagauaucugaagagauuauaggaucacccaucccagaaccuaggcaacgcucaagacuucuaagaucucaaucagaaagcucggaugaaguuacagaauuagaccuuucacaugggaaaaaagaugcuuuuguuuuggagguaauguggcauuggacuaauuucuuaaagguuuuggaagcuaagauacacauuuuuucacgugcuaaauuaauaugauacuuuuauaucauuacaacuguuauaaauauuuaaaaaguuauuauauaaaaauacaacaaacuugaaaauaacagaacuugguaacauauguuuguucaauaccaggucacugauacaauaaugcagaugguucugaaaaaguuaauguauggguugaaauaaugauagaauaguauuaaaccuuugaaguuauuuuuguaaacuugaaugaauuuaaaugaagugccauucuuuaacuuacuauaauuauuaccuuuuuuguauauuacuguaguuauaacauuuuuuaguauaaucacugugaauucugaguguaguauuuucuuacugaauucaaaagguauaauugauccaucuuuauaaaaagauacuaagaacacuuuaguaacuuucccagagaguaaaugucacaugaaaaguuuauggagacuccuuccucacagaucugcuuccucugcacuccccuguagaaugguuagcucccaaagagauagauuuuucuuuuucauauugaaggaaaggaaaauaaaugauuaagauguaaguugagagagagaaaaaucagaugcuuugaucuugguguagcaggaagcuggugguagaauuguguugggaugggauuggagguuuaaagagucaggaacggugccaguggcuguaacaaggaucuaugagagacgcacaggccuaaccaaggugagagugucaguuuguagaaaacucaacuuauaugguuauuugccccccacuuuuuccccacauuucucuacagucugagaauggaaaauaugucauggaaaauaucucaggucaaggagguuaaaaguuccaggguacuauuuacagcaaugcuacucaaagugugaugugccuacuuguggcgucagcucuaccugggagcuuguaagaaaugcaaauucuugggccccuaccucagaccuaguagaugagaauuucaagguggagcccaggaaucuguuuaacaaacuuuccaggugaugccaaacauuaccugaaguuugaucuagggcauuauugauaagucugaucuugggauccuggcuaaguagagaggcacaugagaacaaagugcuucaaacaugggcagaggacagagggcaaguggaauauccaguaagagaggacaaagagacaggacuguaguuggagaaugcucgagauccuggguguggaacguuuuggggaauaauggguugagguauggcugugacuguggguagccacgugaaguggaagugaaagugguucuugaaguccugagggugaugugggaagaagcuuagcgagucugcagguuaggacuuagaaacugaggugcagaugaaugucagcgccuguccagcuggauaguuucccuauuuauuauucacaguggaauauggugauguaagaagaauagaauuuagaccuauuuauuuuauuaaaaaaauagaguuuagaccuauuauuagauaugucuuuaaauuuaucuguaccuaauuccauuguaaaggaguucugcauuuagugaaaggaucucauuacacuuuauuaauuuaaacaaauuagaauaaugauugcuuaugaugucuuugucuuuagaaacauauucucauaaaggcuugagaaagagcuaguuuucuuuuuuaacuuaguguacuuuguacguaaaauauuucacuuggaaguauuugugguuauuacuguggagaaauuuacugauauuagaauuuuuuucuuguuacauauuuuuacuuaggaaaaaugacucugccuuuucuugacucuauuaauaguucuuuuaaaacgugaaauaauuaugcauuuacuacuuauaaaauaguuuuaaucucuauuuuaagauugaugacacagaugccauggaagauguccauucucuacuuacugauguuccuccuccuucaggugaacaaaaaaguuaucuuugagaugaaacuaguuuuacauauaaauguuuuagcucauaauuguuacaguacuaauuuuacuuuaaaagaaggacuuaucacagugucacagcuugucauguacuuugcuacuccaagguagaaaacauaccuuaaaaauacuuauguuagaacuuagguggaagugauuuuuaguccuuuuauauuuauacacggaaaaaaaaaccugugauaauuuauuaggaugguuuaaagucuccugcagguauaguuuuagaagaaaaaaaaugaaggguguuauaguuagaacuucauauaauaauugaaaaaugucauuuaacacaaaaaucaaugaaauauuaucauauauuuugauuacaauuuauuuugacaggcuuuuauaguuguaauacagaaauuaugcccgguauaaauaauuggaccucugaaauacagguaaaccuuuuuuucuuaauuuuaagcacauaacacauaaguuauuuuaguaaguuccauuuaaauauuugucuuuuuuuuuuuaccuccuuauugcaauuaaaauaccauccuuauucuacuacauuaguuaguauuguucauuauuuggcaauuuaucaacuguuaaaauauuuaguuaaaaauaauaaaaugacauguuaugucaccccacauuuagauguucacuucaguaagaguaaucagauuaagcagccucaaccugacuaaucaagcucucaauaagaacuuuaaugaucucugugaaaauuugcucaagguaggaaccuucugacuaaauuuuauuucaugcgucuauaauaaugaaauuuuaagugucuauauugcuguauugucuguaauaccuuacacaguugugggcugaaucauucuuaccuacuuaccuuaccucuaucagcgggugagauacuaaaguuguccucucccccuuacuauaucaaauuauaaaagaaauaguuuuaguuaauagcuuuaacuuccauaaaaaucuaguguauauguguauauuuaaaaaaacuuacuauauuauuuuuugugacuuauugacgauuaaaucuuauugucuacuuaaauauuaaaaaguauaucguuaguguaaaaauacacaaaacaaaaguggaccaguuuuguuuuauuuuuaacucuccauuugcuauaauauaauguacauuaaaaaaaucagcuuuuaaaaauuuuuaaauaaaaaagugacauuacuaauauuuucuauuguguagagccuguacuuuaaacuacgaucuaugauccccugcugccuuugccauguaaauuuuacaguaucucugccugaagaugaauuaauucagguaauuaagauuuaguccauuauuagucuuuaucugaucuguuuuauuauuuucauuaucuguuuaucauaauuuugccguaauuaaauaaacauauacuaguuuaccucacaauauuaaaaaauauauguuaguaugcauuaggccauguguguuucuuuuucugaacuuuaguuaucugaggggguaagcacacguaugcuucagcauguauacaguaggaucuguacccaucaugugggauuucaccaguucccauuuuuuagagaagguucuugagcucuuucuggaauaucuagauuuagguauaacuguuugguauaguuguaguuuguguaugauuugaauuuauacauaauucugguugaggauuuuaaccagaaaagguauuugguguagguuguuccgugguacugaaaaaaauauguaagaaacuuaguuuuggcagugauuauuuugcuaaccauuauuguuuuuauaauucuagguuacagucacggcagucgcaaucacuuuugacaaaaaucaggcuuuacaaaccacaaaaaccccuguugaaaagucauugcaaagagguaaaucuuuacugaauaggaaguucaguuuguguuugucuguguuaugguucagugauaaaauauacaggacagguggauucaauaaauuacuuauuucuugaagaauauuugcugcuuuuucuguucaucuuuaugaagauaacuguguggauaagcguauggcugacuugauauuuuucacacgcgacugggugguauuugacugauguuuacauagagaaugcugcugguuuuuuagacuuaaauuauagccuauuaauucugcaguaauauaaggguuucuauacuaagaucucuggcaaggucuucaaggcaucugaggaccuacugauguaguaagcacaauugugugccuguguauuauuuucaggacaaguuccauaguguucaacagauucacaaagguggccuuaauccaguaaaauuuaggaaguagucuuaauauauauucugaagaaauccaaauuauuggaaacuguguguucugaaaaacacauaaugggggauacuauacuuucuuguauaguuugaaugauuuacuggcuaaaugaaauauuccugauuaguccuaaacuuuuaaaaguugauuacauucuacauguauagcauugauaagauuugagcagugaguuaaugucagguagauguauuaaaugauuauguguucagauauuuaucaaagaagacauguaaccgguuuaaguaucacaaaagcuaguaauggacaaaguauaggauauuaauuauugucuagcauuuauuauuugcaaagcacugugcuaagugaguuacagauauuaaucucuuaaagcuucacaagagucauaccagggaagauagcaccagucucagcaucaugcagaugaaugguuuccaugggagaaaucaaggagaaaaugaccagaauaaauugggguggggagauggagcugagaauauguauauguauguugucacagauucuuaauuuuaaaaaauuaauaauagaucauuacuaaauaacugauauuuucuugccuuucuagccucaacagauaaugaagaacuuuuacaauuuccacuggaacuguguucagauucacuuccuucucauccuuuuccaccagcuaaagguugguuaagugagggaaaaagcaaacacaaauccugguuucuaguuccuuucacugcuucuucauuauaggaaaucuuacuaaccuugaggugaaaauuuauccuucauucccucauuauauguuucuucauauucauaaaggggagaaauuaauguuccuuuuauuuuaauuucugaaguaauuucauucuaaguuauuaagguaauuuuuccuaugauauucuauucucauaccuuaauguauuaaagcuuuauuuucaaagguuuggauuucccacuguaacuauucacacauagaauacuugauauuuuauauuauauuugguaaguuuuuuccagcaacaauuaaaccuucacaaaaaguuuuggauuuucaugcacaacagaaugcuuuuuuuuuuccagaagauacaugaagagguuuugagugggaguaguacaagugagaaagcgaugagcuuccugucuuugcuguggcaauaauugaagaacauuguuauguacuuauauaagacacugccauguuuuuuuuccagugcaaauugauagcuccuuaauuuaauagcaauaaaucuauuuugaucugcauaaucuuuggggaaaagugggagguauuguuuuccauuucucaucugauuuuaguaugauuuuuauuacaaaaaaauuuaaaauuacuaugccuuauuuuguagcauuauguauuagauaaauguaguauguguuuuucacuaaauuuauuuugagaaaugauaguuauuugaaaugagcuauucaacuuuuaugucuuauaauacaauggauauuauuuuaugauuccuacuuguuauuugauaccaaauuauguauaauacagaauaguuuuauauucacuuuacauauaugucaauagaaucuuuauuaaaucaguacaaagucuguuuauauagauaaauagaucuugucucauauuucaaagacgaaaaauaagcugcuuccagauucugaacuuuguaacguaguaacugugguccuuuuuccuuuuugugaucacccaaaauucugauuuagaacuccauagagaauuguagcauaucucaauguccuugaaagaauagagaggaaaaaucaaauucaaagguaaugugaguucagauuuaugaauuaaauacagcuuccaggcagaaagcagaacugucaagagucuucuuugggccgggccuguuggcucauaccuguaaucccagcacuuugagaggcugaggcgagaagaucgcuugaauccaggagcuuaagaccagccugggcaacacagugagaccccagcucuacaaaaaauaaauaaugagcugcaugugguggugugcaccugugauccuagcuccgugggaggcugaggugggaggauugcuugaucccaggagguuaaggcuacagugagcugugauugugccacugcacuccagcccaggcgauagggggagacccucucucaaaaagaagaaaagucuuucuugaauucacuauacagcaaguuuuuuuuucuuuaacaucuacuuuauacagaaauuuguauuuauucaggguuaguuccaaaucacuucuagguauaauuucauuuauccuuauccugcaauaggggccaaaaaaaaaaaaaaaagcccuaaaaccuaaucgacaaagguuugauugauuguuauucuguaggaaaagguauuuguggacuuggggucccuguuagcucuguuuuacuauguuguuaauaccuacugaauucugcagaagauuagauuucagcucucuaaguuugccuugucuauaaggacaacuuuccacuucugcaauagcuuucaaaauguuuucaaaggaauuauaacuggugcuuaugugaucguuacuauacgguauccaaaugauauuuuguggacuaaaaaacaagaaaauaagaauuugaguagaguaaguccuauuugaacaguaccuaaaauauuugcagcucauuuuagggagaauugagagggaccgugagguagguuggaaaagcaacugaccuguuuucucaguucugcuauggauuaggcaugagaacuuggaccaauugcuuaaccucuuugagccucaguucguccuuuguaaaaugugaaaagauucucucuaaccuuuaaaauucguuggguuucuauaguuuaugguucuucaauuauuaacauauucccauuuugaaaaguaaaucaaaagcuaaauuagaccccaaggucacacugagcgucuguauuuaauuuaaguguguucagcugggcgcggugacucauaucuguaaucguagcacuuugggaggccgaagcaggcggauugcuugagccuaggagucucuucucuacaaaaaauacaaaaaauuagucaugcaugguggugugccuguggucccagcuacucaggaagccgggugguagaaucaccugagcccagggagguugaggcuacaguaagcugugaucaugccacugcacuccagccugggcgacagagugacgcugucucaaaaaaaacagaauaaaaaaugauuucaaauaacuuuuaaucaauuaaaccaauaauuuuaauuuuaaauucugcuccucugaaccauagagguuugucagagguaccucuuggccugccaggaggcaaagugaaagggagcagagaaggaugggauugaggguaggucucuggauccccuacuuuucugaaacagcagcuuugauuccauguuuuuauauauccaucuucuguaugugauuucacuugaagaaagggucucaaagaguuugaaaaccauugauugauuaugccacccuuuauugucaucaucaucaucagaccaucacaucuaauacgaauauauguaaaacuuucuauacuaagugcuuaacugugaaaccuaugugcuuuuccuugaauacugcauuuaaaauaaucaguaaacacuuaaaaguguaucuguaccuuucugccaauauuucuguaguuuuguaaauugugguuuguguugcgugcuuauuuauugucuugugcuucaagucuuuucaggaggacaugggcuaaauacaauuuuuaaagcuaucucaaaauguuuuggaaaauuugaggguaagauagguuuugaaaaggucugaaaaauauaauagagucuuaaaaauggaguaauugcguguuguaacaugaaagaaggcaaugucuggaaaaauucaaaaauagcaauuuagcggaaauaggaagagaggaagguaagaguguuagggauaaaugcucaaaagauuucucuguuuuuuuaaaauaugcaaccauaagaggcuuaaaagucaguuacuaauacugauaaauaaaaguauaguuuuuuaaucauuuuguuaaguuaaauaaggugauagcuuuuuuuuuuuuacuuucaguaacuuugaauuccaguguauauuucauguuuuuaaucacaaauaggaugauuguuaaaauuuuuuauuuccuuuuauauugacuaggggauuaguuucaagagcuaagcauaguauguuuauuaauauuuccaucuuuuuacuuguagauaaaccuuucauugucuuuuuguguuauugaaaaugggugaaugucauguaaagaaauguugcuucaauaacauguaucuuaauucacaguguagaguaagccugggccugaauuguccauccauguucaauuuuuucuuuccaucguuuauuauauuugguuuuguuuuuaaagguagcagaguaguuugauguaugucucaaauuuaugguugauuugguguuaccuugcugguugucuugauuuuucugauuugauauauuaacuggugcugagccuaaauaauuuauuuaaggauagaugauaugguaucaacauaaauuauuuauguuuauucaagaguguguuaugagaaaaaugauagcuauagcaaauuuuuaauacaauuuucauguguuuuucucaucauugauauccaaaccugaguuuuucucugaaaugauuuucaagagacuuuaaaaauaauguguguaucuauauagaaaaaaagaaugagcaaaaugggggggaaucuggguugaggucugggagaagaguaaaaaaaaucagcgagauucuucucauagauuucaguuuaucucaagaauuuuauacauguaauuuuuauaaaagguuagcauauuacuucagagaaauaucuaaaggcuuacaucuugagcuauuaguugcuguauuguagggcuuaagaacuuauauuagacaaguguguauaaaucauauacuacuuuaaauauauuucaaguucuuaaaaaauauuaccuaagguaggauaauaguuuucauuaaaacacugaucauuuaaaaauuaaaaagguuuaauuaagucaauuuuaguuuuaaauaccguugagugaaacuguauagaagacucuuuuuuuuuaauacccaccuuguuuccugcuuuccuuuugcuuuuacuagaguauuuccucguguucaguggcauacgcuauaggcuggcaggaauacucuauucauuacauuagcugcugacugcuguggcaagcauagguuaaauauaaaaacaaguuggcuuauacccacaauacauuguacuucaaaauuaggugucuacgucagaaguuuuuuauuguaggcuagaagaguuacuuuuucuuuguuaaaccaaauuagauuuuuuuucuuuuuagagacagucucauucacagauuugauuuuaaaauaguuuaacuguuugaauuuaaugucuugcuaacauuauuuuaaaauagcaauuagaaguguacauuuguaaaaaauacagaaguuaucuuuuacuuuuccugccaacuaacgguuugaauucuuaugacuauauauaauuccuuauacuaauuaaaagcauuuuauauauuaauaguccauugcaugucuguuauuacuauuuuuuaaaaaauauauuuugucacuaugaccaaguggcagcaacaauaaaaaacaguuaaaauucuugauguuauuggaggccaaauaaucaauggcaaguuuuaaaaggaaagagacgcucaggggaagagaaugcaaaaaacagaaacuaacuagaggaaaaugugugaaaaacucaucccagaaaugggaaggaaggaaggacggaaggcaagagaauugauggagaaguaggaauaaagaaucuuuaucucuguggcuucuucaaggcagcuugaggacagugaaauccacaguuagaggaagagggaguaaaaagcaaaggaaaauugcauugaguuacugacagaaaacggauuauuuggaagagaagcuauaaaagauaggagugagagggagauugcaugcuuggaaauggaagcaggaaaauguaagaaggggauugaagaagaaagacaagugguuuagaaugucguacaccuuuaauuagaaacuuaaaugacccaaauagggaaguuaauugucuuuguuaucuaauauauguacuaccuagguaucacaguugaauuuuucccuuauaaacuguccaaauugaagcuaguucugucuuucugugugccuuaguaauuuacaacuguaauauggcaguuuccuuaucaauucaucaauauuugaguaucguuauagaucagguuuauacugaauguuuagauauaucauuugucuaccccagucaugaaguuagauuuuauacuuauaaagcauaacuaaucaaugcauuaucaauugauggaaauuccuaaagaaacauaaaacccaguuuugaucauaauaaaacugagaauguuuaaauaggaaaauaaaacauaaauuauaaugacucccaacugcauauauuuuaaucugccagagaaucauuuccaaauuuguaggaaguuuuuuaguuuuaguaauucuuaaaagacauucagauaagauuuucucaaauauuuuuuaauuauuuagagcaaagaugaucugcaaauucuaaugauauaaagugaauagauagucaaaagagguacugaucaguguagaaauuuauuccuguauuuaucuuaguuuguuugguacuacugugacaaaacacuugagaccguguaauuuauaaagaacaggcauuuauugacucaguucuggagguuggaagucccauaucaaggaaccagcaucuggcaggggccuucuugcuguguuaucacagggcagaagggcaaaaagagagcaagaggagaucaaaucucccuuuuuauaauggcaccaaucccacccauaaggguggagaccuggccuaaucaggccuuaaauguccuacuuuuuuuuuuuuuugagacaagagucucccucuguugccaaggcuggaaugcagaggcacgaucuugggucacugcaaccuuugccucccagguucaagugauucuccagccucagccucccaaguagcugggguugcaggcgccugccaccaugccuggcuaauuuuuuuuuguauuuuuaguagagacgggguuucaccauauuggucaggcuggucucgaacuccugaccucaagugauccgccugccuuggccucccaaagugcugagauuacaggugugagccaccgcaccuggccuuuuuuuuucucucucucuuugagacagggucuuacucugucccccaggcuggagugcagugcugcgaucuuggcucacugcagccuuuagcuccuggguucaagcgauccucccgccucagccuccugaguagcugggaccacuaacacccccuugccugguuaauguuuaucuuuuuuuguagugaugggguuucaacauguugcccaggcuggucucgagcuccugagcucaacugacccgcccacuuagguuucccaaagugcugagauuacaggugugaaccacugccccuggccagaauguccuacuucuuaguacuguuacaauggcaguuaaauuucagugaguuuuggaggggaccuacauucaaauaaucgcugcagcuaacgaauaccuuugccauugguuacgacaaguuauuuagaagaauggaaaagucucagacuuuagacguacuggagaaugucuguuugagggaggaagaauccuuuuugucguuaauaugcucauuuccacugagcugauuuuaaccuggguuaguuucccucccacaccacuacacacagggcuuguuaaauauugcuagagugcacuaggggaauuauaaaaccauagcccuguauugcuuugcuaaguuucuagggucauuuauuuggggcuugcaggguuaucacuuaauggugacuuuuaaaaaaaugcaaaauaaucuucuucuugcauuaagugggaaaccaaauuauaauagaagcagacuguuguguggcuuaauugagacuguuugcagcuagaagggggaucuugacaugaaaagcauuuguuucagacucuuccauauagaucuacaaauggcacacaagugagcacaacucagcaaagccugaaagacuuuuaaggagauuucuacccuugaauaaugaacuauguuguuuuuaauuuaguauuagucuagagacugcauguuguuuuauuucuuuuaaacuggaacucccaguuggucagugagccagacugcauguaucugcaguaccuucucuuuugaaaagcuuaucaccugggaagccaaacucugaucaggaggagcagagggccugggagucugaggucaucagacauuugagguauucaaaccaguccaggugcugaugucuaucugcugcugggaccagcuggccuugggccucuugggccuuuuuuuucuaggagaaaaauuaagauagcaagcauguuaaaagaugaaccugcucucccuaagugaaaucaaaaaucucccuuaaaaacuuggguuuuucagauuuuuuucagaugcauucguauuugagggcagggaauaaacauuuucccucccuuuuuucccucuucauccuuuauauaaauuuuacuggguaaaaguaauacauguauaucgugaaaaauuugaauauuacaaaaaucauguaguccagaauaaagcucucuucuccauuuccuuccccaagaggcaacuacuuuuagcaguuuacugucugucuuucaaagauacucuauucauccuuuuuaaaaaacacaaguauuuuacauaucauuguguaccuuguuuuuuccacuugauguuagagaugggaacagauauuuaauacauacucagguaagcucuuucuguguacauuugccauuaaaauauaugcaguuccuacuagggaauuccauauuacucagauaauaucaagguauagaaaagauuuucguuuuagugauuuuucagaaauuuuuaagccguuccucuuuccccugcaguuuaaaaaaaugcacagaauuccuaaugccagcuauauguucuguaauucuacaccaaccaaaucuauacugcacaagacauaugagagccucaggacucucuugggauauguaaguuagggguaggacaguuggugucccagucucuccauugagucuguuucugugcugagugucccuacagaugugguaagccucugaaugucaggucugugcuggucuuucuuuaggucccaucuccuccuagacuuccaaagucucucaagauccugaaucaggaggacuuuuccuaucuagaucuccagucagugagcaugauggucagggcauguccacagugugguauccucauaggccauucguggaccccaccuggugaucccuuuuauucaucagcucuguauauguuacaggauuagcuaguggucaguugcuuuaugaaaacugugggccagguuugguggcucauaccugcaaucccaccacuuugggagaccaaggcaggcggauuaccugaggucaggaguucaagaccagccuggccaauauggugaaacccaucucuacaaaaaauacaaaaaaauuagucgggcgugguggugggugccuguaaucccagcuacuugggaggcugaggcaggagaaucacuugaagcuggcagguggagguugcagugagcugauaccgugccacuacacuccagccugggcaacaagacgaaaacuccgucucaaaaaaaaaaauuguguuggugggguguggugagauacuugcauuguauuuucaauuagcagcaacauucuaugguagaaacauucuguacaaauaauguuuugaaaaguuuuuuuauuaauuuaagaauguuaccaaaaaaucaacacacuaaguagaaaugaaaaaacauauuuaucuaucuauacuuaaacuauacuauacuaagccaaccgaauuauucucagugcuuuucaugaguuauuucuaaauuggcaggacuauucuuuuaguuguaaaauucuuucaaacaaaaauuuaaauauucuaauguggguagaacaugagcauuaaaaauagguuaugaaguuuuuuuauagugcuauuuaaauuuguacaauaccuuaaauaccuguaauaaaaaauaucagggaaaauucuggaugcuacugucagguuacuggaaagggagugauacuggcuugggauuccugguuaccucugugaucacucauuuuuuaguuucacaaagucuugauaccaccagagggagcuguugauaucgaagucuucgaaugaagaaguugguggugagaguuaagacuagggagcagcuuaugcugaucugugaagcauaaucauuaucuugucuguaauuuguaaucuuauagacucuuccccacagcaaacauuuuccuuccauguuucauuucagauauucuucccaacacauugacccuuuucucugccuagucucacauccugcuuucaucauacucacauucguuacuauguuuauauuuucuugugacuauaaaguuucugaaacucuuuuuguguuacaguaagcaaguagucuccuuuggcaugguauuuaugaacugagcuaguuuucauuuaucaauagaaacugcauuuuaaaccuagaugcuuuuauuugguuugcuuuugcaaugaagccauaaagauuuccuccuauucuucuggcuuauagagguauuaacaaauaacaaagaagagguacuggcuuguacuuagcaucugagcuaauguuguucauauugucuuauuagaacaccuggagagugcaaguucuaacucagguauaccagcugcacagagaggugaguuugucuaauuaagcaaauagucaccaaagguguaaaauucuaguuugguggugcauaaaauuauagacauugaagaaaaugcacuggacaauauggaauagacaccaaaaucuggcuuuuuuuuuuuuguagguagaauauguucuuuuaaaagcaucaauuaaacuaauauuuaaauuuuuuaguauguuaaugguuucccaguuucuaagcauaaaauuuuagcuccuuaaaauuuuuuuuccagcuuagcaguaguaaaaguuauuguuuuuaaaagggggaacuugugaggcucacaccugcccugaccccauauuaucagaggcuuuguugcccaaaaucagacauggaaacaaaacauuaacaaaaauggcccuuugguuuuccucuuacugauuguagaaagaagauacuuuaauaacagauaagucaacuacuaacuuuuaaaaauauauucuucaacauuugauucucuuuuuuuaaaauuuuaggguaaaacuagggaaaugaauuauucacaaagcuuugauuauaaaauaaaauagaaacaacugaaauauuguaaauuaagaagaauaggaaauaaaguuaguuaaagcacaguaugugguccuuucauugauauuuauguuagaccccacucaggcucucccuaggagaccacacaacuaugacaucaccagaaaugcucagccugcuaacugagaacuugguuuuggacaaaucagugucuaaagcuugacucuuuacuaucucucuuaucugacuugaaaaggaccauucuuuuucugaguuacaguuaaauuacaucaucgaaaggaguguuaagacgaguaagagacaucauccauauuuuuuucuuuguuuuuuucuuuuguuuucugucuguguuuucagcaacgucaguugauuacaguuccuuugcagacagaugcagcagcuggauagagcucauuaaacugaaagcucagaccauaaggcguggaucaauuaagacaaguaggcggauguuucuaccacauuaugauaaucugagaaacauaucccugauuucccaguggugaaagcuagaccuuacuacccaguaauaacauugccaauccaucauguauuagagugugaaagcugcagacuguaacggucauuuaggaaaagcuuuugaaaggccuuuagauuuauuaguuuuaccuauagaauuguguuuuuaaaauuuuccuuuuugugcagguauucuuaaaaguauauaaauagauauuauaucauucuaauuggaaguaaauugccaacucucuuauugaaaagacauucuuccaggacccaagguacuauuuaguauguggcaucugucgguuuauuaagugugauaugcagagggcuaaacuaauaaagaauuuauggugagaaaguaguuauuaccuuacugcuagaaucagaaucauuacuuauauguuaucuuaugccauguguuuugguaaauuuugagguaaauauauuugagugaaagagcuuaccguacauuaaaagggggaaaaaacuacauuucacaggaaauaauauaggaugugaaaccagccagaucugguucugaauccuagaagugccauuuuaauagcuaugagaccuugggcaaguuacuuaacuucucuaaccuuccauuuccucaugcaugaaauggggaugaugaugauaaccuguguuuuugggugguuguaaggauuagauauauauauauaugucuggcuuauggcaguuauuuaauaagugguagcuauuauuuuuuuacuuuauaaacaaccaacuuuuagcuagcagaggucguuaagcuuuuaaaauuaugaguugguuuucaaaaagguuuggaaaaaaccaguaucuuacaacuagauaacauaagguuuaucuacaaguugacaaugaugaagucgucugaaaaagauggaaaaauugcacugggaaauagaacaacuuucacacucuccuuguaauaauuuguuccuacagcagauaauuuuaaugcucagccgcuuuuucuuuuucuucacuuuauaaccaaucauuguguguguagcuauacugcaucaacauuuucuuuugcaggaaugccauuuuucuuccaaaagaauuccauuccagcauuuccucucauguuuuucugucucucuuuuuuaauugcaugcagugcaugauaauuucuuuucuuucaugacauggcuuagccucacagacagcugaauguugucaccacuuauuuggaaaccucagggaauaauuguguuaccagcgucuguucugaauguuuucucauuuuucuccaauuuuagccaugacaguugaaaaagcaaguccagugggugauggaaauuuccggaaucguucugcuccaccuugugcaaauuccacaguugggguuguuaagaugacaccucuuucuuuuauuccuggagcaaaaauaacuaaguaucuugggauaauuaacauguuuuuuauucgagagacuacuucucuucgggagguaauuuuauagaaguuauuucauuuuuuaaaaaauuuucucugaagauuuaguaacaaaacuaaguuucaaauuguuauuuuuugccaaaaacuuacaaauauuuauuuauauuuuaauuaucuggauugagucuagaguuuauuucauuuagcagcgaggauuaucacaagaauuguguuaguuuuaaaccuauuuauuguuagaaaucuuagaaccuuaucauauaguaaauaaaacaaauaucuguguucaaauagaaguuuaaaauagcccugaaagaacagcuucguuuccucaguaauuuagcaauuuuugacagaucacauuuagaaauaguagaggacuguauuacagauacaugucuaaggagauacuuuauguaauuuagcucugcuguuucuuccuccugagaaaggaaugaagcugcucauuuuuuacucucucaguuaguguaugaggaugacauuucuucagucuuaccucacacugaguaucauuaaacuuuaauuugguuuuuaaauaacaaguuguaauauuuuacuugaugugggaaaaguucagaaucagagucagccuguuauaucuuuuauaacacaggaauuuaaacuuaaaaaaauuacguugugucauauguuaaggaacaggggcuaccaagcaaauuaauauggugaauagggaaauuuuuuaguuacugaggugugacauccaauaaccuuuucaaauuuuacuucagcugcaguuuguauuuuuaaaaaguauauucauuauaaagaugacuuagcugugcccuucuucaccagcaguauuucuauacuuucuuaggaauaacagccugcacacugucuuuaauaucauacucaccauccugcgccuagcacaguagcuggcauggaauaaacacaauauguuuuugugcaaauaaaugaauagcuucugacagauuauuuaauuaauuagauggauguuuucuuuaagguaaauuaggccaggcacaguggcucacgccuauauucucaccacuuugggaggcugaggcggguagauugcuugaggccagcaguuugagaccagccugaccaacaugacgaaaccccuucucuacuauaaauacaaaaauuagccgggcaugguggcacaugccuguaauccuagcuacucaggaggcugaggcacgagaauugcuugaaccugagagguggagguugcagugagccgagauugcgccauugcacuccagccugggugacagagugagacucuauccuuccccccaaaaaagauaaauuaguuuuuauaucacucuuaauuacguuaagaugaaaaauaaacuaugaagauauucucaaaagccuuuggauagagaauuaaaauagaugauacuucuacauccauuuaaauuugacaaagauuuggugcgaaaagcuggcauauauuaugaauuaaccuuuucuacuugcucuugguagcacauggauauuacacuauuuugaauccauaaaauuguauuuccuaagccuucuugacuacuuaagcucccauaccucaaaauguugcuucuuaguagguuuuccuucaacagaaacuuauaauaauaauuguguagcaccauaucccaaauguguuaauugccugagucguuuucuuacaguuaauuaauauuuuuaaaauuaauccucuguagcuacugugucaucagaauuuuuugauuuaauaaacaggaaauugauaaaacucaaaaaauauacugaacuaugauugaguuggaggcaggcugaagcaacucccuuaauucccuaacuacaaaaagagauaucuuuauacaacuauauguaggauccucaggcuuuucagaaggaugugacccaauaaaaugguuuucuaauacugcagucauuuuuccccuucacuuccaguuuaaaguuggaaauuuccuccuagacuguaaauaaguccaauagaauuuguggaaaccuagguugaaaagcauuucaagcuauugacuagccuuugauuucuguuuugcuuguuuuucaauaugggaaaaguacccugaacuacuggauuuuauuuccuuacaauuauauauggaauucuuauuauaugcaccuguugaacuagauguuagcauauaguuguaugcaaaacagauacagucccugaccuaauggaauuuacagucuaguagaacuggagcacgguggacauuaacaaauaaucauauaauuaguaucuaauuacuagggagaguaaguaauauaaagaaauugaacagaggcuaucagaguauauaauggacuucaacuuagaguucacagucagagaagguaucucggaagacauuauauguaaguugggaccaaggagugaaugaguuguucucugaaaaaaaaaaaaaaaaugaaaagucugcaggagcaacaugugccagugagccugagguaggaagagugcuugugcauuugagaaacugaaaaaaaggcaaguuugauuggaacaugguucagguucagaaugagagauauagauaacagguaaguuuuaucguuuaggcuuaucaucaauuuguuuaaaugaugaugagcaugauaugauggagauguugaagguggaggcacaauuugaauucuugccuugccauuuacuuacuagcuaauuugaucauagcuagucaugggcaaauuacaaauucuccgggcuucaguuuuaucaucuguaaaguaaagguaguaaauccuugccuggacauguguucagucaauguuuguucauucaugcaguaaauccccauugugagggaaguuuaaguuauuugguauauuaagauaauuuaggauguuuuaauauauauucuuugacauuuugugugcauuccuauauccauacacauguauauauaguaugauuuuccugugcacuauuauuuaggaaggaggagucagugguuuucuccaugcuuuuauugcugaaguguuugcaauggugagagcucauguugcugcauuaggagggaaugcuguugucuccuacauaaugaagcagugugucuucauggagaauccaaauaaaaaccagguaagaugcaguuaaaaauuccugauuggcgggaaccugagaauuucuuccauggcuuccuaccccuaacccccuccaaaagagaauugcucuuuagagcccuuugagucuagaugcguaagauauuuuaaugaguuuauucauaaccauggucauacauagucacaagucaauacaugcuauuucgacaucucagguaacuaggguauuauucuuaaucacaucuggaauuugugcuccugaguuacuguuuccacccucuuguugguagguguuuagaauacagugauagcuaacugaggagagcuaaagauauccuuuaguuuggacuaugaugcuguccaguuucagcugccuuacuaaugaagaguauaucauaguaaggccauaguaaggcuugcuuauuucuaguaaguaguguuauucucuuaauggggaugaaagcaguuaguuuaaaucuuaaaauaaauuucuaaauuuuguguuaagauaauucacuuaaaauuguuaaaauuuuuuaaaaauuaaucaacuauacuaaauaguaugaaaugccauaaaggcaguucuucccaaccugcuucucuuggcacacaucaaaaauccuauuucugugguccacugguacacugugaugaaugcaugaagcuguauguggcugcugguaauuggcccugcguuucugacccaagugacuccccuaagagcagaggggaucaauaucuuggcagacacagagcuuaagaagcucuaauauagacuaauuacuuaucauuuaagcaggaguaagaaugaauagauguguauauguauauauauuuuuugccccuaccuguacaucuagauaauuguaaccaaagacaaaucauuuaaauucuuaguaucauuuuuucauuaguaaaauuaucuuauagugaaagugaguugcugucauaaauauauaagcaguuugaaaagacauuauggaaaugcaaaauuguuuuagcuuuauuuaagagauaggguccugccauguuacccaggcuggacuugaacuccugagcucaagcgaucuucccaccucagcuucccuaguggcugggacuacuggcacaugccaccacaccugacugguuuuaguuuuauuuugaaaucaugaaguuuaaucaguuucuucagaaggguacuucauuuacuaaguucuuuucagguuuucuugauaguuuauacauuuuuguaacucacgguauacuaaacuucauuaacauguugaagaaacauagugauaaacaaaacuaugagacaaccuucugauaaauuuuggcaauggcuaaggcacguuagagggggaagggaagcuaugaaacauccuaggaggguuuuugguagauaauuggggcauaucuaaaagcucagugaggcuacugcaguucuggauucgcagcuagcuuauugauaagauuuggcgugaaggagauuguguggaguggucaaaagggguacauggggagaagaaagauugagaaaggaacagugagaaaggcgggagggaaaccaggagggcugcgaacuaccucuacacggaucguuugaaaguagaaguagaguggaaaccaggcacauccugagcaggaguauuugauaucacuugauauuaucuggucguaaagaacgcaucuauuagaucuugaaauuauauucaacuggauacuucuuuguaauaauuuauuugauauaagaggauuuucccuacuuuaagaauccuuuuuugcuuaauuacuuuguauuugagauugagauuuguaguuuuggguuuuucccaguguuaaauuuauacaacuuguucacugacuuaacuagcaccuuaacaagugccucaaaaucagcuuauccagaacagaacuuaucucuaugccucaguuuucucaucuauaacauugggauaaaaauuggggaaaucaugaguuaauauauguaaugugcuuagugcugguggauuguaagcacuguaaaaguuguuacuauuaucuuuuaaauguuugucuucaaugauuucuuacaagacaaagucaugcuucuuaauaugucauacaaggucuuccacauucucaagucuucuaccuuuucagacucaucuguugccccccucaccucuccuaacaugcccaagagguagauugcauuguuugguuuuccaaaugaacugugcuuuuuuuuuuucuuuuuucauuucuaguacuuuguaguguugauauuaacuccauuuuguaggugaaaaaaacugagggcuaaaaaacuuaaguuugguaugaggcuauaaguagaaaagcuagaauauacccagauuuuccaccaccagucgucuuccucuguacccaaauaauaacugucaauggcugauuaccacugauguguacacaucauaucaggugccaugauuuaugucauuagcuuuuucccccacuuuuaugugagaucuugcauauacacaaaaaguguagagaauugcacacagacauucuuacacgugacccucagcuuaagaaauaaaauauuaaaaauaugguugaagccucagugggccuguuuucucuuuauaaugaaugaaccaucuuaauuuuguugucauuccuaugcaugccuuuauaucuuaaaaaaauuaauuguaguuuuauuuuguaucuaaaauguuuuaauauauuuuugaauagguaguacaugauucaaaauucaaaaagguaugaauggaaaagucucuccuugucugcuguuccagccagucacuuuucuuccccacaugcaaccaaauuuuucauuuuuuuuuuuaugguaacuucuagagauguaacacuccagaguguguaaccagagagauuuuauacauacaagcaaauauauauaaauauauauucuuuuaucucccaguuuaauauaagugguagcuuuacaguacauauugcuccucagcugucucuuucaccugcuuuuucuuggcaacauuuucauuucaggacauaaagacuaccuuuauuguuuguuacaaccacauaacacuccaugguauaggucgaucggaauuucuuuaauuaguccccugcugauaaauauuuagguuauuuucaguaaauguugugcuaauacauacagugcuacaaaaacaaugugaugcauaagugauuagcacaagugugagcaucucuguagggaaaauuucuuaaaacagaauugcuaggucaaaguaguaccuuuguaauuuucauagagauuuccaaaguuccccuucauugagauauuuugcauauucuuuauauaaauauagaaggauauauauaauuauguaaaugauuuuauauuguauauaucauuuugcaaauuguucuuaauuuaucauaagauuuacccauauugauugagcuuuaggucauuuuucacuuccauauaguauuucaggcaugaauauuccacaguuuauuuucauuucccuuuugaugggcauuuaguuuguuucuaggauuuugcuaaacaugaugcagugaaaaguuacuuauuaaucuuuguugcauacauguccaagauuucucuagggaacacauauacauggaauuaaugggucagggaguguguucuuuuucugcuuuaggagacgguucuuuucaggaugguugcacuuccuguugcaguguuaaguguguugcucuugucccaugucuuuguuaacacuugguaacauccaacuuuuacauuuuuuugccaguauauaugaaguggugucucguugucauuuuaacuguauaucucuaauagcgggcuugaauauguuuucauauguucacaggagcuccuugaguuuucuuuccugugaauugcccucuuacccuuuucucauuuuucuguuggauugccuaucuuuauccuaaugauuuagaagccuguguuuuuuggcuguacagcacugccccuuauguaacagaagaguaugaauguguugaguauaacugaaccuguccuguuuguuguucuuauaggcacagugucuuauaaauguaaguggugaugcagugguuuuuguucgugaaucugacuuagaaguggugucaucucagcaaccuacuaccaacugccagucaucauguacugaaggcgaaguuacaaccugaggaaaauuaggaaaaaagagcucaacuaaaugaaauucaucaaucucuguuauuuugucauuaauuaucuucuuagacuuaaaauugaacuugagauaaauaaggaagaauugaguagauuugauuugccuggagucuuuuggaggcaugagaauuuucuaaucuugacauuuuguuugccuguucuagacaggcccuguggggucuugacccuucaguaaguuaagauaaauuuuuaaaagaaccguagcaaagauggaaccuuuguaauuuauguugauuuuaauaaaaucauaauuuaaaaaaugaaaugggaagauugucaggaaauuaggauagcuacucuaguauaauuuagaaaaacuaagcaagagauucuccaguugcuagugaguaagcacucugauuugagaaauguguggggacaauggagaaaaguuuucagaaaacugcuauguagauuucugaauguguuguauuuugcugaggaauucgguaacaacugaaagggaaaagugcuucagccaucuuuugaaaacaaguuaaaauucuggaacuuguaucuguaauacauccuaacucuuguaaaagaaaauaauuuaucauagcugguguccuuucauugaaaguuguaauacugucucuaaggagggaggaaaagauuauuauauaauuuuauaacuggcaacauuugaguuaguauugacuuugucuaaaagaggcuugacuucaacugggauaaaaaugucagugaauuuuguuaaaguaguaaaaaugcaguugacuuaguaggaacauaaaauuauuuccuaauaagauaauauugcacuccuaccaaauaaacaggauuuuaguaauaucugagggauuguugauggugaguuagacuguauuuggcauagaauuuggaaauguaacuugaauguaaauaugcugcaaaauguugaauguauacauagaaagacuuuuucugucgacgccaaaugcccguuguaaaugaaccuuaaauauuacauuccuccuuugcacaauaauauuucuuuauaacacuuaugauuuuuucccccaggacaacaaacugcccuuaagagucauuuccuuguuaucacaggugucaauauuuuucuguauuuuguuuauaauuuuauuuuuuaaauaaaaaguguauaaaaauaaacuggaauauuccua

SEQ ID NO: 14965 - RNA, 7427 nt, Homo sapiens
accccauggggaacaaugauuaacaacuuuggccaccacauaacccccaguaaaaugacaauuuuccauuagccuggaacuggaacugguuaaguccuaacuccuuagccuagaaugacagggggaaaaaacuaucaauggggacugcaaccgcugucucauccagcgcacacauccaaguuuucagaauaauagggggcuucucuuaguccuuaacucuuggcucuuuacuuaaaacaguaaccuccaugacuucaugcagaguucaggagcagccucagggcccugcugaacucaaaauuguuuauucacuacauugugaacccaaggagaccuauuucucuuaguggcuaaaguaaaccuaaaugcuucaaggucaacugcauaaagauaaacugcauugccuggugugguggcucacgccuguaaucccagcauuuugagaggccaaaguggguggaucacgaggucuggagauggagaccauccuggauaacacagugaaaccccgucucuacuaaaauaauacaaaaaauuagccgggcguggugaucagcaccuguaaucccagcugcucuggaggcugagacgggaaucgcuugaacccgggagagggagguugcagugagccaagaucgcaccacuacacuccagccgggucaacagagcaagacuccgucucaaaaaaaaaaaaagauaaacugcauuaauucauauaaguuaacauaucaaagaagaacaaauuugccauagccacacuaguuacauuuuugcugggcaaguguuuuaugauacauaauuuguaaaaagaccaacaacuaaaaaggacaacuuaagccaggucccugaaagcuuucacaaguuacaaauugugaauuaaaugaagcugugcuguuaggcauuaaacagguuauaguuugcaauucgaaauuacaucuauguauauuuaauuuuaaauuaugugaaaagaacaugguuccgaagagguguuuuuuguuuguuuuguuuugagacagggucucaaaaugaauuuugcccagguuggagugguggaacaaucacggcucacuacagccucaaccuccugggcucaagcgauccucccaccucagccucucaaauagcugagacuacaggcacacgccaccaugccuggcuaauauuuuuuuacuuuuaguagagacaaggucucacucacuauguugcccaggcuggucucaaacuccugagcucaagccauccuccagcccuggccucccaaagugcugagauuacagguacaagccaccaugcccagccuaagaaucauucuuaguaagauuauuucacgcugcuaauggcucucugccaaaagaaaaaaaaggaaguuuaaagaaugaaguaguuaauauaguggguuaaauacccucaucuaauuuuacucccuuccaaaacuacuaaaucuacaguaaaaugauauaaaaauaaauuggaaaaauggggacaggagguaacagcaauaaaacucagaagcuggaaaacaggugaaugaaugugacuuagcacaccagaaaaacccaauucacucugcagaauucucaaaaggcacugaaacacgcacccugaaauuggaaguggacuacaugaaagcuauuugagaaacaccucuaaguaacucuacccccuuacucccauagaagacuagagguuuauuucuggacaaaguaauacuagucccuggacuggggcauccucaggcauucuagagaagcacacuggaaacaaaguuaagugaauuuaggaauacauaaugcuggaugcagggcccgcauuccucuuauccuuagaagacuggaagacucaacucugaggaacugaccagcccaggaggagcaauccaagauagugacaucagagguuccccaguaaaggcccacccagagcacccuaagugaagcccagagucuauaugcuucacccacguauacagaucuaaaaagcuuuuuugucuuuucauucauaagaguagacagaaaagaaugaccagacuuuggaagaaagcucagaagugauagagacagaagcaagcagaaaagcaauuugaaguaaaacagcucagaagugauaagagacaaaagcaagcagaaaagcaauuugaaguaaaacaacagaaaauuucaagaaagcaagaaucagugaacuuggaaagaaaaaaugccuacauaauaugcuuguuaugugaauuagcucauuaacuaguaguaaguacaauuuaacaaguauuaauguagaaguauuuuuuucccuaggaaagaggagccagaaaagcaguaaauguaugaccuucaguuaagaaaaggucauggcuucacugcuaugcuggcggcaagugucuuucagauuuuuucauugauucaaguguauauuccaggguuccuuccccagagaggcauaccccaaguucuguguagccaucgacugaggacagguagagucaccuauccuacccacgaauuggcagccuugugguuuagauggauuucuacuuccauguguuauuucagcaucucuuagcucuguucuuagacuuuggcuggcauuucuauuauuuuuuuaaguuuugcugaaguagaauugacacugaauuacacuuacaaaguauaauucgauaaauuugguucauauauauacacaucuauauaugcauauuuauagauauauaugugcuauaauauauacuacauauaguauaauauauaguauacauauuuuuguuuccauagaaacaaaaauaaaaggaauuacuauguacuauauacuauauauaucuacuauauacuacguaguauguacuacauaguacauauaguacauauaguacauacuguacuauguaguauauaguaauauauauaguacauaacuauauauguacuacauaguacauacuauguaguauaugguagauauauauaccauaguauacuauauacuaaaaauggcuggcuaccucuguuugucaauauauauuuuaauauauuuuugcaaguaauagaaaugccagcaaaagucuaagaacagggcuaaguggugggaaaacuacauacuauauacuauauaguaucuauacuaauuauauagauuuguauauauacauauauguauacauacacacacacacacacacacacacacacaaugaagccaucaccacaaucaagacaauaaauauauccacuauccacaaagguugccuugugcaucuuugauuccuuccuggucuccagccccuacucccauucccaggcuacucuauuauaauuuuugaguauuuuuaacaucucuauaguagucuccagcuaugcugagagcaaucugaguggucaaaauuaacuguccaggaagagcagaaaugaacaacucaguagaacacuuggaagaagaaaaugagaaaaucccccauacaacuaaauaaaaggcugggcgcagaggcacacaccuguuaucccagcacuuugggaaaccaaggagaguggaucaccucaggucaggaguucgagaccagccuggccaacauggugaaaagccaucucuacuaaaaauacauaaauuagccaugcuuaguggcaggcaccuguaauuccagcuacuugggaggcugaggcaggagaaucacuugaacccaggaggcggagguugcaaugaguugagaucaggccauugcucuccagcgugggugauaagagcgaaacuccaugcuuaaaaaaaaaagacaaauggaaaauaguacagaaaaaaggaagagaacauguuuagaaguucaaacauccaaauaauaaaaguuccaggaagggagaaaaaagaaaauggaggagggaggaaaucaugaaugaaaucauuuaaaauuuuuucccaaauugaaggaaacaaguguccagauugcaagggccaacugaguguccaguacaauggauaaaaauaaauccauuaucaacacaucacuaacauuucaaaaucuucauggagaagauucuguaaguuucuggggagagagagaaaaaauacaucacauacagaggaucacuuaccaggacugcuuugaacuuaauagcaaugguaaaagcaaacagacgagcaacuacuucaaaauguugaaaagaaaauuauuuccagcuuucaauucuauacucagacaagcuaucaaacagauagagggagccagccauuuuuagacauccagggucucauuuaccuuccauguacccuuuucaagaaguuaggaugugcuccacagaaacaaaaauaaaaccaggaaauggaacacuuuggaauguagaaaaugggauaaucaacauagaggauaggcaagaggaauuucugggagcauggucaaguaggauuccagcaccacaguugugcuucuugauguagagagcagucaguccagaaucaagcagcaugacucacauugauggcuauuaucacuaagaucccugcugccauuguaucaucuuuuuaaucugaggacauuaugcccaggcaagccuggcucagauucuuaccgguauuugccuugucuugaccauguggugaugaaauuccugcucucuucugugcugugcugacuggaccaacugaggacacucauuuuuacccuucuuuuucaaccuauuccugaaagcugauguugggcguuggugagcuuaaagcagaaaauagccuuccuccuucccauuuuugcuauguauuggccagaaaucagguaucaauucuacacuuugaucuuuccacaugcuucaguugugaggagcccaguauucacucaugacauugcaaauuaacuucucuagaagggauccagaaagccuggagaagguaaagccagacuagggcuguuuggcuuuaauuaacagcagcauuguugcccuuuuccuugcuagauucgugcuugcugcucaaauugccaaaauuaaauauuuagggcaauguucaugagugcugggaaaacuaaagagaauaagcaggaagucauuagaggcuaucuugguagagauggggaaggagaagcaauuggagaggggcacaugggggcuucuaagacuuuuguuucauaacuugaaugauggguacccagauguauauuuuacuuuaauuuguacauucauauuuuaugcaguuucuaugucuaauacguauaaaaauuucagauuaaaugaaauacaugaaggcacuggcacccugccuuucaaauuguaaaagguguaaauuuugcaaaaugccuaaaggggcaggugaggucacaaugagaaucuacacuauuguacuucgggguucaacccaaacagaaguuaacaggagaacuuaaauuauguagcgcaugauuuuuaauugaguaugguacuguaauuuuaauccacauuuucugcuaguuaacuauaaaauaacccuuaaaacugaucuaaaagccuauuuuaaaaauauaaguugcggccgggcacgguggcucacgccuguaaucccagcacuuugggaggccaagguggguggaucacaaggugaggagaucaagaccaucccggccaacauggugaaaccccgucucuacugaaauacaaaaaaaaaaaaaaaaaaaauuagccaggcgugguggcgcgcacacguagucccagcuuacuggggagacugaggcaggggaauugcuugaaccagggagguggagguugcagugagcugagauggcaccacugcacuccagcuuggggacagagcaagaauccaucucaaaaaaaaaaaaguugcuuccugcuugccuaucagaguaauucaguccaaaagucauuacguggggcugagcaaggcaggcaucuggggaaggugggggcgagagaaaggcuggcaagguaguagcccagcaggggauacuggagcccaaaugcagugaggagggccucuggggguagggacuugugcacagcagcagccuagcaggggaugaggagggcauccuauuagggugaaggaaaugguggcacagguuuuuggaaugggaacaaaaggugagccuuacccaggagggaggaaauggugcaguguaaguugcuugagcccaagaaggguagguugggggaaagggggaagagaagaccaugcaugugggaugguggcaguggcacucuggcauuagguggcagagcucagagaguagagugugugcgccgaauggugacagcaagaggauuuugauuacauagugagagaaggggugaugauuauaaaaaguaaauuuauuaaggacaagugggaaccagacuucucacuguucagcaagaguauuaaacccauguaaagaggggaaaugaaaauaaacccuguaguauuggaauugaauguuagguagcagauuauauggagauuaauauaaaagucauacacacauacaacaccuaaauccguauguauauacacuugcagcuuugucacuuagaggaccugggaacagugacagucccauggugauuagcauuuuuagcacccagaccuugguuucuaaagcauuccauccagauuauaguuucuaaaugcuauucuccauuaaaaggacuagguuccuuggagaaauaauuuuacaauggacaaucuuagcaaauacauuaauuggguaaucaaaguuaucaaucacaauggaacaaauugcaguugcauccaccugauaggaugcaauguuaagagcuuacuauucaacucuaacagguagugggaauuauuuucuagguuuagacugucaugaugccuuuaaguuuggagccuccucuacaaaguagaguuaacacauuacacauaaagaagcaugauuuugccuguuccucagggacacccucuuacagguuguucauuuggccucuucaccaccaaucuuacugcccaucuacuauuccaaccugcuuaacucacccaguuucugcuaguuuucagccucccuuuggauaagcacccaucagcauuugaucaggcuucugcucaauguccuucaaguggcucuggccuugccuugagagcaggguaaagauaaucucuuguuuguugauaaggaaaacucaggcucagcaagguuaauuaaucuguacauuaugcaacuggaauuuaaaucuaguuuaacucauuccacuguggcauaaaaggagguacacguaccuaucugugaugacaauccacuuucucauuuccuucaugugacuucucacaaucacaauugucuuugcuuaugucucccauaggaaaacgucaauuaugacagcagguaauuuuaucggaaguguuuauaacuauaucccaguacguggaacgaaaaaguuaucaagaaauauuuauugaauguaaaaaagguuaccauuuucucaauguguauaaccuuuuuuuauuuuuuuaagacuacaaugcagcuaauugca

SEQ ID NO: 14966 - RNA, 7427 nt, Homo sapiens
ugcaauuagcugcauuguagucuuaaaaaaauaaaaaaagguuauacacauugagaaaaugguaaccuuuuuuacauucaauaaauauuucuugauaacuuuuucguuccacguacugggauauaguuauaaacacuuccgauaaaauuaccugcugucauaauugacguuuuccuaugggagacauaagcaaagacaauugugauugugagaagucacaugaaggaaaugagaaaguggauugucaucacagauagguacguguaccuccuuuuaugccacaguggaaugaguuaaacuagauuuaaauuccaguugcauaauguacagauuaauuaaccuugcugagccugaguuuuccuuaucaacaaacaagagauuaucuuuacccugcucucaaggcaaggccagagccacuugaaggacauugagcagaagccugaucaaaugcugaugggugcuuauccaaagggaggcugaaaacuagcagaaacugggugaguuaagcagguuggaauaguagaugggcaguaagauugguggugaagaggccaaaugaacaaccuguaagagggugucccugaggaacaggcaaaaucaugcuucuuuauguguaauguguuaacucuacuuuguagaggaggcuccaaacuuaaaggcaucaugacagucuaaaccuagaaaauaauucccacuaccuguuagaguugaauaguaagcucuuaacauugcauccuaucagguggaugcaacugcaauuuguuccauugugauugauaacuuugauuacccaauuaauguauuugcuaagauuguccauuguaaaauuauuucuccaaggaaccuaguccuuuuaauggagaauagcauuuagaaacuauaaucuggauggaaugcuuuagaaaccaaggucugggugcuaaaaaugcuaaucaccaugggacugucacuguucccagguccucuaagugacaaagcugcaaguguauauacauacggauuuagguguuguauguguguaugacuuuuauauuaaucuccauauaaucugcuaccuaacauucaauuccaauacuacaggguuuauuuucauuuccccucuuuacauggguuuaauacucuugcugaacagugagaagucugguucccacuuguccuuaauaaauuuacuuuuuauaaucaucaccccuucucucacuauguaaucaaaauccucuugcugucaccauucggcgcacacacucuacucucugagcucugccaccuaaugccagagugccacugccaccaucccacaugcauggucuucucuucccccuuucccccaaccuacccuucuugggcucaagcaacuuacacugcaccauuuccucccuccuggguaaggcucaccuuuuguucccauuccaaaaaccugugccaccauuuccuucacccuaauaggaugcccuccucauccccugcuaggcugcugcugugcacaagucccuacccccagaggcccuccucacugcauuugggcuccaguauccccugcugggcuacuaccuugccagccuuucucucgcccccaccuuccccagaugccugccuugcucagccccacguaaugacuuuuggacugaauuacucugauaggcaagcaggaagcaacuuuuuuuuuuuugagauggauucuugcucuguccccaagcuggagugcaguggugccaucucagcucacugcaaccuccaccucccugguucaagcaauuccccugccucagucuccccaguaagcugggacuacgugugcgcgccaccacgccuggcuaauuuuuuuuuuuuuuuuuuuuguauuucaguagagacgggguuucaccauguuggccgggauggucuugaucuccucaccuugugauccacccaccuuggccucccaaagugcugggauuacaggcgugagccaccgugcccggccgcaacuuauauuuuuaaaauaggcuuuuagaucaguuuuaaggguuauuuuauaguuaacuagcagaaaauguggauuaaaauuacaguaccauacucaauuaaaaaucaugcgcuacauaauuuaaguucuccuguuaacuucuguuuggguugaaccccgaaguacaauaguguagauucucauugugaccucaccugccccuuuaggcauuuugcaaaauuuacaccuuuuacaauuugaaaggcagggugccagugccuucauguauuucauuuaaucugaaauuuuuauacguauuagacauagaaacugcauaaaauaugaauguacaaauuaaaguaaaauauacaucuggguacccaucauucaaguuaugaaacaaaagucuuagaagcccccaugugccccucuccaauugcuucuccuuccccaucucuaccaagauagccucuaaugacuuccugcuuauucucuuuaguuuucccagcacucaugaacauugcccuaaauauuuaauuuuggcaauuugagcagcaagcacgaaucuagcaaggaaaagggcaacaaugcugcuguuaauuaaagccaaacagcccuagucuggcuuuaccuucuccaggcuuucuggaucccuucuagagaaguuaauuugcaaugucaugagugaauacugggcuccucacaacugaagcauguggaaagaucaaaguguagaauugauaccugauuucuggccaauacauagcaaaaaugggaaggaggaaggcuauuuucugcuuuaagcucaccaacgcccaacaucagcuuucaggaauagguugaaaaagaaggguaaaaaugaguguccucaguugguccagucagcacagcacagaagagagcaggaauuucaucaccacauggucaagacaaggcaaauaccgguaagaaucugagccaggcuugccugggcauaauguccucagauuaaaaagaugauacaauggcagcagggaucuuagugauaauagccaucaaugugagucaugcugcuugauucuggacugacugcucucuacaucaagaagcacaacuguggugcuggaauccuacuugaccaugcucccagaaauuccucuugccuauccucuauguugauuaucccauuuucuacauuccaaaguguuccauuuccugguuuuauuuuuguuucuguggagcacauccuaacuucuugaaaaggguacauggaagguaaaugagacccuggaugucuaaaaauggcuggcucccucuaucuguuugauagcuugucugaguauagaauugaaagcuggaaauaauuuucuuuucaacauuuugaaguaguugcucgucuguuugcuuuuaccauugcuauuaaguucaaagcaguccugguaagugauccucuguaugugauguauuuuuucucucucuccccagaaacuuacagaaucuucuccaugaagauuuugaaauguuagugauguguugauaauggauuuauuuuuauccauuguacuggacacucaguuggcccuugcaaucuggacacuuguuuccuucaauuugggaaaaaauuuuaaaugauuucauucaugauuuccucccuccuccauuuucuuuuuucucccuuccuggaacuuuuauuauuuggauguuugaacuucuaaacauguucucuuccuuuuuucuguacuauuuuccauuugucuuuuuuuuuuaagcauggaguuucgcucuuaucacccacgcuggagagcaauggccugaucucaacucauugcaaccuccgccuccuggguucaagugauucuccugccucagccucccaaguagcuggaauuacaggugccugccacuaagcauggcuaauuuauguauuuuuaguagagauggcuuuucaccauguuggccaggcuggucucgaacuccugaccugaggugauccacucuccuugguuucccaaagugcugggauaacaggugugugccucugcgcccagccuuuuauuuaguuguaugggggauuuucucauuuucuucuuccaaguguucuacugaguuguucauuucugcucuuccuggacaguuaauuuugaccacucagauugcucucagcauagcuggagacuacuauagagauguuaaaaauacucaaaaauuauaauagaguagccugggaaugggaguaggggcuggagaccaggaaggaaucaaagaugcacaaggcaaccuuuguggauaguggauauauuuauugucuugauuguggugauggcuucauuguguguguguguguguguguguguguguauguauacauauauguauauauacaaaucuauauaauuaguauagauacuauauaguauauaguauguaguuuucccaccacuuagcccuguucuuagacuuuugcuggcauuucuauuacuugcaaaaauauauuaaaauauauauugacaaacagagguagccagccauuuuuaguauauaguauacuaugguauauauaucuaccauauacuacauaguauguacuauguaguacauauauaguuauguacuauauauauuacuauauacuacauaguacaguauguacuauauguacuauauguacuauguaguacauacuacguaguauauaguagauauauauaguauauaguacauaguaauuccuuuuauuuuuguuucuauggaaacaaaaauauguauacuauauauuauacuauauguaguauauauuauagcacauauauaucuauaaauaugcauauauagauguguauauauaugaaccaaauuuaucgaauuauacuuuguaaguguaauucagugucaauucuacuucagcaaaacuuaaaaaaauaauagaaaugccagccaaagucuaagaacagagcuaagagaugcugaaauaacacauggaaguagaaauccaucuaaaccacaaggcugccaauucguggguaggauaggugacucuaccuguccucagucgauggcuacacagaacuugggguaugccucucuggggaaggaacccuggaauauacacuugaaucaaugaaaaaaucugaaagacacuugccgccagcauagcagugaagccaugaccuuuucuuaacugaaggucauacauuuacugcuuuucuggcuccucuuuccuagggaaaaaaauacuucuacauuaauacuuguuaaauuguacuuacuacuaguuaaugagcuaauucacauaacaagcauauuauguaggcauuuuuucuuuccaaguucacugauucuugcuuucuugaaauuuucuguuguuuuacuucaaauugcuuuucugcuugcuuuugucucuuaucacuucugagcuguuuuacuucaaauugcuuuucugcuugcuucugucucuaucacuucugagcuuucuuccaaagucuggucauucuuuucugucuacucuuaugaaugaaaagacaaaaaagcuuuuuagaucuguauacgugggugaagcauauagacucugggcuucacuuagggugcucugggugggccuuuacuggggaaccucugaugucacuaucuuggauugcuccuccugggcuggucaguuccucagaguugagucuuccagucuucuaaggauaagaggaaugcgggcccugcauccagcauuauguauuccuaaauucacuuaacuuuguuuccagugugcuucucuagaaugccugaggaugccccaguccagggacuaguauuacuuuguccagaaauaaaccucuagucuucuaugggaguaaggggguagaguuacuuagagguguuucucaaauagcuuucauguaguccacuuccaauuucagggugcguguuucagugccuuuugagaauucugcagagugaauuggguuuuucuggugugcuaagucacauucauucaccuguuuuccagcuucugaguuuuauugcuguuaccuccuguccccauuuuuccaauuuauuuuuauaucauuuuacuguagauuuaguaguuuuggaagggaguaaaauuagaugaggguauuuaacccacuauauuaacuacuucauucuuuaaacuuccuuuuuuuucuuuuggcagagagccauuagcagcgugaaauaaucuuacuaagaaugauucuuaggcugggcaugguggcuuguaccuguaaucucagcacuuugggaggccagggcuggaggauggcuugagcucaggaguuugagaccagccugggcaacauagugagugagaccuugucucuacuaaaaguaaaaaaauauuagccaggcaugguggcgugugccuguagucucagcuauuugagaggcugaggugggaggaucgcuugagcccaggagguugaggcuguagugagccgugauuguuccaccacuccaaccugggcaaaauucauuuugagacccugucucaaaacaaaacaaacaaaaaacaccucuucggaaccauguucuuuucacauaauuuaaaauuaaauauacauagauguaauuucgaauugcaaacuauaaccuguuuaaugccuaacagcacagcuucauuuaauucacaauuuguaacuugugaaagcuuucagggaccuggcuuaaguuguccuuuuuaguuguuggucuuuuuacaaauuauguaucauaaaacacuugcccagcaaaaauguaacuaguguggcuauggcaaauuuguucuucuuugauauguuaacuuauaugaauuaaugcaguuuaucuuuuuuuuuuuuugagacggagucuugcucuguugacccggcuggaguguaguggugcgaucuuggcucacugcaaccucccucucccggguucaagcgauucccgucucagccuccagagcagcugggauuacaggugcugaucaccacgcccggcuaauuuuuuguauuauuuuaguagagacgggguuucacuguguuauccaggauggucuccaucuccagaccucgugauccacccacuuuggccucucaaaaugcugggauuacaggcgugagccaccacaccaggcaaugcaguuuaucuuuaugcaguugaccuugaagcauuuagguuuacuuuagccacuaagagaaauaggucuccuuggguucacaauguagugaauaaacaauuuugaguucagcagggcccugaggcugcuccugaacucugcaugaagucauggagguuacuguuuuaaguaaagagccaagaguuaaggacuaagagaagcccccuauuauucugaaaacuuggaugugugcgcuggaugagacagcgguugcaguccccauugauaguuuuuucccccugucauucuaggcuaaggaguuaggacuuaaccaguuccaguuccaggcuaauggaaaauugucauuuuacuggggguuaugugguggccaaaguuguuaaucauuguuccccauggggu

SEQ ID NO: 14967 - RNA, 1036 nt, Homo sapiens
augugcauuccugauuccuuuugguuccaaguccaauguggcaacucucaaggaucagcugcuucauaaucuucuaaaggaagaacagaccgcccagaauaagauuacaguuguugggguuggugcuguuggcauggccugugccaucaauaucuuaaugaaggacuuggcagaugaacuugaucuuguugaugucaucgaagacaaauugaagggagagaugauggaucuccaacauggcagccuuuuccuuagaacaccaaagauugucucuggcaaagacuauaauggaacugcaaacuccaaacugguaauuaucauggcugggacaugucagcaagaggaagaaagccgucucaauuugguccagcguaacgugaacaucuuuaaguucaucauucuuaauguuguaaaauacagcccgaacugcaaguugcuuauuguuucaaauccaguggauaucuugaccuacguggcuuggaagauaagugguuuucccaaaaaccauguuauuggaagugguugcaaucuggauucagcccaauuccguuaccugaugggggaaaggcugggaguucacccauuaagcugucauggguggguccuuggggaacauggagauuccagugcaccuguauggaguggaaagaauguugcuggugucucccugaagacuccgcacccagauuuagagacugauaaacauaaggaacaguggaaagagguucacaaacuggugguugagagugcuuaugaggugaucaaacucaaaggcuacacauccugggccauuggacucucuguagcagauuuggcagagguacagugaagaaucuuaggcaggugcacccaguuuucaccaugauuaagggucucuauggaauaaaggaugaugucguccuuaggguuccuugcauuuugggacagaauggaaucucagaccuugugaaagugacucugacuccugaggaagaggccuguuugaagaagagugcagauacacuuugggggauccaaaaagagcugcaauuuuaaa

SEQ ID NO: 14968 - RNA, 3191 nt, Homo sapiens
aaguuauagauaccugaaagcuggguuggucuacuucaggaacauugcuuuaagugauguauuuuaaaauaacccgcuucauauguaugaucuguugguguacacaccauggguaagguauugcuugcacauaauuugcucugcauauuauggaccauugugguuucuuccagucacuuagauggaaaggagguuaaaccuagguacuuuuuagcaaggauauaaagucaaauucagcauauguuuuuauuuuuaggcuugacuuuuacaagacauuaaucuccauuuguacauauguuauuuuauuuguaaaaccaaauaugacucaacaccuuuuugaugaguagugacuuaacuaagauuuacaaguaauauuuagacagauucagucagacaccacuuagccauuuuuacauucccucugguuagauuugguacaguauaauuaagacuuuaaucugaaauuuaaaguaguuuuaauucugaagaaguuacauccucuguauuauuuacaugcaacaaaauaaaaguggauuaauauaguaaugccaugguaacaauagagcuaugucuuaugcaugaaggcaacuuuggauguuuuaacacauuugacugacuuugguuuagugaaugcugacaaugcugcucuacuuagguuuccuaugaaauuuuuaagaauggcuaugagacuguauagaagcuucuagagaacugaaagucauaaugcagaguugccuuuucuagugcagcuaaguggcggaccucaacugaagauaugaguuucuuuggguucuuggaguuaucaaauugaucuugccauuauguuacuuugcaaauaacugaaguaaaugauucuuaccuaaauaaccacaaccuguacacauuugcucacaauuuauaguaguuauuuucuaucuaccuauauuuaaaauuaggaugauuaaaaaauaauuuauagauuuugugacaguaaugauuuacauaugcccaauauaugccuuauuuuuaaauaagucauucuguauaaagucauuuuguuguuguucagagaaaucaagaucuuauucacaaagaaaaacauuuuauaaauugaucgcauuuucuuuaagucaaaauguuaaacuggaggcaguauuaaacuuugcaauuaggaguuucagagaugccuuggcauaccacgaaaaacacugucaauauccaacucauuauaaauuguuaucagaauuaaccuaauaacuuuaaguaaggacaagcagcauccuagcaacuuguaguagucuuggguucccagcagaguaucacaguuaaccucucugacaacuucaucagaauuuccaagcugccaaauaaucuucauagaccuaauuacagauuuaaaaaaauuuccuaggcgacgaaaguauagaaaugugaauauguugaauacauugagaagcuguacuuuuuaauuaguuauauuacuucuggaagcacauaucuaaggaauauuuucuaagacucagagggaaaaaaacucguuuucauaggaucaucugaagauacuuuaguauauuugugaucauuuuuaucuauugcaaauacaaaugaauuagauaagugccacauccuggauacauuucggagggguagugggcaaugguauacaaaaauaccaaauauaaaauuuucaucugggggaauguucagguucuaaauacuaaauuagauuucaauguuuuguguuuuuuuuaaaaaaaucauauugcaacuuguuuuauugugauuuucuacaaguauuaaauacauuuaaagaucuuuuuaucuuaccaagaaauaauuuggaauagcauugguauauuugaccuuuugagugucugucauccucagagaauggcccauaguguguugccuguggacauaguguccauagucccuuucuuguccuucugagauauuuugguuugauaacauuuuguuuuuugucuugaugcacagggacuuuuuuauaauaugagacuucaguugguauuaauaggaguuaccuauuuaauucucccagucaucaaugagguaaucaucaauuccuauaguucaaauuagucauaaacaagagcuacagcaagacugauagaguaaaaacuauauaaauacaguaaaaaaaaaauagaauuuauggugugaaauaugaaguauagcaauauauaacaagaacauguaagcacuugcuuccacagcauaaauguaauuuacaucugcauuaaaggauaauuuucucugugaauaagagcaaaauggucuucagagaaacagacuguucauuugaagccauuucuguaaacaucuuccaagauagaacuguaauggauugaggaaauaacacagaaaagacaaaaacuuuugauuucaggcaugcaaagugcuugggcagauggacaguucccauugugcauugccuuugauaaauuuggccuuaauuuauauaacgaugcuguguucacaucccucuccuaccuaaaguugucuuuauugguuuauauuguguuaaaauuagcuuauaauuauuacuuuuguauuguguucaguuuuuuaaguugcauguuuauacuauuugcuacaguauuuuuaaguuuggggugaaggccaucagcuguaucaaaaagacaaaacaaucacuauuuauucaguauugcugcuuuacaucuccagaauaagcuuucgaugccaggacagugacugccugaaagcugcaggagcucuuuucaaugcauuuuauauauuuuuagaaaccaaauaaaugcagaaaacuauuucguauacuaauuauauuaaaccagcagaaauauaaaggcaauaaaguauauacauauauauggggggaggggaaagauuaaaaaauagauuuacagccagacauggugauagcccuaaauguauuucucaauauguuuuucuuuauugacccuaggaggauuugaguugcugcagcuuuaaacagaaaauugccauguucacuaauugugagcacauaaauaugcuuuuaguacugcuuugcuuauguacaaauaaaucuguaauauguauuauauguaauuauccuuuucuuugacuuucauuuuaaauguauauuuucugaucauuaugagcuguaaaacaaagaaucaauauuggauauucucccaaauaauaaauuuucaggauucauuggggcauua

SEQ ID NO: 14969 - RNA, 9188 nt, Homo sapiens
gcugggugcuggucuggccggcgacgcgcgugcccuguggccaaacacugccuggagugagagcaaacuaccagcgcaguggggccggcgcgagugugcgugugugugcgugugugugugcgagcgcgguggaggggggggaccaacugcuucacacuuucaacacugcacugaagagggagagcgagagagagacuggagacgcacagauccccccaaggucucccaagccuaccgucccacagauuauuguacagagccccaaaaaucgaaacagaggaaacgaacagcaguugaacauggacgaaggaauuccucauuugcaagagagacaguuacuggaacauagagauuuuauaggguaaggugcacgcacccuugcgaauaucugucuaggcuuugguuugauuuuuuucuucuccagaaagugguauggagcuggcgagggcagagccccuccccgaaugggugccugaugcugauuucuguuuugcagacuggacuauuccucuuuguauauguguaaacccaaaaggagcaugaaacgagacgacaccaagguaaguguaaguucccgauauuccucauaaccugcauggguaguuaauuagagccauugauuucacagugaagcucugcccgcaaauauauuccagccccugagcuuccccaacugugaauuuuaaguggcuugcuggguacucucagggggauauuaaacaucauaccugaauuuaaauugcauugcagaacaguccagaggaaagagguuucuuggguguaguuuaucacauaguauguuuuauggugggggggcggggggggcagacgaggguaauauccaauaagugaauguuucgcuuacuguuuucucuuuuccaugacucucauauauuaaggauaccuacaaauuaccgcacagauuaauagaaaagaaaagaagagaccgaauuaaugaaugcauugcucagcugaaagauuuacugccugaacaucugaaauugacaguaagaugcacauuuucauucuuugcugcucuccaagggcguguuaauagucuggugcgacucccagaaaauauaagaauaaauguaaauauaaguuccugacuuaaaacuugugcuauaccguacagaguuucccgcaaacuggaguaggugcucccagcugaaggcaagaaaucauuuauaaccugucuuguggaaagcucaagaaguaaaagaacaguacuucuuucaaaguguuugcuuaaauugcugugcugaauggacagccaauuaagccaaauguguguuuuuaaguaaccaagugcccguuucuuuuuugcaccacugcagacucugggacaucuggagaaagcuguagucuuggaauuaacuuugaaacacuuaaaagcuuuaaccgccuuaaccgagcaacagcaucagaagauaauugcuuuacagaaugguaagucaguucagggaggccagccuacccugaugaagcggggcagcccacaggggagcagugucaggacucccucacccgcaccccaucucuuuccgugggcucauggguucccucucauuuguuaaauugcuuauacuuucccuucauuggaacgagcccauuucccgaagcauccuagaggcuuucagcagaacucggaggaaucaggauuuaaaguggcgguugcacccgcuccacuuugguuuucagcugggaggagagcgcccucuccccgcuccgcaccuccgccaccccgcuucucucgucaacugguggauuauaucacuugaauacuggggaaaaaccgagaucacuuuagucgaugcagggcccacgugauaagcagauguuuuaacguggguauguuucuucuugccuccacuccuccgucccccacccccaucccuuccucauccuaggggagcgaucucugaaaucgcccauucaguccgacuuggaugcguuccacucgggauuucaaacaugcgccaaagaagucuugcaauaccucucccgguuugagagcuggacacccagggagccgcgguguguccagcugaucaaccacuugcacgccguggccacccaguucuugcccaccccgcagcuguugacucaacaggucccucugagcaaaggcaccggcgcucccucggccgccggguccgcggccgcccccugccuggagcgcgcggggcagaagcuggagccccucgccuacugcgugcccgucauccagcggacucagcccagcgccgagcucgccgccgagaacgacacggacaccgacagcggcuacggcggcgaagccgaggcccggccggaccgcgagaaaggcaaaggcgcgggggcgagccgcgucaccaucaagcaggagccucccggggaggacucgccggcgcccaagaggaugaagcuggauucccgcggcggcggcagcggcggcggcccggggggcggcgcggcggcggcggcagccgcgcuucuggggcccgacccugccgccgcggccgcgcugcugagacccgacgccgcccugcucagcucgcugguggcguucggcggaggcggaggcgcgcccuucccgcagcccgcggccgccgcggcccccuucugccugcccuucugcuuccucucgccuucugcagcugccgccuacgugcagcccuuccuggacaagagcggccuggagaaguaucuguacccggcggcggcugccgccccguucccgcugcuauaccccggcauccccgccccggcggcagccgcggcagccgccgccgccgcugccgccgccgccgccgcguuccccugccuguccucgguguugucgcccccucccgagaaggcgggcgccgccgccgcgacccuccugccgcacgagguggcgccccuuggggcgccgcacccccagcacccgcacggccgcacccaccugcccuucgccgggccccgcgagccggggaacccggagagcucugcucaggaagaucccucgcagccaggaaaggaagcucccugaauccuugcgucccgaaggacggagguucaagcagagugagaaguuaaaauacccuuaaggagguucaagcagagugagaaguuaaaauacccuuaaggucuuuaagggaggaaguguaauagaugcacgacaggcauaaacaagaacaacaaaacagguguuauguguacauucggaguuccuguuuugcucaucccgcaccaccccacccuccacacacuaacaucccuuucuuccccccaccagcuguaaaagauccuaugcgaaagacacuggcucuuuuuuuuaaucccccaaauaaauuuugcccccuuuuaggccauguuccauuaucucuuaaaauuggaaccuaauucgagaggaaguaagaagggucuguucuguggcugagcuaggugaaccccgggguaggggaaagauguuaacaccuuugacgucuuuggaguugacauggaacagcagguaguuguuauguagagcuaguucucaaagcugcccugccuguuuuaggaggcguuccacaaacagauugaggcucuuuuagaauugaauuuacucuucaguauuuucuaauguucagcuuucuaaaaggcauauauuuuucaaagaagugaggaugcaguuucucacguugcaaccuauucugaagugguuuaaaugguaucucuuaguaacuugcacucguuaaagaaacacggagcugggccaucgucagaacuaagucagggaaggagauggaugagaaggccagaaucauuccuaguacauuugcuaacacuuuauugagaaauugaccaugaauuaauggacucaucuuaauuucuucuaaguccauauauagauagauaucuaucuguacagauuucuauuuauccauagauagguaucuauacauacacaucucaagugcaucuauucccacucucauuaauccaucauguuccuaaauuuuuguaaucuuacuguaaaaaaaagugcacugaacuucaaaacaaaacaaaaaacaacaacaacaaaaaacaaguccaaacugauauauccuauauucuguuaaaauucaaaagugaacgaaagcauuuaacuggccaguuuugauugcaaaugcuguaaagauauagaaugaaguccugugaggccuuccuaucuccaagucuauguauuuucuggagaccaaaccagauaccagauaaucacaaagaaagcuuuuuuaauaaggcuuaaaccaagaccuugucuagauauuuuuaguuuguugccaagguagcacugugagaaaucucacuuggauguuauguaaggggugagacacaacagucugacuaugagugaggaaaauaucugggucuuuucgucaguuuggugcauuugcugcugcuguugcuacuguuugccucaaacgcuguguuuaaacaacguuaaacucuuagccuacaagguggcucuuauguacauaguuguuaauacauccaauuaaugaugucugacaugcuauuuuuguagggagaaaauaugugcuaaugauauuuugaguuaaaauaucuuuuggggaggauuugcugaaaaguugcacuuuuguuacaaugcuuaugcuugguacaagcuuaugcugucuuaaauuauuuuaaaaaaauaaauacugucugugagaaaccagcugguuuagaaaaguuuaguaugugacgauaaacuagaaauuaccuuuauauucuaguauuuucagcacuccauaaauucuauuaccuaaauauugccacacuauuuugugauuuaaaaauucuuacuaaggaauaaaaacuuuaauauacgauaugauauugucuaauaauuaaaaaagacauaauggaugcucaauuaguuuuaagauaucuauaacuauagggauacaaaucacuacaguucucagauuuacagcuuuuuuuugucauuggcuugaugucacacauuuccaaucucuugcaagccuccaggcucuggcuuugucuaccugcucguucccaauguaucuuaaugaaaagugcaaaagaaaaaccuaccaauuaacuugugugguuuguuuauguuagacccaauuuucuauuguuuuaaugauugacaaguuuuucaguuuucgucugugacaucacauagccucucuaguauggucagguguuccucuuucacugggucuuguauaaauagaugaucacaaaggggugcuuaauaugagaguguuuuggcuucuuuuuauaaaauaauucugucaugggacuuuaucauggaauuccaggaucagaaauaauuucuagacuuuucucaaauuuccauucaaaucugugauaugauacaaacagugaaggauugucagcuuuuaguuucaggaauguucuucacaaaccccuugauuuuugaaaauguuuaaaugagagucagauuguauaagauguagaaaaagugcucccucugcugacuuuauggcaacugaacugcaagucauaacaguaugaagccagaaggagccacagcucauccaguccccugcauuucgugauaggaaaaaaagaaaggaagcccagagauauuaaguaucuucccaaggucacagagcuaccuagagucagcacuagcacuaguggccagcucuauuauaucccucagucacucaacuacuucccauugcaguaucuuggaccaaguaagcugaacuugauugagcagcccccaugaagcuucguaacaaaccauagaacaaaggaaauugaaaucaacacuagaaaacuauguaggauuuuucagcauuguuaauuuauugaacuuuagaaaaauuaucugaaucagaauaaugggaaaaacagcauuucaaauauuuugagcuauauuuugaugccacuacuguaguaauauuaguuucauaaccaaaaaggauuaaaagugaaucagaggauaauacaguguuuuuagcauguguauaauuuugguauaaugagauaaaaaaaucuucagaguugggccagauuuuacaagucaguuauuuaguccaagugcccauaugguaacaugguaagauaaaguuagaacagaaaugcaaaaauaauauugucuauauuguaucugaaaaucugaaaaaacuuuauuuuagucauugauuuauuuuaaugaauuaaaaggcugaagucauaauucacuaaagaggcuucuauacuuguaguggugaaauuucagcuaaaaugauuuuccaacuucaggcaaauaugaaucuugagucaauguuuuuaugaguauaguauuauacucauaaaaauuuaauuuuacauacauauauuuuacauaaucuuuaaaaagauuaauuuuauauaacacauuucuuagcaaacuuuauauugaauugaaaaaaaauggcccuucccuccccuccaaagagcuaaccuuaagcacguuuucaaggcacuagaaacaacacuuuaauagcuauguaaaauuuggaguuuuaguuccuaucauugugaaacuauuuuucauuuaguucccuguuucuggccauccaggcgaugacuuugguuauugcccaccacccgagauuuguucaaaaguuauguaaaaggaggcucagccuacuccuuucuaugucacaggucaauucuuaaccuuuccauggaaagugauugccaguggagccucuggagagacauggcugggcaaacacacgaaggacuuuuacauuagcuagaaaugaacagagcucucaugaaugacuuaagaccauuauauugccaaaagcuggcuguacuguugugaucaugguauuuuacuucagguagcaaccugauauuuuucauuaaacaaaaauucuuaaccuauuggacccucagcucaauauauuuagacccacccauuguucucacuguuauuuuaaacaaguucaagauggauuuacagugcaugcuaaagucccauggaaguucuaguuuuucauagaagaauuuaaguaagggauugacgugggaaauuaucacauauuuugugugauuaagaugggauuuauacuagaaaacaugcgcagcauguacuuuaaaaauaugcuauucuaggaguuguacguuugucuuaaaaucggguuucuuaugcucguucagagauuccauauugaaaacuccaaacaaauauaaaaccaccuuuuuuaaauguugauauuuuaaaauucuaaauucagugaugccuaguuuguccgacaggagggacagucagugguuuagaaaacuaaaacuucuauguucaaaugccagugcuguuuuucauuuuugaauuuuuaguggaaagcauacuaaaauguauuacacauauccucuaaaugucuuaaccuggacauacuuaaccuuucucaauaauucagggucaucauuguaaacaucauuuuugcacuaugcaugacaucugggaguaauugcaccugcaccaaauuuuuuuuugaguucuaccugcuuuuuauaggguuuuucagucucuuuacgcacagcuagccugucagcugucacuucuugaagccucagagugcuuccuccaucucuuaucuaauuugcuaccucugacuuacugugggcugggaaaccauuuaaacacuaccacgcccauuugaaaugugcuaaaauuagaguaaauaggcucugacagaggaccugaggguuuguucuacaaguaaguugugugaauuuguagaaucugugaccuuuuuuauuuccuuuaacuuccagauagauucucagcuuuuuuauuuccuuuaacuuccagauucucagcgaugcuucuuaugcaaaugccuucaagauuacuuaugcaaaugccuucaaauacguuauauauuuugccaucauuuuauuacauaaaaauaaaagcaacuugcuaaugguuuuagcccacaacuaaccacaaaauaaacaaauuugcaugucaggaauaaguuauuugauuagaugaacaccucucucuaguugcuaagaauaggggagggagggccacuagugaaacugacucagcauuuugauuuaaggaugacucuggcuccugcuucuaguauguaaccuccccugccucuggguauuggacuucuugggcagccggcagaaugcaaaaguauucuggggaacuggcaggauggguguguagguccagaugcugccucugaauuuagacacacccauggugagagguuucagacuccucaucgauuacagcauauuccuuuucuucuugaguuuauggauucaauaaaugguguggggauucagauauuuguuuugcuugcuguaugugaggugccaugguaagugcuagagaaucaaagauuaaccucugaagaucucagagucuagugugggugauagaccuauacuaaaauaaauuacauugcaacacaguaaguguuauccagggauggauacacugcuguggugggggugggagcuacuaauuacauccaagugaggaggccuaggugagaaguagcuggguuuuacagaaggaacggcagcacaauaagggcaugaggccaucuccaaagagaagguucuggccgacccugcucccgugcuaagcugcacuacacuuuauuuacguuuuuauaguaaaauuuucuuuauuuagagaugacauuaucagguacauaaaucauagggaaucaaucuaccaaaaaaaaauccuacuagaacaaauacaagaauuuagaaaagcuacagaagaaaacaucaauaaacaaauauacauuguauuuuuauacacuagcaaugaacaacuggaaauuaaacuuuaaaaagugccauuuacaauaagcugcaguacaguuuaauuggcuauauuugacuugaggucuaagcaaggauuuccuaacuugccagucucuuuagagcgugacugcuaugcuggcucucaccaaaaucgccuccugaggauuugaaccaugggcugggacuagggagucacgauauuuccugcugcgaagugagauaugauaguauucagagcaugaucauaucucaugugguaggggaacgaaagcaguaccucaugagcagcucuuugucucaccuccuccaucuaucuguuuuacaaaagaaacuaauggugacuucuuucccuucgaguaagggagugagagagacugagcaguucuagagggaaacauggcauccuaaggccugauuuucaa

SEQ ID NO: 14970 - RNA, 33207 nt, Homo sapiens
gcccuucuaugucccucccuauuccucccuucccaggcuuucgcucggccucucgcaaagucucgcgaguuuuuccaggggaaaccggccuggguggagagacagagaaggggagaccgggugggugggucguacgcuuagggggccgugguugguacuucgcuguuggggaggcuuucaggucgcccagauccugcuucccaaugggugacugggaaaauuagcggguggaaaaucucgagggguggaggcuuuuuuuuuccuccuuggccccgcccucuuccuguucggcgacugggacgccuggcccuacgagggggaagggaggcuuggccgggcuaucggagagcgcugugcgcacgcgcgagcccgagugcgugugugugugugcacgcgcacgcgcgcuccugcucuuaggaagccugggaaggaccggugugcuaggagaugaucggggaaagcauaguccccugucuguggcaccagacacucccgacugugcgcugacucuccccgcccagccagcagccuuuuccagagaggcugugguccauagccucuguucguuuucacugcaggaccaggcacgaaaguaagcgaaccucgauccugaggucuucccuauccacucaccuuguauuuuccaccccccacccuccagcaaagugggucuagaagguuucucaaagagaguuuugcaugaaggggagaugcgucuugaaagcaagaggugaaaauagcuggaucguaagaaaucaguucguuuugauuuaacacuuuggcuuugcuugccaugugcuuuucgaauguggauugucuauucaguauaagauuuuguuagcgaagcaggggaguaccguaugcucuguuuuaauaagaaaaaguuuuaaaaguuuuaaauuuccuucuacacaccagugugaugguaacaacuaaguuuuucugcucuaccugguaaauuacugugauguuucaaaagcuaaggggagagugugaaguugggguccuuauccuaaggcgaagaccugaugugcgguuaucuuaggagauguuuaucuuuguuuuggccuuuucuuuugcugucacuccucuuuccuguuaauuccgcaccccuacccgccagucccccuucaaacguuuuucuuggagggaagugcaaaaaugcuggcuugggguuuauaugugacuaaugucaauuagcaaggaucauaaaguuguauuucaagagucuuugucacuuauguuucguauauguaagggaaucaaauacaauuaaaugucaaaauguuucccucugacaauuuuaaguucauuuuaaaagcaaaaccaaaaaugcaugcacugguauuuuugucugggccugguagagugacagccuaauaugguguauugauacccuugcuuucuggucaugaccucauuaaacuguccuuugucggacagauuucuuugaacauauuauucauguucccuaccaagucuucuugagggaaagacaaucuucuugagaaaauuagaaaaaauguaagauguuauguacaaauauuuggcuaauauguuuuuccccuuacagguuaaaacaaaaugaagauuuuuucugaaucucauaaaacaguguuuguuguggaucacugcccuuauauggcagaaucuugcaggcagcaugucgaguuugauaugcuggugaagaauagaacccaaggaaucauuccuuuggcccccauaucuaaaucauuguggacuugcucaguagaaucuuccauggaauauuguagaauaauguaugauauauuuccuuucaaaaagcuggugagugugaaguacaaacaaaaucaugauuuuggggauguacuuaacugcauaaaugaauuuuuauaugaauuugcuauagauaaugacuguguguuuauuacuuaaaaaugugguacauaacgcugcccuuugggauuaauauauaauggauauuuaauuggggccaguaauaauaacagcuaacaauuauugagcacuuuacaugugccagacauauuucaaagugcuucauauuuauuaauuuccguaauucucauaacagucauguuagguaggaacuguaguuauugaagcaauauucaaaguauguaacaaccaguauagaacacagacugaccauugagagcugcugucaaacugugcuggcauguagcagcugacugucagucuuguuuguugcuucccuguugcagauccggaaacugagguaaagagaagaaacuuguccugagucacauaguuacguagaggcagagccagaauuugaaccuaagcuggcuagcugcuugcaauuuuagcaaauauauacuaaacugcuguauuguuuggccauauuagaaagaaauacuuuuaagaaugcuaaguggauaugguuuaucaguaagaagagaaauggaugauugacagaaauuacagguauuaaaguuuaaucuuagauuucaguaucuuaaaugucuuauuuugggaaagucauuuguuuagccacaaguggaagacuugcuuucugucuuacucgaagcgcugggaccuagccaauucuuagacugaggaagguagggcaguagaguaaaggugaacauagucugauauuauacauucacauauauuccaaauuaaaauauaagcccuucuuaaaauuugugugcauucugugugugauaaaaauauauaaugagagggaauguaacugauuuggagcgcaggcuucgguucagaccuuggcgugguuaacuacuagcugugugacuuugaucauauuucuuaaucucuccaagccucaguuuccucccguguaaguauaacacuuacuuccucgauguaagcuuuaaaagagauaaaucuacguaaagugacuuguaaaauauaucccugucagauaagccuuggaagagaagaccaauuaucaaacuucuugggggaggaaggaaaacugguauuucaucgauauauagggaaaaagaucauagauuagaucguguuguccagaguaaagaaagaaaucuaacccucuagccaaaaaggaacaugggucagaaucaucauuugauaaguuuuccaaaauguucuuugucauuaucuuaccugauagcagguaauuuuaaauuuucaaauuugcauuuuacuuuaaaacuuagcguaaagaccauauccauuauuuuggcuuucggugcccuauaugauccagcuccugccucuuucucugaguuugucuccucucccacugccugcucugacuuucacccuuuccaggguauaugcuuagaugccuuugcauuuguuauuugccguacccagauugucuaucccugacuuuacgguggcugguuuuggauugccuucaguugccacuucuauggagaguccuucuguaaccaccuaaucuaaaguagcuaauuaacuuauuuuucauagcguuuaucacucucugaaauuaucuuguucauuuauuuguuuguauucuucccgcagugccuucuguccuaguagacuccccuccccugacuuuccccacauugugagugacagaacuuuuuuauucaucacucuauucccauguacucagugccagcaauagcaccuggcauauacuacacauucuguaacuauaaaaagaagaaugaaugaaucagugaaacaguguuacaaauugcauauuacuugaaaauauguuggugauugagugaaauuagaguugaauacuaauuguuucuuuggaaucuauuaggugaauuuuauugugagugacucuggagcacauguuuuaaauucuuggacucaagaagaccaaaauuuacaggagguaugguuagauuuugagcuguggccauuuguaaauuaucuaaaugugguaauacuuuuuaaaaaaaugacuaauuuuuuaaaucacucuaggauuugcauauaguguuaaaaugccaagucauaugaaaacagcuauccccauucuaggcuuucccuacacccagcacccccaagcaaacuuccauuuuuuaguaguugucauauuuacuuccagauuucuaaauaacauguuuuuauuccuguuuauugaguucucuguuuauuuaucuacuuauuuauuuauuuugagacggagucuugcugucacccagacuggggugcauugcgccaucucggcucacugcaaccucucccagguucaauagauucaccugccuaagccucccgaguagcugagacuacaggugugugccaccaugccuggcuaauuuuuguauuuuuuaguagaaauaggguuuagccauguuggccaggcuggucuugaacuucugaccuucauaugucuaaugccuguccccuucccuuguguucucaauauuaauaugucagaauuguugguuauuucaaaguuucauguuggcauuauaacaucuacguaaaguauuauucacuguuaagccaaguaauauauaugguuaguuccuuauauagcuuuuuguuuauuccuggaauuauuuauuaucuccuuuuucuccccuucauguguuuuguuuucauaauauccauugcugcuuuuucucaugcuucuacaaaacugcccaauauuuugaucauaaauguguuagauaauucagcaguuugauuuuguccccugaggaacuucuuggagcacagucuucugcuccaguuugaacuggcugcuuucuaggcccacugcacuccuaucauccuucucucccuauuuuucagaucccauuuuuuuuccucucuuuuucuuuguguaaucuuuuguuuugguagaacauaaccuccggguugccuguaguuuaccuugccccuugcugauacuuuggguguagaaauuccguguuggaaauaacuuuuuccucaaaauuuugagggcauuauauacuccacaaaauuauguguuuuauagccuccaaugcugagaagccuaacaccauuuuucuuuauaauuucgcacugaaagcuguuagaaucucaguggugugccuugguguuggucuguucucauccauugugcuaggcuuuguauuuuccaguacagggaaauuuccccugcauuguuucauugauaauguucuugucucuguguucugugucuuucaggaauauccauuccugggauguuagaccuccugcauuaaauuccuuacuguuuuucucacugaucaucucauugucagucauucugcuuuuuugacgcuuuuaacccuuguauagaacucucuauuugauuguacuuuuaauuuccaagaacuuugacuuauacucuuaacuaugucuguuuuugucauauccuuuucuuguuuuauggguguaauuuuaccugcagguauuaacauuaguuuauuugauguuuucuuuugugccuucuguguucucacaguucuuuuuuuauguugaggcuuuucuuaaaugccugcugauaguuagcuagacagucuuauuuaaaagcaaggcacuaaauggcagauuagaaaaucuacauguuauggaguagguauugcugacuauauacuucauuguaguuuuagcugauuguuugcacuagggaaccuccaaauauuggaguugacagauggucucucugggacuguucuucuacucuuuuaucuguaugacaacuugguugucagcucucugggagacgggagaggguaaguuuauaccauuuccucuguagcaguagccauauuucagaugcacaguaagccucacauagauaguggcuacuguauuggacagcacagauagagaacauuuccaucaucgcaguaaguucuauugcgcaguagugauuuaguaucuuaccuuuacucucuuaugugcuuuugguauccauauuugauaccuuucaguuucaguucuuccaaagaaugugauucuguaucuugugggguaggggagauguagucacuuacacggguaggguguaaguaagaucugggagucaaguuguuccuuaaacugacuucaagcuauugacguuuuuaguaucuugccuuuccccacuguguuugguaauuggugccucuaguucuugaacuucuccuggauucuccaguucugaacuucuccuggauuauuuugccuuuuaguuuccaugggcacuuagauuucugcauauucaguccuauuaaguucaucaccacuccuucauccauuuuuauauauucuuguugaugucuaucuuguucauuguugucucuucuuccacucacuucacgcuuguggguuuaugcuuucuuuuuugguuuaugaguguuuuuuuuuuuuuuuuuugagacugaguuucacucuuguugcccaggcuggagugcaguggcacgaucuuggcucacugcaaccuccaccucccagguucaagcaauucuccggccucagcuucccaagcagcuggaauuacaggcgccugccaccacguccggcugauuuuuguauuuuuaguacagaugagguuucaccauguuggccaggcuggucuugaacuccugacgucaggugauccacccgccucagccacccaaagugcugggauuacaggugugagccaccacgcacagcccggguuuauguuuuuuaguaaguaaaaucuuuuacuucgauuuuaguggaggaagcagaaaucaacucaugcucaacuaguuagguuuauguuuuaacauuauuugucuaaagauacugaguuacuaguagcuuauguucuuugccaucauuuaguuggauagaagacuucagucuacaagguccuucccugaugaaugugaacaacaugagaaacaaggcuuuagugaaauaauugaauacauuauuugaauuauuuaaugccaaaauuuuuuuguuaacgggugcuaugcagugguaacaaucccauccaagguguuuuuauuauuuuuuguuuguuuucuuuuucuuuuauuuauuuugagacagagucucgcucuguugcccaggcuggagugcaguggcgcaaucuuggcucacugcaaccucugccucccggguucaagugauucuccugucucagucucccaaguaacugggacuacaggugugugccaccaugccuggcuaauuuuuuguauuuuucguagagaugggguuucacuguguuagccaggauggucuugaucuccuaaccucaagcgaucugccugccucggccucccaaagggcugggauuacaggcaugagccaccgugcccggcuucuuuuucuguuuuuuuuuuuaauuuaauuuuauuuuauuguucuccgagguuaguuuuaaauagaaugcuuuuaaagaaaauguguuuuaucauacuguuuggucuuaaaauguuugugauuaguauuauaauauauguaaacaaagcuaaccuuucauucuuuugagguaauucacucaguaggcuuugauuggcuuggcuuugcacuaauaucauuccagaauguucuuaauauacuauuaccugaaaaaacaauuuuaagaauuccauacguuuccaccuuacuuuuuuaaauacugugaaagaaguguuuaccuuuuucaagagguacugugaaagaagugugaaggcuuucuaguaguguaugaauaaaaauaaguacauaucuguguagauuuguaccuacugacugcaccucugcagugcaguaaaagugugcauuugauggauagguaugcuagucauaaaggaauuauuacuucuuuugcuuucccaaggugaagguacacgauaucccauucauugcuuuuaaauuuugaauggagggggaaucuccaguugugaaagcaacuauauagcaaaucacugguguucaagaauguauaaaagaauguacauuuuguauaaauuguguauaaucuugucuauauuuaauguuuagcuuugguuauccaugucacaccuuuucccuauguuaaaccuuucugugucucuaugucuaucuugugccaguaccguacuaucuugguuaccauuguuuuguaguaaguuuuaaaaauaggaagugugacucuucuuaccuuguucuuuuugaagauuguuuuggccagucugggucccuugcaauuccauaugaauuuuagaaucacguuaucaauuacuacaaagaaguuggggauuauguugacacuguaggucaguuuggauaauauggccaucuuaacaauauuaacucuuccaauccaugagcaugguauguuuuuucauuuuuuagaucuuuaauuucuucaacaauguuuuguuguuuucagaguauaaguuuuauaguucuuguuaaauuuauuucuaaguauuuuauuuuugaugcuguuuuaagugggauuuuaaaaaauuuagucuucagauuauuguaaguauauagaaauacaauugauuuuuguguauuaaucuuguauacuacagguuugcugaacuuguauauuaguuauaauaguuuuuuaguggauaccuugggauuucguaaauucaggaucaugucaucugcaacauagaguuuuaccucuuucuuuccaaucuggauucuguccauccucucucucucucuuccuuccuucccuuuuuccuucuuucuuccuuucucuuucuuccuuucuuucuucccuuucucucuccuuccuuccuuucuuucuucuuuccuuccuuccuuucuuccuuucugucuuucugucuuucuugucucuguuuaucaccuaggccagaguucaguggcugaacuccugggcucaagcgauccuucugccucagucuucuaaguagcuaggacuauggguguacaucaccccaccuagcugauuuuuuaguuuuuuuuuuuuuuucuuuuuauagaaacggugucuugcuuuguugcccagccuggucuugaacucuuggccucgagcaauuguccugccuuggcuucccaaaguacugggauuacaggcaugagccgcugggcuuggcaugaauuucuuuuauuucuuuuucuuuccuaucaccuuggcuagaacuuccaguacaguguugaauggaagugaugagaguaaacaucuuuguuacugauaaguagggagaauucauccaaucuuucaccauuaaguaugauguuaucaguagguuuuucauagguguccuuuaucuucuugaggaaauucccuucuguugcuaauuuuuuuaauuaugaaaagguuuuggaucuugucaagugcuguuucuguguuuauugagaugaucaugugauuuuuauuuuauugauauaugauguauuguaauaauugauauuugcauauuaaauaaacuuugcauuccuagaauaaaucccacuuguucaugguguauaauucuuuguguguuacuggauuugguuugcuacuauuuuuuuaagaauguucauguccauauauguaagauacauugguguguaguuuucuuucuugugauauuuuuaucugaauugcacauacucuugucaacauaauuguuuucccuuuuacuuagcuaauggcagcauuagccgcuguugggccuccuaauccucgggcagauccagagugcugcaguauucugcauggccuuguugcagcaguggaaacucucugcaaaauuacugaauaccaacaugaggcucguacucuacucauggagaaugcagaacguguuggaaauagaggacgaauaaucuguauuacuaaugcaaaaaggugagguguugauuauagcaauucuuucacugugggaauuuuaaaauccuguuguaguuuuucagaauaguagagacagcauguuuacauguuuacguuuaagcauauuacaaguggccuuucugauuuuuuucuuuuuuuuuuuuuugccuuuuaauauugaggcuguguuccauucuaaaauaaagacuuaucucauugaaaacuguuuagauugccaucauguagguaaauuuaacauuuuuucucacugguuuuucagcuaguuguuuagugguaugacuuagcacacuaaagauaguccuuagugaaguaacuuuaaaugucuauaacaccauauuaaagcggaagaguguuuugaauuuuuucuguuacuguuuauuccuuuaaauuugcuauaucuuuuuuaugccauagugauagucaugugcgaaugcuugaagacuguguccaggaaacgauucaugaacauaacaagcuugcugcaaauucagaucagugaguauaauucauaaaugaaauaaauauguucauguggauagauauauguuauaauuauuuccaauaacuugacugguagcguuucccugaauucucuauugacucaacaaauuagucaaaaaauguauguuugaucagaaacuuuuuuuuccauuuucccuuucacuuuaauuuacuuuucucccacaagaaaggugaucaaaaggauaaaauaauacauaaauuuauaauguguauuuguuuugaugguuuuuuucucauaguuguguuucgaauuuguaaaauguguuggguguaguggcuuaugccuguuaucccagcacuuugcggggccgaaguggagagauaaccugagcucaggaguucaagaccagccugggcaacauggcaaaaccccgucucuacaaaaaauauaaaaauuagccgggccugguggcaugugccuguagucccagcuacucaggcagcugaggcaggaaaauugcuugagccugggaggcagagguugcauugaaccgagacugugccacuacacuccagccugggcgacagagcaagaccaugucucaaaaaaaauuuaauuuaauuuaauuuaaauuuaaauuuuuaaaaaauuguuaaaugugcaaguuguuaguggcguuauucaguauguaccacaucuaaacauaaguaguugcauugugugacuuuuuaaaaaaacuuuuucuguuucugaaaaggaaaacaguuuuuuuuccucuauacucacacuaguacuuuugaucaaauguguggguuuuucuuccgcaccaauucuccaacucugugaauaccaacuguguguccuacaauucaauuaugacaauccuuggaguuaauacagaccccacagauuaguuauugcagacucaguuccacaagacuguaacccacuuagacacaaaucucgacuagugguuccccacacuuucgucugacuuggcuacaaguuagguguuuccacaacccccuccucauguucaauacuuuguucugaugggcucacagaacucagggaaacacuucaguuuucugauuuauuaugaaggauacagaugcacagacacaugaagugggugagguuggaaggaucccaagugcaucagguucugucccuguggaguugggguguaccacccucccagcacauggauguguuuaccaaccuagaagcucucugagccccauacuuuagggauuuuuauggaggcuucauguaggugugauugauuauuaacucaguaucuagcuucuguccccucucuggaggauagcagaguggggcugaaugcugcugagcuucuaaucauugcuuguucuuucuggugaccagaccccauuggggagcuguccaggaucccacuaaaguugccucaguagaagaaaagaugcuccugucauccaggaaauuccaaugaacuuaagagcuaugugucaagaacuggggucagaaaccaaauauuagagcaaaagaugcuccuagcaccccugucauuuaggaaguuacaaggauuuugggagcucugugccaggaagcaugagcagagaccaauauguauauuugugauugugucacagcuaguaaagacauguuuggaacuauugcaauguggacuuuuuuagagugauuauuaguuuucuuaggugcggucauaguguuauuguuaugaguaggauuguucucacuaggcgaagcaggcugaaguguucaggacuacacgucaagcccucugcaacuuacucucaaaugguuuaauuaaaaaguguacaucuaccuaaguauaguauauagagaaagcaaauauagcuaacagugacucuaggugaaggacauacguuguucauugaauaguacuuuucuuucaacuuuccugugggucuggaaauuucaaaauaaaaaguugggggaaauuuuuagcauuaccaauccuauaacuuggaaauaacuaauuauagcuaaugguuaguauugccugauuuuauccuuaagaaauauuaguauaagggaaauuaauacacaauauauucauuuucgcuguugcaguuaucuauugaaaauuagacuuaauuauaagaguuuucucuuuauccuucagacacucacaauuauuauuuuuugcauuuaaauuaaauuuguauacucauuaaguguucauacagguauagcaauuacauauacugccuuucuaauauuuagcuuuuggguuaacaguaauaucuaauuguagcaauaugauguuuuaauauguuaagguuuuaguaguuuaccugcuugaauucuuuacauacuauguauucuuaaauuuuaagucaaaaauuucucuuuaagucucaugcagauucaaaaaugugaguuggucuugauccacaccuacccaguuggugaagacagccuuguaucugaucguucuaaaaaagaggugaguguugaaauaaugaaagaaaagacuauugugguuaauaauaauaaauacugagaaggguuaucauuaaaaugauccauugccaauauuuucugccaagaaaauauuuugaguuuucaaaguaaaccucuaugucaagacaucuagguugguucuuuaugguauaauuguggauuuuaaaguguuuccuauucugccugccuuuucauguuuguuuauuuuaucaaaauguguuacaaaccauacauaguuuguauuguuccuaaaauuuuauuuuagugauuauuuuuauucuguaaaaaucuuuuuccuuauuagaaaagcaauacacucuuuaacaaaaaauauuccaauaaaaaauuaauuuuacacauucagagggaaaaaucuuauuuuccaaccuugguuuuacuuuuuaaauaaauuugaauaauuuuaaaggaauagaugauccuguugauugucaaauagauccacaucauaauauucucuaucaguaauuuauguuuagaaauauagauauauguccugguuuuucauuuugcauuauuuaauauaaacaucgcuaguauuacuuuuguccaugaauuuuuguaguuaagugguauuuuuagucauuauugccaucauuguguuuuuaagugguuuccagcauaagccucuuuuuuauuaacuuuuuucugccucuuuugauaauguggcaauguuaguuuuauuuuaugauaaugaaaacuuauuuguaauuaauauuauugcccuggaaugaguaagauuuuguguuaucuuguuguacacuacuucuagcugccuuauuuauuggugacagaaugaaauuuuuguggcgauuuccacauucauucuuuuaguuuuaucugcaggguuuuguccucucaacaaaauaaauuauuuuuucugcaguguacuucaaaucauuuuugcauauagauaaaaagacguaaaaauuguaaagaaauauauuuaaauauuucacucuaaauuucaggaggacagggauuaugucuguucacugcuguguucuguauacucacaguuucugguaucuagcaaacugauuaauacauauguggugagugaaugaaugcaugaaaauguauugcuaaaauaauugucaugguuaauuuauggauccuuuuuuuccaacuucuaaaaaguuaaaaauacuuaauuuuaauggauuuauacuaaaauauuuagcaguaggucacaaugaauuaauauuuuguggauuauuuuucuuguauguuuuucuguaguuguccccgguuuuaaccagugaaguucauaguguucgugcaggacggcaucuugcuaccaaauugaauauuuuaguacagcaacauuuugacuuggcuucaacuacuauuacaaauauuccaaugaagguaggcaguucuuuuuccugcuauuuugaaagcacugcuuugcuuuuuaaauauuuguuugaggccaggcgugguagcucaugccuguaaucccagcacuuugggaggcugagaugggaggaucacuugaggccaggaguuugagaccagucuggucaacauaguacgaucccaucucaauauuaaaaaaauaaauaaauaaauaauuguuggacauguauuauuuauuuuaauugaaccuuuaccuuuucuccccauaucguauuuucuguuuugcuagcccacauucaaugucuuugaccaggucaguaaauacugaaaagcaaccagaaaggaucacagaauaaaaugcuauauuuuuguuuucuaauaagaacacguuaugugagcucucuuaaaaaaaaaugcugucauuguuuucaucaaaauauaauuucuauuuuaaauuauuauucugugauucuuuucuugacagcuguguuauuagauuuugcuuacuuuguguauucuaguggaucuuuuauucucuauguuuuuguuguugcccacccaguauaaagguguuuauagcuaauaggucuaacuaggggaaaauagcucauaguuuuaaaucaguuuauuacucucuaacugaaagaccauagaugugagcucugugauuuuacugguggauuuuuuaaggaaucuauugcuagcuguucauuuucauuauauuaacauuaucauuaaguuguuuuagggcuagcacagugcccggcccauaguaagcuucaaauggguuuuuacugaguggaauggaauuuaauuguauugauuauguuuacaaauauaagguagccacuauaucucaaaauucaaauuuuucuuacauuccaguuucuauuuucugccacuauauuaugaacaauaaauugcaugagaauuauaaucuuuucauuguuaauuucuuaaugccauuggccgguuuuucacuacaaauguuaggcuuacccuguagaaccuuuuggaugcagaaguaaauaacauaauagguacacuuuaauauauauaaugucauguguuauaagaaaaauacucugauagcuugccuguuaauuuugaucauauuugugugcuacuggugugacucuucaaucuuuguguuuuuugguaaacagauaauguugaaauuccuauuuccuauuacugaaaacaaguuacuaaacuuguuuauuaguuuauauuuuauauaauugauauuugguaauucacuguagguauuuaaagaugcuauuuccucuuuuuaacaaugauuucgcuuuaaauuuauguaaauuauuucaauuacauuauauuuguauauuaaaaauauuggcaagacugcauuuggaguaaaaaaaauucaaaauuucugaguuagucaucuuuguuaauucugacauaauguaaaaaaaucauuaaauacuuuauuaccuguauauugccaguuguuuuuuaauggaguuuauguugcauggaacacuugcaucuuuaaauagauuaucccauuauuuuagcuaauuauuauugaauguauuugcccucauuuuaaacaaaaagcaaaugaauaauuaauaauuuuauuauuuugaaagcaaaaccaaguuuuuuaaaauguuugaaauuuuacuucaaggaagaacagcaugcuaacacaucugccaauuaugauguggagcuacuucaucacaaagaugcacauguagauuuccugaaaagugguaagagacauuugaaaguauuauuuuguaugaucuaacauaugaaagcauauuacaguagcccccacauccucagggaagacauuccaagacccccaguggaugccugaaaucucagauggucucgaacccuauacuguauacacuguuuucuccuauacguacauaccuaugauaaaguuuaauauauaaauuaggcaaagcaggagaucaauaacaauaagaaugaaauugaacaauuauaacaauauauuauaaugaaaguuauaugaauguagucucuuggucucucucccucuuucucaaaauaucuuauuguacuguacucaucguuuuugggaugaugugagaugauaaaauaccuacaugaugagauaaacugagaugaaugauacagguauugugacauagcauuaggcuacuauggaccuuaaacacaagcacuaugauaccucgacaguggaucugauaaccaagaaggcugcuaauggacuuguaguguuuauagcauauauaugcuggacaaaggaaugauucacaucccaggcaggacacaguggcauagugugagacuucaucaugcuacucagaacagcaugcaguguaaaacuuaugaauuguuuauuucuggaauuuuguauuuaauguuuuugggcugcaggccggggguaguggcucacaccaguaauccuagcacuuugggaggccaaggugggcagaucacuugaggucaggaguucgagacaagcguggccaacauggcgaaggcccgucucuacuaaaaauuaaaaaauuagccaggugugguggcguguaccuguaguccugguuacgugugaggcucaagcaggagaaucucuugaaccugggaggcggagguugcagugagcugagaucaugccacuacaccccaaccugggcaacagggugagacuccaucucaaaaaauacauauauaucuuggggcugcaguugaccacagguacugaaaccacggaaagcgacacagcaaagucgggggacuacuguaacagcuuugagaaguucuucaguacaaaccagacugacuaguucaucccugugcaaacuuaucugucaguaucaccuauuaauggcaauggaacuaguguccuguggaauuuacuucggaaaagacugggcuaauagaacaaauacugagaaagauagccauggcuuucucaaacucauuacaguuucauuugcaggcaaacaaccuugaggaagggaaaagaauaggagcaaacucgaaagagugauagacuuucaacuuggccuagaaauuaaauuuugaaauuuaaguuaguuuuuuuuccucuaaaaauuauuucaauccauagaucucaucucccaaacugauuucugcaacuguauuggcuugguuuaggggagaagacucuggaguuaggagauaaguuuuagcuaaagcuuugccaccaacuggcaagacccauauguuucuagauguauguuugcaugcuuaugaaugaaagaugcuggauuagaugagcuguaguauuccauucaauucuaaaauacaaugaaaauuuuaagauguugaaggucauuuuaaaagccuuuaagcuuugacauuugguuaaauucuuuagaauguuuucuaguaaauugaugcugccagagaaacgguugacuuugauuauguuguaugcaucuucugaagcauaaucaugagccaauugugacauuuguuacaugucugaggaaucuuagaauaaaccuaaugaacugcuaacaugaaagaaacuauuaugaugcagggauauauaaacguuuaccaaaggaauauagagaacuuguuuuugaaaauauauuacauggaaauugcuacgaaccugugaugugauaucaauuuuuaaaauguuauuuuaaaaacuuacaaaaaugggccaggcgcaguggcucacaccuguaaucccagcacuuugggaggcuaaggcagguggaugacgaggucaagagauuauccuggccaacauggugaaaccccgucucuacuagaaaauacaaaaaauuagccgggcaugguggcgugcgccuguagucccagcuacucgggaugcugaggcaggggaaucgcuugaacccgggaggcagaaguugcagugagcugagaucaugccacugcacuccagccuggcgacagagcgagacucugucucaaaaaaaaaaaaaagugucaaaaauauccuuuguaacacaaaauaguucuuuaaaauaguuguugacuuggccuguaguuauaugcauuacauguggacacuaugugucaaaaguuauuuuaacaauaggaacagagugcugugggagcacggaggaggcugccugugguugugccaguaagaguuaggcagguuuuacugaggugguaacaguguagcuaggucuuggugaguaggcuuauacuuuagcccagauaccuucccuaaguuccagaucuuuuuuuuuuuuugagacagagucucgcucugucgcccaggcuggagugcagugacgcgaucuuggcucacugcaagcucugccuccuggguucacgccauuuuccugccucagccucccgaguaguugggacuacagguguccaccaccaugccuggcuaauauuuuguguuuuuaauagagacgggguuucaccguguuagccaggauggucuugaucuccugaccucgugauccgcccccucagccucccaaagugcugggauuacaggugugagucaccgugcccggccccuaaauuccagaucuuuauauucuacuuccuaauuguaucucuuagaugucucucagucaccuacacuucaacaugcccaaaacaacuuaggagcuuugccaccugaacuagucuguuuccuuuuucagugaauggcccuguugucuguucauuuauguaaggcagaaaaccucagaaucguuuuugagacaucuaauccaucaucacauuuucuugauuuugucuacuaauuuuucucucguacaucaaaaucuccaucuuagcuaccaauaacauuucccuaauccagccuuuuauuuccuuaccuaguaucucacaguagccuacuaaauggccugucccuaucuacucuuuacccucuagcuacaguaacuuucagaaugcuaauccugaccauguucucaugaccuuaaacccgccccgugccuaugcuuuucuguugcccuuaggaaacaacagagcuguuuaaaugucuuacaaggcccuucauugucuggcccccucccccuuuuuauucucaucucaaagcauacuaaucuucucuguuucagccacacagaucuaauauuuuucaugcuuccuccugccacaguaucuugguauccauuguucuuuugccugaauagucuuuccucuauuucuucuucuuuuuuuuuuucuuuuuuucuuuuuuuaaucugagacagagucucacuuugugacucagacuggaguacaguagugugaucauagcucacugcagcaucgaccccucgggcuacaagcaguccuuccaccucagccuccggaguagcugggacugcaggugcauaccacgaagccuggcuaauuuuuguauuuuuuccauagagacagggucucacuauguugcccaggcuaguuuccugaccuccuagcaauccucccacuuaggacucacaaagcacugagauuuuagaugugagacacugcaucuguuccauuucuuuacuuaauuucuacucauacccuuauaacucagaccagucuucacuucucaaggaaacuucuccugguguuuuggaauaggacagaucucccucuacaggcacucauagcacuguagauuuuccuucaaagccuugucagcuuuaugguugcacauuuguucauuauuauuagauuaauaucuucuuacguauuuacuuuccagaucccuugguuuguguuucuucuaacuaaacuuauuagaauucaguaugguugugcauuuuagauuccuuaagcuuuuucugaguacuuaaccaugucauuuuaucauuuaauagugugggcagggaagagcaguuguagaugcuugagauuuuuuaaauucuugcuauugacuuucagugcaaugaccuaaaugauugauuaaugaugaauguggaggaaaauuacuauuuauuuuaaucauagauaauaucuuugguauuuguccaggggaccugauaaaaagauguugucucagagauauuuucccuuggagaguuuaaacucauuuggaaaucuugguaaauaauuugaagcuugugaucuacuugauaauguuaguguuucucugacauuuuuuucauuguuguuuuuaagugaacuuuuaauuuuagaguaguuucagauuuacagaaaaauugugaagacaguacagaguuccgguuacuccauacccaguuugcucuauuauuauuuuuugcuuuuauuauuauuauuauuuuauuuauuuuuuugauacagagucucacucuguugccuaggcuggagugcagugucgugaucgcagcucaccgcaaccucugccgcccagguucaagcgauucuucugucucagccucccgaauagcugggauuacaggcaccugccacugcgccuggcacauuucuguaguuuuaguagggacaggguuucgccaucuuggucaggcuggucuugaacuccugaccucgugauccaccugccucagccucccaaagugcugggauuacaggcaugagccacugcacccggccgcuuuuauuauuuuuuaaauuaaaacauaauuguacauauuuaugggauacagugugauguuuugauacauguauacaauguguaaugucucugacauauuuuuaaaggugauucgcaucuagguggcggcagucgagaaggcucguuuaaagaaacaauaacauuaaagugguguacaccaaggacaaauaacauugguagguauuuaagaauaacugaaaaagacgaaaucaaaagguucuuaagguauuauaugggggucaauuuauucuguuuugcauuuucguuuuucauuguuucaggacucaaugaacucagugaagaaguuuuuuuuucuuucuuuuaauugugggaauauuucuuuauauucuuucaaaucaguguuuucuucuauuucagaauuacacuauuguacuggagcuuaucggauuucaccuguagauguaaauaguagaccuuccuccugccuuacuaauuuucuucuaaaugguaacuuuaauuauuuaaugguuuugacugaaauuauuuauauuauuugaauuauuuauuauuaaauuauuauuugagugaaauuauuauuaagaauaugaacucuggaaagcuauauucaucacuguagcuuugccauuuauuugccaaagcuguuuuaaacuuauguaauuugaaauacccuuuaacaguuuuuacuaacauuuaaaagaugacuuuagguuuggcuuucaggcuauugcaucuaagcagguuuuauuuaauaaaauugugaguauuuuuauuuaaaaaauuugaccuucagagucuaaauugauuuguuuuagaagcuauaauuagaaaauagauuugaagaauuaaauagaagcuagaauaauauagaccauuuaucuuggcccauugaauuuuaaaucaaaucaaagguggacuuacuuauauuugaacaugauaccuuuaucauaaauaaauauuauguuuuuaguauuauaccauaugauucuuaccugugaccuuaaaucucugguuucauugugugaaaauuuuuuacaagucuuaauuauuugauuccaaauuaaaagcuucucugguaauucuuaugaucaucucagguuuuggaacuagugaucuaaagagucagucugucuuuaucauaagguuaugucauucuuaguuaagcauaauuugauuaucagacuaggugaaauucagauuaacauuuggacauguagaauagaaaguaguuaugauuacaguguggaugaggaacuguuguguaagugaacugagacugugccuucuccccaaauguucuguagcauuaauaaccugaggauuauggagcaguugucucacuuuucuucuugagguccaggagaaaaauucaauauguacauguaauuggaugaaccauauagccaaacguauuaugccagagaccacuauaguuguugugagaaacuguauuaacuauguaaccuuggaguaacugagauaaaguuaaggcuagaauucagauuuuuaggcauggaagaguagauacacuaaauuagcaaugcugguuaaaauacggggaucaauaaauaaaaugaaaaaaucuagacauaaaucucaaggaaauaaaugagagcccauuugaguuucauuacugauaguguaaucuuguuuuugacaggucguucuguuuuauuggaacaaccacgaaagucagguucuaaagucauuagucauaugcuuaguagccauggaggagagauuuuuuugcacguccuuagcaguucucgauccauucuagaagauccaccuucaauuagugaaggauguggaggaagaguuacagacuaccggauuacaguaagacucuaauaucuauaaauuuuaaguuuugaaucugucaucauucagcaaguaguuaucgagugcucguuaaaugcuaaggucuguggaaaaaaagagacuggaagaaguugauuauuauuuuaauuaggugaauuuccugcaauauuugcucaaaaauucuauuuaucauuguuuaaucuuauuguauauucaguauauacugagauguaucugaauugcaaugacacgcuggaauuguaggaaauaauaaauugauuugaacuaauauuuuaggugaaacuuaauuucuaguaauuuaaauggcaaacagaaaccuggaauauuuggauugcugcuacuuagaaauaacauaaacuuuuguauuauugggaggaacauaaaaggaaauuuauguccauuuuugguagaaauucuguucuaaucuugauuuuucauucucccuccucucuuuccuauuugguauuucauagcuauuuacuucuugaggugguuguaaaaacuaagugugauuuauauauaugaauaugcuuuguaaaccacaaacuguuauauacuguaaguaacuuuuuaauuaggauuuuuuuaaaaaacauaauauuuaaauaaggagaagccuaaucaauauuuauuguagaaaauuuagagaauauagauaucguaaaaaaacacccacaccuguaaauuaccuauaauuucaucauucacagauaacuauuguugacauguuuauguuaugucaagguaguuuuuuuguuuguuuguuuguuuugagacagaguuucgcucuuguugcccagguuagagugcaguggcgcaaucuuggcucacugcaaccucugccuccuggguuuaggcgauucuccugccucagcuucccgaguagcuaagauuauaggcgccugccaccaugcccagcuaauuuuuguauuuuaguaaagaugggguuucaccauguuggccaggcuggucucgaacuccugaccucaggugauccaccugucuuggccuccugaaguguugggauuacaggugugagccaccgugcccaaccucaagguaguuuuuaaauaagcaaaugggucuucuaaugugauuaacugacucuuuuaucugugugugauagaaaaguuaaauuacagaaggggaaaaaaaguguuccuugguuuuuacaaaagguggggaaaacauaccaugaaugcauuuauguuugaggcuuucuucauuuucaucauauaaaggcugauagguuucaaguucagaaaggauaaaaaaguaguggaguuaagggauacuguuagaaaaaauguuuuguugcacaucacaggacagaagacaucagggaaacagacuaguacauguaauccauacugaaacauuagacauaguuucuaauuuuaucuuauuugguuaucauuaggauuuuggugaauuuaugagggaaaacagauuaacuccuuuucuagaccccagauauaaaaucgauggaagucuugaggucccuuuggaacgagcaaaagaucaguuagaaaaacauacccguuacuggccuaugaucauuucacaaaccaccauuuuuaacaugcaagcgguaaguguuaaguagcuucaacuuuucuuauagauuaguuauauauucuuuauagaaaucaauuagacaauuuguaauuuauaccauuucuuaagcaaagaaugaaauauaugagcuugcuaaaguuaaagaauuaauaauuaaaaauugaagugauaguuauagauuccuucaccaugauaaucuuuaaaauccuuucgaaaaucaaguucugccuagauguuuugauauuuauuuuucaagacagauuuucuuuuuucuuuaaaaaaaaucuaacagguaguuccauuagccaguguuauugugaaagaaucucugacagaagaagauguguuaaacugucaaaaaacaauauacaacuuaguugauauggaaagaaaaaaugauccucuaccuauuuccacaguugguacaagaggaaagggcccuaaaagguacauuuuuuuuucuuucuuacuuuauagaucacauuuacuugauacauauuguuucucaagauaacuuauuccauauguaaauucuauuugaggacauguuuauauauauauuugagaugaaauaauacaaaaucauagaaauggauauauuguagccuagaauuucacuauuaaguaccaaguaagaggaaggaaguccacauuucauuauuuguuuuuacuuuaccacuagaaagugacacuucaauauuauuuaaagaguauuuccaaaucuuugcugcagagaugaacaauaccguaucauguggaaugaauuagaaacccuugucagagcccauaucaacaacucagagaaacaucaaagagucuuggaaugucugauggcaugcaggagcaaacccccagaagaggaagaacgaaagaaacgaggaagaaagagggaagacaaagaggacaagucagagaaagcagugaaagauuaugaacaggaaaagucuuggcaagacucagagaggugacuuccuggcauugauauagcaccauggugccuuuuguuauaucacauucugcauagaacacuuucauacauucaaaccugauuuaauaguaguucauuuaauacauguuuauucauuuucauuacuguaauuuuaucauucuuaaaaucuagaggaucuuucuugggcacaaaaaaguaugaauuuuuacuguuggggcaaaguuaguguuaguuuuuccuaauuaacuucugaaaaucauaaugcaugauguuugguaucaguaugugcuuuauguguugugaacuucacagacauaauuuuauuccucuguucacuaaauauuuacugaaugcuuaugaugugccaggcauuuggcacaagaucccuacccuugaagaacauacagugugaugcuagagacagacaaauuagugauugcaggcugggugcagugguucacaccuguaaucccagcacuuugggaggccgaggcggguggaucacuugaggucaggaguuugagaccagccuggccaacauggcaaaauccugucucuacuuaaaaaaauacaaaaaucagcuggguaugggggugcaugccuguaaucucagcuacucaaggggcugaggcacgagaaucacgugaaccugggaggcagagguugcugugagccgagauuccuccacugcacuccagccugggcaauagaguaagacuuugucucaaaaaaaaaaaaaagugauugcagcaaaguguggaaggugcuauuauaaaaauaggcauaggauguccuuggaagcacagaagaagggcauacagucuauucugaaaauguuucuuaauaguauacucuuuuccuuuaguuugugauuuauauuaugaugucagcguuaaaucugaaaaacauaaaaguaauaaaggcuuauaaauagaaauagcguauccucuggcuauauccucuauccacuugccagaaaucagaccaacaccaggucacuuuuuuuaaaauuaauuaauuuuuauuuauuuuuuugagacagagucucgcucuaucacccaggcuggaaugcaguggcaugaucucgacucacugcagccucugccuccuggguucaagugauucucaugccuuagccucucagguagcugggauuauagguaugugccaccaugccuggccaauuuuuuguauuuguaguagagauggaguuucaccauguugcccaggcuggucucgaucuccugaccucaggcgaucugcccaucuuggucucccaaagugcuugggauuacaggcaugagccacugcgacugacgaaaaacacaucuuuuuaugauggaaaauuucaaacauauguagcaaaagaacagauaguuacucaucaucuaccuucaaugauuaacaauucauggcagaucucauuucauauauaucuucauccacuaccuuuaccacuacacccauaggaauauuuugaagcuaauucuggaaauccuguaauuguauccauuaauaauagaauacuuuuauucucuuugacuuuagaagcucauguuuuccuuagggcugcugagcuucugaaacacuacuggcucacuguaagagggaaaaaguacuaucauuuaggucccacugagcuucaaguacacucuuguauauuuugcaaguguuuuuguucucugaugaaacucuaaaaguuuagaguuaaguuucugauuugcagaacauaaauacaucuacacaauacauagacuagagaauaaaugggaauaaacuuauuaaucuuauuuguaauuugaaauucaguguuauuuuguuccuaucuuuaaaaaucagaauugugcaauuucuucugaagaucacaucauuuccuaccuuuuaaauuuuaauuuaaguaucuucuuuuuuuuuauauuuuacagcuaauuccugaaucauugcauuauuauuaugaaggaaaagggaaacuuguauuuaauucauuaauuucuguuaccugguuuuagauugagauuuuugauuagucccuagguuuauuuuaugagauuagccaucuuuuauaaagguugauaugcaaaguuaguuuaauuauuagaccauuagacuucuaaaaauuugaacuuuacauuucauuauuugucccucuaaaagauuaaaaggaaucuuagagcguggaaaagaagaauuggcugaagcugagauuauaaaagauucgccugauuccccagaaccuccaaacaaaaaaccccuuguugaaauggaugaaacuccacaaguggaaaaaucaaaagguaagguacagcugugguaacuagguuuauaaaaaguuuuccaggccgggugugguggcuuaccccuguaaucccagcacuuugggaggcugaggcaagcagaucaccugaggucaggaauucaagaccagccuggccagcauggugaaaccccaccucuaauaaaaauacaaaauuaggcgggcauggugacacacaccuguaaucccagcuacuugggaggcugaggcuagagagucgcuugcaccugggaggcggagguugcagugagccaagaucgcaccauugcacuucagccugggcgacagagcaagacucuguuucagaaaaaaaaaaaauuuuccaaugaagcucuguuuuguacaguguuauuuaauauuguuguguaugugaggaagaguucuuaaguauuuguggguguuguuuaggacauucucuguuuacaaccuguauuaguccagucuuaugcugcuaauaaagauaaaaauacccaagacuggguaauuuuuaaaggaaagagguuuaauugacucacaguuccagcauggcugggaggccucaggaaacuuacaggcauggcagaaggagaagcaaacauguccuucuucacauggcagcagccaggggaagggcagagcaaagggagaggaagccccuuauaaaacuaucagaucuagugagaacucacucacuaucacgagaacagcauggaaauuuggguggggacacagccaaaccguaucacagccuuagagaauacaggcaguaaauauauuugucaguguuaaaaacaaaaacaaguaguguuauacuuucauuaaugaagccuuuggaaaauaagcauauaaaguuuguguuuuaagaaauuuuaaauauguaaacuugaaucuguuuauguuccugauacuauaguaagagcugagauauugaauacaaacucuuuugacccuaaacucuuacgaaaccuagaaauauguaauaucacucauuuauugcuauauuaaaauguguuugaguuucaguguaguuauuauuauaaacaauauuuucacuguaaagccucuuaaucucuuauaggcuaaaaaguuuaguuuccucuugaaggaauucuaggcaccaaggauaugauuugggauuggcagcuccugaaaucguucuaggcuuuaguuaucuugaaggcaaacuagauuuagucuuuuuaggauacauguguaaugguaugccgucauuagacuaccugauguccugccacuaugccucuccuaaggcaguagaaccagcuuaugaauauuggcagcucauccuagggagaagguaggcuuguuugcuuuuuauaugcuuguuauaguguauguauauagugauacauguuauauucuucaguucacuaguuucuuugaagccagagaucacccuugaggugaucuuauuauauuugccuuucaggcauuugcuagagggcccagaaaauaauaggauuuaaauagauguuuuuugauaaauuauuucucauaugacaaaauauaccacucuucauuaggaugagaaauuuaggucuacucuaaacaguguuucagcauugcuugguaaauagaacucuaaggaguauuacugaggcagagauugcagugagccaagaugccacugcacuccagcccaggcgacagaguaagacuccaucucuaaaaaaaaaaaaaaaaaaaaagaguauuaucuauacuggcaaaaauugcaagcaccuaaaagccauauuaguaggaaaaugacugaauaaugguguguccauagggugguauguauguauuuauuuauuuauugagauggaguccacucuuguugcccaggguggagugcaauggcacgaucucagcccagugcagccucugccucuuggguucaagugauucuccugccucagcaucccgaguagcugggauuauaggugccugccaccacacccagcuaauuuuuauauuuuuaguagagacaggguuucaccauguuggucaggcuggucucgaacuccugaccucaggugauucgccugccuuagccucccaaagugcugggauuacaggcaugagucccugcgcccagcccccacagggugguauuuauauaacccaagaauaauuauugaaugaauguguaaauaaguuuuuuuaaagcagguuacauaaacauauguacugugaucucaauuuuaaguuuucauacacauauguacuagcuugucacuuagaugaaauaucagcuaucauuaaauuaaauggaucccugauguuuuucgcccuggaaauauuauaugaaauagcucauaugagaagcaacuugauugcauauuacugccuuuccuuguaacuuucuauuugaggcugauauuugaaaaguguuuguuuuuuccuucauucuauuuuaugaccuaaauugcaugucucuucugaucagcaacugaucugggccuuuuauuauaccucaguuuuaucugcuuuggaaaaugacuuuccaggccuccccaaagugaauuuugugccugcuguauacacuguacuuaaggcuaggcuauuccaaaugugccaucuagauuuggcaaacgucuauucaacucucuuuguaugaugcaguaacaaaaaaaaaaaaccaaaauaaccauuuguugauauagauuggcacugaaaaaaagacuaaaauuuuuaguuguuagagcaguggcauuaggaugauuuuauuuccuccuuuauguguuuuauuguuuucuaaauuuguucucaugaacaugcauuaguuuuauaauaagaaaacuaagaauuuuaaaauauauaugacaauauuagcucuuuuugauguacaguucugugaguuuagacaaugcauaccgccaucacaaucaggguacacaacagucugucaccccaaaagauuuccucauauugacccuuuguagucaucuuucacucuccuccucaaucccuguagucauccuucacucuccuccucaaucccugguaacuacugauauguuuucucuuccuauaauugugcucccuguaauuuuucggaaugucuuauaaaugaaagaaaaugucaugccaccuuuugagauuggcuuuuuucacauaguauuauaaugacuaauuuuauaagaaacugccagcuuauuuuuccaaagugguggcaccauuuugcauucccaccaccaguaugugagaguucuggguguucugcauccuuguccaguugcuguugucaggguuacuguuuguuuuguuuuuguuuuucauccuauaagguauguagugguauuucauugguguuuuaauuuacauuucucucaugauuaaugaugguaaaacucuuuuccuuugcuuauuuguugucugucuucuugggugaaagguccauuaaaauauuuuguacauuauaaaauuggauuguuucuuauuaguggauuuugagaguuguuuauuuaucuggauacaaguucuguguuggacaggugauuugcaaguauuuucacccagucuguggguuguucuucucuuauaaaugacuuuugcacaacagaagcuuuuuauuuugaugaagucaaguacauccauuuuugcuuuuaugauuaugcuuuagguguuacauguuagaaaucuaacccagggucacaaaggcugauuuucuuuuaggaguucuguaauuuuagauuuacauuuaggucaugaucaauuuuugaguuauuuucuauaagguacaaaguaugggucaauauuaauccuuuugccuacgauguccuaauguuccagcagcauuuauugaaaagacuauccuuucuucauugaaauauuguacauuuaucagaaauuaguugacuauguaugugggaucugcuucuggauucucuuuuauauucuguugguuuauguggccguccuuucaccaauccaguacugucacagucacuucaaauuaagucuuguaaugaggaaguaagaaucuucuaacuuuugucuucuuuuucaaaauuguuuuggcuauuguaauucuuuugccuuaucauauugugcaggaaagaguuaacauagcaggccugagacuauuauaauuagaaaagccugcuugcagguuuggcuguuggcuggcaucugggaacuuggcuuuugagauauugccuagauaaugaacugaacaccugcuucccuucugaaagucuggaacuuuggucauugugguuaggcagagaauaccuaccugaucagcccccaguaaaaacccuggacucuacucaaacaggcuuuacuggcagaaauauugugcacauguggcugcauguuugccuauggagguaguaugcacucugcauaaaccucauuggagagagugagcaugggaagccugcaaauggauucugccagucuccaccucauguguuccuucugcuuaccgaucuggcugugucuccuuacuguaaugcuguaaucauucuuaaccaggaguguaacuuuacauuuagucauuugaguccuuccaucagucacugaacuagugguugcucuuggggacccugaaacacauaaauuuuagaguaagaggaaaaugauugccuuaaucguguaaaaugaacuacagaauuaacugccuuaauuguguaaaaugaacaacagaauuaaagguaaguuuggaaauuuggaaauuuggaaauaauaaauuauucuaucuuuuuuuucucucuccuuuuaaauauaacacuagggccagugucguuauuauccuuguggaguaauagaaucaauacugccaauuccagaaaacaucaggaauuugcuggacguuugaacucuguuaauaacagagcugaacuauaucaacaucuuaaagaggaaaauggguuuguguuacuuauugucaaaauugguuuugucaauugccuguauaguaccuuaacaaucauugcuuauuuguaauaaucagcaguuuuuuauuacuaauauuaugaacuaauacauguuccccauaagcagaaaaaauuaaccucuuugauucuugcuucuaaaaggcuuaguuauauugauuguaacccugaaaguauuuacuccuuagagcauuucuuuuuaaugcuuaauaaacauuacagagggaaaaaucauaccacuuaggauauaaugccagucucuguaaaauaacagaggaaaauguuuuccuauuaaggaauacaauauuaagaauauugauuauaguaaaauaaaucucagaucugauuauuuugauuuuuuuagaagaaauccucuuaauuuguugguggaaauacauuuauuuaguggggaaggaaauaaauucuugaugaaauuguagagauuuuuuccuuaguuuugcuuggaaagggagagugugguauagucaaacaaacaaacaaaaaacaguggccuuugacuuguaaccuugggaaagucacuuagucucucaaggccucaauuuucacuguaaaaugaagaaauuggccuagcuagaggaacccugauguuaguccuuuccuaaaaugcugauguucuguucugugaauauauuauuuuaauuuucaugugaaagguagauaaggagacaaaauguuaaugaauauuuauuuuaucaacucguuuuuuucuuccuauuucaggauggagacaacagaaaauggaaaagccagccggcagugaagagugacuugaagaacuaaauuuagcauauugcaaaaauauuuugugcggaauucgauauaaguacuuuuacagcaagaugguauaguuauguugccuggacugguuuuuacauuuuuaaaauauuucagcugucauuuuuguacuaauuauaaaauuggcacauaauucaaaaauauacauuugagaugauuuguccucccaaauuauacaaguuuauuuuaugguauaaaguguucucucuggaaauguuuuuaaaaaaauucuuaggcuucucuuugcgaaauaaaacuauuaaaauauuugaaaugcaaaa

SEQ ID NO: 14971 - RNA, 6648 nt, Homo sapiens
agaaguaguuccuuauaaagcauauuauauugaaaucaaaugggcauuaaagccauggaauuccuuugaaagguggaauaaagcggaaauuguuuugucuugguacuucuugaucuagacuaauaauccuuugggggaauuuauccugaggcuuuuuaccaauugugcucaugacuggcucccucagugaauguuaucugaugaaggucuuauuucacuucugaaagcacagcguuguucuauuuguuugagguauuaguagguagcaggaaaagaucgacuccagguaaugcaauauaaaacccacccguccaucuugaaauuggagguuguccugcaugcuauauaaguucucccacuugcaauauauaaugaggagacauauuuuugaagcaauuaacuguuccuucaaaauuguucuuuauuguugguguaaggacuuuagcacucucuaggaaaucgucuauaacuugcuucauuuuucuuuuguuuuguaagaggauuuuagacucuauucuuguggccaguuagacuuggauccgugcauccucuugagccgugaauuuucuggucucaaagucccaggcucaagcgauccuugcgccucggccuuccaaagugcugagguuauaggcaugagccacggcaccuggcccauaauguauuugacacuauaauuaagagauacugagauauuuccuauuuuaaaauacuucguccugcuuucuaauauauagcaugacacccaaccucagaggguauggaaagcuuacuuuacuguaaagacuugcaaagcacacugcuuauauuuuagggacagguucauaccugccaagcagguuuaugaaacacugaugaauaaacacaaguaugucagaaaucuuacuaaagaacagugcaucuuauucaguguagacagucuucuaaaguauuuugguugaguucguccuagagcuuaauugcgagaguaagaauuaaaauaauaaaacugguugcaagucuuuugagaguaagauaugucaucuuucuuucaggccuaucauagugucuagucuaaagcaacaguaaggcuccuugcauauuuguugaauuaaauuuucaauuuaguuucugaauuccuugguccuaauagauuucucaguugauagguugccaucucacuugacgucuacuugauggcuauguucucuucuugucugccucccuuuucacuccuguucuugacccuacugaccagucuuuuuugacuuaaagaauagcaacucuuuaagcuguuguauuucacuuuuuuaaaauuauauagacaggauacauuaaaaacauuuaaagaauuacauagagucagagagauagauuacuuucuacuaaaugcuguguuaggauuuuguuuuuuuuguuuuuuuugagauggagucucgccccauugcccgggcuggagugcaguggugccaucucuucucacugcacccucugccuccuggguccaaaugauccuccggccucagccucccgaguagcugggauuacaggccccugccaccauaccuggcuaauuuuuguauuuuuaguacagacaggguuuuaccauguugcccaggcuggucucaaacuccugaccucaagugaucuacccaccucggccucccaaagugcugagauuacaggcgugagccacugcgcgcagcccacuguguuaggauuugcaauauaaaggaacuaagaccuggugguugccuuuagaucucacagucuacagguaaaauggaucuauaaagagggcugaaaaguacaaaucauggcaagaagguggcagagcagggacuaggggacagcuaaaggagggucaugaucccuuugccugagggaucaauauugcccaguaguaacccuagagcagguucuuuaaggaugaguuucccaggcagucaggaaauggggagggaaaucccuaugguuuuguguauuggccccagugagaagcaaguguguccccuucgggaacuugaugaguauagauuuuaaaaaauaucugggagaagagaaaggcaaggcauggcagauguuacuagaugugguagacaugccaaguuuggguaggagguauauggguuagaucuagagggaagcaguuagaaguuggggaacaggaagccuuuuacaaccaaccuccccuugcugaauggauuauuacuucauuagaacucaauguuuacccacuacagaauauuaucacucauagucuuuauagucauauauuugccugauuuuaucucuuaaauaaggcaauugagccuaaagaucaagacuuuuuuuuuuuugacaagcuagaaagguaucugacacuccuauuugcuaaauauuuguagaaggaagaaagaagagaggaaggagagggauaagggaauugaaauugaggaaaggaaggaauuugaaacugaagagucauaugcuuugccacauaaacucugaaggucacacaggaugguagugccagcagaagaaggaggacguugagugaaccugugauugaaugaggaggaugguagagaugcugggaaggugagagucaggacaagaaggcugagggcaccuuccucaaagaaguugacauucaguggaacguucaaugacaauugcaaaggaguuucagagggcagaauggaauggauugggagaggacuugguuaagauuuacugaaaacccugaacuuuugguaaauacugcucugugugggaaauguuucaaugagaauugacucuuaauuaacucucacucuuggauaucccuugaacaaguugucuggagaguuccucaggagaaugucuacuugcaacaacaguaauaauauuuaucaagugcuuguguuaccucauaaacucucacacuaacccugugagguauguauuauuaucuuccacuucuuuugaaugaagacagcuagacuuagagugguuaagaaguguucacagucgucacauugcuccuaagugggccacuacuacagccaaggcaacacaugcuagaaccugucagguaccuggggaauaucagaacugcugucugaucucugaaauugaaauuaauuuccucagugacucaauaccuacugccacucacucaagcccugcaaguucaagccaaaucauccugccaccgcaggaaugugaugggucacgcugcuaccuacugaaaauggggauuuggguuaacuagaguaaaauacaguaagaaugggugagaggagagaaaaagaauacuucaguuuaggaagcauaauacuacuuaaaauuuccugagaaagaauuucuucccuuggaagugcaucuucccaggagguuguguccucacaggggguguccucacacgggaaauagcccgcagagaggcucagguuggaauuggauuuggagcugucguccuuucugucacuguuagaggaugaauaugcaauggaguucaaaggcacaaaucugucaacuugagaagcuucaaaaaagaacagcacauaugcuuucaaugugagucaagauggugugcuggaagaggaagacauggguaacaagaacguuuauuuuguuuauugaggaaaaaauaaacuauuggggauuaucaguggaauccuaucuuauggauuauuuucaacuuuccaaaaaguugaaaaaucugucuauauaggauguccuaauucaaggguuucuugagguugaauucucuugccucugugaaagaaucguuuccuuggugcuggcugacggggacucuugguggcuuucacaggaugauaccuccucagcagaggggagaggauaugcugccucagccagcugaaggcccacccaaaguucaggcagcacugggccugugugugggaaggagugucauccuucuccggcugcucugacaggauugagaucucuggagcacuuguccuuuggcuggcaguugccuggcuuaucaucugccaagaaaauaaagaauauguuagguaggcguaaccaugacagcagccaagucaacauuuacucauuuauggaacucacauccuuuuagcaaaaauagcccaaguaggcugggugcgauggcucacaccuguaguaucagcacuuugggaggccgaggcauguggaucacuugaggucaggaggucgagacaagccuggccaacauggugaaacacugucucuacuaaaaauacaaaaguuaggguagcagacgccuauaaucccagcuacucaggagguugaggcaggagaaucacuugagcacgggaaguagagguugcagugagccgagaucacaccacugcacuccagccugggcaacggagaaagaaugucucaaaaaaaaaaaaaaaaaaaaagcccaagugucaaugcaaagcuucaauguagauacaguuuuuaguccuucuccuugcuugcuacccucuuguuuaccucagcauuccucagucuuuucccuaaaacuccacccugacuccuuucuucguugucugucucccacugguaucacuucgggccccuugggaccugcuuccuaguggucguaagauucugugguucaacccaggccuaucccuuccuauccuaugaggcaucucugugcucaccucagccagcucauguuccuuaagccuuagaggagucuguggagacuacauaacaucuuuauuuucugguggcuugcacuugggcaggucuugacaagcaucauguucuugaugacugaccugaaccauuucuggaggggagcugccguacagcuggaaaucugaguaguuucaggaaacacagcaucaucaucuucauugucuuucagauuuucuagaaaugucugaaacucuugcacaagauuauucaguuugcugacagauaguuuuguccucucuuuugggaacuuguuuauccacagguuggcuccauuuagaagccuauuagcuauugagucuguguugucagagccaacguccaugucccaggccaggaagauguucaguuugcaaaacugucugguucguccugaauuugguauugucucuucauguguuuccuuauccuuucagucccccaugccccuuggaugggagggagaaaguggauggaaggacccuuggaaggugcgucuucccaggagguuguguccucacaggggguguccucacaggggaaauagcccacagagaggaucagguuggaauuggauuuggagcugucguccucuaugucgcuguuagaggaugaauaugccauggaguucaaaggcacaaaucucucucaacuugagaagcuucaaaaaaagaaaagaagaaaaaagaaaaaguaggugggaccggggagaagagaaucaugguacuuaagcaaaaacauuauccauccccuuuucuauuuuuuuuuuuuuuuuuuuuugagauggagucucacucugucauccaggcuggagugcaguggugugaucucggcucacugcaaccuccaccuccuggguucaagugauucuucugccucagccucccaaauagcugggauuauaggcacccgccacaaugcccagcuaauuuuuguauuuuuaguggagaugggguuucaccauguugcccaggcugguuuugaacuccucaccucaggugauccacccaccuuggccucccaaaaugcugggauuacaggaaugagccaccacgcccagccccauucccuuuucuauucagaacuaccccauuuagauugaagucuuauccuauuuuuauaaucucccagugaagggcagaagaggcagcccucugccuuucaaaacuuacuucauuguguuauaauccucucuacuaagcaucuccaccucucaucauuuguccuauuacaguuuuaagaucuuguaucauaaaagaaaaagaucauuauauaaaauuggaaaaauguagaaaaguaugaagacaaaaacaaacaugccaugguccuaccuucuaaagguaauaacuaucaaaacauuuugauggacuuccuuaucuuuucuauuuauauaaacacacacauauauaucuguacauuuauauaauauauccacauauccauauaugugaauguggcuaucacaucaguugaaacagauuauuuuauggcauagccuacaacaaacauauauaugguuacucugcaauuguuaauucuuauuaaugaccauuaggugguaguuauuguuuuacuaaauaaaucuguaguaaaccugcuuuuccauaaaucuuugacuaugacccuuauuuuucuauguguaggauuaauggaccaaacaucacaaauauauuacagucuucugcugguugauaccaaauuacuuuccaggaagguuuugcuguuuagaugcccauccucccaucaucugaugacacuuuuuaguccagcuuuuucugugaagccccggaaagcaaguagggcuggaagaaugcgugcacacgcgcgcgcgcacaaacacacacacgcgcauacacacaugcgugugcucacacacacacaugcacgcaagacugucacacccugcucugguggcugcccacauggaagaagugcugcuaacuccugaggcaagaaggggagacgugagaaauccuucacaucccgagucucaguggcuaaaaguccagcugucagaagucu

SEQ ID NO: 14972 - RNA, 4193 nt, Homo sapiens
cauugcauuauuuugcucuaaauacagguaaguguguuaacagaccagguggaggcucagggagagaagauucgagauuuggaguuuugucuugaagagcacagagagaaggugaaugccacagaagaaaugcugcagcagguaugugcagaggccagaaccaagaugggauuucccugcugaacuaugugagaugcugcauuucuauguuguguuugcucugaugcagcaguaaguuucuugauucauuuagaccagcacauuaaaaaaaaaaaauugagaguaguagagucucaaaacacaugcacacaauauaaaguguuuauguaauuagaaucuggaacaaaaugucaauaggauuguggcuuauuuuaauuuucuuuuuuugcauucagaugguuuccucucacccauagcauguguuuuauaauuaagaaaaaauauaauaguaaaaaaucuaauaauccaguuuaaaaauggguaaaauauuugaauagacauuucucaaaagaagacauacaaauggcaaacagacauaugaaaaggugcucaacaucauugcucaucagagaaaugcaaaucaaaacuguaaugagauacuaucucaccccagcuaaaauggcuuuuauccaaaagacaggcaauaagaaaugcuggcaaagaugugaagaaaagggaacccuuguacacuguuggugggaauguaaauucauacaacugcuauggagaacaguuuggagguuccucaaaaaacugaaaauagagcuaccauaugauccagcaaugccacugcuggauauauacccaaaggaaaggaaaucaguauaucgaagaaauaucugugcucccgaguuugcugcagcucuguucacagccaccaagauuuggaagcaacuuaaauguccaucaacaaaugacuggauaaagaaaaugugguacuuauacacaauggaguacuauucaacuauaaaaaagcaugagauucagucauuugcaacaacaugaauggaacugaaggucauuaugugugaaauaagccaagcccagaaaaacaaacaucucacguucuuacuuauuugugggaucuaaaaaugaaacaauugaacccauggagauagagaguagaggggugguuaccauaggcuggguaggguaguggggaugaagggagagguggaggauggcgaagggguacaaaauaauaguuuccaugaauaaggccuaguauuuaguagcacgucagggugacuauagccaauaauaauuuaauuauacauuuggaaauaagaauauaacuggauaguuuguaacacaaaggauaaaugcuugagaagauggagaccccguuuuccaugaugugauuauuacacauugcaugccuguaucaaaacauauaccccauaaauguauauuccuacuauguagccacacaaguagaaaagaaaauaucuaacauauaggagaggcucuguaaggucauggauggaguaugcacuugagcaaaaccucguagguuuccauuccugcuguguuuuuauuuuuucuuuuucccuguaugacauuaggccaguuccuaaccucucuguuacuauguuuccucaucuuuugauuaaggauaauaagaauuucuaccugauaaguuuuuugugaggauugaaauaguauuuguuacaaccggugccuggcacauagcaaacauaguaucaccaucaucaauguuaucaucagacugaaguauauauaugguuuaugcauguguaucuacacaacauaugucucccucaguaaacugacaugugcuuauuucuguucaaaggaggguaacuaaagugaauaguucuuuuuuauuuuauuuuauuuuauuuuugagauggaaucucugucuguugcccaggcuggagugcaauggugcgaucuccgcucccuguaaccuccgccuccuggguucaaguaauucuccugccucagccucucaaguagcugggguuacaggcacccgccacuaugcccggcaaauuuuuguauuuuuaguagagacaggguuucaccauacuguccaggcugguucucaaauuccugaccucaagcgaucugccugccucggccucccaaagugcugggauuacaggcaugagccacugugcccagccucaagugaauaauuuuuuaaaaguguguagauucaguaauuauacuucacuauauccucuacuugauaggugcugcuuugugcgaucauaaaugagguaaauucacgugccuguuuauaauaaaagacuucuugaauguaucuguuaaauuauaauaggagcuucuaaguaggacauccuuagaaacucagaaguuggaucugauggcugaaauaucuaacuugaaguugaaacugacagcuguagagaaggacagauuggauuaugaagauaaguucagagacacagaggugagugauacagucucuccucccucucucucucucucugucacucugucuuugucucugacacacauacauuccuagggcaaaguugaaauucccuggaggugugcaaggaaggcaguuaauuacuacguaccaucauccuacuucauuuuaagaauaaucuuucauugcauugacuuuuuaucacuagaugcuaauggcaauuuuuauuuuuagacuuuugauaugaaguauuaaucuuuuuauuaaccuuuagaaauacuuuugacuuuacgauauuuggagcauccguccauccauacuguuuuucuuaauuuuguaaauaaugggcuuaaauacaugguuucacuaguaguuauuauuuaggcacacugauuauuuacuauguaauuggauuuugaaaaucuguauagaaaacaugcuaacauucuauacucacaaaaucacagacagagcuuuuuugaggucuuuuaauuuggcauucuacuuuuggucuguuccacauguaaaucauuccaauuaaauaagacucacuguacuucuacaaaaaucaggguacauucuguaacuugaaguauccauuuuaguggcuuaacaagcuuuauuguuuguucuauuuuguuaauucaggccuccuaguuuguuugcuuugugacauuuggcaaguucuuaaccucucuguugguuuuugauggagacagagagcauauccauuugaaacauacauuugaaaugaaguauaaagaguugcagaaauuucuuuucucugagagccaucuccccuccuuuuugcuuccuauuuuguuuccuugguuggaguauggaagggugucaugcuggauuagaaaauggguaccaaggagagaggagagaaaaugguuuacuuauuuuucccuucuguuuuuauuucaaucauguauuucacgcugacuauaagccagcaugauaccaggcauuacauacauuauccaccauaggaaaguucuuuauauuggaaauaacaaguuuuacuccacugcuauuuucaaaauuaaauuuucugucaaagauucaauuacaguggaaagucuugguauaugucuugcuuccuccauagcaaaaggaagucuuucauuugguucauguuuuaaucuuuuuuuuuuuuuuuaagagauaggaucuuacuguguugcccaggcuaguauggaacuccuggccucaagcaauucucccauuuuggccucccaaaagcacugagguuacaggcaugagucaccaugcccagccauguuuuaauuuuaaaacucuuugucaguugccugugugagcauguuucucauuugauagaagcuggggcucuuaaaacaggacuuagaaaguuacccaauuuaaaauucuugguuuuguauuuucucuaaaaaucucuuugauauuuuccucuuuccccucuuuuugucagguccuaaccccauagucgcaggguaaaguaauaguaaaacucagucaacagaugggcaacauggcaguggagcuagcucugcugcagggaagaauugaugguagauauggauagagguggucuucuacauugcguccacaaagucaaggggaaauauucaccuguuguuaacuuaauuuguauaugagauguuaaccaaauguuggggcuaaauugcaguagauguguuacuuauuguuguaagcgccuaggguaauauuuauaucccuugaguuuggcugcuuuuuuuaaucaaaucucuuuuccccacuuuuu

SEQ ID NO: 14973 - RNA, 798 nt, Homo sapiens
auuuuuuuuuuuuaaccaaacugcguuuucuuacacaaaacuaaaaaugauauccuugaaagcauauaaucuugcuacaguuuuuacuaugaagaguucuccuucauaugguuacgguuuuuaauuugcaaggauccugauuuucucuguccugguuuauacuggcccugcugcuuuccacagcauccagaugccaggaugacuauacaacagccgagaaagaugacagaggugcaaagggccacagaaaccagccaagucuuugaagucacagauaccucaucuucauuugcagaugugugguuucugcuauuguauccuuugguuuuguuuaguaauuguuugcuacuguugaguccagguggaacaggcauaugagaaaguuuugugucuauggguucaaagaaaggagaaauagucuuauuaucuggauugcugaugaaaucaguacuuggugacaccuuauuuaucuuugugguaauggacucauucagggaaguaaaucuugcccaaaaaucugugguuaauuccuuagaauaacugguacuguuuguguuuacaaccaaaucuugaugcgugguugaggauggagccucuguggauggcagcauaccauuuaucguggugguuuguuuaucuaaauucauagcuuuuagaauccuuagucugucccaucuauuggaugaagaacgaguauuuagauaugugggagauuguucaaaaaccagcaaauccggaucuauaccugaaaaauaaauaaggcaucauucauuuuauuuuuacuuucaaagcaaaaac

SEQ ID NO: 14974 - RNA, 906 nt, Homo sapiens
ggaagauggggguccucuuuccuugcuuaaugcagccaugacuugugaucccaagaagcaucugaaguggguagcagcuccaaagcauuggaugcuggauaaguugaccaguguguuugauccucguccauccaccggucccacaaguugagagugugucucucccucaucaucuuccuaaggaacagacuuaaguaugcccugacaggagaugaaguaaagaagauuugcauucagcaguucauuaagaucgauggcaagguccaaacugauauaaccuacccugcuggguucauggaugucaucagcauugacaagacgggagagaauuuccaucugaucugugacaccaagggucgcuuugcuguacaucauauuacaccugaggaggccaaguacaaguugugcaaagugagaaaaaucuuugugggcacaaaaggaaucucucgucuugugacucaugaugcucgcaccauccacuauccugauccccuuaucaaggugaaugauaucauucagauugauuuggagacuggcaagauuacugauuucaccaaguuugacacugguaaccuguguauggugacuggaagugcuaaccugggaagaauuggugugaucaccacagagagaggcaccguggaucuuuugacgugguucacaugaaagaugccaacagcaacagguuugccacucgucuuuccaacauuuuuguuauuggcaagggcaacaaacugugaauuucuuuuuccugaggaaaggguacccaccucaccauuguugaagagagagacaaaagacuggcggccaaacagagcagugggugaaauggucccugggcgacauguuagaucuuuguauguaauuaaaaauaauguggcaugauuaaaaaaaaagagaaagaaa

SEQ ID NO: 14975 - RNA, 906 nt, Homo sapiens
uuucuuucucuuuuuuuuuaaucaugccacauuauuuuuaauuacauacaaagaucuaacaugucgcccagggaccauuucacccacugcucuguuuggccgccagucuuuugucucucucuucaacaauggugagguggguacccuuuccucaggaaaaagaaauucacaguuuguugcccuugccaauaacaaaaauguuggaaagacgaguggcaaaccuguugcuguuggcaucuuucaugugaaccacgucaaaagauccacggugccucucucuguggugaucacaccaauucuucccagguuagcacuuccagucaccauacacagguuaccagugucaaacuuggugaaaucaguaaucuugccagucuccaaaucaaucugaaugauaucauucaccuugauaaggggaucaggauaguggauggugcgagcaucaugagucacaagacgagagauuccuuuugugcccacaaagauuuuucucacuuugcacaacuuguacuuggccuccucagguguaauaugauguacagcaaagcgacccuuggugucacagaucagauggaaauucucucccgucuugucaaugcugaugacauccaugaacccagcaggguagguuauaucaguuuggaccuugccaucgaucuuaaugaacugcugaaugcaaaucuucuuuacuucaucuccugucagggcauacuuaagucuguuccuuaggaagaugaugagggagagacacacucucaacuugugggaccgguggauggacgaggaucaaacacacuggucaacuuauccagcauccaaugcuuuggagcugcuacccacuucagaugcuucuugggaucacaagucauggcugcauuaagcaaggaaagaggacccccaucuucc

SEQ ID NO: 14976 - RNA, 300 nt, Homo sapiens
cguugcacuccugagagcaagaugggucaccagcagcuguacuggagccacgcgcgaaaauucggccaggguucucgcucuugucgcgucugcucaaaccggcacggucugauccggaaauauggccucaauaugcgccgccaguguuuccgucaguacgcgaaggaugucgguuucauuaaguuggacuaaaugaucuuccuucaaaggguuauccaaggcaucuacucaaugaaaaaccaugaucauucuuuguacauaaaauaaacauuugaaaaacccaaaaaaaaaaaaaaaaaa

SEQ ID NO: 14977 - RNA, 6805 nt, Homo sapiens
uccagcggguguuuucuucucgguuguuagauguacaauuggauuaauguccaucguuuuggaagacgagagaaaguugagaagaacacgaagcacagacccugaugugauaaaacauuuugugguuucucugagucacagauaaacuucugccaucaaauggcuacaguucauuuaaauuuaaaaaaaagaaaaaagaaacagaaaacgugucucagauggcuggcuuuaccucgauagcauaagagagaccuaagacauguaaaauacguauauugcaguaucaucuuuccucacacuccaaauucagcuagggaaguugauuccaauauguuugucauugauauuuauuuuguacuuuauuugcuacaugauuuaugucuauacaaauaauuucucugaggugaauuuaauucauuuauuuucaaauaagcauaauuugcucaauuaaguaugaguuugaauuuaguuugaaaucuggaauuggccagacuguggucauuuuucuugcacaaaaugauaaaugaggugcaucagaauguuaacaauaacuguauuuugcugcuacgcugguauuguuuaggcacuuacuuucuaaucaguagcucauuaacugcuggguuuuguuuuuguauuuuuaacuagaguucuucacuggacauuacuaaguaaaucuaagaaagagacuaaguuaugauuuauugacuuauucaaguuuugauggcaucuuuacuuuuauuuuuucauugcaguugaguagauguacuggugcugcuccuuuguauguguguaugugugugauaacguuaaagaaggcucaauaacuugaagggaaaaaaaugguguguuuauuuaaugaccagaauuuuuuuuacuucucccaaaaucaggguccuacugagucuuuccugauaaaagguaucaaguacaaaugggaaaauauauacauauauagauguaagauagccuuuaauuaauuaauuuacccagagaguguucaaaguuugauuaaaauuguauguuuuguuguuguuaguuuuuuucauaacgaaucuuccuugccaaaaaaacaauagauaauaaaccuuagcucauugucuacuuuugacaaacacucaggugccuacaaacauucuauuaucuugagauaauacauguuccugguuaauuuacagauucugcuggguaacuuuuaugacuugauuuaaggcaguggauuuucauagcaaaauuuauuuugcacauaaucugacaaacaaggaaaacagcuaacugagcugaaaggucuaacacucucgggcuccuuaaccaucaagugcugcccacacaauugcuccuagcccugauuccuugucuuugucagguagccuuaacuuauuuaaaaccauaaggguuugaccuuuucauauaaagacaucuguaacuucucuucaaaacaaaaaugacccucacuguuaacacaaaggacaguuaccaguguagggcacugagaaaggagauccaggagccacucagcuuauugagcggacauggguggcacagaaauggagugguccaucagagaccaaaugguaagucguaaagcacauugcaggagcuuucguuagucauacgccuauuaaguaguggucgcuauuaccaaagcaaccaggacguuuuguguucuuuauaugagugcuauuuuccacagugucauuuauuaugcaacguggaguaaagaguugaaaucuucaccaaaauaaggguucagguuaaaguacagaaacagaaacaaaacgauucgacaugaaguucccaaccauagcagccuaaccuucugcucuuuucuaccugcauggccuugcuguuccuaaacauugucuucauuucacuggcguuguaucugccuaguaccaguauuagugagacuguggauuuuaucagaguucaaugaaagaaagcuuaccccugcccucacuuuguguuuuuuauuuuucccccuuucucaagcaccacguauuuggaccugagaaguggcauagcugcuaaguugacuuuuaauaaaaaacuguuugugccugagggaaauauaugccuuuuuaaaaaguaccucagaacauguucguagaucgucucaucgguuuuguuuggugggacugggaguucagcaggaaguauugucugugugugaugacggggcaguauugccagucggcaauguuguauuugcauucuuuaucccuaacucugaaucuaggacuccaugaaaagccgggucacccacaaaacauuucuuccaauacaaaguguauuauuacgucuauuauaaacuaguuucauuucaguuauuuaucuucauagagugggaaagucuuuuucugaaauacuaauucuaugaaaauaauaauuuuagugaaucuuugccaagaaguuauagaaacuuggaaauaaauuucucauuuucagcacaaaauuaagugauagucccuaagcaguaagagagaauaccauguauuuacacuguggcaucauuuaguauaguuuacacugagccauauuuauuuauaggcauuuaaagugaaucaguauguguaguguugauaaaaaucaguaucuguaaagauaacaucaggaauucaaaaggaaauugaaaaggggcagaacuagugagaaccaaaaagaaugaacuccaguaagacuaauugaagacauacuuggagaggaaaaauaaacagcagaaaugcacuaaaaaauacuggcuaauuauugcaaacagagugagcaaagauuaaugcuaacuaguaaaaguaguuagcaaaguaaacagguaguuuuuuaaaaguaagcacaauuacaauauugaauaguauggagaaaugcuuuucuccugaggauuuuccuuaaucaaaaaauaagaagaagcaauaaauugucuuuggccugagugcugaguggcauaaauaaaggagcuuggcuuaaucuuucugguccacacauaauccauuagaucccauucauauauccaacucuggauucuaauaaaauaauuuggagaacuuugagaaaaaggaaaacuguuaaauaagaaaagaccuauuuagaaauuauacuuuagucuaacgaagaggagguacaauaguagucuucaagaaaagaauauuuaacaaaugauagauaucagcuauagauauuguuacuaagucuagaauaaaaaaggcuucagugugaaggauguauaguaacucuaggaaagagauuuuuaacacugggaaauuaacguggaaauugauaaucauaaagaauauuuguuuuguaaaaauugaauaucauugguggucuaguaaguauuaaguggcaagauaggagaaugcauuucaguucugggagcucauaauccugugauucuuuuauuuuaaguuuuaaaauacauuaaaauuuuacugguuaaucauaaaauauuuuauauuugaaaauaggauggcaaucuuuauuuuuccaagauauuuguuggaaaaaaaugaucguugguauuauuuuuucuuucagcuauauuccaugguaucuuuaaaauuguucagaauauaggacuuuuacuaaaaaaauucaauugucagagucuaaaaaaacaauguccucaggaauacuucagaaauagaagguaugcaaucccuuaguggggggcaaacacauuucagauuucgucuuuauuuaaaaggaucuucagucuacaacauuugcuuuuuucgugcuuuggaaaauauccuugugcagauaaguucuucuguuugaaacaagcaugaaacauugguccaauaaccuaagaauguggagauuucuugauauucuguauuaauuaaaguucucuacaugucucaaauggagaucacaaaacaugaaaaggaagaaaugaaauaucuuuucuucugggaugagugucaauuuuaauguauaauugucauaaucaaucagccaaaaguuacaaucugucccucagagacauugggggaagcugauggauuuccaguaaggaacugugguggguucaaacucaggcugccacaaauacauugauaugguagguaggaaguaggacuaaauuugaaagaaacuuaugggauaaaguucacaauuuuaaaaagguugcccuccaguuuuuuuguuuguuuauaaacuagagugauuuuuaaguaacccuuauauuuaaggcugcaaaaaauguacaagaguauguuuucaaguaaagggaacauaauucuucaaaaagcuguugaacuggaguuaugauagguuaugacagagagcaugaucagugcugauacugacaaguacuuuuuuaccuuaaaaucaacuucuauggaacuacaagaucaaucuagcucccgagugacauuuuccauugucuguaauaaugcccucggaugaguugugucuaaaauuaaguucaucuuuauuuauaugcgaacuuaacugccauagucccuaauguauugcguuuguaaccugaucguauuauguuuacagcugaaagauuucaucuagacaugucuuucguccuuauuauucaaaguguaauugaaagagauauuuaguauuaagacauguuccccaauugagaauuuuccagaauauucuacuuaagaagaagaagagcaauuaacugccuuuaguguaagggcgagagugcauagaaauaugcaauguaaaauguuugcaugaauuauuucacaucauguaagcuuucccauauucauaagaugaacacuauagaagucucauuucucugugaucuucuguccauuaggaaaguaaggagauuguuaucuauaucuagucuccuuuccauauugaacugcauggcucuaauccucaguguauuuuuaucccuucucgaguuauuuaaaauuugcccuauuuaagcugaagccuggauaaacugcugagccagauuauuccugugauuggaguuuaauugcuguagaacacuuguugagaacacauuuuuuacuuuuuuucuuucagaauuauuccucaaucauuguucucuaaugaaaacaccgagaaguaaaucuggugcuucuuaguguaaauauguuuuucuuuuuaaaaagucauuuuaaaacaaagaugagagaacuauaaaguaaggggaaauaucauuuuauuuaaaaauaauuauucaaugauagauaauggagauacagaaugacucauuggguucauagguaugauuugugcagccagucuuagaggaaauacaucauuuuaacauuauucccacaaaauguuaaagcucaaugguuugacuaugagagucaaacaauuacuauuugaaaaucucuuaugacauuuuuauaaucuacucuguuuuuauuugcaugauuaugcuuaugugaugaaccauccaugauucugauauuguauuucuuuccaguauuaacauguguauuguguggccaacucugauuuguacaccguauuauuguuguaaugauucaacuguuccuacauuuaauugcaguuuaauuauuaugccuuuugggguuaaaugaugugaaguguuuccaccuacugauaaauaccauaugaaaacacgacuaaaagacugauuuaagaaacuuguuauuuuuaaaaauaugaauuucaaaagaaauguucucaaagacacaugcauuuauuuuaaauucaaaaaauucuuaugaauuuauuauugcuuguacuuuaacuuuuuuuauuguagacaauccuaagugaauaaugucucaugggagaacacaugauaugugcuuguauuuguguaaucugaucaugcacucaaugguuggaaaaggcacuccagugcuaagaaaauaaccagaagccaauauaucgauucuuauaucucgguuuauguuaccaacugaauaugguguaaugcauaacuuuuuccaguaaauaaacugguuauuuuuuguucauuucauuaaugcugccuuuuuaucaauuugagcaguuuuucuguaugucauuuugauguauacuuacaaaaaggaaaagacuauaugaauucagaugugaucuauauguuuauucaaaguaagaacuuauuugaacuaaaaacuaaaugcuuugcuuuaacaacaauucuauacauuccugguaaguaauguguaucaacucugcucauuuccuccaguuaucaccucuucuacuuguaaucuuuucuagaaagcuauuuuggcaggaggauauacuuggcugaauuugauuagaaauguaccaacaugaagaaaaugcuugcccuaaaacaggaaacauuauuuugaugaaagaagaaugaaguuucuaugcauuauuuugggagacaauuccucuuuguucuuuuuggaacagcagaguuccaaaacuuugagggagguuaauuuucuagcuccuccuacaaauacauauuguaguaaaucagcugcuuugggaaccauccacuuugauucgauuuuauuuaaaggguggaggagggggagaggcagauagaacaugguguucuagugaguuaaaacgucuaaugcaauccucauuauagcuaaucaaauucgugcaacacgggcagccaacauccuggcaaaagcugucugcucaccuguugcauaaauacaacacuagaaauaauaauguaaacuuuucuacaaauuucuccuuuuucucuuccaaaagcuuuuguuuuucuuggagguuggaucuauaagucuauuugauacuugacuuucucuuacaugauaaagcugauagucugccacauucaaaagugaaaacagcuggacgcaucaagaaagucucuucucaucuauacauu

SEQ ID NO: 14978 - RNA, 884 nt, Homo sapiens
uucuuuugcccacacuagacauggaacuggucagcuauuuggagaggcugcuaugaaccagugcagguuuucuggacucacaguuuaugcagaucugcuggaucuggguccagggagucccacugaugggcugaggcuggccaugcccagcuggggagucucagaggagcagggaaucaaaaugcuuccuggaaucaccacccuggucuucaaguucuggcauggagucauaguugcagcagacuauagggcugcagugggugcuuacauugccuccagaugguaaagaaggugacagagaucaaccccuacccgaagccaucauggcuaggggcacagggaacuguagcuucugagaauggcuguuggcucggcaaagucaaauguaugagcuuugaaauaaggaaugcaucccuguaacagcugccuccaagcugccugacaacauauuguaucaguacaaaggcauggggcuguccauaggcaacaugaucuguggcugggauaggagaggcccuggccucugcuacauggacacugaagggaaucagaucucaggggccaccuucucuguagguucuugcucuguguaugcuuaugggguuaugaaucagggcuauuccuauaaccuggaaauggagcaggccuaugaucuggcccaugagguaagcuaccaagccaucuaccaagccaccugcauagaugccuacucaggaggugcugcuaaccucuaccaugugcaggaggauggcuggauccaagucuccagugacaaugcaguugaucuucaugacaaguaugauggaucuaccccaggagggagggugauguagcuguuugcauuucuugggugacugucauugguaauauggauacagugcuuc

SEQ ID NO: 14979 - RNA, 884 nt, Homo sapiens
gaagcacuguauccauauuaccaaugacagucacccaagaaaugcaaacagcuacaucacccucccuccugggguagauccaucauacuugucaugaagaucaacugcauugucacuggagacuuggauccagccauccuccugcacaugguagagguuagcagcaccuccugaguaggcaucuaugcagguggcuugguagauggcuugguagcuuaccucaugggccagaucauaggccugcuccauuuccagguuauaggaauagcccugauucauaaccccauaagcauacacagagcaagaaccuacagagaagguggccccugagaucugauucccuucaguguccauguagcagaggccagggccucuccuaucccagccacagaucauguugccuauggacagccccaugccuuuguacugauacaauauguugucaggcagcuuggaggcagcuguuacagggaugcauuccuuauuucaaagcucauacauuugacuuugccgagccaacagccauucucagaagcuacaguucccugugccccuagccaugauggcuucggguagggguugaucucugucaccuucuuuaccaucuggaggcaauguaagcacccacugcagcccuauagucugcugcaacuaugacuccaugccagaacuugaagaccaggguggugauuccaggaagcauuuugauucccugcuccucugagacuccccagcugggcauggccagccucagcccaucagugggacucccuggacccagauccagcagaucugcauaaacugugaguccagaaaaccugcacugguucauagcagccucuccaaauagcugaccaguuccaugucuagugugggcaaaagaa

SEQ ID NO: 14980 - RNA, 19805 nt, Homo sapiens
augaugugguccaacuucuuccugcaagaggagaaccggcggcggggggccgcgggccggcggcgggcgcacgggcagggcaggucggggcugacgcccgagcgcgaggggaaggugaagcuggcgcugcugcuggccgccgugggcgccacgcuggcggugcuguccgugggcaccgaguucuggguggagcucaacaccuacaaggccaacggcagcgccgugugcgaagcggcccaccuggggcuguggaaggcgugcaccaagcggcuguggcaggcggacgugcccguggacagggacaccugcggccccgcggagcugcccggaggugagcagccgccgccccgagcgcagggcuugcgucccacggacagggagggagaggggcccguguccgaggagaaaacccgccccagggacaaaagccugagcccggaggagacagcuugccucgcaguaagcgccagugcccacuucguccucugcucucagaaacugcugagagauagagggaucccccagauauggcccaggucccucacgggccuaccgccagagaaccugugccuuagagcuugcuuuccugcuacagacuguaccccaagaccagaaugugccuacagggagucugugcccccaggccauccuguacccccagaccaggcugugaccugagacccccucagacgagucuguaccccuauucugcaccucuaaagagagcuugugcccccgccuacagccugugccccaagaccauccuguaccccgacuauccuguacccccagaugagccuguguccccagcuacaguuuccacccccagacuaacaugcaccccuagaccagucuauacccccagaccagccugcauccuuacaccagccugugcccucagaucagccugcaccuccacaccaggcuauggucccagaugauucuaugacccccaaagucccugcccccacacagccaauguucccaggcaucgcuguguccccccagaccagccuacagcucuagagagagccugugucacuagaaaaaucuugccuguguccccagacccagccugugauuccagacacagcugguguccucagauagccugugcccaccccagacagccugcacccucuggaagugccugugcccuggagacagcccgugcccacucugcaugugcccacagacagccugugcccauggagagacagccuggguuccuggugucagcuuccucuucccagccuggagacagcuugcgcucccauccugugagcccuggggagacagacgcccaccccaaagcaggaucuaugccuguuccccaccuacugcuuccaccaaaccaagcucucaccagacgccucccaacacccgagggcagaccuuguuccuucccugcaauguucuucacuuccuguccucucgccuccaaaugcccagacuggacauuucagcguuucucauuuucuccgagagacauucccauacucccuccuuucccaaaucauggcuguuuuaucccugggcauggcagagagcuguuccauaccucccugacacgccacgccacggcuugugcuuauaccagggggacauucuauaccccuugggaacuggaugaaaucuccuucuaccuccacugacccauggaaaauaccuggcacuccucagagcccauuugggcugucauauauuugaucacccauaugagaucuccagcacucuucagucuccaaagacgguccuaucaucccagugccccucaaagaauauggccuauuuuucugggcuccguaugagauuucccucgucccucacuucuccagaugugauaucuuauauguguagagugcaaaauaggaugucccaagcccucgauaggacagugggaugccaggccccccggcugucugagcuacccacuugguguccagaugggcuacccuugaucauuuuauuucugcagaugggcugucucuggccccucaggggucucauaaaggaugaucucaaacuuuugcaaaaugggaguccccaguaauaagaauaguagcugcuuauguaaugccugguucucaucucaguguuuuauguacauuaacucaucaagcaucauagcuagccuaugagucguuauuaucacucccguucuagagaagagaaaaaugagggggcgagaaaucucgguggcucggucuaugcacccaggcuaguuagauggaauuugaagcuugguugccucucuucucaacaacugcauuauaucacaucucacugguccaucaagagaucccaaaggucaaagguccugggacaauggagggguggcccaucccaucucaccgcauuguaugggguuccuugcaucccuugcuguccccuccauugaucagaaaggacuucagucuuccagcagggccauuaacguuaucuuacaaacccaaccccucagaggacaucucucaaucuucauuaucucagagaaauaucucacacucaccacugcccaucaaaaggcaucccuggcucccuuggcuauaaguauggaaugugggggugacccuuacccugcacuuuuccagaugggaugugucauguuuggggguggucgaauugggaugugcuaaacuauuaguagccaaaagaggaugccaggcaaccuacauugucccagaagggccgucacacuucccuuguggauguagaccguguuucccgcaaugacugcuucaaagagcaccugcacccuucgcucagugacgugaagcacccuuuaccucuuuuucuuugaaauggaguuuugcucuuguugccccggcuggagugcaauggcacgaucucggcccacugcaaccucugccuccaagguucaagcaauucuccugccucugucucccaaguagcugggauuacaggcaugcaccacaacauccggcuaauuuuuguauuuuuaguagagacgggguuucaccauguugacgaggcuggucucaaacuccugaccucaggugaucugcccgccucggccucccaaagugcugggaugacaggcaugagccaccacgcgcagcccagcauccucuaccucuugcugcugcauaagaacucacauaucccacuccuccuggccggacaucucaccccuucaccuccccucgggguacuuggggagcgcccgcccacaccaccucaccugacucagggauugauuucuugucccuucauauccuuguucaaauugaaaaguucaauuuuucacauucauggacugccuggucccucuucuauggccuuuacuccuguuauucucgaccucucuucucucuuucugugccucaguuuccccaucuguagaauaagagaguaggucaggcuaggugaauucugagggaauuucugggucuaaaaugcacuucagaaagugcuccccucccuuccuucauuucuccuuccuucucucccuuucuuccuuuuucugucuuucuuaacuuuaaaauuucucucucucucuuuuuuuuuuugagauguagucuugcucugucacccaugcuggauugcaguggugccaucucagcucacugcaaccucugcuucccggguucaagcgacucuccugccucagccuccugaguagcugggauuacaggcaugugccaccacucccggcuaauuuuuguacuuuuaguagagaugggguuucaccauauugacaaggcuggucucgaacuccugaccccaagugaucugccugccuuggccucccaauguguugggauuacaggcaugagccagcacacccggcccugugcuuuguuuuauauuauuuuuuccucguucuuuuccagcucaucucuuuaauguguuugauauacacucacagauauguauuuugacuuggaaaauauauaguguuaguuuauauguguguuuuacauaaaugagaucaugcuauugauuuugucugaucuuugggauuuuuuuuuuuuuuuuuuuuuuugagaugggaucucacucuaucacccaggcuggagugcaguaguacaaucuuggcucacugcaaccucugccucccaggcugaagggauccucuugccucagccucccgaguagcugggauuacaggugugugcugccacacccagcugauuuuuuguauuuuugguacagacgggguuucaccacguuggccaggcuggucucaaacuccugagcucaagugauucuccugccucggccucccaaagugcagggauuacaggugugagccaccuuuccuggccucaauuuuuggauuuuuaaauuaaauuauuaauauuaauuaucauuauuguuuugaucaacacuguguuucucaaaucucuccaucuugcuuuagguuauucuaauucauggcuauauguacuggagagauuuucacaaggacugucugugucauuuacuugucuguuccccauuagauggacaccugacuugauucugacuccauguuacuuauaaacagugcugcuguaaacaucugcauauauauuccuguuuuguuuuuuuuuucuggaguuauacccugcaaugaaauuguugagccacaggcuaugaacauucuucauuucauaaaguaccucagagugccuucccaaaagacuaggaguacccguucauacacgguguuuccucuuaucuuuucaaacgcuugauaugacccuuuuaauguuggccaaucuaauugaugggaagugguggcucccugcugauuccggcugccucucucugaucccuggugaaguggggcaucucuccauggacuuaugaguuacccaggcuuccucuuuugugaauuacuauucauacccuuugcccauuugucaacuggguucucucucucuucuugcuaauccgcaggagcucuuuguguguucuagguaggaauccuuccugagacaggauuccuuucugagucuguuagucuucugcuacuuguaucuugguauccuuuguugaaucaagugauuauccauauguaaucccacuugacccucaacaaacccauacgaaggggccaggaaagagauuauuaucucguuuuaaagaggaggaacuagagacccagagaggcuaauggcgcacuuggggccacaggucuggggcucagagccccggguaggagucccagcuccuagauggcaguguggucgcagguggcuuucacaccucugggcaucauuuuucuccucuguguaucagggaugcugauguccaaguuuuaggcucccgugggcuguuaacuguccagcccugagcuuacgcaagggaccucacauccucaugucuguuuucucucuccugcucccacagaagcaaacugcaccuauuuuaaauucuucaccacgggggagaaugcacgcaucuuucagagaaccacaaagaaaggugagaacuuuucacccccugcugggugacaggugggggaaaugcugagcgugcuggaggaguucuagagagaguuauccccuccucugcuuuaccccagggcaggucucgugucuauaaucuguggcuguccccuggggagugcuggcgggagaguuaaugauggggacauggugcucuagagaaucuagagaacucuuuuuuuuuuuuuuuuuugagaugaugucuugcucugucacccaggcuggagugcaguggcacaaucucggcucacugcaaccuccgccucccagguucaagcaauucaccuaccucagccuccugaguagcugagacuauaggcgcccaccaucaugcccagcuaauuuuuauauuuuuaguagagaugggguuucaccauguugaccaggcuggucuugaacuccugaccucaggugaucccucuccucagccucccaaagugcugggaugacaggcgugagccacugcaccuagcugugccuagagcucuuaccccaucucugccuaugccacguucugugucaccccgggcaagucgcagccccucucuguggguagcacuuggacaucucacaaaccugcaggcaucaaguacugaccacagugcugggcacuccaucuguaagaucuccaguccucgcaguagcccugcagggugggggcuuuaucuuccaucuuccagaaguccaggaaugguuacaauuauucuucccaggaaaauuuuucaccauguuggccagccuggucuugaacucuccugaucucaagugauccacccaccuuggccucccaaagugcugggauuauaggugugagccaccgcaccugguccacaggaggaaauuuaggcugagaaggguucagccuaaauuccuacuggaaucuggaaaauccuacuagaaucuuccauguaggaaguaguuggugagauuuccaaccuggaucauuccacuguagcacacugccuuugccaucgucucccacacaccccacugccucagcuuccucaacuguaaaccagugguaaccagauccuaaguaauaguugguaauucucaacucuuucuaauccuggcccucuccucccuuugcucagugacuuuagagaaauaacugacccuuucugagucuuaauuccuucaacaguguaaguaaaauguugggcuggaugauacucuacuugaaaauucuucucucgucccgaaucuuacaucuuccugguucuggguuccuaugggugaauccuccucauucccuacaucccauguucucugcuucuuuccucucuccugcuggcagaggugaaucuggcagcugcggugauagcagugcugggccuggcagucauggccuuggggugccucuguaucaucauggugcucaguaaaggugcagaguuccugcuccgaguuggagccgucugcuuuggccucucaggugaggguucagagccuggaggcugaggacauugcaugcugggaggaucuccaggcacuguugcaugcugggagauggggucucuaugcacuguugcacgcucagagauggaaucucuaugcacuguugcaugcugggaguagggucuccacacacuguugcaugcugggaguaggaucuccacacacuguugcacgcugggaggugggaucuccaagcccuguugcaugcuuggaguugaggggaagcccaagggcuauaguagguucaaagaugggagaaccccaacaaccgggcuaaggauuggaggguguccaaacauuguuuuagauuuggaccugggauuuccaaucacuguugcaugcuaggcauuagagaaagcgcaaggacuauagaggucucaaaaauuggagaguucuaagcccuguuguuggcugggaauuggaagcuguccaaacgcuuuucaagguuugaacauggaguccccaaacacuguuucaugcugagauguuuuaagcacuauagcguguugagaggucagggaagcccaggggcuauagcaggcucaaagguggaagaguuccaagcccuauuguuggcucagaauuugauggucucuaaaugcucuuuuagauuugagacuugaggucugcaaggacuguugcauucuuggagcugaaggucuaaauaaaaugcugcaucuugugaaauguagcccucaguaauaaacaacacuucaguuuauuguacuuccaguucaaauccuuacaacagcacuauuaggcagggcuuacuaucccccauuuuauuuacuuauuuauuuuugagacagagucucccuuugucucccaggcuggaguguaauggcaugaucucggcucacugcaaccuccgccugcuggguucaagugauucuucugccucaguuucccaaguagcugggauuacaagcaggcaccaccacgccuggcuaauuuuuguauuuuucgguagagacaggguuucaccacauaagccaggcuggucucgaacuccugacgucaagugaucugccugucuuggccucccaaagugcugggauuauaggcaugagccaccacacacagcuucccccauuuuauaaaugaggaaauugaggcucagagaagucagaugaauuacucaugggcacacaaucaaugauggcaugauggcagaggugggauuuuaaacucgguuuucuuucuuucuuuuuugagauggagucucacucugucgcccaggcuggagugcaguggcacgauuucagcucacuacaaccucugccucuagguuccagcccaagcugugcccugaaucacuguguggccuugggaagguuccuuuuauuuucugggccuugguuuucuucuuggaucaaauguuuucuuuucuuuucuuucuuuuuuuuuuuuugagacagaguuucgcucuuguugcccacgcuggagugcaguggcacaaucucagcucacugcaaccuccgccucucagguucaagcaauucuccugacucagccucccaaguagcuaggauuacaggugugugccaccacgccuggcuaauuuuuguauuuuuaguagagacaggguuucaucauguugaccaggcuggucuccaacuccugaccucaagugauccacccaccuuggccucccaaagugcugggauuacaggcgugagccaccgcgcccggccaagacuuucauaaaacacuuuuauaucaacaccuuccugugcacccccagggguaaugcaggugugaguuuaauaauaacgccagcaccaaauuccuaccaagcuacaaauuccaugaaaacagacaucaucuuuaucuuuuucaucguucuguccucagggauuuagagagggccucucuggggaggugacauugaagaugucaaaguauggauagacaagcugggagaguuugcugcauugcagaucuugaaagaaagccagugugacaggaguguggagagagacagggagacugguguaaaagaugucacugcauuaaugugacauuaaugucacugguccugugacauuaacagggaaucaaaaagaucuggguuggagucccaacuucuuaacagccauguaauuggggcaaaccuuuuucuaucucugagcuuaaaucuccuuauagccaugaacucacucauccauguaucuguuaguauuguguccauccuauccauccauccauuuauccuuccguugauugaucaguuuccuccuucucuccccuuccuuccccucucucucuuucccuaugucucuuucuaucucucucuuuuuuuuuuguuuuugagacagggucucgcucucucauccaggcuggaguacaguggugcaaucucaucucacugcaacuucgacuuccaaggcucaagugauuguccucccuaccuuucagccuccugaguagcugggaauacaggugcaugccgccaagcccggcuaauuuucgguuuuuuuguuuuuuuuguuuuuuuuuuuuuuguagagauaggguuucgcuguguugcccaggcuggucuccaacuccugagcucaagugauccgcccaccucggccucccaaaagugcugggauuauagguaugagccaccaagcccggccccucucucuuuucuuucuuuuccacccucuuucccuuccucucucccuccaaucaucuauuucuccuuuuuuuuuuuuuuacuuguccauucauuuaacaaguauuucuuuaauauccagugagucccagaugcugugcuaggagccgcugaggacgcaacgaugaauaaaauaaagaugauguuuguucucauggaauuuguagcuugcuaggaauuuagugcugguguuauuauugaacucacaccugcauuacuccugggggugcacaggaaacuguugauauaaaaguguuuuaugaaagucuugagcacaaaaauguuccacagauuguacaaccaauugagagugaagaaggauuugauguuguaauuacugugguuagauugcgugucagggacuggggcagguugggauuuugaggucucccuaaauaaagggucguguucagguugucuuguuucucuccuuauaauacauauaucagcuguuguucuaguuuuagagguaugagacagagaagucugcugcccucguggauuuauagugcagugggagagacagaaaugagauaaagagacauuagucauacaaaucaauauacauucauaacuaccaacugugaugaaugcuauagauaaaaaguacagaguaugagaaaaauguaugacaggagacccacuguagauuuagguggcagugguuagugaaggcgucccuuugaaacauguacuucauacagagaugugaagaauaaggacaucuaagacaggcucagggagggggaggcggaaaauuauuccaagcagcauaaaggucuucaagccugaacaaaucuggugcauugaaaguccugcuccacgcugcgagagugugggaggagcagcuugagaggaggcuggagaagccgcaggagccagacccgcaugccuuuuuauuuauuuuauuuauuuuuuauuuuugagacaguuuugcucugucacccaggcuggagugcagcggugcgaucucggcucacugcaaccucugccucccggguuccagcgauucuccugccacagccucggaaguagcugggauuacaggugccugccaccacaccuggcuaaguuuuguauuuuuaauagagacuggguuucuccauguuggccaggcuggucucgaacuccugaccucaggugauccaccugccuuggccuccgaaagugcugggauuacaggcaugagccacccugccuagccauccaccagcaaauucuauuggcacugcuuccaaaauguguuuugaaugcaaacacuucccucgguuucacuaauccaagccacggcuauauuuccccgagguaauuucuauggccuccuaacucuucucuaugcuucuccuuuuaaccuccucaaguccauucuccacagagcagcuagagugauacuucuauuuuuuuaauuuuaaauuuuuuaagacagggucuggcucugucgcccaggcugauguacaguggcacaaucacagcucacugcagccucaaccuccugggcucaagcaauccucccaccucauccucgaguagcugggaccacaggcacacgucaccacucugggcuaauuuuuaaaauuauuugcagagaugaggucucacuauguugcccaggcuaaucuugaauuccuggacucaagcaguccucucgcuucagccucccaaacuauugggaugacaggcaugagccaccgcacccggccaagugauacuuuuuuuuuuuugagacggaguuucgcucuuguugcccaggcuggagugcaauggcacgaucucgacucacugaaacgucugacuccuggauucaagcgagucuccugccucagccucccgagcugggauuacaggcaugcgccaccacgccugguuaauuuuguauuuuuguguguguguguguguguguguguguguguguguguguguguguguguguguguguuuaguagagaugggcuuucuccauguuggccaggcuggccucgaacuccugaugaccucaggugaucugcccgccucagccucccaaaguguugggauuacaggugugagccaccacgccuggccccuaagugauacuuuuauaucauaagucggaucacggauucuccccagaauaaaagccacuuaaauuccuacugcuagaauaacaugguggcaaggccucgcgcgggcugacucccggcgcccugcgacucccucuccugccaccugcucucccugcuccggccacgccagccucugcuguuccccagacgcucuaagcucauuccucccgcagcguguuuucccgggcugccuccucggccuggagcguucuuccgccggcgcuucacgugucucguuuccucgcauuguuuaagucucuggucaaaugucaccaccucagagagaccagcacugaccaucgugucuaaaggggacucauuugguauccaagaaaauguuaaaaauaaauaaauaaauaaauaaauaaaagaggggggcgcgguggcucacgccuguaaucccaacacuuugggaggccgaggcagguggcucacaagaucaggaguuggagaccagccugacuaccauggugaaacccugacucuacuaaaauacaaaaaucagccgggcgugguggcgggcgccuguaaucccagcuaagcaggaggcugaggcgggagaaucgcuugaacccgggagguggagguugcagugagcugggaucgcgccacugcacuccagccugggcgacagagcgagacuccaucucaaaaauaaauaaauaaauaaauaaauaaauaaauaaauaaauaauaauaaaagaaagagcacgugagagaaacugggcgcgguggcucacgccugcaaucccagcacuuugggagggcgagguacgugaucccuugagcccaggaguucgagaccagccugggcaacauagugaaaccccaucucuaccaaaaauacaaaaacuagcuagucucauaaccugaucucaaaaaaaaauagauaaaaauuuaaaaauaaaauaaacuggccgggcauggugguucaugccuguaaucccagcacuuugggaggcugaggcgggcagaucucaggauuaggaguucgagaccagccuggccaacguggugaaaccccguuuuuacuaagauauaaaaaauuaggcgggcaugguggugaugccuguagucccagcuacuaaggaggcugaggcaggggaaucacuugaauucaagagguggagauugcagugagccaagaucgcgccacugcacuccagccugggcaacagagugagacucccucuuaaaauaaaauaaaauaaaauaaaauaaaauaaaauaaaauaaaauaaaauaaaauaaaccaggcgcgguggcucacuccuguuaucccauaacuuugggagccgaggcuggcagaucacuuaaggccaggaguuugagaccaaccugaccaacauggugaaacccugucucuacuaaaaauacaaaaauuagcugggcguggcggcgggugccuguaaucccagcaacucgggaggcugaggugggaggaucauuugaaccugggagguggagguagaagugagcugagaucgcaccacugcacuccauccugggugacagagcaagacucuguuucaaaaauaaauaaauaaauaaauaaauaaauaaaauaagaaagaaagaagacucauuucuagcugggacuuuaccugcuuuauuuuucuucacagaauuuaucacuaccugaaauucucugcuuauuuaugcccguauucauuugccagggccacuauaagaaaguaccacagccuggguggcucucuauuuauuuaugcccguauucauuugccagggccaccauaagaaaguaccacagccuggguggcugugguacaacagagauugauuuccucaccguucuggaggcuggaggucuaagaccaacgcguccacagggaaguuuucuccaaggcuucucuucuugucuuguaaauggccaacuuaucccuguaucuucacauggucuucccucuguacuggucuguguccccaguuccuucuuucuuuucuuuuuuuuuuuuuuuuuuuuuuguugagucagagucuggcucugucacccagauuggagugcaguggugugaucucucucugcucacugcaaccucccccucccggguucaagugauucuccugccucagccucccgaguagcugggauuacaggcacccgccaugacacccagcuaauuuuuguauuuuuuaguagagaggggguuucucuauguuggccaggcuggucucgaacuccuggccucaggugaucugcccaccucugccucccagaguauugggacuacagccgugagccacugugcccggccuucuuuuuuuuauuuuguuauuuuauuuuauuuuauuuuauuuuguagagacagggucucacucuguugcccaggcugaucuugaauuccuggccucaagagauccuccugccugaaauuuuuuuuaucucauaaggacaccagucacauuggauuaggguuccuucugaugacuucgcuuuaacuuaauuaucuguuuguguguguguguguuuguuuuguuuuguuuuuugagacagggucucacucuguugcccaggcugaagugcagugguucgaucucagcucacugcagccucugccugcaggauucaagcgauucucaugccucagccucccgaguagcugggauuacacgcaugcaccaccacgccuggcuaacuuuuguauuuuuaguagggaugggguuucaccguguuggucaggcuggucucaaacuccugcgauccgcucgccuuggccucccaaagugcuggaaugacaggcgugagccacugcacccagccuuaacuuaauucugucuuuaagaacucuauauccaaauacagucauguucugagguacuuggggucaggaccccaaaacaucaacuuuuuuguggaggacacaacucagcccucaacagugcauuuaacugauaauuguccaucucuccuucuuggaugaaacuccagaaggacagggauuuaguuguaguaucauuuauguaucauauuauauguauuuuguaauaagagcucaaugaacaucuguugaaugaaucaaagaaugcaugaaucaggucugcugugguggcucacaccuggaaucccaacauuuugggaggcugaggcaggaggauuguuugaggccaggaguuugagaccagcccggggcaauguagaaagaucccgucucuacaaaauaaaaugaaauaauuagccauggcagcuugcgauguagucccagcuacucaggaggcugaggcaggaggagggcuugagccugggaggucaagguugcaugcagugagcuaugaucgcgccacugcacuccagccuggguggcugagaccuugucacuaaaaaagagaaaagaaaaaaaaaaaagauugaauuaggaaaggaaugaaggggaguccuugucuaaaugcuuuuccaccucccguucuguaauguugggcugcauggagcaaagaaggggcuuuuaaaucacagcauccuggcugcauucuccaggcccugaaucaaaaccacagugaauggcugggcacgguggcucaggccuguaaucccagcacuuugggaaguggauagaucaccugaggucaggaguuugagaccagccuggccaacacggugaaaccccaucucuacuaaaaauacaaaaaugagccaggcgugguggcaagagccuguagucccagcuacucaagaggcugaggcaggagagucucuugaacccgagaggcagaggcugcagugagcugagauugcaccauugcacuccagccuggaugacagagugagauuccgacucaaaacaaaaccaaaaccgguaaacaaacaaacagaaaaaaacaccacaguggggcuggggcgcagggaggaagcagggucaggaacugggguuggggcaggacuccagggucuggagagaaggcggcugggauccaugacucaugcgugacucucagacgguccugcaugaccuggccccugcccgccccugcaguuccauuaccgccucucuccccaaccccaacucuccuugcucccaccacacucagcuuuucucuuuucuccaaacacucugugcugcguccuacacaggacccucgcgucagcaccuccuucugcucggaacagccguugcuucguuuugagcaugacugacuucuuuucauccuucaggucccagcucaaauggcuuuucucgacaccauccaaagucccugcuccaccccugggugccacucucucuguuucuauuuccuuccuuucaugcaucacccucugagauuaucuugucuccucauuuguuuauuuuggacauugcaaccuggcagccugcaggcccucgauggccaggagaugugcuuuguuugccaggcaguguguaaagauuucuucgaguugacguuuaaagguugggagaauucccauaaaaauaauaaucauuuaagcaauuauaggccgggugcggcaguucaccccuguaaucccagcacuaugggaggccaaggugaguggaucgcuugaggucaggaguucuagaccagccuggccaacauggugaaaccaugacucuacuaaaaauacaaaaauugccgggcgcgguggcucacgucuguaaucccagcacuuugggaggccgaggcagguggaucacaaggucagaaguucgagaccagccuggccaacguggugaaaccccgucucuacuaaaaacacaaaaauuagccaggcgugguggcgugugucuguaaucccagcuacucaggaggcugaggcaggagaaucacuugaacuggggagguggagguugcagugagcugagaucaugucacugcguugcagugagcugagaucaugucacugcacucuagccugggcaacagagugagacuccaucuaaaaaaaaaaaaaaaaaaauuagccaggcgugguggagcacaccuguagucgcagguacucaggaggcugagcaugagaaucgcuugaaccugggaggcggaagcugcaaugagcugagaucaugcuguugagcagcugcagcuggcuucugccaucauuucuaccuuacuugccgcccuguguguuuacacuuucucaugcccccugcaggcauuugaguuuugcaaauuuugguuuauuuguuuacugucuaucuccaaguaauauauaagcuccacgaggguagggucuuucucuaucauguucuuucuuuuucuucuuuuuugcuuuuuuuaaaaaaaaaaaaucagccuguaaucccagcuacucgggaggcugaggcgggagaaucacuugaaaccagaaggcagagguugcagugagccgagauugccacugcacuccagccuggguguaagagcgaaacuccgucucaaaaaaaaaauaaaaaauaaaaaauugcauugcaauaugacuuuaucuuuauuuugugaccccucccccucuaucacucuuuuaaaaaacuugcauggagacuauuucuuuucuuucuuuuuuuuuuuuuuuuguugcccaggcuggagugcaauggcgugaucuuggcucaccacaaccuccgccucccagguucaagcaauucuccugccucagccucccgaguagcugggauuacaggugcacaccaccacgcccagcuaauuuuguaguagagauaggguuucuucauguuggucaggcuggucuugaacuccugaccucaggugauccacccgccucggccucccaaagugcugggauuacaggcgugagucacugugcccggcccaauuuuuguauuuuuaguagagaugggauuucaccuuguuggccaggccagucucaaacuccuggccucuagugauccaaucgcuucagucucccaaagugcugggauuguaggugugccuggccgcuaauggagucuuaauuugaauuuuguguuuucugauuccuguguuugcuuuaagaaaaaaaaguugugggaaaaugugcuaaacauaaaauguguaauuuuaaccauuuccccuuuuuauuuucaauuuuuauuuauuuauauauuuuuaagaauugggaucuugcuguguuguccaggcuggaguguacuggugugaucacgguucacugcugccucauccuucugggcucaaaugauccucccaccucagccuccugaguagcugggacuacaagcgugcaccaccacaccuggcuaauuuuuuaaaauuuuuuuuuuguagagauggagucuugcuauguugcccaggcuggucucaaaauccuggccucaggcaauccuucguccucggcgucccaaagcgcuuggauuacaggugugagccacagcacccagccuccucuuuuauuuuuaguugacauguaguacuuguacauaucugugggaaacagaaggaugguuugaugcauguaaacaaugcauaaugaucagaucagggcaauuagccuauccaccucuucaaacuugaucauuucuucauguugugaccauuucaaaauccucuccucuagcucuuugaaaauacacagccaggcacgguggcucucaccugucaucucagcacuuugggaggccgagguggguggaccacuugaggucaggaguuccagacuagucuggccaacauggugaaaccccgucucuacuaaaaaaaaaaaaaaaauauauauauauauauauauauacacacacacacacacacaaaaauuagccaggcgugguagcgcacguguguaaucccagccacucaggaggcugaggcaggagagucgcuugaaccccagcuacucgggagacugaggcagaagaaucaggaggcggaguuugcaauaagcugagaucgcaccacugcacuccagccugggugacagagcaagacuccgucucaaaaaaaaaaaaaaaaaaaaaaacaaaacaaaacaaaaacaaaaaacuaaggaaccauauucacccuacagugcugcgaacaccagaacgcguuucucccgucuagcugugauucuauauccgccuuuuaaucauuuuccagcguacgguucuguggcaucaauuccguucacauuguuaugcaacuaucacccccauccaccuucagaacgauuugcgucuuccccagcugaaauucuauaccuguuaaacaccaacuccccuuuuuccucuucccuccggcccucggcaaccauccuucuacuuucugucucuaugacuuugugucuuguuuuuuuuuuucuuuaucuccagcuucccaaaugcugccugcuauauaguagguguuuaguaaguauuuguugagugcacgcgugggaaggugccagggugggcgggagggcugggagcggauggcggagauguucagacacagcuggggucgcgggcgucugacugcgagcuguccucucucccgcaggccugcugcucuuggugagccuggagguguuccggcauuccgugagggcccugcugcagagagucagcccggagccucccccggccccacgccucaccuacgaguacuccuggucccugggcugcggcgugggggccggccugauccugcuguugggggccggcugcuuucugcugcucacacugccuuccuggcccugggggucccucugucccaagcgggggcaccgggccaccuagagccacgcgugagacuucucuaagcaaccaccgagcccuuugaccuucuccauuguacccccaagaucuuuuugccccaucuccuagagaaacuguguucucccugcucgggggcccauguuuuuuuacacgccugccuccuguccccuuauccuuucucccucuguaaauacguuuuucucuguggcuguauguggguugcuugggggugggaugggaagaggcucuuugcaaacgaggguccccagagaagacuggcggggaccugaugggguagcuggggugugggguugggggaugaggucagggggucuugggugggaguugggggccccuucauuucccaggucuggaucgauucacuugccgggagagacuuuuuacaacucaucugcagcuccgggugcgguugggggagauagcgaagggucuggccucgcugugaucugauuugggauuaaagguuuggaaauuuaacaacuuugcuuuggag

SEQ ID NO: 14981 - RNA, 17167 nt, Homo sapiens
gucaaguuuagagcucuuuuuaauugguugcgggggcauauucugccuugaagucauugguugguccuggaaguggguggggaaagcggaggaaggcauggagugugggcguuaggggccgcguaccuaaugggagacagacaggugccuuuaaagcgggggccgagccgaagucaucugccaaucaaaacagccacagggccaagugggaggagcugggcaagaaaguccaccccuuuuucuucguuggcccuaaaaguuaucauucaugcuaguuugaccaauagcguggcgagugggcgguagcugcucguagagcgugugaaagaggguguauguagcuggcagaagugggacuuggucgcaaccguugcgucccggccagguaagcagcuucccucucagcugccucgucuuucuccaagugccucuauguuggcacaucucugaaauucauuauuugcugagugaaagaagaaagggaccagagacacugcuuuaagucucuggcaccgugcauagcagaauugguugggaagcgugaggcauggaguuuuuguccugccccugccugguuaggcgaccagaugguaggacagucauucuccucugcgucuccgcuuccuuaguguguugaggacgcugcagaagguacagaggagacggguggcucccuaaugccugcucguuucaggucucagcucuguugucuucuuggagagaaaacuucccugaccucccucccgggcggagcgcuccugcgcgccuuguucguuaggauuuauuuuuguacgucuaccgucauuuucguaauuauucgguuucccugucuggauuuugcaucuccagcacuuagcacgcaggaaguagucaguaaccauuugucaaaggaauagaugaaugaaugugaggaaugacuugugauugaaaacuuacuagacacugagacuuccacgaacugggaggcauuugcccagggucacacaaccgagaugggaagccagauucgccccuuccugucuaggugguggaaaguaagauaaaucccagggagaggugaacgugaaggaggauggagccguucagcaccacccgcaucagaauggucugaggcaagggggaggaggaaugcuugcgaaaaugcauauucguaggcccacacacagacaacgggaaugaagccuagaguuauuguucuagagcucugcuauucaaacuguggccccuggacaaaguaucgcuucucagacaucuccggaaucaccuaggaauguguuaaaaugcaaauucugcuuuucuaacaagugccgcaguccacgguccgcaguucacuuugcacaccgcggaucuagcgaugacuuuccaacuuggcugcacaucagagucaccugaggaacuuguuguuauuguuguuguuguugagacgaagacuugcucuugucccccaggcuggagagcaguggcacaaucuaggcucacugcagccucugccucccgggguucaagugauucucccgccucagccucccgaguagcugggauuacaggcgcccgccaccacgcccgacuaauuuuuguauuuuuaguagagacgggguuucaccauguuggccaggcuggugucgaacuccugaccucaggugauccgcucgccucagucucccaaagugcugggauuacaggcgugacgacugcgccuggccuaccugaggaacuuuaaaaaaaaaaaauuuuuuuuaaauuagaggccaggccgggccgggagaaucacuugaacccgggaggcagaggcugcagugagccuagauugcgccauugcaccuguaaucccagcacucucagaggccgaggugggcggaucaccugagguagggaguucaaaaccagccuggccaacauggugaaaccccgucucuacuaaaaauacaaaaauuagcugggcaugguggcaugugccuguaaucccagcuacucgggaggcugaggcgggagaaucacuugaaccugggaggcagagguugcagugacccgagauugcgccauugcacuccagccugggugacagagcaagacgccgucucaaaaaauaaaaauaaaaaauaaaaaaguccagauacccaggcuuacacuggaccaacuaaaacgaucuugaggugggagccagugucucucucacccaggcuggagugcaggggcgccaucucggcucacugcaaccucugccucccagguucaagccauucucccaccucagccucccaaguagcugggauuacaggcgugagccaccgcgcccagcguaagagccgcuuacagagucuucuuuucuagagcagugcuucugaaauguggccuugggucaggcacguacccaucaccugggaacuuguuugaaaggcacauuuuugagccccacccuagacugaaucagaaacucugggcccagcaacuauguuuuaacaaguccucaguguaauucugaagcgcauuaaauucugagaaccucuguucugaaaguacgagggcugcaggcccaggcgacucaagauuccuuuccugagauugacacccucaugccacagccccauugguagaugccggauauuuuggccaagggagaugggggauucugaacaggguuguggaccacggguccuucccuggcagaccaguauguagagaucagcaaagguugucauuuucaaacaggguugacccagagggucagggauaacauugagaaaacagacuugaguuauacaaccugggguaguucagccacucaagggaaccuccugagugugucgacuuuuugacuugaggaaggagagagauuuagagauugccacugagguccagagacagagcucuggguugaaggacagggauccagagauacacagaguggugacggggaggcccagagaggggaacagaaagagcaaaaucucagacaggaccuagaaagucagagggagacccagauagcaugagcuggagagagggagggagagagagagagggaagguggagagagggagggagagagggaagguggagagagggagggagggagggagagaggggagguggagagagggagggagaggggaggagagagggaagguggagagggagggagagggaagguggagggagggagagggaagguggagggagggagagggaagguggagagagggagggagggagggagagagggaggggagguggagagagggaggggagguggagggagggagaggggaggagagagagggagagagagggaagguggagugaggggagguggagagaggggagguggagagggagggagagagagaggggagguggagagagggagggacagagagaggggagguggagagagggagggagagagaggggagguggagagagggagggagagagaggggagguggagagagggagggacagagagaggggagguggagagagggagggacagagagaggggagguggagagagggagggacagagggaggggagguggagacaggggagguggagagagggagggagagaggggagguggagagggaggaagagagagaggggagguggagagggaggaagagagagaggggagguggagagagggagggagagagaggggagguggagagagggagggacagagggaggggagguggagagagggagggacagagggaggggagguggagacaggggagguggagagagggagggagagagagaggggagguggagagagggagggagagagaggggagguggagagagggagggagagagaggggagguggagagggaggaagagagagaggggagguggagagagggagggagagagaggggagguggagagaaggagggagagagagaggagguagagaccuggaggcaucaucuucccaccaggcugcugcuuguccugguaacaucucuuagguaacuaacagaagcccgaccuuguaggucaggugacuagcgcugccuccuuaguaccaccguguagcccagcuccggagcacauaguaaauggaaccccuggaguugcucuuccuuaaccucuccagggagacgguuucaugccacccgcuaggacagccccugcuguccccuggaaacucuccugacugucugcaggccacauuccccucaguccaaguaaaggcgcuccuggccgagccccgguucccgagacucagugacuggaggucaggggaggggaagugugcuccuucugcucaccuggcaggacuuuuauagcaaccagguccuaccagggcaggaagccugccugcuucgccugugcccggcuccacacagucccucaacacugguuauaaauaagaggcugggccaggcacaggguaaucccagcacuuugggagacgaggcaggcggauuauuugaggucaggaguucgagaccagccuggccaacaugguaaaaccccaucucggccgggcgcggugggucacaccuguaaucccagcacuuugggaggccgaggcgggcagaucacaaggucagcaauucaagaccagccuggcccaaauggugaaaccccgucucugcuaaaaauacaaaauuagccaggcgugguggcgggcgccuguaaucccagcuauucgggaggcugaggcaggagaaucacuucaaccugggaggcggaguuugcagugagccaagaccaugucauugcacuccagccugggugacagagcaagacuccgucugaaaaacaaacaaacaaacaaacaaacaaacaaaacccaugggcgccuguaaucccagcuacucaggagacugaggcaggagaaucaccuggacccgggagguggagguugccaugagccaggaucaucccacugcacuccagccugggcaacagagugagauucugucucaaaaaaaaaaauaauaauaauaauaagaggccagacacagcggcucaagccuguaaucucaacacuuagggaggcugagguggaaagcucacuugagcacaggaguucaagcccagccuggguaauagagcacgacccugucuauaaacaauuuaaaaauggggcuggggugguggcucacaccuguaauccuggcacuuugggaggcugaggugggcauaucaugaggucaggaguucgagaacagccugaccaacauggcgaaacccugucucuacuaaaaacuauaaaaauuagcgggacaugguggcacaugccuguaaucccagcuacucaggaggcugaggcaggagaauugcuugaacccgggagguagagguugcagugagccaagauugcaccacuguacucuagccugggcaacagagcgagacuccaccucagaaaaaaaaaaaaaauuuaaauuaaccaggaggccagcugugcugguucaugccuguaaucccagcccaggaguuugaggcuuuagugagcuucaucgcaucacuguacuccaaccugggcaacagagaccccgucucuaaaaaacccaaucauaacaggaccugguuauagggcgcugauggcaagucccaugcuaagugcuuucugugcauucuuuccaguccugggcaccugggcguagguguggaggcuuggaaaggugaggaggcuggccugagguggacagcaaucccggucggccugcgcugagaucugcggcuguuggcagccacaucauuugcuaucaaagugacugcggcucuccaggggguuggagagggcuuuuuccuucugggaucccaugacgagaaaguaacggggaagggagugggccuagacaccgcuuggacccgagggccaagcucuuuucucaaagcuccacagcucugauucuucuaguugccccggcuguuugaaaaaugaucacuccccaaggacagaucuugacaauguccuuuuaauuguacucuuuucaaaaaaucuccuuucucaguuaaaaaagacaaggcaugaugaagaccugcucuagcccauacugggcggugaucucgguccugggggaggccaggccggacucuuccaaggccuccucccugggcagucccagcaauggggccaguggcagggcagguucucccugccagaacccgauccuagcccuucagaaggacuggaccucugugucccuucagugggaagccaccuuggacacacgcagucauucagguggacauaaggccacucuucucgcccuugaccuugaggaacucagccaugcuggagaaauacuucugguuggccucagccaccuucuucucugccgccuguggguucacaaucuccaggcccugggcaggugagggagagaggaugauggguuaggugaggagaaggccccaacugugacccaucagagccccccaggcccuuccccauggcacucaggccuuggugggcaugagacaguuugccugucccuggaguugcccugucuugggagauucugacucagugggucuagagggagaggguggggaggaaccagggcgccuggauuuguacgaaguuccucaggggugcuaaaaacaaccaaugcuugaggacagccaauccugcccaguuucugcauaaggaaacugagucccugggggacauggcuggcccgagguccuagcacaaaucacaccaacaccacugacgaucauaguggcagcaaugggagccaacaccuggcuggcacuuccuaaauauuuucaaggcaacagagcgagcccccgucucuaaaaauaauaacaggacccagucauugggcucuaauggugagcccagugccaagugcuuccugugcguucuuuucaguccugagcaccucaugauggaggaggggaggcuuggaaaggcacagccacuggccucaucuucucaaagaggcccucccuggcugcuccgaaacgagagccuccccugucccaccuccuaccuuccaccuccuccccucccuggcauuucugccuucuuuuuuuuuuuuuugagacagagucuggcucugucgcccaggcugaagugcaguggcgcgaucucggcucacugcaagcuccgccucccggguucacgccauucuccugccucagccucccaaguagcugggacuacaggcgcccgccaccacgcccggcuaaguuuuuguauuuuuaguagagacgggguuucaccguguuagccaggauggucucgaucuccugaccucaugauccaccugccucggccucccaaagugcugggauuacaggcgugagccaccgcgcccggccuggcauuucugccuucuacuacacugggcaucuuacugagcugucugcgcccagccuggcauuucugccuucuccuacacuggacaucuuacugagcugucugcgcccggccuggcauuucugccuucuccuacacuggacaucuuacugagcugucugcgcccggccuggcauuucugccuucuccuacacuggacaucuuacugagcugucugcgcccggccuggcauuucugccuucuccuacacuggacaucuuacugagcugucugcgcccagccuggcauuucugccuucuccuacacuggacaucuuacugagcugucugcgcccggccuggcauuucugccuucuccuacacuggacaucuuacugagcugucugcgcccggccacccacuggcuccaagaagguaagacuugucucucauucguugcuucauccccagagccgggaacacugacagaacucagcaggugcugcguagacacccgcugacugggcagaugagcucgcugcugucucgccuccguggugcaggcucgcccugcucuguggaugguaaaccgaggcuccgacgaugcggugacugccaugcuccacgcugcucacugcugacuggcuggggccuggacccacacuugacauccaagcccgccuagccgggaacuuucucgagugggguccugagguuaccuuaaccguccuggccguuuugaacuggagggccuggaggcugagcaguguuacccgcucacagcccgacagaggaacugggugcccugaacacagcugugggccugguucuaaagcagugcgugcucacgaggacugcucagcgcugggcucucgucucugcuaaccucuuccugugugccaggagcugucuacguccucugcauaccucgucaccacacccuccacaacagccccaugaggagacucauccuggccuucuucacaggggcagagggcaaggggccuugccaaggucucagggcuggggacagagccggcccaggggagguaccuggaguggggugaaggccacgcuggaggccgugcccgaggagcggucgcggaugguggacuucccgccauauacgacgcucugcuucugcaggguccgcuguggggaggacagggaggcugcgaucugggcuccccccaccuugugucccucgguccccagccccaccugggucuggcccauaccugcagcgucuuggagauccuggccuugguggccucguuuaccugugucugccgcacacgcccacugcccgacuugcccagguggcccaggcugaaucccagguccuccugguaggcguccuccucgaucuagggggaagaggaggcgcccugcaguucagcgaccaggcccugcccuccagccaccgaggcacccccuccaccagccggaagcccagcggucaccagccggccggucccacgggcaccugcuccgguacccacucggcccggcugaggccugggggcccacacacgcgggggaugccggggagccugagaggggcccggucccagcacugcucugugagcucagaguugggaggccauuccuuccuuacucgugugggucgggggaugucaggaaccagaacagguuuaauaggaugagguggccucugaguucgguccugcaggaccaaggggaugacgcugggauaacagaggagacuggcggggcccagggacggggcggccgugcagcagggcacuaaggagccucugggcagggaggaaccggccaaggagcccggggcgaugggaagccgcgggggcucuaagcagcggagacacaggcuccaagggccgcgagggucgcuuuggggcugaauggauggaaacgagaauagaggccgggggggaggaggcuggggcagcgcccuagacaugagccagggccacaggacgagaggaggggcgguggcaggaggcagagggcgguggcggcuggcuggcugugggguugaggagggcgcucugggagucugaccucuccgaagcucauacgguuggccugcuuccggaucuccgucagccccagccgcuccuucaucuugcgguaccuggggacgggugggugggcggcgccagggagucggcugggaggaggacgccggcuucuccccuccaugacccccaugccuaccggacccccagggccccucaccugcggccgccucgcuucuuccgcuguccauccaggggcgcaggcagcggcuucaccugcuucacaggcggcggcuccugccacuugucgaauuugcgcucgaucucauccuucaguucguagcccaccuggggagggcgagggggagguccugcagcugcucgcgugggcugcccacccaggccuccucugagcggaccccccgaguauccacgugccuuaguuaaaucagcaccuaaugcugccucaccgccacccccuuucuuuuucuucuugguguugacuuagcaccgcuagacgcaggacagaguucaccuguugacugucucuuugacccggccccaacaagaauguccacgccacggggcagggguccugucugugcuacucacagcugcacccccacacccagaccaggggugagauggggagagggaaaggagaaggggacacggaacaccugaacgcugugccaggccgggugcuuggcaaacgacaguucacaagacagaaaacgucuccucucccgaguacaucuaccaaggaagacagaagguaacugaauaauuacuugaauaacauccccuguugcagcggggacagauccugguguggaaggcaaauuacgcccccaccaacacacacaugcccaaagaggcccauguucuaauucccagaaucacagggcaaaagggacgugaagagguuaagaaggauuuuaaggauugugagcugggaagacuauccuggaccaucugaguaggcucaguauagccacaggggcccuuaaaauagaagaggggaacaaaaacagaggccgagauaugaagacagaagcagagucagagagaggucugagggugcuauguggcuggcuccgcagacagagggagggccacgagcuaaggggugccagugaccccuagaagcuggaaaagacaagggaauggauuaucccuugaaucccccagaaggaacgcuccaggaugacacccugacuucagcccagugaaacucauuuuggacuucugaccuacaggaccacagauaauaaaccuguacuguuuuuuguuuuuguuuuuagauggagucucgcuaugucacccaagcuggagugcaaugaugcaaucucaguucacugcaaccuccgucucccagguucaagcaauucuccugccucagccuccugaguaacugggauuacaggugcgugccaccacacccggcuaauuuugguagagaugggguuucaccauguuggccaggcuggucucaaacuccugaccuugugacccgcccacccuggccucccaaagugcugggauuacaggcgugagcuacugcacccggccacaccugcacuguuugaagccaguagguucaugcuaccuuccaacagcagaccuaggaaaccccacuggggaagggggugccugaccccagggagggugggcagaagcacugccuccgccuugguaggacagugcucgcuggggugggcucccugcugagggucucccugcagagacaccccaggcccagaggaaaagacgcccggccgccccucaccuuucccuccucaccuucccuucugugcucucguggaaacuguccacacgggcugccagugugcacuuggcggccaccagccgggccgcuuuccgccgcagauccuggagcaacggaaaacggggguggaaucugugugagacagacagacagagguaacagcaaagcaaccgcgcgcgcuccuccucuggcucuaccugggguccuggaagggggcuuuccacccuugggcucuagaggugugugcucucagcuccuacuucacaggaagaggggaugagggcagggcacagagccaugucccagcugauaaguggccaucagguaaggaugacaguaaggcacgcugacaacgaggacgguggugacuguggagacgccggggggagugcacucggccuggaugccagccccaugcuaagcacgccccucggaucaucucaucaaauauucaaauauugggcuggugugaucauugcacccccuuuucagauguggaaaccaaggcuucaagucauguggccagggagacagccagcaggugauggagccaggguuccaauccaaacugcaaacagagcccagcugucagccacagugaagcgauggccagcccuggccucccuuacaggccuguggugucuacggccugugccuggaccgaugugagauggccaaaugaagaggcagaggccugggugacaagacaucaggcucccuggggcagguuuaacccauaugcccagggcugugaggcgguggcgauggcaggggugcagugaggcagcuggagccccgagccccaggcccacccguccuggguucuaucgcccacucucucuccucccaggauggggugaccugccagccucccuggguguguuccaguagcagugccugaccuaaagggucgcagaaaagaccacaaaaaaaaccccacacagggcugggggguggggccaggaagugccugcccagccuuggccaucagugcuauuguucuccccaucccugggggaggccaggcagggcacagggccgugagccugagguaacucgccacagucggacagagcagggucuggacccaggccugucugucccagaaccugucuuguuuuuuuuuuuuuuugagacagagucucacucugucacccaggcuggagggcagugguaugaucuuagcucacugcaaccuccaccuccuggguucaagcgauucuccugccucagccucccaaguagcugggauuauaagugugugccacuauacccagcuaguuuuuuguauuuuugguagagaugggguuucaccauguuggccaggcuggucucgaacaccugaccucaggugaucugcccgccucggccucccaaagugcugggaugacaggcacgagccacugcgccccgccaggcuagcgggccugugugugugcugucaggcgucgaugcugggauggugaugugucccgacugcagggagaggacccgggaagcuccgagguuggugaccucuccugccccuccugugugucucuccccauggcugaugugcagcccucaguggauucugugagucuuucuagugaauggucaaaccugaggguggucuucggagcaguugcacgcuaacccgacgcugcuugucgugagcuaggccugaacuguaagugcuucaugugcacugagcccucgucccaacucaugaagcaggcgcugugcucccauuugauaggggaggagacugaggcacagggcgcucaugccucuugcccacagucaccugacuggugggugcuggagcuggucugcugcagagcccuggcucucacgucccaugccacccuguucccagcuccugagugcuaccgucagcugggccagaugguggguggcugcucaggcugucugggcacagcggaaggcuccaggggggccgggggaggggccaugacgcagugggcucaccgguggcagggacugcacgaugucacugugguagauguagccgguguggggcagcacugagguagacgagaagcccgacagcgucuugcgcugggccccgagcagcaugauguugcaggcgggcaucuuggagagguuggucaggccgccggccacaccugcggugggagggagggaggaagggggggcggucagaagaaagcagagaggugggggugaguaaaucugccugggggcucgacgugugcugggcaccuuuacaugaaguucugguuggauuccucgauggcccugccaggcgggcgaccuggcccauuccgcaaggggcagaugcaaaggaggcucagagagggagggcagcuggccugggggugcagggaggaggcccccaacaggaagcugaccaccacguuugugcuaagccacacuaacgccguuccagggauggcuguguuuuggaaccauuuucaccaaaccaggagcucccugacaacagggccuggguguggucaucucuggguuuccggcacaggggagggagaaggagcugugggugaguguuuuucccacagacgaggcuuugcugugugccaggcuggcugaccucugugauguccagggagacggggugcugagguccaggugccaaagcccccauucuacagaaaaggauguagcuuucccaaggucacagugucagcagacccccgcuccaugggacccagcccggggacucacccaugaucuuggcggccguggaugccccgauaaugauggacagguugggugcgaugaaggacauccgggacuccacauacucguagaugcggugcuuggaggcguucagcuccagcgccaugucgcaggccuccuccagccgcuccagcuccuccuccgacagcugcugccugcaggggcgggugggcccagccuccuggaucucccgccugccuggugugcccagccccagcccucucgguucugugugugugugugcauguguguaugugugugugcguguguacaccugcguguguagcuccagccuaauccccaaucccauuagggcccggcgccucccucgaagcggacauaccccugggugguggaggcggugacgcugacgaccaugaugguggcauuggugaggaucugcugcagguucucauuguucuugcacuuguccaggcuguugcccagcuccugggggcgagcagagaagauaggggaggcucgggaacucaggaaggcucgagaaccucucuugcucagcaccuccucaggucucuucuuagggacacugggacagucagggucucugcacugggggccucuccugccuccaccgccugaagcauccacaccauuccugccuccaccacgucaagcauccacaccaucugcccugcuuucgcugaccuggaaacggagcccgggcagaguggcgucuggaaagacuguggccucacaagccucuggccugcgucaagucggagugcaaauccgcggccucgcuucccugcaggggcuuccccaccgccauccuaauccuuuccuggacaugcguggggaccuccuccucuccccgcccucacgcacaccugccccucuuuuccgaaacccuuccuuggcuuucuccuaagacccaaaggcuggacgugauccgaccucuuccccguccccuccuuccccgccucacuuccuccccacuuguucccucuccagcucucugcacuuagacgucucucugccccaaaucuccgugugccugcccugugucaaccuucggaugucaacuccaaugccaccggcuccaaccacagcgggagcagcgugggucaggccagcggggaagcccucucgggagacugggguuggaggggagcccugagaaaguccuguccaggcuccgucccucccacgcugggcagagcagaccacugagcccucguccacuccucuccaucgucuccagacccugaggccucugggaggggguccgagagugagccccgccugccccuucacgccagcagaagcaccccaccuucucugcgcucaccuugaccgugcggauguaauccagugcauuggggaccaaggacuccaguucagggaaucucuuugaguacuuaucccggaugaacuuauggaugaugucuaggguaaacgggacaggagguugucgggugagauggaagguagacucugcugguuggcccuaacacccauguccccuucuuccuuuaguaacugaagcccuggcuuguggccuggcacacgggcaccagcauacagccuuucucagccguccuuaccgcuaggugugaccaggggaauuaguucuggucuguaaaacgugagcugcagugacauguucuuaaagaaaagaagcgccuugcuggugggaaugcggaggugauggcuggagguggggcagucaccucgcaccgugaggcagguggccgaccaacaggauggaaagagccggggcccuacaggcagccaagcggccacaccauccccgagugcuccucagacucauacgcgagagaacgcacuuccuucuuauuucagccacucugugacagcaggucaaccucgaucugagcuugggcuuaggggcaggacccugggaaaggccaguggggaagggagagggggcgugagggacgucacacggggcugucuccgccugccccccagcacucacucagcucguuuucgaucuccacggucagguuguuggcauccacgaugacgcgguauucaggcgcggccuccacuggucccaucacugugaggacacggaggcaugggugugaguaucuaaaucccuacccccucucgggucccgcagcuggaggaggcggaggaugaaguugggaggggucaggaaggaggggcugaagaguaaaccagggacaggcugaugucugcagacaucccugaacuuguguuccugccuucaaucccucucccuccacaccagucuagacuugaccccaucuaccccagaacugaccgugugaaaccuccuacggcuccccacagccccaaggcuaaugaccgaguccucagacugacauucagggccuccccaacuccggaagcucugcagggaccagugcugugccugcguuggcuguacccacagccgaguacccaggacagcaccuggcacacagggaguucccccguuccuguuugcugacucagcagcucugcagucuggccucccgcccuucccgccccauccucucaccacaccucauuuuauuccacuccagccauaaaggagugaucacagugccccagacacccacuccuccuagccuuuuuuuuuuuuuuugagacauaauuucgcucugguugcccaggcuagaguauaguggcaugaucucagcucacugcaaccuccgccuccuggguucaagcgauucuccugccucagccuccugaguagcugggauuacaggcaugugccaccacgcccggcuaauuuuuuuuguuuguuuguauuuuuaguagagacgggguuucaccauguugggcaggcuggucucgaacucccgaccucaggugauccaucugccuugaccacccaaagugcugggaugacaggcgugagccaccgcgccagaccccuccuggccucugcaugugcugcucccucuccccagagcaucccuuaccccacgucuguuucuggaaaacgcuucuuugugcuuuaguaauaagaggucaggcacaguggcucauaccuguaaucccagcacuuugggaggcugaggcaggagaacugcuugagcccaggaguuggagagcaaccugggcgacauagggagaccccaucucuacacauaauuaaagaaaaaaaauuagccaggcauggugguguacaccuguggucccagcugccugggaggcugaggcaggaacgccugagcccacaaggucaaggcugcagugagcugggaucgugccacugcauucuggccugggugacagagugagacccugucucaaaaaacaaacaaacaaaaagauguuguguuuaaaagucaugcaaauacuaacugccugaugucacagccaguagaaggcagagcucagaucugacaccaggc

SEQ ID NO: 14982 - RNA, 6857 nt, Homo sapiens
gagagacccccacacaccaauuguaaagcgcugauccuguuuauuuggcaggaaaacgagacaauccagcagcccaggagggacagguggacuuaauccuccuccucgucgucuccagccccagccccacccuggcccuucuuggcauucuuccucuucacgcggcccgggcggccacccccguagggagagcgcagagagaagucgaugugcuucugggaauccaggcggacaaugaaggacgggauguucaccaccugcuugcggacccuggaagaagcgacaaggugagguggacuggaggagaaacggacgcuaaccccagcuaccgcaccacucuuuccucuccacccaccccgugaggccgccacggcugcagacaccaaggcgcugcaggaagggugcaccugauccuacgugcgcccuccgggguuuuaggguaucaccuuaauccccaaaaaugcuucagaugacuuucucaaccccauuuuauaggagaaaucugaaaguaucccaccuaagaccacaaagcaaaugagauggccaugugagagcccccaaguuccgagucugaaauaucgugaaccccacaccugacacugagcuguauuaccacgugcagcagcaaugcccacaauaacacagcaacccgaggcuacgucuccgacgaaagcauugacacacaaggcucugccuacggcucacaggguuagugaagggcuggggcgaagauucuaaacgcaaacaucuugcccucuuucuguacagcuccucccccucaauggugccacauuacagaaagggcacacugaguacccagaacgcagucauggaucggggucuggaaucaacuucacaagcgagccaggagacagcugaacccaccacccaagcgaggugaggcugguucucucccuccacuggggacaccaagagcuguuaccuguccagcugcccacaugccuggcagaggccuucacaagguguacggcuagagccgcagugacccuugcgcugggcuauuggggcaagaggcugccccagcucccuggugagcugugugcaagggugaaucuguacccucugggugaguucacacccaucaccuccgagggcugcauaggagauagggacagcaggcuuagugagggcaaccaucagaggggcagguggaggaagauucaggugcccauccgaggugguaccugauauggcgcuggcggaucagcacgcgagcgugguggauggacuuggccaagcccagcuugaagaccugggucugcaggcgucucucuaagaaauccucuaucuucaggcccaggauguaauccagcuucaucuugcccucauccagcaccccaaugcggaccagccgccgcagcagggcguugccugggaagagugggaggaaacacugauuccgccuucugaccucaggcuucuuggguucaaauccuggcuccgccucuugguagcuccaugccgcggcggugaggcacaaguaguacagcgccaucaccgugacccaugucacugucaaaaccacccuacgggcugggagugguggcucacaccuguaaucccagcacuucgggaguccgagacggaucacuugaggucaggaguuugagagaccagcccggccaacauggcgaaagcccgucuccacuaagauuacgaaaaauuagccaggccguuggcgcacugccuguaaucccagcuauucaggaggcugaggaaggaaaacugcuugaacccaggaggcggagguugcagugaccugagauggggccacugcacuccagccugggcgacagagugaggcccugucacaaaacaaaacaauacaaaaaaccaaacuacccuaugguugucaggucaucauucauaguaaacugcagaugacaggagggcaaaauacaccugccuccucaucugagagcauacaucccucgcuccacauucuuagcaagaguaaaggaaaucaccuccuuacaaggacucagucugcaaaagaccaaaugcagcugcuauuaagcuacuaccaccguaacaaagcacagugcugaagaguucauauccucagcccagaaagcucuucugauuaagcagaugugagauugaaucacauuccgugccauaaauagcaguaucuacaucuuuuaaggagagaaaaguaauuucuaacacuagaauuuuuccagcuaaguacaugucauucauuuuacuauucuguacaaaauuuuccaccaaaaauagaucuaguauguauauaaccuaacaaugcacugcauaaaauauccaacagaugcccuacuacaccuuucuuccaaccccaggcucaggacggcuugcuccuuacccuguccaaagccauggcuucuagcuaauacucuggacugcccuugcccacagccccagggcccugggggcaaacgccauccccuaggcucccgcucacugcuauaaucccacacgccuucagcaaaucaacugccccuugacugggguaaacaccucaaccuuuuuuccuuaugugcacuuuuauaaaaaguggcucuuacuaguuacagcaaaccauucaagcaagcuuucauaaauagaucuacaugcaucaggcacuucugauauuccuggcacuguuacccuccaagcaaaguuugaaagaaagcuagcucacuuugugaggacccaaaguuuucccaguagggagcaguuacagguagggagaaucaaaauggaaacaccagcugugugcauuuccagcauccuaugucauacuauggcuucaauuuuuguucuuuuuuaacucaacaucagaggauauuuaaacaccugaauaucaaaauacaaaaacauguccaaaaggcaaugaaaaugaguuugggaucauuuaccucuuuggacacuucacgccuuuuugucuuuacauuagaaaauggaaacuuaagccacgcacagucccuuaugccuggccuauaaacccaauauuuugggaggcugaggcaggaggaucaguugaguccagaaguuugaaacuagccucggcaacacagugagaccgcauuuguaccaaaacaaacaaaaaaguaaaacuaaauuagcugggcauggugguacaugguggauuguggucccagcuacuagagcugaggaggaucacuuaagcacaggagguccaggcugcagugagccacgaccaugccacugugcuccagcccgggagacaaagugagaucgucaccauuaggcaaaacaaaggcaugauuuuaaaaaaauguuucacauuuauuaucauuuuugagacagaguuucgcucucguugcccaggcuggagugcaauggcgugaucucggcucacugcaaacuccgccuccugggauucuccugccucagccugggauuacaggcaugcgccaccacgccccgcuaauuuuguauuuuuucaguagagacuaagggguuucuccacuuuggucaggcuagucucaaacucccgaccucgggugauccgccugccucugccucccaaagugcugggauuacaggcaugagccacugcacucaggcccacauuuauugaaccaucuaucuccugaaaaagaacaggagagucagccacaggcaaaaccuuuaaguaugaagacaauaguuuucaacagcacaauaaaccuuacaccuucaacaaaagcauguccuacugcugaggcuccacugggccaaugcaccaagagaauuuaaaaugcuuuaaaaaugcaaaccagggaggaccucagugggaaacagguccuugucaucauacaaggcaguuagguauuacaaugccuucauuucugaucugaaaaauggacaugacuccuacauuucuucacaguugugcugggggguggggggggaguucguguuguuuugugucucgcugucacccagugcagugccgcggaucucggcucacugcagucucugucucccagguucaaucaauucuccugccucagccucccgaguagcugggauuauaggcacaccaccaugcucggcuaauuuuuguauuuuucguagagauggaauuucaccacguuggccaggcuggucucugacuugaggucuccugaccucaagugauccgaccaccucggucucccaaagugcugggauuacaggcaugagccaccacgccuggccucuaucuguugauuauuaacugccagccaaauguuggcggcuguucagucuuaacagacgagacucagaaucucgcuagucacacaucuuagugggaaaggcuggaucugaaucaaggcaggauuacaccaaagagcaaacauccaagcuccuccuuccugucccugacuaggcuagauggcuucauuuacuagaaaguguacucaccugaacaacuguguaccccuugggaauuuucacuucugccuuggaaaaccacaaauaacccucagacaccugcaccgcuuucucacaugacuguaaguuucauugcaauuaggaucuauguccagaaaguccucccuaaaaccagaaccagcuauagcccacuccccacagaacccugggaugaauucccacccagcaucaguaucuaugggggagggaucuccagcacuuucaugagauuaucaacggggucuacaaauugacgaaaagaaugaaagggucaggugcgguggcuuacaccuguaaccccagcacuuuggaaagcugagguggauggaucacuugagguuaggaguuggaaaccauccuggucaacacugcaagauccugugccuauuuaaagaaaaagcuucuaacaucugcaagccugggacaaacugugauaaucuguagcuaaacaugcgccaggacuuucucaacgccuaacauggaugaccacucucaugccuaacagucagggcucagguguagagacugcuuuucaccauaaaucaugacuacccaaacucaggcaaaagcagcgucucaggauauacaaaugccaaucuuggucaugccaaucugcuguagaaagcacuccaauaacaccgcaucucagaguagauuuuaaaacaagaugguuaagaugguacauuuucaauuuaauguguauuucaccacaauuaguaaaguaagccuaagucuaugugaucugcaugcccuccuaaagucaucaccugaaaugcuguucccugagacauuuuacagguucucuccuguucaggccuuugcuaaauaccaccuaaauguccuugaccagcuuaaaaaaacaagcaccagccuggacaacauggugaaaacccaucuccacuaauaauagaaaauuagccaggcuugguggcccaugccugugauuccagcuacuuaggaggcuaagacaggagaaucgcuugaacucuggaggcggaguuugcagugagccaagauugcgacaacuacacuccagcaugggcaauggagcgagacuccgucucaaaaguaaaauuagccaggugugguggcgugcgccugucuguagucccagcuacuugggaggcuaagauaggagaauuguuugaacccaggaggcggggguugcaguaagccgaaauggcgccacggcacuccagccugggcaacagagcaagacuccgucucaaaagacuaaauaaaacgagaaaacuuaauuaaaaaaacaauaaaccaagcaaaugugcaaacccuguuaucaccaucacuuagcccagaaauuccacuucauagucuacucucauccacuagcaaacaggccacauaaacagaauauaaagauauagacgggugcccaggugugccaggccuaucuuuagcucuggucauuacuaaacugaagguccaauaacugggcaaaaaagccacacaccuaagaaacagggcaaagacugauccagauacacuuuuccuacuucacaagugccacuaaaaguuagaaggcugguuccauuuauccaaugacacaacucucaucacuggaacagaggcaacagaagggagaaugaaccucacaagcccugcaccccaucccucugcuguggacucccauacgcaccuucgaacagacgccguggguccuucucaucaagcgucagcaguucccgggcggccuugcggaucuuggccaggguaaauuugacccuccagaccucacguuuguuccggagcccauacucgccugguggggagaaggggguggacaaguguagucccacguacuggcacaacaacuagacuggcagcuuuggaaucacaaaaccuuccuaaaccacgaauaguaccaaauuuaggggacggacuagauagaguacaugggcaccuucauccacgugcuaaccgccucccggaagccgaaccacuucccggaagccuuggccacucaccgaucagcuucagcucuuggucgagacgagauuucucgaagggucuccgcggggucacauaaguuuugcgacaaacccagcuccgggccacuggcauguuggcuccgcuuccccgucugcgccugcgcgggagagaagugugagcguaagggcuccaaacggcgccugcgcagucccacaacuacgccaaaaccucgcggagcccagauccgaucucgcgagaauaaccuccaacgcucucauagucaguaucugcccccacaaccgugcugcacucccguucaaccacccugcucuguuuccuaacgucuuuagcuuacucauggaaacucggaaggcccgggccaccauccaacccaaacccuagagaaaaagcacaccgccgcaccucaccuaagcaaaccacccggucacugagaaagaggcgcgcaagcgccacggcugcgcucuuauaguaacgccggcgucucg

SEQ ID NO: 14983 - RNA, 33682 nt, Homo sapiens
ccccaaucuccgccccccacccccugccucccccccgcucccgcuccccugagcccagccagaccccgcgccgcccgcgccccgcucgacuccggaggcucccgcagccccggcguccgccccgcugcccccucccccgggggccaugggggcgcccccgggcuaccggcccucagcuugggugcaucuccuccaccagcugccccgcgccgacuuccagcuccgcccggugcccagcguuuucgcgccccaagagcaggaauaccagcaggugggaccgggcgccagggccugggggccagggcugggggccggagcuccugggucccgagggagaagggggcugggucacagauuuccugagcuccgccggaggcugggggccggcccggacuuugggguuucggagggaggaggagccugggggcgcccaugccuggagguucuccugggacgcgcgcuggggguccagaccucgagcucucuaaauaagggaaggcuggggaccugcaccccugaguucauggagaggaggggaggggggcccggauucccgggugucugauaccugccugggaagccggccuccagggucaucgggaggguaggucuacucuuccugcccuaaaagaugacccugccccacaggaucagagcaggugaauaugucccagauaaggugggacccaggagacagcggaccugauaacgguggcggggaaaacgcuggcugcugcggugcugggaugggauugagagucugaaauggggaagggggcuucaggggcugaggaccagggcuggaaaaugaaggggcucugggagaggaagcuucuugcccgucccaagaaagaagggguggucagggcgcugcaggggugagggccgagaugaggcuggguuuggggagccucgggaugacagacccgggucccgaggguggggccggugugggaaccucacagaagccggugucccuggggaaggggcccggcucggggcagcuccaaugggcgaaagagcuguccccugacccaguuuaauucaaguccuugacuucgagauuaaugaggagaaaggcuuggcugagcuggggacgggugggggugcugggagucccgauguggccccaggacggguccuggcccugcugauggggccugagccccugggcuccgucuuggguugcuccugggagaagggggcugggauuggagagcucagggggcguggagggggucccagaaaagcgcggaggggaugagugcuguguucugagcuauuugggucacggcuggcacagcccugagcagcucuuccccgccugcuccucgccgcccccucuccccacacacggggaccgccguccccucgcccacagccucgcgguuacacaacggccaccuccaacaacgccgcuccaccggcuccggccucggcccagacucacgcccgcucuggcccggagaccucccgaagccgcacgcggggauccgcggccccagucaccgccagaggcacggguuugggggagccucacuccgcccccacggucgggggucagggucaggguggcagggaugcgcgggcagagccccacagccgaggagggcaagggggaccccugcagggacgcgaccaccguggguacagcugcagacacagccagggccucagggacacuggcccgggggaggcacacagccacacgcacacacucacuggcauaugcacagcacacacacacguccacuuacucccauuacacacucacaugcacacacauaugcacaggcacacccagacacgcccacuuauuccaacacacucacaugcacacacauaugcacaggcacacucagacacacccacuuacucccauuacacacucacaugcacacucacaugcacacacucagacacgcccacuuacuuucauuacacacaugcacacacacauaugcacagguacacacacacgcccaccuacucucauuacacacucacauaugcacacacacauacccauuuacuacucccgcuaugcacucacacccacauacaacacacgcauauagacacaugcauacacucacauggauauacccacuuacacauacacaaucacacauaugcacacgcacauugcgcacagugacucacaacacacacauacacauguauaagcauuuacucccauauacaagcacacacugcacuuauauauauaugcuuacacacucaugcaugcaccgucacauacacguuuauacucccauacacacacacacguacauuccauucacaucuacacacacaugcacacacauauugacuauagcauucaugugcacacacacacucacaugcagucacgcauccacacacacacucauccacacuguuacacacacacaaccggacccacucacaggcccaaggaacugugcccagaacacacaaaugcccacagauguucucauuugcagacagcagugcacccaggagacacacucaggugcccccucaucucauggagacagcccaaagauaaaaacauccagucucaaccagaaacacaaacacugcacacacuugggacacacacacacacacacacugugccacuguguguguguauguguguggacaaaggcagaaacaccgugguuuaggggaaacagccuuggcaaguccagaggugugacucugaucccaauguugucccuccaugcuccggggcucagugcaaacccccugggccacugugggccucugggaccgcacaggucagcugugaaauccccgccacguggagagcccuguuauucugcaaggcucugcccaccgcagaacguuuccgcggccugccugucuuccgggccuuggcucucuccgccucucuguccuugugugucucucccgucuccauaguguucucacgcucucucucccuuacucugcucuuccucucugauuugaucccuuuugcucucugccuuuuucugacucaugcccgaaccuugucuuaucuuugucucuuuuuuugguugugucuuucugccugugccucccuccaucucucucucucucucuuucuguucugucuucacucuuccaguuuccauuucugagucuugcauacacacacacacacacguugccacacagccccucgucccgucccugggugacaagcucaggcgcugugggguguagcgcucagcagcaggggagacagugagcagggaggagagggggaggaagcacgccucccccagccuggcccgaggcaccaggaacaggugcccccacacccccacccgcccccugaucccacacgauuguggaggggccuuggcagguccuugggaaaaccuccauuccaacugcuggcugcagagagaaggaaacccaggcucggagaaggggcgguuccugcuaaagauugcacagccaauggagggcagagcagaauugggacccaaggcuuggggcccccaguuggaagcucccuccagcaagcuggcccugacaccuggagccccagcugccagccugggaggggcugggacccaaucucccccaagauuaggccagggaugucucccaccuucacucugacaucccagaccccgaccccccagccacgcaggaagggggaucugaguguggaacacacgggugcccucggaggucugaugucacccccuuccccaggccuuguugcugguggcggccuuggcgggccugggcuugggccugagccucauuuucaucgcugucuaccucauccgcuucugcugcugccggccccccgagccccccggguccaagauccccucgcccgggggaggcugcgucaccuggagcugcauugucgcccuucucgccggcugguaauggggccccagggugggugggcgguggggacagggcuccccaagcucuuugcuggccuuccuggggguguccuccggggacauggaggaagcagacaggaaggaggaaacucccucgucccugucccugccauuugcaagcccacuucagcgcacagcaggaaggacugucccauuugauggauggagaaagugaggcucuggagaggaagugaaucaagggcagccaucuggugagaaggcgcaggggcagucagauggccugguuuugguggcucucccauugaauagcugugugaccuaagggagugauagucucccugggccucaauuuccacaucuguaaacugggcauuaucaucucgcccaccuccugcggggguaagauggagagaaagcacagugucugacuugcagcuacucucagccaacauuaacuggugaugucugucauuccgucauucaccagcucauucauucgacaacuguuuauugaguauuuacuaugugccagauacugaccaagccaggcaaggagccccucgugcagcuuauguucuaaucagggagacggacgauaaauagauauaaucacccuccaagagcaccucaucugugcccagaccugagcuggucuaauuccuucucacaauaaugcugcuggauucaggggugucaggcccaguuuccaaagaggaaggcucagggacagaggggaggucaccuuucaaggccacguggcuuaagaggcagcacagagauucagacccagguuaguaggacccccucacaccccucaaagcgagcuuagggggcuuccaaugugaacacaccagcuaccaagaacgagcucugagcacagcccccuccccggcagggcagcacccacagguuacagacagcaauccucuuccacagacggggggucccagagggccagacgccugccccggacccacagcgggcaaggggagggaccuguagggguggccuguauucaggacgcuuccuccuccggcucucuggcguggggggagacaggggagguggacaaaggcccagugggggagagacacggccccagcccccgcagccugggaacaagaggagcuuuguaggacucugaacaauggggcggggacacugggcguccgacccgagggauggggguggaggcccagccggggcugggaaccgggagggugucaggcucccgcccccuccacugcgggacaccggccgggggcggggacgggaggggucuggggccccacauucaggucccacaauggagcucugugugucgguagggugggggcgggggcacggcuucucgcccauccuccagccucccucccacauucccuuacuucccucccagcuggcccgacgcuugggucccgggugggggaaggccgagagcuccaggcucagcguccccccaggagaugguggcagcugccccccuuguacccuuaggaacccccaggaggugggggcggagaacgucucagcacugaaggguuggcacugcaggccccaaggacccuagggcacccuaggacaggugccaggagggcugccugccuggcaaaggaugcgggggaaggguguggggcaggcaguccuagggaggggaagacggcccaucccggagcugggugugacugggguucugcuccagggaggugcgaguuaaaucgggggcucccucccccccaccacuccacccaccauuaacaucacaaugacgucccuccgcugggggagugaggccuucccguucccuuggcaaccgacgggggccaggcugaagucgcccuuuucccacgggcuggcccaaugagguggggcugagaugggagggguggauaagaaggcgagguggaggggauggggugggaggggacgguggcccccgggguccugggacccgcugagauuccucucccuccuccuccgcucagcacuggcauuggcaucgguuucuauggcaacagugagaccagugauggggugucccagcucagcucugcgcugcugcacgccaaccacacacucagcaccauugaccaccuggugaggggccagcaaccagugggaccccagacccacaccuggacgggcuccccacacccaaggacaaagggauccaaacucagagcuaagaccccaggcuugaagcuuaggaacccagauucagaacuucauccugagacccacagaccucagacuauccacccaacccccgacccuggcugcaaauugaggaccucacacacaggcccagcccuggaccuuaccuggaacccccaagccacacagaaaccaagcaccagcgacaccagccccuguccacgggccagauccagggccccagaccugauucuuggcccguaagcaagcucagggacccccgcccugaggcccagguccccgacuugaggcuucagcuccgacaucagcuccaggauucugggcccuggggcugaggccuggccccacuucaugccuuagauuccauguccagcugcagacucuagaccaugggacccagacuugagaccccagauucuggaaggcagaugaaaacuucagaccuaaagcuccacacuuaaucucaguccuggggcuggacuuacuacccugggcucaagcuaccaaccauccagagcucuggauagaggccacagaacuccaugaacuugaucuugaagccccuccccaaucccuucccuuacucaauccucagaugucccagacuccagaucucagacacccgcuacuaugcaccccuccuucacuucuaaaaccccaugccucgaccgcgggcuccccccaggauguccuuccagaccucagccccuguccuauccccagguguuggagacgguggagaggcugggcgaggcggugaggacagagcugaccacccuggaggaggugcucgagccgcgcacggagcugguggcugccgcccgaggggcucgacggcaggcggaggcugcggcccagcagcugcaggggcuggccuucuggcagggagugccccugagcccccugcagguggcugaaaauguguccuuuguggaggaguacaggugagacgcugcucuucuugcucucugugccggcagcucucaggcggaguccccggggggacaguuggcaaugccuggaggcaguuuugguugugacagcuggggagugugugcgcacugcuggcauccaauggguagagcccaggaacuguucaacacccugcaaugcacaagaacccccuccccacccauuggcagggaaugauccagccaccaugacaauuaugacgaggcuggccaggcgcgguggcucaggccuguaaucccagcacuuuuaggaggccaagguggguggaucaccugaggucaggaguuugagaccagccuggccaacguggagaaaccccgucucuaccaaaaauacaaaaauuagcugggcguggcggcagaugucuguaaugccagcuacucaggaggcugaggcaggagaaucccuugaacccgggaaauggagguugcagugagccgagauuucaccauugcacuccagccugggcgauagagugagacuccaucucaaaaaaaaaaaaaaaaaaaaaaaaaagaugagguugagaaaccuacuguggagggacagaucaccagaccccauggccauccugacacccauguccucacccauucacucacucacccccuccacgucacuccacucacuuauucacacaugcguucauuccuugacucacucauucagcaagucacucuuggacucaguuacuccuggacuaacccagcaggccacucacucaguucguucauccgugugacauguguauuuguucagcacuauuuuuuuuuuuuuuuuugagauggagucucacucugucgcccaggcuagagugcagcggugcgaucucgacucacugcaaccuccgccuccuggauucaagcgauucuccugccgcagccucccaaguagcuggcauuacaggcaggcgccaccacgcccggcuaauuuuuguauuuuuaguagaaacgggguuucaccauguuagccaggcuggucucaaacuccugaccuugugaucugcccgccuuggccucucaaaguguuguucagcacuauuuauuuagcacccucuggugaaagaggcagcguaccuacagaucaggaaccugagcucgaaagccagccagccccacccuaaccacgcggcugcaaucaaguuacuuugcagaccucugccuugguuuccccaucugugaaaugggaaucggggcagcgucccccuuguugaauugguucgaguuguugaguuggcaucugagugcugagaaggacgauuagcacagggagagcaccgcagagauaugaaguguagucaccccgguggcgggccgggcagugagcaaguggcagaaaucccugccacguggcugcguccuccggggggaaccagcaagggacaaacgcagagaaaaacauuguaagguguugggccaugagaacuuuggagaaaauuacagaggggaccaggcacggugguucacgccuguaaucccagcacuuugggaagccgaggcaggcggaucacgaggucaagagaucgagaccauccuggcuaacacggugaaaucccgucgcuacuaaaaauacaaaaauuagccgggcgugguggugggcgccuguagucccagcuacuugggaggcugagacaggagaaucgcuugaacccgggaaguggagcuugcagugagcagagaucgugccacugcacuccagccugggugacggagcgagaauccgucuuaaaaaaaaaaaaagaaaauuauagagggagaugaggugggacagagucuggcaguucaucagggggacugagaagguggcauuuggaggagaggaggcagugagcugugcaguguccaggcagccacccuucccagcggccaccaugacgguguccucauugcuuugaccauuaguaaucauucauucauucauucauuuauccgacgucagcuggaggcccugcccgcggggcaugcgcugagauuugggaggccuuccgggaugcugcgcuccagcggggaaggccgacuggggcugaaaaagcuggaggucaggacacacccgcagggcagcaggugcaagagacagacaagccuggguuugaagaaguccagguucugcauuguggucaggcccaggggcugcacaagccgggccucagcuccuucuccugggcgagggcagggaaguggugggagccauaagggugaugccagggugaggcagacccaccaucgcuagaaaauaucuuccgggugcaccacugcgaaagcaccccacacuugggagucccucgacagacaaaucaggggccuccaagggagucuugcuggaggggagcacuugcgaggcugggcggaagcagccagagaccaggguaaggagugaagcccaagcuuguggggccugcagagaauggcaggaggauuacaugagcacuuacuacgugccgggcacugugcuguuguuacggcggguccuugcucccggagcucccaagaucgugguggccacuuccaagagggcagcaagccucguguucucugaccugggguucuuggccucacggauuccaaggaauggaauccugggcccugcggugaguguuuuagcucuauuagaagccgugggucacggaagagaaccguggaacccagcgaccaguguucagcucgaucaggaugaacccaggcaguuagcugugcaggaacaauggcgagccucuagcccgauugggagcggcaaugggugucucccuggaucacgagcacaguggacacccugccggauccggaggguggaagucagcggcgggucugcgacggcggcaaacagcagugguggacggcgagcgaaagcucagcucaagccguaacagacacggaccagaagagugugcaguuucaaguuuuaauagagugaaaacagaguucccauacaacgggaggggacccaaaguggguagccguugcuggcuggaaugccuggguuucuauccagaucauugucccuuccccugugcucucaggugauagaugauuggcuauuucuuuacuuccuauuuuugccuaacuagcacuuuagugagcucucuuuacuaccugauugguugggugugagcuaaauugcaugccccguguuuaaagguggaugcggucaccuucccagcuaggcuuagggauuauuagucggccucggacauccagcuaguccugucucucacuguggcuugcaugcuugcaccuccugaaucaugguggugggcccuucacugauauuuaaggauuaacuuuuuuuuuuuucauuuuugagacuaagucucacucuugucgcccaggcuggagugcaguggugcaaucuuggcucacugcaaccuccaccucauggguucaaaugauucuccugccucagccucccaaguagcugggauuacaggcgugcaccaccacgcccggcuaauuguuguauuuuuaguaaagacgggguuucaccauguuggccaggcuggucucaaacuccugaccucaagugauccgccugccucagccucccaaaaugcgcggauuacaggcgugagccaccucgcccggccaaguauuaacuauuaacuaacaucucaguucccucguucacgcucaggcuaaccucuaaguguguccacgugcuuggcacucuccuaagcacuucuagucaugcagcccacucgaggcaauauucucaagccaguguuguugugcuccccacguuacauguagggaaacugaggaacgagaggcuaagguuaccgagacaagaguuacccggccaguuaagcggaggggcugggguugagaccaggcagccucugccuccagacgucaugcccuccagggaugcgaugggaucuuuggugcagucuugagaacgaguaucuccacucugcagggugggguuggggauggggagcucggagagaacacaucacgugucccuggucacagggcacauguguguggcccggccaggggauagucccaggugcucaggaccuguauucuaaaccgcuccaguguccugucucaugauaacacuauuucacagaggaccugggcuguggcccagacacaguaaacagcaggaggcugagcuuggaggguggugaaugugaggcugagcuggggggcagggugaaugcugguggaggguugcuguuccgccggggugccuggaggcagguuugugguuucagcccuacccucuccccucccagguggcuggccuacguccuccugcugcuccuggagcugcuggucugccucuucacccuccugggccuggcgaagcagagcaaguggcuggugaucguguaagugcaggcaguagggggacccagugcuugccuggcacucuccuggcaggcaggaccucagucuuacaacucuccuacacggaggaccgugguccuucacggccggguacacacgaagaaaagagagucagagcagcccaggagggaggcggggacagaccugaaaacaggcagcccuaacaguaugaaguaugcuggaaucauggcagaaauaaucauuguguuggcaauaaagaugaggaugaggccaggcgcgguggcucacgccuguaaucccagcacuuuaggaggccgagguggguggaucaugaggucaggaguuugagaccagccugaccaacauggagaaacccugucucuauuaaaaauacaaaaauuagcugggugugguggcaugcgccuguagucccagcuacucaggaggcugaggcaggagaaucgcuugaacucaggagguggagguuguggugagccaagaucacaccauugcacuccagccugggcgacagagugacacuccaucucaaaaaaaaaaaaaaaaaaaaaaaaggcugggcgugguggcucacgccuguaaucccagcacuuugggaggccgaggagggcggaucacgaggucaggagaucgagaccauccuggcuaacacggugaaaccccaucucuacuaaaaauacaaaaauuagccgggcgugguggcgggcgccuauagucccagcuacucgggaggcugaggcaggagaaucgcuugaacccgggaggcggagguugcagugagcugagauugcaccacugcacuccagccugggcgacacagugagacuccauuucaaaaacaacaacaacaacaacaaaaaaaaacagaugaggaugaugaucuauugagggucaugcacgcugaguccuucaguugccuccaccccaugaaggagcuaccauaaggcuccauguggccggucagggaccugacuaagagcgcagaggguggccaaguccgagacugagccguccuuaagugucguggcaaagccgcaggaccacacugauuucacagcucgcucuacgcgcccgacacucuucucugcacucccuggagcaccucaugcccccugugaggaaggugcuuccuucugccuguuuuuuauuucuguuuuuuauuuugagaaggucuugcuuuguugcccagacuggagugcaguggcaugaucacggcucacuacagccucuguccccugaggcucaagugauccccccaccucagccuccagaguagcugggaccaugggcuuaugccaccacucccggcuaaguuuuuuuuuuuuuuuuuuuuuuuuuuuugagcugcaauuuggcucuuguuguccaggcuggaguucagcggcacgaucuuggcucacugcaaccucugccuccuggguucaggcaauucuccugcuucagccucccaaguagcugggauuacaggcguaugccaccaaaccugucuaauuuuguauuuuuaguagagaugggguuucuccauguuggucaggauggucucaaacuccugaccuaaggugauccgcccgccucagccucccaaagugccuggauuacaggcaugagccaccgugccuggccuaaguuuuguauauuuuuguagagauggagucuugcuauguugcccaggcuggucucgaacuccuggccucaagugaucagccugccucagccuuccaaaguacuggguuuacaggcaugagcuaccaugccuggcccuucucccuguuuaacagagggagagacugaagaucagagagguuggaccacuugcucagggccacacagcuagaagugcuagagcugggauuugaaccagacaggccauucucauuggaggagucccugcauucucucuggcccuaguggggugaggcggaguugaaccuguaccuccauugccccugagagagugggagagaccccgcguaaggcuugcagacccauaaaccuagccaacacagggcaggucugggacuggaagccaggccuucaguuuggggaccccugggugcccuucuugcuuacuggucacccuaccaaugcugacacgcccccugcaccccuccccacccggaaaguccagagacuuucagauuucagcccuggcacugucucccauucucagaggagacagggcagagccagaggcugaucaggcuguggguggacuugggggagccuucgggggaagugagcccagaggugagcagucaccgucccaggguccuggagcugggauccaagcugcgaccacccagcccagggcccugcucauaccccacacccugcucaucugggcaggagccagauguccugcuggacaucagcagccacuggccuacccccaaccacugaacuuguguuucccuaauucugauccuccaggcuccagagguggguggagguggggggcggcugugaugggauuugggguguggaaagaggcuaggcuaggagauuaagaaccccgggcugauccucccucccccacucuaggaugacagucaugagucuccugguucucguccugagcuggggcuccaugggccuggaggcagccacggccguggugagugccagggccgggccauugggcucugggacucagggggccuggagacuucaacuucuggaucucgggauggcauggcuuaguagagaaaggaauuggggggcacgaucacagcucugagguuuagggcuuguuuccuggggccugaguggguacagauugguguccuggacguuugagcuguaauggaggaggggcuggaaaccuggauuccuaggucugagggaggaggggcugggggucuggacuccugggugugagggaggagaagcugggggccuggacuccugagucugagggagaaagggcuggagagucugaaccccugagucugagggacgaggggccuggggccuggacuccugagucugagggaagaggggcugggaccuggaccccuggguggggaggggagcuggggagccaggcacugggugcugugggaguguggaaucggggcaguuuuggguuugagccccuuuucugcugccucacgcagggccucagugacuucugcuccaauccagacccuuauguucugaaccugacccaggaggagacagggcucagcucaggugauuuccaagggcccgguggguccgccggguugggcagugcaggcccuggcuuccucaggccuccucugugcccgguccugcccaggguggggugggggugcagccugccaggcgagacccagcccucuggaagggaagcagggcuccuggccacuccccagcucggagcccuccuggagccccgccacccgccagacccucaucccuucugcuccagcuggcagcgccucuccuggugggcuggaaaagagggcaggauaaagauaauggugccaggaagagagaggagggucaggagagggugcuccugggcgucaggaauggggaguuuggcccccuggagaaaacuggggagcaccauuuagucagggguucccagggaguauaggguugcccaccagcgccugcucuggcuguggcaggagcagaagggacgcggggcuggcgggucucugaagguaaggccaucgggcuccagggcugggcugaggccccuaacccugcuaaccccccagugcccggccuucccccgggagaucccugggggcccaggcucauggccuccuccccucuccuccucccacuucagacauccugagcuauuaucuccucugcaaccgggccgucuccaaccccuuccaacagguuagggcugcgggcaggggaaacggguguugagggagccagaaaucuggacucugaagggagggggcggggcuggggcuggggccuggacuccuggguuccggggaggaugcaggccaggggcccgagugcuguguccggaggagaggagagagggccgggggcguauacuccuggguccuccucccucccuuucucuuucugcagaggcugacucugucccagcgagcucuggccaacauccacucccagcugcugggccuggagcgagaagcugugccucaguucccuucagcgcaggucggugggugggcgcuccccagacacgcggaccccacggggaaggcggacggggcgggauggagcuguggggcguaggcggggcugcagagcuaggcggggccuuggguugugggcggggacgcagggcggggccagggcgaugggcgggccugaagaguucgugggaaaacgaccccuccucgccccgcagaagccucugcuguccuuggaggagacucugaaugugacagaaggaaauuuccaccaguugguggcacugcuacacugccgcagccugcacaaggugaagccccuccccucccaauuucuucucccacggggggccucugucucgacccacagaacuaccuccuccuucuccuuggaccccugccauugcgccugaggauaucucuguauccucuguuuauaugauuuaucuguccuauaucuauucucuaccuauuuauaaccugucgucuaccuaccuaucaagcauuauccauauuccuucccuccucccucccuuuccccccaacucccgcacuccccgcuggguccccaucccacccuccccgucccuuccugccaccuuuuccuuccuugucuucucuccucucuccguccuccugccucucccucccuccuagaggcugccgcuuagugaguucuggagcaagacugccuggguuccaguccuaccuccugaccaagggcaagucaccuaacuucucuguaccucaguuaguucccucacuuauaaaccugggauugcaagagugggcaccuguccagcuccccugcggcuugugcuguucauacacuggacaggcaggggugggcagggugcccaggaggaaagauaucugguguccugcaggcuccaguuugggcucugccgcaggcugcacggccauaggcaggugagcguggcugacucugcuucccacccguaccgugaggaaggacgaguuuuuuuuguuuguuuuuuuuucacuggauggcugugaggauugaaaaaaaaaauccccuuauaaaacaguaggagcuggccgggcgcggaggcucacaccuguaaucccagcacuuugggaggcccaggcggguggaucaccugaggucaggaguucaagaccagucuggccaacauggugauaccccgucucuacuaaaaauagaaaaaguuagccgggcaugguggugggcgccuauaaucccaacuacucgggaggcugaggcaggagaaucgcuugaauccacgaggcagagguugcagugagccaagauugugccacugcacuccagccugggcaacaagagcgaaacucugucacaaacaaacaaacaaaaccaguaagagcuguucuaaaacacacacccgaggaugccuuuccccggccagucuucccaucaaagaccucacaugugcauagcuucaccaaguaccugacccuguugcauuucacaggugguaacucaucgaugccucauaacaaugcuaugaagaaggaacuaugauuaucccaccuaacagguuagaagaugaggagcagaguugagggaccuucccaaggucacacggccagccagcccgugcacacugaggagagagggaccuuccggagggccccgcccucugccccccacagccaggcaguugcccaguuuuguccuuucugcuucuggaaugucuucauccaucuacucucaaugcccaaugccccugccgcagcugaggccucguucucuccccugcagaaggaagcauggcccccuccccauccauccccccauggacccuagaauagggcugccagauucagcaaacagcaaaccacucugcuauaaguacgcccggugcaaugcuggggagauacuuauacuagaaaauuauguauugggcauccgauacucaaauguaacuggaaguccugaauuugaucuggcaacccuacccaagagggauuugucuacgccaucgcauggaucugagcuuucccuggucuggcucagacagaccccuucuguggcucccacugccucccacccuucuggaacuggcauuccaaaaagggaguggggaguaagcacugaagccaugcucagaauugcugacuauugagcugagaaaggcugggcccccacccagcccagggcugcccugaucuuuugcauaaggauaaacugggguucaggcgcuuuucuguggccuaggcagaaacugggcuggaauacaggcccccagacuccuuuguggagggagggaagggaaggaagaggacagaucacucuacccuucccuaccacugcaccaugagacccugggucuccaucuccccugucagugugccaggguccucacagauuaaaaucaagaauaagcggcggggccgggcacuguggcucacgccuguaaucccagcacuuugggaaaccaaggugggcggaucaccagaggucaggaguuugagaccagccuggccagcauggcgaaaucccaucucuacuaaaaauacaaaaaaacuagccgggcgugguggcacaccccuguauuccuagcuacucaggaggcugaggcacgagaauugcuugaaccugggcaguggagguugcagugagcugagaucgagccacugcacuccagccggggugacagagcgagaauccgucucaaaaaaaaaaaaaaaaaauaggagggggcuagggaugggugccucgugccuauaaacccagcacuuugggaggcccaguggggcagaucagaacuccuugagcucaggaguucaagaccagccuggccaacauggugaaaccccaucucuauuaaaaaaaaaaaaaaucaacaauaagggacaucagggaugaggaugaaggagggagggcacuggagccuaagagaaucagcuccaauaucgcuucugccccuuccagacagugugacucugggcaaguagcuugccuucucugggcugcaacuucuuuccaccauugcaagaggcggcagcgugagagggucagugucugccuggcagggcuguugugaggaugaaggacagugugcauguaccaauacucucaaaacagagccuccauugccccgacagguccguaccccaacccucacuggcuuaguaacagacaccccaccucaaccaggugcuccugccagaaacucaggcucuuagcucccacaaccauucucagaacaaguucuguuggcccuuccucugaaaccuauauggacucccaccgcuguuccuaccaccauugcugugcccugguccccgcauccuagccaccaugaccacaggggccucuucccuguccccccucgccuacccccgucuguccuccaugcagcagccagccagccaggugauccuuuuaaaacacaauccgaucaaguucuuccucugcuuaaaacgcucagugauuccccucagacauggauuaaaaucccuguuccucgcccugaccuacaagggccuggguggucaguccuggaucugucugccucuggccucagccccucccagcuuccucugcacagcccucugccuggcuccuuccuggaggacccaucccugcuagugggguuacccgaccuaccccugcccugcacugacccccgcccuccuaccucguugcacaccagccucugagaugaccuucucgguccuguuuaccgaaguuuccugguacugggggcagcgccuggggcagagcaggcucugucaacccccacugaauacauacgcugugcaggugcuuagcacucggugaaggccguuucugcugauuucuugggacgacagucaucagagccagcauuuguuggcauguugaguguguauugugugcgcggugucaucuugagccacugguugguuuuucgacgugcuguuccacgugcucuaggccagugauucugcccccagggacaccuggcugggugaggaguucugcccccagggacaccuggccgggugccgaguugcuguugguugucacacugcaggagggggugcuccuggcaucugguggguggagcugaguggggcugcucagcaccccacaacacacagggcagcgccgucaccacagagaaugaucuggcucaaaaugucagcagggcccagguuaugaagcccucgccccuggaccaaggcggagcuggcgguggcuggccugugggcgcuuggugcaggggaggaugcucuugcaggaggugccgcugccgggagggagaagggaaacggaaguagcaguucucacguuccuggguagaugaagauggaggagagggcccagggcuggugggagaugcuggacugguucuagauguggggugcugacuggggaggacccaugugaaagggagauaggggccugcaaugacaagggcgggugcagcucaggagaagccaagucuggaggcugggcaauuaauuccugagugccaggccuaucacaccaaagaccccacuguacccacuguauucucagaacugcccuuugacaggggaaacugaggcacagaguggucaguugacgugugcaguaccacagccgggaggacggucagacugaugugcacagugugugccgaugggggaggggguggggacgcauggccugaugacgcccuccccucaggacuauggugcagcccugcggggccugugcgaagacgcccuggaaggccugcucuuccugcuacucuucucccugcugucugcaggagcgcuggccacugcccucugcagccugccccgagccugggcccucuucccacccaggucaggagcgggggaggguaggguccuggggagggaagaggaggggcagcaccuggggaccacgguggcaguggggguggggggugcagccuccugauggguccccaucccgccucucugccaugccccgcaucaaaccccagugacgacuacgaugacacagacgaugacgacccuuucaacccucagguacuggaugccugggucugagggaggaggggcgggggguccugaacuccugggucugagggaggaggagcugagggccuggccgccugggucugagggaggaggggcuggggcccggacuccugggucugagggaggaggggcuggggucccacaguacaaagccaauucccacuccauucccuccucucccccgcuaccccgaaucuccuagcaggaauccaagcgcuuugugcaguggcagucgucuaucugagccccuccucccggcuggacuggagccuggcuccccucuucggugagcuuccaagggccaccccagcuccugcagccgggccucugccccccucccgcccuccgagcugcuccaggcaugggcugcgugccuccugcuggguggaucgcaccgggcaggcccuccagccugcaucacugcccugucucucccucucuccgcaguuccuucccuggcugccggaggagaccccacuaacccagccugccugggcucugaccacuaacacucuuggccauggacagccugcacaggaccgccucccugcucuuggccacugugcucccauuucuguccuuggccuugggaguagcugagggggcagacuagggaguagggcuggcaggggagggggcagacagccucgccucgcacccuucaucccuggcugccggucccauccuuggagggacuaagcugggggugggggacaugagucccccugcugccccugccacaucccagugggcucugacccccugaucucaacucguggcacuaacuuggaaaaggguugauuuaaaauaaaagggaagacuauuuuacaagcagcuggguccuccuuauuucuccucucccuugauucggccuccuggccagggcugggacauccucccugcuguccucucucccccggccucccagcugccaggaauuucugcgccuguccaggcucagcaagggguccaaagacauuguucuuuaaaaaaaaaaaaaaaaaaaucaaaaaacaaaacgcuuucuucugauucuaaaaguaaugcgcguguccugacacaggaagacacaggcaucucuggcacagaauagauggccuagaaauagaucuaacuguguguguguguguguguguguguauauauauauauauacacacaugacagaagacagauuucaagucaguguggaaaggacgguugguuuagcagcaguagugacauaucggcucuccaucuggccaaaaacuucuauagauaagauggguggaagaucuagauguaugcaaguaaaggcacagaagaauuucuagagaaauuaggagggugggcaugguggugcaugccugugguuccagcuacucgggaggcugagacuccuugcuugagcccguuucgagguagcagugagcugugaucgugccacugcacuccagccugggcaacagagcaagacccugccucuuuuuuuuuuuuuuuuuuuguuuuugagacggagucucgcucugucacccagguuggagugcaguggcgcgaucucggcucacugcaagcuccgccucccagguucaugccauucuccugccucagccucccaaguagcugggacuacaggcgcccgccaacacguccggcuaauuuuuuguauuuuuaguagaaacgggguuucaccguguuagccaagauggucucgaucuccugaccucgugauccgcccgucucggccucccaaagugcugggaauacaggcgugagccaccgcgcccggccaagacccugccucuuaaaaaaaaaaaaaaaaaaagacaaaaaacagagagaggcuggcugcgguggcucaugacuguaaucccagcauuuugagaggccaagguggguggaucccuugaggccaggaguuugagagcagaguggccaacauggugaaaccccgucucuacuuaaagaaaaaaaaaauuagcugggcaugguggcacaggucuguaagcccagcuacucgggaggcugaggcaggagaauugcuugaacccgggagguggagguugcaccacuguacuccagccugggagaucaagugagacuccaucucagaaaaaaacaaaacaaaacaaaacaaaccagagaaauuaggagaauauuuguauauugucugcaugucauguaucuggguagggaaaauggggagggaggaguuuaagcaggagaucauaaaaccagaaaggaaaagauagcuuaguuggcaaauuauagauugaaaaacauaccguaaagucaaauggcaaauugacagacuggggaacagugagugugugcgugcguguguguguguguguguguguguguguguguguguguauguuaacaguuaugaugcagaaauguuauucuuaaaagauauaaucuacaaaagcuuucauaaacuaagaaaaagacaacccauuuaaaaguaaucaauugaguugaauacucaauaaaaauuccaacaucaguaaacagacaaaaagauucaaacucuaauaauugggaaaugcaauuugaaagaaugagaaacuacacuuuuucacuaccuagacacaaugaaauuaacaagaguggugauguccugggcgggcgaggaccuagaggaacaggcacucaaaacacuucuccugaggcugugagcugccaccaucccuugaaaaaaaaaaaaaaugcgcuuguaugugaucagaucaaaacugcauacaccccaugccccaacaauccugcuuuugggaauugauuuacagaaaaagacacacaggcuucugaagacuucuauuuagagcugccuguuacaacgauaccacuuugaucagcuaaacccugaaaacaaacaugcacaaaaagagaaguccaauaacugacugcacagcagggcucucuggaagaaaccagcucuuggcugaguugaggaugugagggaaaagccuggcagagaggagcuaucagagcaggguguggcagacagcaguggcagaguggacugaaggagaggggccugcacagugaagggcccagcuuaucauucaaggcaccccaggccaccauccuggcccugcuuuucaugaccuucacggauaugggaaagucacuugacccguuagaccucgguugccucuuugaucaaacggguaucagaaauccaaaauuccaaaauccacagauccaaagagcuccaaagucaagccauccccaagcucauugggcaggaaaaccugaccuguguuggugggagaugacuuacagacaugacugacacgcuuggugugaacguucacauacuucccugcagaaaaguuaaccaggcugcugcacacugcugugcugagcacugagggugccgugugcccuguggaguagagaucauauugccuuugcaacugaaaaauccugaaucucaacacacaccuggcuccgaggggaucgaguuggugcuuggugacccacagugccagaugcugguguacagcguggggccugcugcugcucugugccugucaaucauuucuauuuuguguacugcaaggagcguucagaggaagcuuuagauaugugggccugacggugggaauaaaaaucaacugcaauuucagggagggguucugggggccacaugcguucacucacuuuuuccuaaccaugugggcugucugccccaggcccggcccugcugcuaugcugacuucuuuccucucaaacacugcccucuagugccccugagcccauuucccaagcacaggcauccgcuggcuguugggcggcugcaaaguaccuugagacucagcugcuugaucucccaugccaaugagccugggggugaucucucaacaagaaguuggccgggcacccuggcucacgccuguaaucccagcacugugggaggcuggggcaggcgaucaccugaggucaggaguuugagaccagccuggccaacacggugaaaccccaucucuacuaaacacaaaaauuagcugggcaugguggcgggcgccugcaaucccagcuacucaggaggcugaggcaggagaaucaccugaacccgggaugcggagcuugcagugagccgagaucgcgccacugcacuccagccugggcgacagagcaagacuccgucucaaaaaaaaaaaaaaaaaaaaaaaaggcauuuuacccaaacuuuacaaaaggaaaauccaguguuauuuuuagaauguuaccuaugggggcuuccacugcgaccaggauggagucacagagacuggacuugaccccccaaaaauagaguaaauacaagaaaacaacaguggucaagacucuaccaagaaagugaucccugaggaacgggaaacaucaaggcaagcccuaaaauugccgcuggguccuguugcaaguuucuagaccacgggacagggagggaagacugaggcggagcugggaggacuccgugagcagaggagacaaagcagggagucugagcuuuguucuugagcuuuguuuugagaaugaaguuaugggccgggugcgauggcucacgccuguaaucccagcacuuugggagaccgagguggguagaucaccugaacucagguguucgagaccagcuuugccaacauggugaaacccugucucuacuaaauauauacaaauucgccggguguaguggugggugccuguagucccagcuacucgggagccugaggcaggggaaucucuugaaccugggaggcgaagguugcagugagccaagaucgcgccauugcacuccagccugggcagcagagcgagacuccaucucaaaaaauaaauaaauaaaaauaaaaauaaauuaucuuggacuuccagccuccagaacugugagaaauaaguguuuguuguuuuugagccaccaguccaugguccucuguuacugcagacuagaaugccagggaaagaaccaccuggagggacugaagcaaauagcgccugaguucuggggacucacacaggccuugacaaggcgcuguuccugccagaagaaccucauaacugaaggaacacuggguagaacacggagagggucuuacaucagccguggggaauaagcagcccuaaccuguuaaacacuguucugguccugccugaggaaucuuaaaagcaaaaccugaaaggaucaagcugcuuccaaguaaggugacugcauucucaaacaaagcucaagaauauuuauaggcauacaaaaguaacgagugcucgacaagguaauacugauauugucuaguauccaacaacaaagucaccaaauaugcaaaaagcaggaaaauagggcacaucaugaggauaaaaaucauucaacugaaacggacccaggaguuagaauuaguagguaagaacauuagaacaacuauuauacuguacuccauacguuccaaaaguucuuuacagauacggaagauauaaaaaaacucaaacuggauaucaacagauagaaauuacaaugucugaaauaaauaauguacuggcuggaacagcagauuuuuguuuuuugggggagagucuugcucuguugcccaggcuguagugcaguggcaugaucuaggcucacugcaacuuccaccucccagguucaagcaauucucaugccucagccucccaaguagcugagacuacaggcaccugccaccacauccagcuaauuuuuguauuuuuaguagagacgggcuuucaccauguuggccaggcuggucucaaacuccugaccucaaaugaucugccagccucggccucccaaagugcugggauuacaggugcgagccacugcacccagcccuagaacagcagauuagacauugcaggaaaaaaaaaaaaaucuggaagacaacauuagaaacuguccaaaugaaacauuuaaaaaaaugauuuuuuuuuuuuuacuuuuuagacagggucucacucugucaccuaggcuggagugcacuggcgugaucaugacucacugcagccucaaccucuccagcucaagcgauccucccacuuuagccucucgaguagcugggacuacaggcgcacaccaccauguuuggcuaaucuuuaaaaauuuucuguagagaugaggucucaccauguugcccaggguggucucaaacuccugggcucaagugauccuacugccuuggccucccaaagugcugggauuacaggcaugagccaccaugcccugccccagaaggaaugaauauauuuuuuuuuaaugaaaagaacacuggugagcugugggacauuuuaauauauguguaacuggaggcccauaaggagagagaaagaaaggaacagagagaguguuuaaagaaauaauaaccccaaauuucccaaauuugauacaaacuauaaaaccaaagacacaagaaacucaacacaccccaagcagaagaaacacaaagauaaaccaagauacaucauaaucaaauuucuuaagaccaguaacaaagagaaaaucuugacaacagccagaugaaaaacaaaaagauuuuauaaacagaggaacaaaaauuaggaugacaccagauuucucacuggaaacaaugugagaaagcaguguaagaaaauucuuaaaguagcaaaagaaaaaaguagucaaccuagaauucgauacucacugaaacuguuuuucaaaagugggccgggcacgguggcucacaccuguaaucccagcacuuugggaggcagaggcgggcggaucacaaggucaggagaucgagaccauccuggcuaacacagugaaaccccgucucuacuaaaaauacaaaaaauuagccgggcguggugguggacgccuguauucccagcuacucgggcggcugaggcaggagaauggcgugaacccgggaggcggagcuugcagugagccgagaucgcgccacugcacuccagacugggcgacagagcaagacucccucucaaaaaaaaaaccaaaaaaacaaaagugaagacaaggccaggcgcaguggcucacaccuguaaucccagcauuuugggaggcugaggcaggcguaucaccugaggucaggaguucgagaccagccuggccaacauggugaaaccccgucucuaccaaaaaauacaaaaauuagcugggugugguggugggcacagagcagagauagaacaguaucauaaggcugggcgugguggcucacaccuguaaucccagcacuuugggaggccaaggcaggcagaucccgaggucaggaguuugagaccagccuagccaauauagugaaacccugucucuacuaaaaaugcaaaaaggagcugggugugguggugcacgccuguaaucccagcuacuugggaggcugaggcaguagaacugcuugaaccugggaggaguaggcugcagugagucgagacugugccacugcacuccagccugcaugacagugagacuccgucuaaaaaaaaaaaaaagguaucauaaaaaaugcucaaacuuccaaacuucucuccacaaauggugcuagaacaacuggacaucaacaugccaaaaauaaauaaaucaaaucuauacacagaccuuagucucuucacaaaaauuaacucaaaauggaucauagagcugaauguuaaaugcaaaucuauaaaacuccuagaagauaacauaggagaaaaccuacaugacuggguuuugugaauuuuuuuuuuugagacaagagucucacucugucgcccaggcuggagugcacuggcagaaucuuggcucacugcaaccucugccuccuggguucaagugauucucaugccucagccuccugaguagcuggaauuacaggugugcgccaccacgcccggcuaauuuuuguauuuuuaguagagaugggguuuugccacguuggccaggcuggucucaaacuccuggccucaagugauccacucaccucggcuucccaaaauacugggaugacagcugugagccaccacgcccagccgugauaauuuuuuugauacaacaucaaaggcaugauccaugaaagaaacuuacaagcuugacuuuauuaaaauaauaauaaaaaaaccccucugcuaggccaggcgugguggcucacgccuguaaucccagcucuuugggaggccgaagcgggcggaucacgaggucaggagaucgagaccauccuggcuaacacggugaagccccaucucuacuaaaaauacaaaaaauuagccaggugugguggcaggugccuguagucccagcuacucaggaggcugaggcaggagaauggcgugaacccgggaggcggagcuugcagugagccgagaucacgccacugcacuccagacugggcgacagagcgagacuccaucucaaaaaacaaaacaaaacaaaacccucugcucuuugaaaaacauuuuuaauauaaugagaaaagcugcagccugggagaaacuauuugcaagagaccuaucucaugaaggacugcuauccaagauuuacaaagggcucuuaaaacucaguuaacaggaaaacaaucugauuaaaaaauaggaaaaggggccaggcaugguggcuuacaccuguaaucccagcacuuugggaggccaagacgggcaggaauuugagaccagccuggccaauauggugaaacccuguacuaaaaauacaaaaauuagccagcaugauggcacgugccuguagucccagcuacucgggaggcugaggcagaagaauugcuugaacccgggaggcggagguuggagugagccgagauggugccacugcacuccaaccugggugacagagugagacucggucucaaaaaaaaaaaaaaaaaaaaaaaaaaaaaaaaaaaaaaggauuguuucugggugugucugugaggguguugccagggaggcugacacuugagugaguggacggggagagggagacccacucucagugugggugggcaccauccagucagcgcagaaggugggaggggcuggcuugcugagucuucuggcuuucaucuuucuccugugcuggauacuuccugucuuuggagauuagacuccagguucuuuggccuuuggacucuugaacuuccaccagugguuugucggggacucuuaggccuuccgccacagacugaaggcugcgccguuggcuucccuacuuuugaggcuuuuggacuuugagacgugacuggcuucuuccuuccucagcuugcagauggacuauagugggacuuugccugaugauccugucagccaguucucccuaauauacucccuuucaauauauacauauauccuguuaguucuggcccucuggagaacccuaauacagauggcaaauaaacacaggaaaagauguucaccguaugucauuagggaaccguccauuaaaacaagacaccacuggccgggcgcgggggcucacaccuguaaucccagcacuuuggaaggccaaggcagguggaucacgaggucaagagaucgagaucauccuggccaacauggugaaaccccguuucuacuaaaaauacaaaaauuagcugggcgugguggcgcacgccuguagucccagcuacucgggaggcugaggcaggagaaucgcuugaacccaggaggcggagguugcagugagccgagaccaugccacugcacucuagccuggaagacagagugagacucugucucaaaaaaacaaaaaaaaaacaagacaccacuacauaccuauuagaaugccaaauccaaaaugcuggcaccaccaaaugcuggcagaaauguggagcaacagaaacccuucuucauuggugcuggcaaugcagaaugguacagcuacuuuggaggacagugugguggucucucauaauccuaaacauacucuuagaauaugaaccagcaacacugcuccccaguauuuacacagauggguugaaaacuucugcccacaaagaaaucugcacgugcacguuuauggcagcuuucuuuaucacugccaaaaacuuggaaggaaccaagauauccuucaauaaaugucuuacuacauucugguuguuguaacaaaauaccauacacugcguagcugaggcaggaggaucacuugagccugggagguugaagcugcugugggcugagacagagaucacaucauugcacuccagccugggugacagaaugagaaacccugucucaaaaaaaaaaaaaaaguacaguuuugguuuuugcugugacugggcuccuggagugagagcucuggaucccagcugcaagaugaggaaucuggagccgagagaagggaaacgaguuuuccaagucauacggcugguuaaguaaaagagccgggauuaugacuuagguuuccugccccccaagauuauuauuuuuugaaacagaguuucgcucugucucccaggcuggagugcaauggcaugaucugggcucacugcaaccuccacccccaggguucuagcgauucuccugccucagccucaugaguaacugggauuacaggcaugcgccaccaugcccggcuaauuuuucuguauuuuuaguagagacgggguuucgccauguuggccaggcuggucuugaacuccugaccucaggugauccacacgccucggccucccaaagugcuaggaucacacgcaugagccaccgcgccuggccuacccaagauuauuaaaauaaguuuucagaagcaacccccuacuggccaggcgcaguggcucaugccuguaaucccggcacuuugggaggcagaggcgggcgggucaccugagguccggaauuccagauacugugaaaccccgucuucacuaaaaauacaaaaauuagcugggugugguggugcacgccuguaaagagaauugcuugaaccugggaggcaaagguugcagugagcugagaucgugcuacugcacuccagccugggcgacagagccgucucaaaaaauaauaauaauaauagauuuuuuaagaaaagcaauccccuagugacuucuuagagcacaucaucagacaguugggguaaaauucugaaguggauuaagggaggggugcugguuugccuggauggcuacaugaacauagcccuggaaccaaccaaauauguaacuggacaacagaaaaauaaguacagggugcauuaaucagaggcaacaauguuuuguacuuaaguacacagaagacacgaugugaagacaccaagagaacaguacuuuucaugguuagacacauuucuuagguauuuuuucuacuuugggauucuuuugugauauaauuuguccuguuuacauaauuuuuuucccugacauguaagauaaauguaucuaauugugggcuuacuuguaaagaguuuucacauuuaaguuccagucauuucauuuuaucgcugugucuguguacagaaugcuaaagaauaagacauaaaaaauaaaaguacaguuauaaacaccucuuuuaaaaggcagagacuguucgcuugggcaaaaaaaagcaagauccaacuacaugcuaucuacaagaaacccacccuaaauacaacagguaaaaggaagcuaaauggaacguggguccuggcuuguacccuggcauguaaagaaaacauuggaggaaaagguggugaaaucccaguaaagucuggguuuuaguuacaguaaugcaucaugucaguaucuacaacaaaccacuuuuguuggugcuugugaugacagcaucagaagaaacugagcauaaaacaugguggacugcguaugaucuuugcaacuuuucuuuuuuuuuuuuuugagacaagaauuucacucuuguugcccaggcuggagugcaaugguguaaccucggcucacugcaaccuuggccuccuggguucaagcgauucuccugccucagccucccgaguagccgggauuacaggugcacgcgccaccacgcccagcuaauuucuguauuuuuaguagagacgggacuucaccauguuggccaggcugaucuugaacuccugaccccaggugauccacccaucucggccucccaaaguguugggauuacaggcgugagccagcgcgcccggucuuugcaacguuuugaauaaauccaaaauuauuccagaacaaaaagcuuaguaccaaaaagaaaacaaaaacaaaaacaaaacaaacccccccccccccacagaguaaaauaacggaaaaagaucuacuaugcuagcacuaacaaaauaauacguaguuaugaaaaugguauguauuuuucaagcuagacguucauaaugguagaacaugaggaggaaaacugccucuuaaaucccaccacuuacugugacgcagugaccggucccugcagcggacuggauaguuguaucagaguccuggacggaaacagauggcacucaaaagguggcgcgcaguucagagaaaugccuauguacggauuugguccaaugccucagccugaccucagggaccuucgggggucugcuccgcgcccacccuuacacaucugugaccccacacacuuccaccccagcgccacugccaacagcuacacccaucccccuccaaccgcgucagcuuccagccucgguccaucugaacucgccgugcccccuccccugcgcccuuccagauucauuugcuagggaagcccgcucuuccggguggagcuguuccucauccccuuucuuuaucauucucuccccagggcuuccacaucaccgugcuguggacaaucccggaacuccugucacgccaguuuacauuuaggaacaguaauggcucccacugacucagucaaaacaaggcugcggccgggcacgguggcucacgcccguaaucccagcacuuugggaagccgagacggagggaucacgaggucaggaguucgagaacagccuggccgacauggugaaaccccgucuuuacuaaaaacacaaaaauuagccgggcauaguggcgcgcgccuguaaucccagcuacuccggaggcugaggcagaauuguuugaacccaggaggcggagguugcagugagcagagaucacgccacuguacucuaucgugggcgacgacagagcaagagcaagacuccgucuccgagaacaacaacaacagcaacaagaaaacaacaauaaaaaaaauaaggcugcgugggaggcagaaagagcuaaugcggccacgcuuguccccucggggccaccguccccacccagacuuccggucugccuuaaaauguucaugcgua

SEQ ID NO: 14984 - RNA, 25265 nt, Homo sapiens
caaacgcagagaaaaacauuguaagguguugggccaugagaacuuuggagaaaauuacagaggggaccaggcacggugguucacgccuguaaucccagcacuuugggaagccgaggcaggcggaucacgaggucaagagaucgagaccauccuggcuaacacggugaaaucccgucgcuacuaaaaauacaaaaauuagccgggcgugguggugggcgccuguagucccagcuacuugggaggcugagacaggagaaucgcuugaacccgggaaguggagcuugcagugagcagagaucgugccacugcacuccagccugggugacggagcgagaauccgucuuaaaaaaaaaaaaagaaaauuauagagggagaugaggugggacagagucuggcaguucaucagggggacugagaagguggcauuuggaggagaggaggcagugagcugugcaguguccaggcagccacccuucccagcggccaccaugacgguguccucauugcuuugaccauuaguaaucauucauucauucauucauuuauccgacgucagcuggaggcccugcccgcggggcaugcgcugagauuugggaggccuuccgggaugcugcgcuccagcggggaaggccgacuggggcugaaaaagcuggaggucaggacacacccgcagggcagcaggugcaagagacagacaagccuggguuugaagaaguccagguucugcauuguggucaggcccaggggcugcacaagccgggccucagcuccuucuccugggcgagggcagggaaguggugggagccauaagggugaugccagggugaggcagacccaccaucgcuagaaaauaucuuccgggugcaccacugcgaaagcaccccacacuugggagucccucgacagacaaaucaggggccuccaagggagucuugcuggaggggagcacuugcgaggcugggcggaagcagccagagaccaggguaaggagugaagcccaagcuuguggggccugcagagaauggcaggaggauuacaugagcacuuacuacgugccgggcacugugcuguuguuacggcggguccuugcucccggagcucccaagaucgugguggccacuuccaagagggcagcaagccucguguucucugaccugggguucuuggccucacggauuccaaggaauggaauccugggcccugcggugaguguuuuagcucuauuagaagccgugggucacggaagagaaccguggaacccagcgaccaguguucagcucgaucaggaugaacccaggcaguuagcugugcaggaacaauggcgagccucuagcccgauugggagcggcaaugggugucucccuggaucacgagcacaguggacacccugccggauccggaggguggaagucagcggcgggucugcgacggcggcaaacagcagugguggacggcgagcgaaagcucagcucaagccguaacagacacggaccagaagagugugcaguuucaaguuuuaauagagugaaaacagaguucccauacaacgggaggggacccaaaguggguagccguugcuggcuggaaugccuggguuucuauccagaucauugucccuuccccugugcucucaggugauagaugauuggcuauuucuuuacuuccuauuuuugccuaacuagcacuuuagugagcucucuuuacuaccugauugguugggugugagcuaaauugcaugccccguguuuaaagguggaugcggucaccuucccagcuaggcuuagggauuauuagucggccucggacauccagcuaguccugucucucacuguggcuugcaugcuugcaccuccugaaucaugguggugggcccuucacugauauuuaaggauuaacuuuuuuuuuuuucauuuuugagacuaagucucacucuugucgcccaggcuggagugcaguggugcaaucuuggcucacugcaaccuccaccucauggguucaaaugauucuccugccucagccucccaaguagcugggauuacaggcgugcaccaccacgcccggcuaauuguuguauuuuuaguaaagacgggguuucaccauguuggccaggcuggucucaaacuccugaccucaagugauccgccugccucagccucccaaaaugcgcggauuacaggcgugagccaccucgcccggccaaguauuaacuauuaacuaacaucucaguucccucguucacgcucaggcuaaccucuaaguguguccacgugcuuggcacucuccuaagcacuucuagucaugcagcccacucgaggcaauauucucaagccaguguuguugugcuccccacguuacauguagggaaacugaggaacgagaggcuaagguuaccgagacaagaguuacccggccaguuaagcggaggggcugggguugagaccaggcagccucugccuccagacgucaugcccuccagggaugcgaugggaucuuuggugcagucuugagaacgaguaucuccacucugcagggugggguuggggauggggagcucggagagaacacaucacgugucccuggucacagggcacauguguguggcccggccaggggauagucccaggugcucaggaccuguauucuaaaccgcuccaguguccugucucaugauaacacuauuucacagaggaccugggcuguggcccagacacaguaaacagcaggaggcugagcuuggaggguggugaaugugaggcugagcuggggggcagggugaaugcugguggaggguugcuguuccgccggggugccuggaggcagguuugugguuucagcccuacccucuccccucccagguggcuggccuacguccuccugcugcuccuggagcugcuggucugccucuucacccuccugggccuggcgaagcagagcaaguggcuggugaucguguaagugcaggcaguagggggacccagugcuugccuggcacucuccuggcaggcaggaccucagucuuacaacucuccuacacggaggaccgugguccuucacggccggguacacacgaagaaaagagagucagagcagcccaggagggaggcggggacagaccugaaaacaggcagcccuaacaguaugaaguaugcuggaaucauggcagaaauaaucauuguguuggcaauaaagaugaggaugaggccaggcgcgguggcucacgccuguaaucccagcacuuuaggaggccgagguggguggaucaugaggucaggaguuugagaccagccugaccaacauggagaaacccugucucuauuaaaaauacaaaaauuagcugggugugguggcaugcgccuguagucccagcuacucaggaggcugaggcaggagaaucgcuugaacucaggagguggagguuguggugagccaagaucacaccauugcacuccagccugggcgacagagugacacuccaucucaaaaaaaaaaaaaaaaaaaaaaaaggcugggcgugguggcucacgccuguaaucccagcacuuugggaggccgaggagggcggaucacgaggucaggagaucgagaccauccuggcuaacacggugaaaccccaucucuacuaaaaauacaaaaauuagccgggcgugguggcgggcgccuauagucccagcuacucgggaggcugaggcaggagaaucgcuugaacccgggaggcggagguugcagugagcugagauugcaccacugcacuccagccugggcgacacagugagacuccauuucaaaaacaacaacaacaacaacaaaaaaaaacagaugaggaugaugaucuauugagggucaugcacgcugaguccuucaguugccuccaccccaugaaggagcuaccauaaggcuccauguggccggucagggaccugacuaagagcgcagaggguggccaaguccgagacugagccguccuuaagugucguggcaaagccgcaggaccacacugauuucacagcucgcucuacgcgcccgacacucuucucugcacucccuggagcaccucaugcccccugugaggaaggugcuuccuucugccuguuuuuuauuucuguuuuuuauuuugagaaggucuugcuuuguugcccagacuggagugcaguggcaugaucacggcucacuacagccucuguccccugaggcucaagugauccccccaccucagccuccagaguagcugggaccaugggcuuaugccaccacucccggcuaaguuuuuuuuuuuuuuuuuuuuuuuuuuuugagcugcaauuuggcucuuguuguccaggcuggaguucagcggcacgaucuuggcucacugcaaccucugccuccuggguucaggcaauucuccugcuucagccucccaaguagcugggauuacaggcguaugccaccaaaccugucuaauuuuguauuuuuaguagagaugggguuucuccauguuggucaggauggucucaaacuccugaccuaaggugauccgcccgccucagccucccaaagugccuggauuacaggcaugagccaccgugccuggccuaaguuuuguauauuuuuguagagauggagucuugcuauguugcccaggcuggucucgaacuccuggccucaagugaucagccugccucagccuuccaaaguacuggguuuacaggcaugagcuaccaugccuggcccuucucccuguuuaacagagggagagacugaagaucagagagguuggaccacuugcucagggccacacagcuagaagugcuagagcugggauuugaaccagacaggccauucucauuggaggagucccugcauucucucuggcccuaguggggugaggcggaguugaaccuguaccuccauugccccugagagagugggagagaccccgcguaaggcuugcagacccauaaaccuagccaacacagggcaggucugggacuggaagccaggccuucaguuuggggaccccugggugcccuucuugcuuacuggucacccuaccaaugcugacacgcccccugcaccccuccccacccggaaaguccagagacuuucagauuucagcccuggcacugucucccauucucagaggagacagggcagagccagaggcugaucaggcuguggguggacuugggggagccuucgggggaagugagcccagaggugagcagucaccgucccaggguccuggagcugggauccaagcugcgaccacccagcccagggcccugcucauaccccacacccugcucaucugggcaggagccagauguccugcuggacaucagcagccacuggccuacccccaaccacugaacuuguguuucccuaauucugauccuccaggcuccagagguggguggagguggggggcggcugugaugggauuugggguguggaaagaggcuaggcuaggagauuaagaaccccgggcugauccucccucccccacucuaggaugacagucaugagucuccugguucucguccugagcuggggcuccaugggccuggaggcagccacggccguggugagugccagggccgggccauugggcucugggacucagggggccuggagacuucaacuucuggaucucgggauggcauggcuuaguagagaaaggaauuggggggcacgaucacagcucugagguuuagggcuuguuuccuggggccugaguggguacagauugguguccuggacguuugagcuguaauggaggaggggcuggaaaccuggauuccuaggucugagggaggaggggcugggggucuggacuccugggugugagggaggagaagcugggggccuggacuccugagucugagggagaaagggcuggagagucugaaccccugagucugagggacgaggggccuggggccuggacuccugagucugagggaagaggggcugggaccuggaccccuggguggggaggggagcuggggagccaggcacugggugcugugggaguguggaaucggggcaguuuuggguuugagccccuuuucugcugccucacgcagggccucagugacuucugcuccaauccagacccuuauguucugaaccugacccaggaggagacagggcucagcucaggugauuuccaagggcccgguggguccgccggguugggcagugcaggcccuggcuuccucaggccuccucugugcccgguccugcccaggguggggugggggugcagccugccaggcgagacccagcccucuggaagggaagcagggcuccuggccacuccccagcucggagcccuccuggagccccgccacccgccagacccucaucccuucugcuccagcuggcagcgccucuccuggugggcuggaaaagagggcaggauaaagauaauggugccaggaagagagaggagggucaggagagggugcuccugggcgucaggaauggggaguuuggcccccuggagaaaacuggggagcaccauuuagucagggguucccagggaguauaggguugcccaccagcgccugcucuggcuguggcaggagcagaagggacgcggggcuggcgggucucugaagguaaggccaucgggcuccagggcugggcugaggccccuaacccugcuaaccccccagugcccggccuucccccgggagaucccugggggcccaggcucauggccuccuccccucuccuccucccacuucagacauccugagcuauuaucuccucugcaaccgggccgucuccaaccccuuccaacagguuagggcugcgggcaggggaaacggguguugagggagccagaaaucuggacucugaagggagggggcggggcuggggcuggggccuggacuccuggguuccggggaggaugcaggccaggggcccgagugcuguguccggaggagaggagagagggccgggggcguauacuccuggguccuccucccucccuuucucuuucugcagaggcugacucugucccagcgagcucuggccaacauccacucccagcugcugggccuggagcgagaagcugugccucaguucccuucagcgcaggucggugggugggcgcuccccagacacgcggaccccacggggaaggcggacggggcgggauggagcuguggggcguaggcggggcugcagagcuaggcggggccuuggguugugggcggggacgcagggcggggccagggcgaugggcgggccugaagaguucgugggaaaacgaccccuccucgccccgcagaagccucugcuguccuuggaggagacucugaaugugacagaaggaaauuuccaccaguugguggcacugcuacacugccgcagccugcacaaggugaagccccuccccucccaauuucuucucccacggggggccucugucucgacccacagaacuaccuccuccuucuccuuggaccccugccauugcgccugaggauaucucuguauccucuguuuauaugauuuaucuguccuauaucuauucucuaccuauuuauaaccugucgucuaccuaccuaucaagcauuauccauauuccuucccuccucccucccuuuccccccaacucccgcacuccccgcuggguccccaucccacccuccccgucccuuccugccaccuuuuccuuccuugucuucucuccucucuccguccuccugccucucccucccuccuagaggcugccgcuuagugaguucuggagcaagacugccuggguuccaguccuaccuccugaccaagggcaagucaccuaacuucucuguaccucaguuaguucccucacuuauaaaccugggauugcaagagugggcaccuguccagcuccccugcggcuugugcuguucauacacuggacaggcaggggugggcagggugcccaggaggaaagauaucugguguccugcaggcuccaguuugggcucugccgcaggcugcacggccauaggcaggugagcguggcugacucugcuucccacccguaccgugaggaaggacgaguuuuuuuuguuuguuuuuuuuucacuggauggcugugaggauugaaaaaaaaaauccccuuauaaaacaguaggagcuggccgggcgcggaggcucacaccuguaaucccagcacuuugggaggcccaggcggguggaucaccugaggucaggaguucaagaccagucuggccaacauggugauaccccgucucuacuaaaaauagaaaaaguuagccgggcaugguggugggcgccuauaaucccaacuacucgggaggcugaggcaggagaaucgcuugaauccacgaggcagagguugcagugagccaagauugugccacugcacuccagccugggcaacaagagcgaaacucugucacaaacaaacaaacaaaaccaguaagagcuguucuaaaacacacacccgaggaugccuuuccccggccagucuucccaucaaagaccucacaugugcauagcuucaccaaguaccugacccuguugcauuucacaggugguaacucaucgaugccucauaacaaugcuaugaagaaggaacuaugauuaucccaccuaacagguuagaagaugaggagcagaguugagggaccuucccaaggucacacggccagccagcccgugcacacugaggagagagggaccuuccggagggccccgcccucugccccccacagccaggcaguugcccaguuuuguccuuucugcuucuggaaugucuucauccaucuacucucaaugcccaaugccccugccgcagcugaggccucguucucuccccugcagaaggaagcauggcccccuccccauccauccccccauggacccuagaauagggcugccagauucagcaaacagcaaaccacucugcuauaaguacgcccggugcaaugcuggggagauacuuauacuagaaaauuauguauugggcauccgauacucaaauguaacuggaaguccugaauuugaucuggcaacccuacccaagagggauuugucuacgccaucgcauggaucugagcuuucccuggucuggcucagacagaccccuucuguggcucccacugccucccacccuucuggaacuggcauuccaaaaagggaguggggaguaagcacugaagccaugcucagaauugcugacuauugagcugagaaaggcugggcccccacccagcccagggcugcccugaucuuuugcauaaggauaaacugggguucaggcgcuuuucuguggccuaggcagaaacugggcuggaauacaggcccccagacuccuuuguggagggagggaagggaaggaagaggacagaucacucuacccuucccuaccacugcaccaugagacccugggucuccaucuccccugucagugugccaggguccucacagauuaaaaucaagaauaagcggcggggccgggcacuguggcucacgccuguaaucccagcacuuugggaaaccaaggugggcggaucaccagaggucaggaguuugagaccagccuggccagcauggcgaaaucccaucucuacuaaaaauacaaaaaaacuagccgggcgugguggcacaccccuguauuccuagcuacucaggaggcugaggcacgagaauugcuugaaccugggcaguggagguugcagugagcugagaucgagccacugcacuccagccggggugacagagcgagaauccgucucaaaaaaaaaaaaaaaaaauaggagggggcuagggaugggugccucgugccuauaaacccagcacuuugggaggcccaguggggcagaucagaacuccuugagcucaggaguucaagaccagccuggccaacauggugaaaccccaucucuauuaaaaaaaaaaaaaaucaacaauaagggacaucagggaugaggaugaaggagggagggcacuggagccuaagagaaucagcuccaauaucgcuucugccccuuccagacagugugacucugggcaaguagcuugccuucucugggcugcaacuucuuuccaccauugcaagaggcggcagcgugagagggucagugucugccuggcagggcuguugugaggaugaaggacagugugcauguaccaauacucucaaaacagagccuccauugccccgacagguccguaccccaacccucacuggcuuaguaacagacaccccaccucaaccaggugcuccugccagaaacucaggcucuuagcucccacaaccauucucagaacaaguucuguuggcccuuccucugaaaccuauauggacucccaccgcuguuccuaccaccauugcugugcccugguccccgcauccuagccaccaugaccacaggggccucuucccuguccccccucgccuacccccgucuguccuccaugcagcagccagccagccaggugauccuuuuaaaacacaauccgaucaaguucuuccucugcuuaaaacgcucagugauuccccucagacauggauuaaaaucccuguuccucgcccugaccuacaagggccuggguggucaguccuggaucugucugccucuggccucagccccucccagcuuccucugcacagcccucugccuggcuccuuccuggaggacccaucccugcuagugggguuacccgaccuaccccugcccugcacugacccccgcccuccuaccucguugcacaccagccucugagaugaccuucucgguccuguuuaccgaaguuuccugguacugggggcagcgccuggggcagagcaggcucugucaacccccacugaauacauacgcugugcaggugcuuagcacucggugaaggccguuucugcugauuucuugggacgacagucaucagagccagcauuuguuggcauguugaguguguauugugugcgcggugucaucuugagccacugguugguuuuucgacgugcuguuccacgugcucuaggccagugauucugcccccagggacaccuggcugggugaggaguucugcccccagggacaccuggccgggugccgaguugcuguugguugucacacugcaggagggggugcuccuggcaucugguggguggagcugaguggggcugcucagcaccccacaacacacagggcagcgccgucaccacagagaaugaucuggcucaaaaugucagcagggcccagguuaugaagcccucgccccuggaccaaggcggagcuggcgguggcuggccugugggcgcuuggugcaggggaggaugcucuugcaggaggugccgcugccgggagggagaagggaaacggaaguagcaguucucacguuccuggguagaugaagauggaggagagggcccagggcuggugggagaugcuggacugguucuagauguggggugcugacuggggaggacccaugugaaagggagauaggggccugcaaugacaagggcgggugcagcucaggagaagccaagucuggaggcugggcaauuaauuccugagugccaggccuaucacaccaaagaccccacuguacccacuguauucucagaacugcccuuugacaggggaaacugaggcacagaguggucaguugacgugugcaguaccacagccgggaggacggucagacugaugugcacagugugugccgaugggggaggggguggggacgcauggccugaugacgcccuccccucaggacuauggugcagcccugcggggccugugcgaagacgcccuggaaggccugcucuuccugcuacucuucucccugcugucugcaggagcgcuggccacugcccucugcagccugccccgagccugggcccucuucccacccaggucaggagcgggggaggguaggguccuggggagggaagaggaggggcagcaccuggggaccacgguggcaguggggguggggggugcagccuccugauggguccccaucccgccucucugccaugccccgcaucaaaccccagugacgacuacgaugacacagacgaugacgacccuuucaacccucagguacuggaugccugggucugagggaggaggggcgggggguccugaacuccugggucugagggaggaggagcugagggccuggccgccugggucugagggaggaggggcuggggcccggacuccugggucugagggaggaggggcuggggucccacaguacaaagccaauucccacuccauucccuccucucccccgcuaccccgaaucuccuagcaggaauccaagcgcuuugugcaguggcagucgucuaucugagccccuccucccggcuggacuggagccuggcuccccucuucggugagcuuccaagggccaccccagcuccugcagccgggccucugccccccucccgcccuccgagcugcuccaggcaugggcugcgugccuccugcuggguggaucgcaccgggcaggcccuccagccugcaucacugcccugucucucccucucuccgcaguuccuucccuggcugccggaggagaccccacuaacccagccugccugggcucugaccacuaacacucuuggccauggacagccugcacaggaccgccucccugcucuuggccacugugcucccauuucuguccuuggccuugggaguagcugagggggcagacuagggaguagggcuggcaggggagggggcagacagccucgccucgcacccuucaucccuggcugccggucccauccuuggagggacuaagcugggggugggggacaugagucccccugcugccccugccacaucccagugggcucugacccccugaucucaacucguggcacuaacuuggaaaaggguugauuuaaaauaaaagggaagacuauuuuacaagcagcuggguccuccuuauuucuccucucccuugauucggccuccuggccagggcugggacauccucccugcuguccucucucccccggccucccagcugccaggaauuucugcgccuguccaggcucagcaagggguccaaagacauuguucuuuaaaaaaaaaaaaaaaaaaaucaaaaaacaaaacgcuuucuucugauucuaaaaguaaugcgcguguccugacacaggaagacacaggcaucucuggcacagaauagauggccuagaaauagaucuaacuguguguguguguguguguguguguauauauauauauauacacacaugacagaagacagauuucaagucaguguggaaaggacgguugguuuagcagcaguagugacauaucggcucuccaucuggccaaaaacuucuauagauaagauggguggaagaucuagauguaugcaaguaaaggcacagaagaauuucuagagaaauuaggagggugggcaugguggugcaugccugugguuccagcuacucgggaggcugagacuccuugcuugagcccguuucgagguagcagugagcugugaucgugccacugcacuccagccugggcaacagagcaagacccugccucuuuuuuuuuuuuuuuuuuuguuuuugagacggagucucgcucugucacccagguuggagugcaguggcgcgaucucggcucacugcaagcuccgccucccagguucaugccauucuccugccucagccucccaaguagcugggacuacaggcgcccgccaacacguccggcuaauuuuuuguauuuuuaguagaaacgggguuucaccguguuagccaagauggucucgaucuccugaccucgugauccgcccgucucggccucccaaagugcugggaauacaggcgugagccaccgcgcccggccaagacccugccucuuaaaaaaaaaaaaaaaaaaagacaaaaaacagagagaggcuggcugcgguggcucaugacuguaaucccagcauuuugagaggccaagguggguggaucccuugaggccaggaguuugagagcagaguggccaacauggugaaaccccgucucuacuuaaagaaaaaaaaaauuagcugggcaugguggcacaggucuguaagcccagcuacucgggaggcugaggcaggagaauugcuugaacccgggagguggagguugcaccacuguacuccagccugggagaucaagugagacuccaucucagaaaaaaacaaaacaaaacaaaacaaaccagagaaauuaggagaauauuuguauauugucugcaugucauguaucuggguagggaaaauggggagggaggaguuuaagcaggagaucauaaaaccagaaaggaaaagauagcuuaguuggcaaauuauagauugaaaaacauaccguaaagucaaauggcaaauugacagacuggggaacagugagugugugcgugcguguguguguguguguguguguguguguguguguguguauguuaacaguuaugaugcagaaauguuauucuuaaaagauauaaucuacaaaagcuuucauaaacuaagaaaaagacaacccauuuaaaaguaaucaauugaguugaauacucaauaaaaauuccaacaucaguaaacagacaaaaagauucaaacucuaauaauugggaaaugcaauuugaaagaaugagaaacuacacuuuuucacuaccuagacacaaugaaauuaacaagaguggugauguccugggcgggcgaggaccuagaggaacaggcacucaaaacacuucuccugaggcugugagcugccaccaucccuugaaaaaaaaaaaaaaugcgcuuguaugugaucagaucaaaacugcauacaccccaugccccaacaauccugcuuuugggaauugauuuacagaaaaagacacacaggcuucugaagacuucuauuuagagcugccuguuacaacgauaccacuuugaucagcuaaacccugaaaacaaacaugcacaaaaagagaaguccaauaacugacugcacagcagggcucucuggaagaaaccagcucuuggcugaguugaggaugugagggaaaagccuggcagagaggagcuaucagagcaggguguggcagacagcaguggcagaguggacugaaggagaggggccugcacagugaagggcccagcuuaucauucaaggcaccccaggccaccauccuggcccugcuuuucaugaccuucacggauaugggaaagucacuugacccguuagaccucgguugccucuuugaucaaacggguaucagaaauccaaaauuccaaaauccacagauccaaagagcuccaaagucaagccauccccaagcucauugggcaggaaaaccugaccuguguuggugggagaugacuuacagacaugacugacacgcuuggugugaacguucacauacuucccugcagaaaaguuaaccaggcugcugcacacugcugugcugagcacugagggugccgugugcccuguggaguagagaucauauugccuuugcaacugaaaaauccugaaucucaacacacaccuggcuccgaggggaucgaguuggugcuuggugacccacagugccagaugcugguguacagcguggggccugcugcugcucugugccugucaaucauuucuauuuuguguacugcaaggagcguucagaggaagcuuuagauaugugggccugacggugggaauaaaaaucaacugcaauuucagggagggguucugggggccacaugcguucacucacuuuuuccuaaccaugugggcugucugccccaggcccggcccugcugcuaugcugacuucuuuccucucaaacacugcccucuagugccccugagcccauuucccaagcacaggcauccgcuggcuguugggcggcugcaaaguaccuugagacucagcugcuugaucucccaugccaaugagccugggggugaucucucaacaagaaguuggccgggcacccuggcucacgccuguaaucccagcacugugggaggcuggggcaggcgaucaccugaggucaggaguuugagaccagccuggccaacacggugaaaccccaucucuacuaaacacaaaaauuagcugggcaugguggcgggcgccugcaaucccagcuacucaggaggcugaggcaggagaaucaccugaacccgggaugcggagcuugcagugagccgagaucgcgccacugcacuccagccugggcgacagagcaagacuccgucucaaaaaaaaaaaaaaaaaaaaaaaaggcauuuuacccaaacuuuacaaaaggaaaauccaguguuauuuuuagaauguuaccuaugggggcuuccacugcgaccaggauggagucacagagacuggacuugaccccccaaaaauagaguaaauacaagaaaacaacaguggucaagacucuaccaagaaagugaucccugaggaacgggaaacaucaaggcaagcccuaaaauugccgcuggguccuguugcaaguuucuagaccacgggacagggagggaagacugaggcggagcugggaggacuccgugagcagaggagacaaagcagggagucugagcuuuguucuugagcuuuguuuugagaaugaaguuaugggccgggugcgauggcucacgccuguaaucccagcacuuugggagaccgagguggguagaucaccugaacucagguguucgagaccagcuuugccaacauggugaaacccugucucuacuaaauauauacaaauucgccggguguaguggugggugccuguagucccagcuacucgggagccugaggcaggggaaucucuugaaccugggaggcgaagguugcagugagccaagaucgcgccauugcacuccagccugggcagcagagcgagacuccaucucaaaaaauaaauaaauaaaaauaaaaauaaauuaucuuggacuuccagccuccagaacugugagaaauaaguguuuguuguuuuugagccaccaguccaugguccucuguuacugcagacuagaaugccagggaaagaaccaccuggagggacugaagcaaauagcgccugaguucuggggacucacacaggccuugacaaggcgcuguuccugccagaagaaccucauaacugaaggaacacuggguagaacacggagagggucuuacaucagccguggggaauaagcagcccuaaccuguuaaacacuguucugguccugccugaggaaucuuaaaagcaaaaccugaaaggaucaagcugcuuccaaguaaggugacugcauucucaaacaaagcucaagaauauuuauaggcauacaaaaguaacgagugcucgacaagguaauacugauauugucuaguauccaacaacaaagucaccaaauaugcaaaaagcaggaaaauagggcacaucaugaggauaaaaaucauucaacugaaacggacccaggaguuagaauuaguagguaagaacauuagaacaacuauuauacuguacuccauacguuccaaaaguucuuuacagauacggaagauauaaaaaaacucaaacuggauaucaacagauagaaauuacaaugucugaaauaaauaauguacuggcuggaacagcagauuuuuguuuuuugggggagagucuugcucuguugcccaggcuguagugcaguggcaugaucuaggcucacugcaacuuccaccucccagguucaagcaauucucaugccucagccucccaaguagcugagacuacaggcaccugccaccacauccagcuaauuuuuguauuuuuaguagagacgggcuuucaccauguuggccaggcuggucucaaacuccugaccucaaaugaucugccagccucggccucccaaagugcugggauuacaggugcgagccacugcacccagcccuagaacagcagauuagacauugcaggaaaaaaaaaaaaaucuggaagacaacauuagaaacuguccaaaugaaacauuuaaaaaaaugauuuuuuuuuuuuuacuuuuuagacagggucucacucugucaccuaggcuggagugcacuggcgugaucaugacucacugcagccucaaccucuccagcucaagcgauccucccacuuuagccucucgaguagcugggacuacaggcgcacaccaccauguuuggcuaaucuuuaaaaauuuucuguagagaugaggucucaccauguugcccaggguggucucaaacuccugggcucaagugauccuacugccuuggccucccaaagugcugggauuacaggcaugagccaccaugcccugccccagaaggaaugaauauauuuuuuuuuaaugaaaagaacacuggugagcugugggacauuuuaauauauguguaacuggaggcccauaaggagagagaaagaaaggaacagagagaguguuuaaagaaauaauaaccccaaauuucccaaauuugauacaaacuauaaaaccaaagacacaagaaacucaacacaccccaagcagaagaaacacaaagauaaaccaagauacaucauaaucaaauuucuuaagaccaguaacaaagagaaaaucuugacaacagccagaugaaaaacaaaaagauuuuauaaacagaggaacaaaaauuaggaugacaccagauuucucacuggaaacaaugugagaaagcaguguaagaaaauucuuaaaguagcaaaagaaaaaaguagucaaccuagaauucgauacucacugaaacuguuuuucaaaagugggccgggcacgguggcucacaccuguaaucccagcacuuugggaggcagaggcgggcggaucacaaggucaggagaucgagaccauccuggcuaacacagugaaaccccgucucuacuaaaaauacaaaaaauuagccgggcguggugguggacgccuguauucccagcuacucgggcggcugaggcaggagaauggcgugaacccgggaggcggagcuugcagugagccgagaucgcgccacugcacuccagacugggcgacagagcaagacucccucucaaaaaaaaaaccaaaaaaacaaaagugaagacaaggccaggcgcaguggcucacaccuguaaucccagcauuuugggaggcugaggcaggcguaucaccugaggucaggaguucgagaccagccuggccaacauggugaaaccccgucucuaccaaaaaauacaaaaauuagcugggugugguggugggcacagagcagagauagaacaguaucauaaggcugggcgugguggcucacaccuguaaucccagcacuuugggaggccaaggcaggcagaucccgaggucaggaguuugagaccagccuagccaauauagugaaacccugucucuacuaaaaaugcaaaaaggagcugggugugguggugcacgccuguaaucccagcuacuugggaggcugaggcaguagaacugcuugaaccugggaggaguaggcugcagugagucgagacugugccacugcacuccagccugcaugacagugagacuccgucuaaaaaaaaaaaaaagguaucauaaaaaaugcucaaacuuccaaacuucucuccacaaauggugcuagaacaacuggacaucaacaugccaaaaauaaauaaaucaaaucuauacacagaccuuagucucuucacaaaaauuaacucaaaauggaucauagagcugaauguuaaaugcaaaucuauaaaacuccuagaagauaacauaggagaaaaccuacaugacuggguuuugugaauuuuuuuuuuugagacaagagucucacucugucgcccaggcuggagugcacuggcagaaucuuggcucacugcaaccucugccuccuggguucaagugauucucaugccucagccuccugaguagcuggaauuacaggugugcgccaccacgcccggcuaauuuuuguauuuuuaguagagaugggguuuugccacguuggccaggcuggucucaaacuccuggccucaagugauccacucaccucggcuucccaaaauacugggaugacagcugugagccaccacgcccagccgugauaauuuuuuugauacaacaucaaaggcaugauccaugaaagaaacuuacaagcuugacuuuauuaaaauaauaauaaaaaaaccccucugcuaggccaggcgugguggcucacgccuguaaucccagcucuuugggaggccgaagcgggcggaucacgaggucaggagaucgagaccauccuggcuaacacggugaagccccaucucuacuaaaaauacaaaaaauuagccaggugugguggcaggugccuguagucccagcuacucaggaggcugaggcaggagaauggcgugaacccgggaggcggagcuugcagugagccgagaucacgccacugcacuccagacugggcgacagagcgagacuccaucucaaaaaacaaaacaaaacaaaacccucugcucuuugaaaaacauuuuuaauauaaugagaaaagcugcagccugggagaaacuauuugcaagagaccuaucucaugaaggacugcuauccaagauuuacaaagggcucuuaaaacucaguuaacaggaaaacaaucugauuaaaaaauaggaaaaggggccaggcaugguggcuuacaccuguaaucccagcacuuugggaggccaagacgggcaggaauuugagaccagccuggccaauauggugaaacccuguacuaaaaauacaaaaauuagccagcaugauggcacgugccuguagucccagcuacucgggaggcugaggcagaagaauugcuugaacccgggaggcggagguuggagugagccgagauggugccacugcacuccaaccugggugacagagugagacucggucucaaaaaaaaaaaaaaaaaaaaaaaaaaaaaaaaaaaaaaggauuguuucugggugugucugugaggguguugccagggaggcugacacuugagugaguggacggggagagggagacccacucucagugugggugggcaccauccagucagcgcagaaggugggaggggcuggcuugcugagucuucuggcuuucaucuuucuccugugcuggauacuuccugucuuuggagauuagacuccagguucuuuggccuuuggacucuugaacuuccaccagugguuugucggggacucuuaggccuuccgccacagacugaaggcugcgccguuggcuucccuacuuuugaggcuuuuggacuuugagacgugacuggcuucuuccuuccucagcuugcagauggacuauagugggacuuugccugaugauccugucagccaguucucccuaauauacucccuuucaauauauacauauauccuguuaguucuggcccucuggagaacccuaauacagauggcaaauaaacacaggaaaagauguucaccguaugucauuagggaaccguccauuaaaacaagacaccacuggccgggcgcgggggcucacaccuguaaucccagcacuuuggaaggccaaggcagguggaucacgaggucaagagaucgagaucauccuggccaacauggugaaaccccguuucuacuaaaaauacaaaaauuagcugggcgugguggcgcacgccuguagucccagcuacucgggaggcugaggcaggagaaucgcuugaacccaggaggcggagguugcagugagccgagaccaugccacugcacucuagccuggaagacagagugagacucugucucaaaaaaacaaaaaaaaaacaagacaccacuacauaccuauuagaaugccaaauccaaaaugcuggcaccaccaaaugcuggcagaaauguggagcaacagaaacccuucuucauuggugcuggcaaugcagaaugguacagcuacuuuggaggacagugugguggucucucauaauccuaaacauacucuuagaauaugaaccagcaacacugcuccccaguauuuacacagauggguugaaaacuucugcccacaaagaaaucugcacgugcacguuuauggcagcuuucuuuaucacugccaaaaacuuggaaggaaccaagauauccuucaauaaaugucuuacuacauucugguuguuguaacaaaauaccauacacugcguagcugaggcaggaggaucacuugagccugggagguugaagcugcugugggcugagacagagaucacaucauugcacuccagccugggugacagaaugagaaacccugucucaaaaaaaaaaaaaaaguacaguuuugguuuuugcugugacugggcuccuggagugagagcucuggaucccagcugcaagaugaggaaucuggagccgagagaagggaaacgaguuuuccaagucauacggcugguuaaguaaaagagccgggauuaugacuuagguuuccugccccccaagauuauuauuuuuugaaacagaguuucgcucugucucccaggcuggagugcaauggcaugaucugggcucacugcaaccuccacccccaggguucuagcgauucuccugccucagccucaugaguaacugggauuacaggcaugcgccaccaugcccggcuaauuuuucuguauuuuuaguagagacgggguuucgccauguuggccaggcuggucuugaacuccugaccucaggugauccacacgccucggccucccaaagugcuaggaucacacgcaugagccaccgcgccuggccuacccaagauuauuaaaauaaguuuucagaagcaacccccuacuggccaggcgcaguggcucaugccuguaaucccggcacuuugggaggcagaggcgggcgggucaccugagguccggaauuccagauacugugaaaccccgucuucacuaaaaauacaaaaauuagcugggugugguggugcacgccuguaaagagaauugcuugaaccugggaggcaaagguugcagugagcugagaucgugcuacugcacuccagccugggcgacagagccgucucaaaaaauaauaauaauaauagauuuuuuaagaaaagcaauccccuagugacuucuuagagcacaucaucagacaguugggguaaaauucugaaguggauuaagggaggggugcugguuugccuggauggcuacaugaacauagcccuggaaccaaccaaauauguaacuggacaacagaaaaauaaguacagggugcauuaaucagaggcaacaauguuuuguacuuaaguacacagaagacacgaugugaagacaccaagagaacaguacuuuucaugguuagacacauuucuuagguauuuuuucuacuuugggauucuuuugugauauaauuuguccuguuuacauaauuuuuuucccugacauguaagauaaauguaucuaauugugggcuuacuuguaaagaguuuucacauuuaaguuccagucauuucauuuuaucgcugugucuguguacagaaugcuaaagaauaagacauaaaaaauaaaaguacaguuauaaacaccucuuuuaaaaggcagagacuguucgcuugggcaaaaaaaagcaagauccaacuacaugcuaucuacaagaaacccacccuaaauacaacagguaaaaggaagcuaaauggaacguggguccuggcuuguacccuggcauguaaagaaaacauuggaggaaaagguggugaaaucccaguaaagucuggguuuuaguuacaguaaugcaucaugucaguaucuacaacaaaccacuuuuguuggugcuugugaugacagcaucagaagaaacugagcauaaaacaugguggacugcguaugaucuuugcaacuuuucuuuuuuuuuuuuuugagacaagaauuucacucuuguugcccaggcuggagugcaaugguguaaccucggcucacugcaaccuuggccuccuggguucaagcgauucuccugccucagccucccgaguagccgggauuacaggugcacgcgccaccacgcccagcuaauuucuguauuuuuaguagagacgggacuucaccauguuggccaggcugaucuugaacuccugaccccaggugauccacccaucucggccucccaaaguguugggauuacaggcgugagccagcgcgcccggucuuugcaacguuuugaauaaauccaaaauuauuccagaacaaaaagcuuaguaccaaaaagaaaacaaaaacaaaaacaaaacaaacccccccccccccacagaguaaaauaacggaaaaagaucuacuaugcuagcacuaacaaaauaauacguaguuaugaaaaugguauguauuuuucaagcuagacguucauaaugguagaacaugaggaggaaaacugccucuuaaaucccaccacuuacugugacgcagugaccggucccugcagcggacuggauaguuguaucagaguccuggacggaaacagauggcacucaaaagguggcgcgcaguucagagaaaugccuauguacggauuugguccaaugccucagccugaccucagggaccuucgggggucugcuccgcgcccacccuuacacaucugugaccccacacacuuccaccccagcgccacugccaacagcuacacccaucccccuccaaccgcgucagcuuccagccucgguccaucugaacucgccgugcccccuccccugcgcccuuccagauucauuugcuagggaagcccgcucuuccggguggagcuguuccucauccccuuucuuuaucauucucuccccagggcuuccacaucaccgugcuguggacaaucccggaacuccugucacgccaguuuacauuuaggaacaguaauggcucccacugacucagucaaaacaaggcugcggccgggcacgguggcucacgcccguaaucccagcacuuugggaagccgagacggagggaucacgaggucaggaguucgagaacagccuggccgacauggugaaaccccgucuuuacuaaaaacacaaaaauuagccgggcauaguggcgcgcgccuguaaucccagcuacuccggaggcugaggcagaauuguuugaacccaggaggcggagguugcagugagcagagaucacgccacuguacucuaucgugggcgacgacagagcaagagcaagacuccgucuccgagaacaacaacaacagcaacaagaaaacaacaauaaaaaaaauaaggcugcgugggaggcagaaagagcuaaugcggccacgcuuguccccucggggccaccguccccacccagacuuccggucugccuuaaaauguucaug

SEQ ID NO: 14985 - RNA, 25265 nt, Homo sapiens
caugaacauuuuaaggcagaccggaagucuggguggggacgguggccccgaggggacaagcguggccgcauuagcucuuucugccucccacgcagccuuauuuuuuuuauuguuguuuucuuguugcuguuguuguuguucucggagacggagucuugcucuugcucugucgucgcccacgauagaguacaguggcgugaucucugcucacugcaaccuccgccuccuggguucaaacaauucugccucagccuccggaguagcugggauuacaggcgcgcgccacuaugcccggcuaauuuuuguguuuuuaguaaagacgggguuucaccaugucggccaggcuguucucgaacuccugaccucgugaucccuccgucucggcuucccaaagugcugggauuacgggcgugagccaccgugcccggccgcagccuuguuuugacugagucagugggagccauuacuguuccuaaauguaaacuggcgugacaggaguuccgggauuguccacagcacggugauguggaagcccuggggagagaaugauaaagaaaggggaugaggaacagcuccacccggaagagcgggcuucccuagcaaaugaaucuggaagggcgcaggggagggggcacggcgaguucagauggaccgaggcuggaagcugacgcgguuggagggggauggguguagcuguuggcaguggcgcugggguggaaguguguggggucacagauguguaagggugggcgcggagcagacccccgaaggucccugaggucaggcugaggcauuggaccaaauccguacauaggcauuucucugaacugcgcgccaccuuuugagugccaucuguuuccguccaggacucugauacaacuauccaguccgcugcagggaccggucacugcgucacaguaaguggugggauuuaagaggcaguuuuccuccucauguucuaccauuaugaacgucuagcuugaaaaauacauaccauuuucauaacuacguauuauuuuguuagugcuagcauaguagaucuuuuuccguuauuuuacucuguggggggggggggguuuguuuuguuuuuguuuuuguuuucuuuuugguacuaagcuuuuuguucuggaauaauuuuggauuuauucaaaacguugcaaagaccgggcgcgcuggcucacgccuguaaucccaacacuuugggaggccgagauggguggaucaccuggggucaggaguucaagaucagccuggccaacauggugaagucccgucucuacuaaaaauacagaaauuagcugggcgugguggcgcgugcaccuguaaucccggcuacucgggaggcugaggcaggagaaucgcuugaacccaggaggccaagguugcagugagccgagguuacaccauugcacuccagccugggcaacaagagugaaauucuugucucaaaaaaaaaaaaaagaaaaguugcaaagaucauacgcaguccaccauguuuuaugcucaguuucuucugaugcugucaucacaagcaccaacaaaagugguuuguuguagauacugacaugaugcauuacuguaacuaaaacccagacuuuacugggauuucaccaccuuuuccuccaauguuuucuuuacaugccaggguacaagccaggacccacguuccauuuagcuuccuuuuaccuguuguauuuaggguggguuucuuguagauagcauguaguuggaucuugcuuuuuuuugcccaagcgaacagucucugccuuuuaaaagagguguuuauaacuguacuuuuauuuuuuaugucuuauucuuuagcauucuguacacagacacagcgauaaaaugaaaugacuggaacuuaaaugugaaaacucuuuacaaguaagcccacaauuagauacauuuaucuuacaugucagggaaaaaaauuauguaaacaggacaaauuauaucacaaaagaaucccaaaguagaaaaaauaccuaagaaaugugucuaaccaugaaaaguacuguucucuuggugucuucacaucgugucuucuguguacuuaaguacaaaacauuguugccucugauuaaugcacccuguacuuauuuuucuguuguccaguuacauauuugguugguuccagggcuauguucauguagccauccaggcaaaccagcaccccucccuuaauccacuucagaauuuuaccccaacugucugaugaugugcucuaagaagucacuaggggauugcuuuucuuaaaaaaucuauuauuauuauuauuuuuugagacggcucugucgcccaggcuggagugcaguagcacgaucucagcucacugcaaccuuugccucccagguucaagcaauucucuuuacaggcgugcaccaccacacccagcuaauuuuuguauuuuuagugaagacgggguuucacaguaucuggaauuccggaccucaggugacccgcccgccucugccucccaaagugccgggauuacaggcaugagccacugcgccuggccaguaggggguugcuucugaaaacuuauuuuaauaaucuuggguaggccaggcgcgguggcucaugcgugugauccuagcacuuugggaggccgaggcguguggaucaccugaggucaggaguucaagaccagccuggccaacauggcgaaaccccgucucuacuaaaaauacagaaaaauuagccgggcaugguggcgcaugccuguaaucccaguuacucaugaggcugaggcaggagaaucgcuagaacccuggggguggagguugcagugagcccagaucaugccauugcacuccagccugggagacagagcgaaacucuguuucaaaaaauaauaaucuuggggggcaggaaaccuaagucauaaucccggcucuuuuacuuaaccagccguaugacuuggaaaacucguuucccuucucucggcuccagauuccucaucuugcagcugggauccagagcucucacuccaggagcccagucacagcaaaaaccaaaacuguacuuuuuuuuuuuuuuugagacaggguuucucauucugucacccaggcuggagugcaaugaugugaucucugucucagcccacagcagcuucaaccucccaggcucaagugauccuccugccucagcuacgcaguguaugguauuuuguuacaacaaccagaauguaguaagacauuuauugaaggauaucuugguuccuuccaaguuuuuggcagugauaaagaaagcugccauaaacgugcacgugcagauuucuuugugggcagaaguuuucaacccaucuguguaaauacuggggagcaguguugcugguucauauucuaagaguauguuuaggauuaugagagaccaccacacuguccuccaaaguagcuguaccauucugcauugccagcaccaaugaagaaggguuucuguugcuccacauuucugccagcauuugguggugccagcauuuuggauuuggcauucuaauagguauguaguggugucuuguuuuuuuuuuguuuuuuugagacagagucucacucugucuuccaggcuagagugcaguggcauggucucggcucacugcaaccuccgccuccuggguucaagcgauucuccugccucagccucccgaguagcugggacuacaggcgugcgccaccacgcccagcuaauuuuuguauuuuuaguagaaacgggguuucaccauguuggccaggaugaucucgaucucuugaccucgugauccaccugccuuggccuuccaaagugcugggauuacaggugugagcccccgcgcccggccaguggugucuuguuuuaauggacgguucccuaaugacauacggugaacaucuuuuccuguguuuauuugccaucuguauuaggguucuccagagggccagaacuaacaggauauauguauauauugaaagggaguauauuagggagaacuggcugacaggaucaucaggcaaagucccacuauaguccaucugcaagcugaggaaggaagaagccagucacgucucaaaguccaaaagccucaaaaguagggaagccaacggcgcagccuucagucuguggcggaaggccuaagaguccccgacaaaccacugguggaaguucaagaguccaaaggccaaagaaccuggagucuaaucuccaaagacaggaaguauccagcacaggagaaagaugaaagccagaagacucagcaagccagccccucccaccuucugcgcugacuggauggugcccacccacacugagagugggucucccucuccccguccacucacucaagugucagccucccuggcaacacccucacagacacacccagaaacaauccuuuuuuuuuuuuuuuuuuuuuuuuuuuuuuuuuuuuuugagaccgagucucacucugucacccagguuggagugcaguggcaccaucucggcucacuccaaccuccgccucccggguucaagcaauucuucugccucagccucccgaguagcugggacuacaggcacgugccaucaugcuggcuaauuuuuguauuuuuaguacaggguuucaccauauuggccaggcuggucucaaauuccugcccgucuuggccucccaaagugcugggauuacagguguaagccaccaugccuggccccuuuuccuauuuuuuaaucagauuguuuuccuguuaacugaguuuuaagagcccuuuguaaaucuuggauagcaguccuucaugagauaggucucuugcaaauaguuucucccaggcugcagcuuuucucauuauauuaaaaauguuuuucaaagagcagaggguuuuguuuuguuuuguuuuuugagauggagucucgcucugucgcccagucuggagugcaguggcgugaucucggcucacugcaagcuccgccucccggguucacgccauucuccugccucagccuccugaguagcugggacuacaggcaccugccaccacaccuggcuaauuuuuuguauuuuuaguagagauggggcuucaccguguuagccaggauggucucgaucuccugaccucgugauccgcccgcuucggccucccaaagagcugggauuacaggcgugagccaccacgccuggccuagcagagggguuuuuuuauuauuauuuuaauaaagucaagcuuguaaguuucuuucauggaucaugccuuugauguuguaucaaaaaaauuaucacggcugggcgugguggcucacagcugucaucccaguauuuugggaagccgaggugaguggaucacuugaggccaggaguuugagaccagccuggccaacguggcaaaaccccaucucuacuaaaaauacaaaaauuagccgggcgugguggcgcacaccuguaauuccagcuacucaggaggcugaggcaugagaaucacuugaacccaggaggcagagguugcagugagccaagauucugccagugcacuccagccugggcgacagagugagacucuugucucaaaaaaaaaaauucacaaaacccagucauguagguuuucuccuauguuaucuucuaggaguuuuauagauuugcauuuaacauucagcucuaugauccauuuugaguuaauuuuugugaagagacuaaggucuguguauagauuugauuuauuuauuuuuggcauguugauguccaguuguucuagcaccauuuguggagagaaguuuggaaguuugagcauuuuuuaugauaccuuuuuuuuuuuuuuagacggagucucacugucaugcaggcuggagugcaguggcacagucucgacucacugcagccuacuccucccagguucaagcaguucuacugccucagccucccaaguagcugggauuacaggcgugcaccaccacacccagcuccuuuuugcauuuuuaguagagacaggguuucacuauauuggcuaggcuggucucaaacuccugaccucgggaucugccugccuuggccucccaaagugcugggauuacaggugugagccaccacgcccagccuuaugauacuguucuaucucugcucugugcccaccaccacacccagcuaauuuuuguauuuuuugguagagacgggguuucaccauguuggccaggcuggucucgaacuccugaccucaggugauacgccugccucagccucccaaaaugcugggauuacaggugugagccacugcgccuggccuugucuucacuuuuguuuuuuugguuuuuuuuuugagagggagucuugcucugucgcccagucuggagugcaguggcgcgaucucggcucacugcaagcuccgccucccggguucacgccauucuccugccucagccgcccgaguagcugggaauacaggcguccaccaccacgcccggcuaauuuuuuguauuuuuaguagagacgggguuucacuguguuagccaggauggucucgaucuccugaccuugugauccgcccgccucugccucccaaagugcugggauuacaggugugagccaccgugcccggcccacuuuugaaaaacaguuucagugaguaucgaauucuagguugacuacuuuuuucuuuugcuacuuuaagaauuuucuuacacugcuuucucacauuguuuccagugagaaaucuggugucauccuaauuuuuguuccucuguuuauaaaaucuuuuuguuuuucaucuggcuguugucaagauuuucucuuuguuacuggucuuaagaaauuugauuaugauguaucuugguuuaucuuuguguuucuucugcuugggguguguugaguuucuugugucuuugguuuuauaguuuguaucaaauuugggaaauuugggguuauuauuucuuuaaacacucucucuguuccuuucuuucucucuccuuaugggccuccaguuacacauauauuaaaaugucccacagcucaccaguguucuuuucauuaaaaaaaaauauauucauuccuucuggggcagggcaugguggcucaugccuguaaucccagcacuuugggaggccaaggcaguaggaucacuugagcccaggaguuugagaccacccugggcaacauggugagaccucaucucuacagaaaauuuuuaaagauuagccaaacaugguggugugcgccuguagucccagcuacucgagaggcuaaagugggaggaucgcuugagcuggagagguugaggcugcagugagucaugaucacgccagugcacuccagccuaggugacagagugagacccugucuaaaaaguaaaaaaaaaaaaaucauuuuuuuaaauguuucauuuggacaguuucuaauguugucuuccagauuuuuuuuuuuuuccugcaaugucuaaucugcuguucuagggcugggugcaguggcucgcaccuguaaucccagcacuuugggaggccgaggcuggcagaucauuugaggucaggaguuugagaccagccuggccaacauggugaaagcccgucucuacuaaaaauacaaaaauuagcuggaugugguggcaggugccuguagucucagcuacuugggaggcugaggcaugagaauugcuugaaccugggagguggaaguugcagugagccuagaucaugccacugcacuacagccugggcaacagagcaagacucucccccaaaaaacaaaaaucugcuguuccagccaguacauuauuuauuucagacauuguaauuucuaucuguugauauccaguuugaguuuuuuuauaucuuccguaucuguaaagaacuuuuggaacguauggaguacaguauaauaguuguucuaauguucuuaccuacuaauucuaacuccuggguccguuucaguugaaugauuuuuauccucaugaugugcccuauuuuccugcuuuuugcauauuuggugacuuuguuguuggauacuagacaauaucaguauuaccuugucgagcacucguuacuuuuguaugccuauaaauauucuugagcuuuguuugagaaugcagucaccuuacuuggaagcagcuugauccuuucagguuuugcuuuuaagauuccucaggcaggaccagaacaguguuuaacagguuagggcugcuuauuccccacggcugauguaagacccucuccguguucuacccaguguuccuucaguuaugagguucuucuggcaggaacagcgccuugucaaggccugugugaguccccagaacucaggcgcuauuugcuucagucccuccaggugguucuuucccuggcauucuagucugcaguaacagaggaccauggacugguggcucaaaaacaacaaacacuuauuucucacaguucuggaggcuggaaguccaagauaauuuauuuuuauuuuuauuuauuuauuuuuugagauggagucucgcucugcugcccaggcuggagugcaauggcgcgaucuuggcucacugcaaccuucgccucccagguucaagagauuccccugccucaggcucccgaguagcugggacuacaggcacccaccacuacacccggcgaauuuguauauauuuaguagagacaggguuucaccauguuggcaaagcuggucucgaacaccugaguucaggugaucuacccaccucggucucccaaagugcugggauuacaggcgugagccaucgcacccggcccauaacuucauucucaaaacaaagcucaagaacaaagcucagacucccugcuuugucuccucugcucacggaguccucccagcuccgccucagucuucccucccugucccguggucuagaaacuugcaacaggacccagcggcaauuuuagggcuugccuugauguuucccguuccucagggaucacuuucuugguagagucuugaccacuguuguuuucuuguauuuacucuauuuuuggggggucaaguccagucucugugacuccauccuggucgcaguggaagcccccauagguaacauucuaaaaauaacacuggauuuuccuuuuguaaaguuuggguaaaaugccuuuuuuuuuuuuuuuuuuuuuuuugagacggagucuugcucugucgcccaggcuggagugcaguggcgcgaucucggcucacugcaagcuccgcaucccggguucaggugauucuccugccucagccuccugaguagcugggauugcaggcgcccgccaccaugcccagcuaauuuuuguguuuaguagagaugggguuucaccguguuggccaggcuggucucaaacuccugaccucaggugaucgccugccccagccucccacagugcugggauuacaggcgugagccagggugcccggccaacuucuuguugagagaucacccccaggcucauuggcaugggagaucaagcagcugagucucaagguacuuugcagccgcccaacagccagcggaugccugugcuugggaaaugggcucaggggcacuagagggcaguguuugagaggaaagaagucagcauagcagcagggccgggccuggggcagacagcccacaugguuaggaaaaagugagugaacgcauguggcccccagaaccccucccugaaauugcaguugauuuuuauucccaccgucaggcccacauaucuaaagcuuccucugaacgcuccuugcaguacacaaaauagaaaugauugacaggcacagagcagcagcaggccccacgcuguacaccagcaucuggcacugugggucaccaagcaccaacucgauccccucggagccagguguguguugagauucaggauuuuucaguugcaaaggcaauaugaucucuacuccacagggcacacggcacccucagugcucagcacagcagugugcagcagccugguuaacuuuucugcagggaaguaugugaacguucacaccaagcgugucagucaugucuguaagucaucucccaccaacacaggucagguuuuccugcccaaugagcuuggggauggcuugacuuuggagcucuuuggaucuguggauuuuggaauuuuggauuucugauacccguuugaucaaagaggcaaccgaggucuaacgggucaagugacuuucccauauccgugaaggucaugaaaagcagggccaggaugguggccuggggugccuugaaugauaagcugggcccuucacugugcaggccccucuccuucaguccacucugccacugcugucugccacacccugcucugauagcuccucucugccaggcuuuucccucacauccucaacucagccaagagcugguuucuuccagagagcccugcugugcagucaguuauuggacuucucuuuuugugcauguuuguuuucaggguuuagcugaucaaagugguaucguuguaacaggcagcucuaaauagaagucuucagaagccugugugucuuuuucuguaaaucaauucccaaaagcaggauuguuggggcaugggguguaugcaguuuugaucugaucacauacaagcgcauuuuuuuuuuuuuucaagggaugguggcagcucacagccucaggagaaguguuuugagugccuguuccucuagguccucgcccgcccaggacaucaccacucuuguuaauuucauugugucuagguagugaaaaaguguaguuucucauucuuucaaauugcauuucccaauuauuagaguuugaaucuuuuugucuguuuacugauguuggaauuuuuauugaguauucaacucaauugauuacuuuuaaauggguugucuuuuucuuaguuuaugaaagcuuuuguagauuauaucuuuuaagaauaacauuucugcaucauaacuguuaacauacacacacacacacacacacacacacacacacacacacgcacgcacacacucacuguuccccagucugucaauuugccauuugacuuuacgguauguuuuucaaucuauaauuugccaacuaagcuaucuuuuccuuucugguuuuaugaucuccugcuuaaacuccucccuccccauuuucccuacccagauacaugacaugcagacaauauacaaauauucuccuaauuucucugguuuguuuuguuuuguuuuguuuuuuucugagauggagucucacuugaucucccaggcuggaguacaguggugcaaccuccaccucccggguucaagcaauucuccugccucagccucccgaguagcugggcuuacagaccugugccaccaugcccagcuaauuuuuuuuuucuuuaaguagagacgggguuucaccauguuggccacucugcucucaaacuccuggccucaagggauccacccaccuuggccucucaaaaugcugggauuacagucaugagccaccgcagccagccucucucuguuuuuugucuuuuuuuuuuuuuuuuuuuaagaggcagggucuuggccgggcgcgguggcucacgccuguauucccagcacuuugggaggccgagacgggcggaucacgaggucaggagaucgagaccaucuuggcuaacacggugaaaccccguuucuacuaaaaauacaaaaaauuagccggacguguuggcgggcgccuguagucccagcuacuugggaggcugaggcaggagaauggcaugaaccugggaggcggagcuugcagugagccgagaucgcgccacugcacuccaaccugggugacagagcgagacuccgucucaaaaacaaaaaaaaaaaaaaaaaaagaggcagggucuugcucuguugcccaggcuggagugcaguggcacgaucacagcucacugcuaccucgaaacgggcucaagcaaggagucucagccucccgaguagcuggaaccacaggcaugcaccaccaugcccacccuccuaauuucucuagaaauucuucugugccuuuacuugcauacaucuagaucuuccacccaucuuaucuauagaaguuuuuggccagauggagagccgauaugucacuacugcugcuaaaccaaccguccuuuccacacugacuugaaaucugucuucugucauguguguauauauauauauauacacacacacacacacacacacacaguuagaucuauuucuaggccaucuauucugugccagagaugccugugucuuccugugucaggacacgcgcauuacuuuuagaaucagaagaaagcguuuuguuuuuugauuuuuuuuuuuuuuuuuuuaaagaacaaugucuuuggaccccuugcugagccuggacaggcgcagaaauuccuggcagcugggaggccgggggagagaggacagcagggaggaugucccagcccuggccaggaggccgaaucaagggagaggagaaauaaggaggacccagcugcuuguaaaauagucuucccuuuuauuuuaaaucaacccuuuuccaaguuagugccacgaguugagaucagggggucagagcccacugggauguggcaggggcagcagggggacucaugucccccacccccagcuuagucccuccaaggaugggaccggcagccagggaugaagggugcgaggcgaggcugucugcccccuccccugccagcccuacucccuagucugcccccucagcuacucccaaggccaaggacagaaaugggagcacaguggccaagagcagggaggcgguccugugcaggcuguccauggccaagaguguuaguggucagagcccaggcaggcuggguuaguggggucuccuccggcagccagggaaggaacugcggagagagggagagacagggcagugaugcaggcuggagggccugcccggugcgauccacccagcaggaggcacgcagcccaugccuggagcagcucggagggcgggaggggggcagaggcccggcugcaggagcugggguggcccuuggaagcucaccgaagaggggagccaggcuccaguccagccgggaggaggggcucagauagacgacugccacugcacaaagcgcuuggauuccugcuaggagauucgggguagcgggggagaggagggaauggagugggaauuggcuuuguacugugggaccccagccccuccucccucagacccaggaguccgggccccagccccuccucccucagacccaggcggccaggcccucagcuccuccucccucagacccaggaguucaggaccccccgccccuccucccucagacccaggcauccaguaccugaggguugaaagggucgucaucgucugugucaucguagucgucacugggguuugaugcggggcauggcagagaggcgggauggggacccaucaggaggcugcaccccccacccccacugccaccgugguccccaggugcugccccuccucuucccuccccaggacccuacccucccccgcuccugaccugggugggaagagggcccaggcucggggcaggcugcagagggcaguggccagcgcuccugcagacagcagggagaagaguagcaggaagagcaggccuuccagggcgucuucgcacaggccccgcagggcugcaccauaguccugaggggagggcgucaucaggccaugcguccccacccccucccccaucggcacacacugugcacaucagucugaccguccucccggcugugguacugcacacgucaacugaccacucugugccucaguuuccccugucaaagggcaguucugagaauacaguggguacaguggggucuuuggugugauaggccuggcacucaggaauuaauugcccagccuccagacuuggcuucuccugagcugcacccgcccuugucauugcaggccccuaucucccuuucacauggguccuccccagucagcaccccacaucuagaaccaguccagcaucucccaccagcccugggcccucuccuccaucuucaucuacccaggaacgugagaacugcuacuuccguuucccuucucccucccggcagcggcaccuccugcaagagcauccuccccugcaccaagcgcccacaggccagccaccgccagcuccgccuugguccaggggcgagggcuucauaaccugggcccugcugacauuuugagccagaucauucucuguggugacggcgcugcccuguguguuguggggugcugagcagccccacucagcuccacccaccagaugccaggagcacccccuccugcagugugacaaccaacagcaacucggcacccggccaggugucccugggggcagaacuccucacccagccaggugucccugggggcagaaucacuggccuagagcacguggaacagcacgucgaaaaaccaaccaguggcucaagaugacaccgcgcacacaauacacacucaacaugccaacaaaugcuggcucugaugacugucgucccaagaaaucagcagaaacggccuucaccgagugcuaagcaccugcacagcguauguauucaguggggguugacagagccugcucugccccaggcgcugcccccaguaccaggaaacuucgguaaacaggaccgagaaggucaucucagaggcuggugugcaacgagguaggagggcgggggucagugcagggcagggguaggucggguaaccccacuagcagggauggguccuccaggaaggagccaggcagagggcugugcagaggaagcugggaggggcugaggccagaggcagacagauccaggacugaccacccaggcccuuguaggucagggcgaggaacagggauuuuaauccaugucugaggggaaucacugagcguuuuaagcagaggaagaacuugaucggauuguguuuuaaaaggaucaccuggcuggcuggcugcugcauggaggacagacggggguaggcgaggggggacagggaagaggccccuguggucaugguggcuaggaugcggggaccagggcacagcaauggugguaggaacagcggugggaguccauauagguuucagaggaagggccaacagaacuuguucugagaaugguugugggagcuaagagccugaguuucuggcaggagcaccugguugagguggggugucuguuacuaagccagugaggguugggguacggaccugucggggcaauggaggcucuguuuugagaguauugguacaugcacacuguccuucauccucacaacagcccugccaggcagacacugacccucucacgcugccgccucuugcaaugguggaaagaaguugcagcccagagaaggcaagcuacuugcccagagucacacugucuggaaggggcagaagcgauauuggagcugauucucuuaggcuccagugcccucccuccuucauccucaucccugaugucccuuauuguugauuuuuuuuuuuuuuaauagagaugggguuucaccauguuggccaggcuggucuugaacuccugagcucaaggaguucugaucugccccacugggccucccaaagugcuggguuuauaggcacgaggcacccaucccuagcccccuccuauuuuuuuuuuuuuuuuuugagacggauucucgcucugucaccccggcuggagugcaguggcucgaucucagcucacugcaaccuccacugcccagguucaagcaauucucgugccucagccuccugaguagcuaggaauacaggggugugccaccacgcccggcuaguuuuuuuguauuuuuaguagagaugggauuucgccaugcuggccaggcuggucucaaacuccugaccucuggugauccgcccaccuugguuucccaaagugcugggauuacaggcgugagccacagugcccggccccgccgcuuauucuugauuuuaaucugugaggacccuggcacacugacaggggagauggagacccagggucucauggugcagugguagggaaggguagagugaucuguccucuuccuucccuucccucccuccacaaaggagucugggggccuguauuccagcccaguuucugccuaggccacagaaaagcgccugaaccccaguuuauccuuaugcaaaagaucagggcagcccugggcugggugggggcccagccuuucucagcucaauagucagcaauucugagcauggcuucagugcuuacuccccacucccuuuuuggaaugccaguuccagaagggugggaggcagugggagccacagaaggggucugucugagccagaccagggaaagcucagauccaugcgauggcguagacaaaucccucuuggguaggguugccagaucaaauucaggacuuccaguuacauuugaguaucggaugcccaauacauaauuuucuaguauaaguaucuccccagcauugcaccgggcguacuuauagcagagugguuugcuguuugcugaaucuggcagcccuauucuaggguccauggggggauggauggggagggggccaugcuuccuucugcaggggagagaacgaggccucagcugcggcaggggcauugggcauugagaguagauggaugaagacauuccagaagcagaaaggacaaaacugggcaacugccuggcuguggggggcagagggcggggcccuccggaaggucccucucuccucagugugcacgggcuggcuggccgugugaccuugggaaggucccucaacucugcuccucaucuucuaaccuguuaggugggauaaucauaguuccuucuucauagcauuguuaugaggcaucgaugaguuaccaccugugaaaugcaacagggucagguacuuggugaagcuaugcacaugugaggucuuugaugggaagacuggccggggaaaggcauccucggguguguguuuuagaacagcucuuacugguuuuguuuguuuguuugugacagaguuucgcucuuguugcccaggcuggagugcaguggcacaaucuuggcucacugcaaccucugccucguggauucaagcgauucuccugccucagccucccgaguaguugggauuauaggcgcccaccaccaugcccggcuaacuuuuucuauuuuuaguagagacgggguaucaccauguuggccagacuggucuugaacuccugaccucaggugauccacccgccugggccucccaaagugcugggauuacaggugugagccuccgcgcccggccagcuccuacuguuuuauaaggggauuuuuuuuuucaauccucacagccauccagugaaaaaaaaacaaacaaaaaaaacucguccuuccucacgguacgggugggaagcagagucagccacgcucaccugccuauggccgugcagccugcggcagagcccaaacuggagccugcaggacaccagauaucuuuccuccugggcacccugcccaccccugccuguccaguguaugaacagcacaagccgcaggggagcuggacaggugcccacucuugcaaucccagguuuauaagugagggaacuaacugagguacagagaaguuaggugacuugcccuuggucaggagguaggacuggaacccaggcagucuugcuccagaacucacuaagcggcagccucuaggagggagggagaggcaggaggacggagagaggagagaagacaaggaaggaaaagguggcaggaagggacggggagggugggauggggacccagcggggagugcgggaguuggggggaaagggagggaggagggaaggaauauggauaaugcuugauagguagguagacgacagguuauaaauagguagagaauagauauaggacagauaaaucauauaaacagaggauacagagauauccucaggcgcaauggcagggguccaaggagaaggaggagguaguucugugggucgagacagaggccccccgugggagaagaaauugggaggggaggggcuucaccuugugcaggcugcggcaguguagcagugccaccaacugguggaaauuuccuucugucacauucagagucuccuccaaggacagcagaggcuucugcggggcgaggaggggucguuuucccacgaacucuucaggcccgcccaucgcccuggccccgcccugcguccccgcccacaacccaaggccccgccuagcucugcagccccgccuacgccccacagcuccaucccgccccguccgccuuccccgugggguccgcgugucuggggagcgcccacccaccgaccugcgcugaagggaacugaggcacagcuucucgcuccaggcccagcagcugggaguggauguuggccagagcucgcugggacagagucagccucugcagaaagagaaagggagggaggaggacccaggaguauacgcccccggcccucucuccucuccuccggacacagcacucgggccccuggccugcauccuccccggaacccaggaguccaggccccagccccagccccgcccccucccuucagaguccagauuucuggcucccucaacacccguuuccccugcccgcagcccuaaccuguuggaagggguuggagacggcccgguugcagaggagauaauagcucaggaugucugaagugggaggaggagaggggaggaggccaugagccugggcccccagggaucucccgggggaaggccgggcacugggggguuagcaggguuaggggccucagcccagcccuggagcccgauggccuuaccuucagagacccgccagccccgcgucccuucugcuccugccacagccagagcaggcgcuggugggcaacccuauacucccugggaaccccugacuaaauggugcuccccaguuuucuccagggggccaaacuccccauuccugacgcccaggagcacccucuccugacccuccucucucuuccuggcaccauuaucuuuauccugcccucuuuuccagcccaccaggagaggcgcugccagcuggagcagaagggaugagggucuggcggguggcggggcuccaggagggcuccgagcuggggaguggccaggagcccugcuucccuuccagagggcugggucucgccuggcaggcugcacccccaccccacccugggcaggaccgggcacagaggaggccugaggaagccagggccugcacugcccaacccggcggacccaccgggcccuuggaaaucaccugagcugagcccugucuccuccugggucagguucagaacauaagggucuggauuggagcagaagucacugaggcccugcgugaggcagcagaaaaggggcucaaacccaaaacugccccgauuccacacucccacagcacccagugccuggcuccccagcuccccuccccacccagggguccaggucccagccccucuucccucagacucaggaguccaggccccaggccccucgucccucagacucagggguucagacucuccagcccuuucucccucagacucaggaguccaggcccccagcuucuccucccucacacccaggaguccagacccccagccccuccucccucagaccuaggaauccagguuuccagccccuccuccauuacagcucaaacguccaggacaccaaucuguacccacucaggccccaggaaacaagcccuaaaccucagagcugugaucgugccccccaauuccuuucucuacuaagccaugccaucccgagauccagaaguugaagucuccaggcccccugagucccagagcccaauggcccggcccuggcacucaccacggccguggcugccuccaggcccauggagccccagcucaggacgagaaccaggagacucaugacugucauccuagagugggggagggaggaucagcccgggguucuuaaucuccuagccuagccucuuuccacaccccaaaucccaucacagccgccccccaccuccacccaccucuggagccuggaggaucagaauuagggaaacacaaguucagugguuggggguaggccaguggcugcugauguccagcaggacaucuggcuccugcccagaugagcagggugugggguaugagcagggcccugggcuggguggucgcagcuuggaucccagcuccaggacccugggacggugacugcucaccucugggcucacuucccccgaaggcucccccaaguccacccacagccugaucagccucuggcucugcccugucuccucugagaaugggagacagugccagggcugaaaucugaaagucucuggacuuuccggguggggaggggugcagggggcgugucagcauugguagggugaccaguaagcaagaagggcacccagggguccccaaacugaaggccuggcuuccagucccagaccugcccuguguuggcuagguuuaugggucugcaagccuuacgcggggucucucccacucucucaggggcaauggagguacagguucaacuccgccucaccccacuagggccagagagaaugcagggacuccuccaaugagaauggccugucugguucaaaucccagcucuagcacuucuagcuguguggcccugagcaagugguccaaccucucugaucuucagucucucccucuguuaaacagggagaagggccaggcaugguagcucaugccuguaaacccaguacuuuggaaggcugaggcaggcugaucacuugaggccaggaguucgagaccagccugggcaacauagcaagacuccaucucuacaaaaauauacaaaacuuaggccaggcacgguggcucaugccuguaauccaggcacuuugggaggcugaggcgggcggaucaccuuaggucaggaguuugagaccauccugaccaacauggagaaaccccaucucuacuaaaaauacaaaauuagacagguuugguggcauacgccuguaaucccagcuacuugggaggcugaagcaggagaauugccugaacccaggaggcagagguugcagugagccaagaucgugccgcugaacuccagccuggacaacaagagccaaauugcagcucaaaaaaaaaaaaaaaaaaaaaaaaaaaacuuagccgggagugguggcauaagcccauggucccagcuacucuggaggcugagguggggggaucacuugagccucaggggacagaggcuguagugagccgugaucaugccacugcacuccagucugggcaacaaagcaagaccuucucaaaauaaaaaacagaaauaaaaaacaggcagaaggaagcaccuuccucacagggggcaugaggugcuccagggagugcagagaagagugucgggcgcguagagcgagcugugaaaucagugugguccugcggcuuugccacgacacuuaaggacggcucagucucggacuuggccacccucugcgcucuuagucaggucccugaccggccacauggagccuuaugguagcuccuucaugggguggaggcaacugaaggacucagcgugcaugacccucaauagaucaucauccucaucuguuuuuuuuuguuguuguuguuguuguuuuugaaauggagucucacugugucgcccaggcuggagugcaguggugcaaucucagcucacugcaaccuccgccucccggguucaagcgauucuccugccucagccucccgaguagcugggacuauaggcgcccgccaccacgcccggcuaauuuuuguauuuuuaguagagaugggguuucaccguguuagccaggauggucucgaucuccugaccucgugauccgcccuccucggccucccaaagugcugggauuacaggcgugagccaccacgcccagccuuuuuuuuuuuuuuuuuuuuuuuugagauggagugucacucugucgcccaggcuggagugcaauggugugaucuuggcucaccacaaccuccaccuccugaguucaagcgauucuccugccucagccuccugaguagcugggacuacaggcgcaugccaccacacccagcuaauuuuuguauuuuuaauagagacaggguuucuccauguuggucaggcuggucucaaacuccugaccucaugauccacccaccucggccuccuaaagugcugggauuacaggcgugagccaccgcgccuggccucauccucaucuuuauugccaacacaaugauuauuucugccaugauuccagcauacuucauacuguuagggcugccuguuuucaggucuguccccgccucccuccugggcugcucugacucucuuuucuucguguguacccggccgugaaggaccacgguccuccguguaggagaguuguaagacugagguccugccugccaggagagugccaggcaagcacugggucccccuacugccugcacuuacacgaucaccagccacuugcucugcuucgccaggcccaggagggugaagaggcagaccagcagcuccaggagcagcaggaggacguaggccagccaccugggaggggagaggguagggcugaaaccacaaaccugccuccaggcaccccggcggaacagcaacccuccaccagcauucacccugccccccagcucagccucacauucaccacccuccaagcucagccuccugcuguuuacugugucugggccacagcccagguccucugugaaauaguguuaucaugagacaggacacuggagcgguuuagaauacagguccugagcaccugggacuauccccuggccgggccacacacaugugcccugugaccagggacacgugauguguucucuccgagcuccccauccccaaccccacccugcagaguggagauacucguucucaagacugcaccaaagaucccaucgcaucccuggagggcaugacgucuggaggcagaggcugccuggucucaaccccagccccuccgcuuaacuggccggguaacucuugucucgguaaccuuagccucucguuccucaguuucccuacauguaacguggggagcacaacaacacuggcuugagaauauugccucgagugggcugcaugacuagaagugcuuaggagagugccaagcacguggacacacuuagagguuagccugagcgugaacgagggaacugagauguuaguuaauaguuaauacuuggccgggcgagguggcucacgccuguaauccgcgcauuuugggaggcugaggcaggcggaucacuugaggucaggaguuugagaccagccuggccaacauggugaaaccccgucuuuacuaaaaauacaacaauuagccgggcgugguggugcacgccuguaaucccagcuacuugggaggcugaggcaggagaaucauuugaacccaugagguggagguugcagugagccaagauugcaccacugcacuccagccugggcgacaagagugagacuuagucucaaaaaugaaaaaaaaaaaaguuaauccuuaaauaucagugaagggcccaccaccaugauucaggaggugcaagcaugcaagccacagugagagacaggacuagcuggauguccgaggccgacuaauaaucccuaagccuagcugggaaggugaccgcauccaccuuuaaacacggggcaugcaauuuagcucacacccaaccaaucagguaguaaagagagcucacuaaagugcuaguuaggcaaaaauaggaaguaaagaaauagccaaucaucuaucaccugagagcacaggggaagggacaaugaucuggauagaaacccaggcauuccagccagcaacggcuacccacuuuggguccccucccguuguaugggaacucuguuuucacucuauuaaaacuugaaacugcacacucuucugguccgugucuguuacggcuugagcugagcuuucgcucgccguccaccacugcuguuugccgccgucgcagacccgccgcugacuuccacccuccggauccggcaggguguccacugugcucgugauccagggagacacccauugccgcucccaaucgggcuagaggcucgccauuguuccugcacagcuaacugccuggguucauccugaucgagcugaacacuggucgcuggguuccacgguucucuuccgugacccacggcuucuaauagagcuaaaacacucaccgcagggcccaggauuccauuccuuggaauccgugaggccaagaaccccaggucagagaacacgaggcuugcugcccucuuggaaguggccaccacgaucuugggagcuccgggagcaaggacccgccguaacaacagcacagugcccggcacguaguaagugcucauguaauccuccugccauucucugcaggccccacaagcuugggcuucacuccuuacccuggucucuggcugcuuccgcccagccucgcaagugcuccccuccagcaagacucccuuggaggccccugauuugucugucgagggacucccaaguguggggugcuuucgcaguggugcacccggaagauauuuucuagcgauggugggucugccucacccuggcaucacccuuauggcucccaccacuucccugcccucgcccaggagaaggagcugaggcccggcuugugcagccccugggccugaccacaaugcagaaccuggacuucuucaaacccaggcuugucugucucuugcaccugcugcccugcggguguguccugaccuccagcuuuuucagccccagucggccuuccccgcuggagcgcagcaucccggaaggccucccaaaucucagcgcaugccccgcgggcagggccuccagcugacgucggauaaaugaaugaaugaaugaaugauuacuaauggucaaagcaaugaggacaccgucaugguggccgcugggaaggguggcugccuggacacugcacagcucacugccuccucuccuccaaaugccaccuucucagucccccugaugaacugccagacucugucccaccucaucucccucuauaauuuucuuuuuuuuuuuuuaagacggauucucgcuccgucacccaggcuggagugcaguggcacgaucucugcucacugcaagcuccacuucccggguucaagcgauucuccugucucagccucccaaguagcugggacuacaggcgcccaccaccacgcccggcuaauuuuuguauuuuuaguagcgacgggauuucaccguguuagccaggauggucucgaucucuugaccucgugauccgccugccucggcuucccaaagugcugggauuacaggcgugaaccaccgugccugguccccucuguaauuuucuccaaaguucucauggcccaacaccuuacaauguuuuucucugcguuug

SEQ ID NO: 14986 - RNA, 16815 nt, Homo sapiens
agcucagcagcugugcccaugggaccuccuggagucucaucuuaccccaucugugaaacgggaggccgggcgcgguggcucacgccuguuaucccagcauuuugggagacugaggcggguugaucaccugaggucaggaguucaagaccagccuggccaacauugugaaaccccgucucuacaaaaauacaaaaauuggcuggguaugguggcgggugccuguaaucccagcuacucgggagacugaggaggaagaaucgccugaacccgggaggcggagguugcggugagccgggauggcgccauugaacuccagcaugggcgagacuccgucucaaaaacaaaaaucaaaaaacaaaaaacgggaaccgucccccaucguccuuugagcagucgcguggcugcgagccccgggcuggggccgcgcugacccucccgugccccucgcagaugcccgugcugaagcagcugggccccgcgcagcccaagaagcggccugaucgcggcgcccuguccaucuccgcgccgcucggcgacuuccggcacacgcugcacguggggcgcggcggcgacgccuucggggacaccucguuccugagccgccacggcggcgggccgccccccgagccccgggcgccccccgcgggggccccgcgcuccccgccgccgcccgccgucccgcaguccgcagcgcccucgccugccgacccgcugcuguccuuccaccuggaucuggggcccuccaugcuggacgcggugcugggcgucauggacgcggcgcgcccggaggcggcugccgccaagcccgacgcggaaccccgccccgggacgcagcccccccaggcccgcugccgccccaacgcggaccucgagcugaacgacgucaucggccucuagguucccucauuccccgcgcccuucccgcccggcaccccacuucuguauacauaaacggccaaggugugugcccgggcucugacuuuucacuuugcacguggaaagggaugaaugauaggguccuggcgccucugagagccggaugugucacccggaggccugguccggguccgaugauugcccuggggugggggugcggcuccuuuaagagagcccgagggcguggccaggcggugccccuugcagaggcggcggcucccgcagucccauucgucaaauacugugcgccaccgccggccggacgugguccuggggccgggccagacucagccaccgcggggccagccgaggcggggcugcagagugcugcagccccaggaguccuucuggcccugaacgccucagguggacuccgacccggcggagccgccguuuacucugggagcggcugcagagggaagugucugagaacacuuuuagagcaguaggggccuggucuccgugggggaaggguccgcaggcaucuugguucuuuaaggcccccgagggauggggccgaacaugcaaaugauuuggacugaggggccagguucucguaaguuucccagaggggcggggccgcaaauguaaaucacuuggacugagggcggguccagguucuuuaaagacguccccucaugggcggggcacacagguaucaccgggaaaggggcggggcaccacauguaaaucaccgggaaagggaugggacacagguaaaucacccggaaaggggcggggcaccacauguaaaucaccuuaaaacggacagggcacacauguaaaucacuuggggagaggcacacacguaaaucacccggaaagaggcagcacaaaaguaucacugggaaagggccagggcacgcauguaaaucacccggaacggggcgggacacauguaaaucacuugagaaggggagaggcacucguaaaucacccggaaaggggcggggcauuacauguaaauuacccugaaaggagcggggaacauauguaaaucacuugggaaggggagaggcacacauaaaaaaaaaaaaaaaaucaccuaaaagggguggggcacucguaaaucaccaggaaaggggcggggcaccacauguaaaucaccgggaacggggcggggcacuacauguaaaucaccuaaaggucgaggcacacguaaucaucccgaaaggggcggggcauuacauguaaaucacccagaaagaggcagcacacaucaaucaccgggaaaggggcggggccaggcucccaagagcuccgggagaccgagacugccgcagccuuuacgcagcuugcuuuccuggcgcugggggagggcgcagccgggaagucccagagcagcggugucaggcucuccaccaaggagggacugggccagaguccucgcgagggcacgcggcgugguccccagagcuaggccggagcgcgggccgcugacgccacugucgggugaggcucggugcauccauggggagccgcccuccgugcggggcgaccucgucugcgcggcgggcgugccaguuccccgcacccauggcagcggccagagagccggaguugccgcaggaagcccccgccacggaacccgcgcccccgccggccugccgcuucuuccuggaaggccgcugccgcuucggcgcccgcugccgccagccccacccuggggcgccggcgccgccuggccgcgaggcgcagccggaggccggggccaagaagccgccgcugcgcacagccgcggacgucauccagcgcauccgcugggacccgcgccucgaccccgccgacuucucggugggcuacgucgaccgcuuucugggugugcgcgaggagcccuucagcgccuuuugcugggaccagccgcuggcggcgcucgggccgggcgugcuggcagugccccagcaccgcgugcgcuucuuccgcuuccauggccgccuugugugggaccgcgccucgcgcaccgaccucgucuuuggcucuggcucggcggcgggacgcgggcccaccauccuggacgcaccgaacaccgagggcgcccacggggcagagggugccgaguggacacuggcggggacaggucaggaggcccaggcugcccccaagcgagggagcacaaggccgcucugcacagggcaccaggaaccaggcguggaggaacccggagagcuggaggcggcccaggagagggcgcugggcacagcugcugauuugggaacacuggccccaagaggacgccucgccggagugacugaggaggcacugaagccaacagcagccaccaggaccacauugcuggggggcaaggaagcacaggcccugggagucccggggggcuccgcugagacgacagaagccgagugggguccugcggccuggcccgaggacaaaagggcccgccuuaguguugcagccccuugccaaccgcgccccacacauuuuguggcccucauggugaccgagccugggcuacaagcagaagugaccaaggcccaggaauaccugguccacguggccccacacugcgccaacuuccuagugcccucucagaaccuacaccugacccuggcccugcugcgacuggcaggcgcuggggaggaggccgcugccauuggagcucugagacgggcccucuuggccccggggcuaaaugcacccccucggcugagcuuuagaaagcugguccuccugggcccgcaugugcugugugccccacccucucccacacuggaaagcauggcacaagugcugagccagaggcuggaagccgaggggcugaguacacuacagucuccagggcagcugcacccccaccucaccguggccaaggugccccaugguucccagguccaccuccccaagcuggaguucacccucagccaggaaguggggugccagccccugcagacacucuggcugugccguauagggaggacaggggggccuuuccagccccuggcugagauccgccuggagugacacccccagaccucuggaggagacaauggaugcaaacagcccacacaggaaagacaaagcaggagcgugcacgcucucucuuucucucuuuaauuuugguuucucucaagcuuccaaauggugcucagugcuccaaggaaaggaaggaaggaaggaaaaggaggggagaggaggggaaggggaggcagaggaggaacaucuggaaaaaaagcagccugacaguccagcuguuugcaaacucauagcacauccuccaguuacauggcagaagagggagggagggagggccaaaaagaaaagggagaggaggaagaaaaauaacuuaaauaaacacacacacaaagaaaagagaaggcaacaugacgugagcuggugauccaugaaggcagggagggaggggaaccguuuuaccugugcugaaccaagggaagaaugcggagagggagggagggaaaggggaaaaaaaaaucagaagaaacacugggggcagagggaggaggggacacggagacaacuuuauacaacuugagacgaggcggcccggccggcguguccucagugcgguguggcggcggaggaucuggugcugguggugcuggcacuucaggguggggggccgaggacgggcacagucucuaagcagcucccccaccccaaacacggaggccccaaggggcugggaacaagagucuguggcgaagcaggugaggcagcgggcggugggcgggcuugcugggugcccccgccgcaggcgggcacgggcuggacggccugucuucuuuccacuggccccccggcaugggaugggccagggcgccgggucggguaccggagugcaagcucgaaagagagagagagaaaacacugagacagcauuaguggagugaaaggcggacacagaugagccugcagaccaugcccccaacccuccgcugcccauccccuccuccccaaucccaucccucugaggcaaaaaauaaaaacguagaaaaaucucuguacagacuccccggugggaaaacgggggcagggaugguggcucuuccuggagcgcacuccccacaaauaaauuuacaacccaaguccacggcucaaaaacagaauccgcaaaggcagcgcugggggcugcagccccugcccccgccccuccucgcugggugcucagaaggcugacagcugcgccaggcugaggcggcagucgaugcuggaguuguccgggcccguguaggccaggcccaggggcucuaggaaggcccggcaggcggccucgcccucgaaggccagcucggccugcagguaggagacuggcagcgcagggcggaagcuauggagacaagaggagaaggugaugaggcgggcgggcgggagggcaggggagggccccacgagcggggaggcccccccauucgggugcccacaggauuuccucagcacagugccugcuggcuccccacccgccucccagccuccccaccucaggggcucggggggggcccggggggggguuagugaccccaguccccugugccccccucacccucacuuaccugugcgggggccagggaggagcggggacgggcagggaagggcccagcgggcuccuccgcuggcugaggggcagggaccagauggagggagcagcacguggcaggggauggggauggcggggcugccagggccaccguggggacccagcccucgcugccuccccugcccugcguuacagugucugggaagccaggcgcaggggugccagcuagcacucaccacuacacacugaaagcagucacuuccggcugcugcuaaaacacacuacugacugagcaucuagcacgagccagguccucagagcucccugaacccucuuccacagggugcagcccuacccuuuccacacacacaggaacccaggcaccgagugaggggcacuaaguccuagaacccgcuucugcuccaaagccagagcuuuccuggaagcccugggaucagagcccacuccgucucccagucucagcuggcagggcagggucagccuccuugaggggaaggugcugacacaaugaggucaaugacagacuggcgccccacccacgaggggcacucauggcuauguucccaaccaaggccaauuagguaucaauuaacaaggacacucgcccaaccacacaccccuguguagcacagaagcuugagagccaccauucauggggcccaucauggcagcagacuaagcagccuccugccuccccuuccuucuaacuucccaagcuggucauggagcucugugcacggcaccccacauccucgucugcuccugugacuccuacccuggcucagccucucccugaaguuggcuugacccacacuagauuccagaaugagucuccaaaccuccaggcugacagucccucccuagcuccaaacuaugcugugaccaugaccucacacggagggccaccuggccaggcucucaaggccuccaugcugugaccaugaccucacguggagggccaccuggccaggcucucaaggcccccaugcugugaccacaaccucacauggagggccaccuggccaggcucucaaggccuccaugcugugaccaugaccucacguggagggccaccuggccaggcacucaaggcccccaugcugugaccaugaccucacguggagggccaccuggccaggcucucaaggccuccaugcugugacuaugaccucacguggacagccaccuggccaggcucucaaggccucuucagucuaccggucaaccucuucgaccagaauuucuccaccuuggcaagacugagcucugaggcccaauggcaguggcagggcagcaucccuggccuccacucacuagaugccaagagcauccccuugcugugacaagccaaaaccucucuugacauugcccagcgucgccugggcaccucaaucaccagacagaaccaugcgucuaaacaugagucaagcaacucauccccacccacagcaagccaggcgcaaugucuagugaacgaaggacacugcaggggcauggccugaccaggggccucuggcaccgcgcccaguguggccucaacacaggugucucccuaagcguuucuggugcucucaaaggagcugagugggacugggccuuguccugguagaccagaggcugucuagauggucucuauggugggagcacagcgacaagcugagaaagcagagaccucaggguucugaggaagcccagggcaaggagugaacuaggggguccaggcaggagagaacaggaggaagagacacacagaugggguggagaagaggccccagaggcagugagcugggaacaguggggagagggagaggagugacccggaacacagaggugaccaacaaggagagcaagaggaacuggagaggggagggcugaauggagaaagaugauggggaagcaaggaccaggacaaggguugggggcugggggaggccugcggccaggagcuggucugaggggcggugcgaggcggaaggaugggaagagcaaaggcagaagggagcuuggcaccacauacguuuugaucauggccuugagggcgaccuugcgcucccgaucugcaaacuuguccacgagguagccagacaugcagggugcauggcaguagagccggaaaaagcggugguaguugcccagggcccaggcuguccuuaaugccaaggcgugggccacgcaaggaucugccuucaguucucgugugagguaugccagcuccguggugaugucuagcaccaagacaaagagggugaagucagcagggcucaacccuggguaccauggccucuguccuggggacugggccucaccucccgaguucuuggugaagauguaguagaggauucgguaggcaguaaacucgcccacauugccaggcaaguucucggcguacagcgacuugagcugcgucuggcacugguuaaacucuucauggucacccuggaaggcagaggcaccgagggaggagagcagagugagggugcugagggcagaacggcagcaggaaaggggcuggggaggcccgcagaggccagcucaccuucuccaaggcgauccgggcaugggucucguacaccuccaccgugaacucggugcggaugcccugcaccuggggcagcggggcgagaacaagagucacaaggagcgggaggcaggacuggcugaggccaggccccucccagcgcgagucucaccgucagauccugccggaucgacuucaucugcucgcaggcaaacgcguaguccugcuucucuuuccaguggcacuugaccaugcacagcgacuuuuucaaaaccugaaaaagggaacugaauucacacucggaguacaacucagguagcguggccaacggcuuccacuuauuuggugggagaguugcaacauuaaaaaaagaaaaaaaaggccaggcgcaguggcucacgccuguaaucccagcacuuugggaggccgagguguguggaucaucugaggucaggaguuugagaccaaccuggccaacauggugaaaccccgucucuacuaaaaauacaaaaaucagccaggcguaguggcagacgccuguaaucccagccacuagggaggcugaggcaggagaaucgcuugaagccggggagcggaggcugcggugagccaagaucacgccauugcacuccagcuugggcgacagagccagacucucucccaaaaaaagagaaaacaaacccacaagacauggguuaagaguggccaccuccacacccauuucccuauaagcacauggcuguucacagguucugcagcagaacagugacuacgccaaacacuggaagcacagccccccacgccccacagcccacgggccugggagaaggcuuuaugcuccgugucaccuaagccaggaaccacggcccagaggucaagcgauucgccggccaagcugcacacccgccacgcggggcuccagggcagcagagcgccuuugcgcuccucucagaacgccgaccagccgaggcgucucuggccgagcuuccccugccauaccagagcccccguguggccucugccacccucccuggguuggcuccccaaguccugagccagcacggccucacagagcagaacugcccugcugggcacuuacugccacagggcgcacgguggacgggucgggggcacaggugaggcgcagguagugcuuggugaugucagggcaggugcccacgaucugcagcuccugccagucagggucagccccacugcucuccaggcugcucaucugcagcaccaggggcucgaggcgcaggcggcgggaguguccgugcuggaagcgggcugcccgcuucugcuucuucagcucucgcuccggguccucacacuccagcgccgccaucuucuuucgacugcgcuuggugggcgccagaucgugccuaggaagggaugaggggcagugagcgcgacaggcgucuccagccccccuucagccucgccccuuuggcagcuggcuguccaccuguccggcccuccuccuccuucucccauggguccccaguacccuccuccacccuggcccgugugucgagcccucacacagucucaccucuucccacgcugcgcccugccucggccccgauccauaugggccccucgaccgccccggcccuuagggggcggguuccugcggcccacagggugacacucauucccugaguaggagcugucggagucugagugggagucacugcaggaagaagcaggagggucaggccugaaacgccucccccucccucacacacagccccagccgggagccucaguaccuucugcggaaguggcgcgucggggaccuggaggaggagcgggagcgggagucugugcuggaagaagagcuguuguccuucaugaagacguugcgguugccaaacuuggugaagcuguugccccgggcucgaccggcacccccagccccgggcgucccucgcugggacggggcacccccgccccuugucgccgagccugccccucuaggagggugaaggcugcuagcggccucccaccgcuucuucuuagggcucucagccacaggcucccgggucagccugagaauacagcagggcagggcgucaccaaccccgccagacacuggcaggacagccgccaccaccucccucaagguaccgacccgccuccgaaaggaaaggcacuuaccccaggcggcucagcuacuacagugcagaaaugagacgcgaacccagguuuuccgucuccagagggugcgcuuaaccacugagcaaugcacgccucuccagcacccaugguccccaccccaccccaccggccucccuccaaccaggacuucauccccccaggauccaacuuuccgguucauuucucuuuggagcuccugguaccugggacccgcaacucuccuaccuccauacccagcccaugccucucacagcaccacccucccaccuaugucccccacccagacuaaccccggcaagggcucccggcuccagucaaugguauaggccgagccguccugcagccgcgccugcagcaccuccuugagcagcuuuuccgugcgguccuuguccuccuccgacucacaggcggugaagcagcgcuccacauacucuuucauguccuggggccagucaucgggcuucccagacagguucccccgggcagaggacccgcugcgggaggacagaugaggggcucagcuggagacgaucccaaacucaaaagaccauccccaccgccacucugagcugacacagcgggacgcaguccccaaguuuuccuucugucuccuucagugcucacagcaacccccaagagaggguccuucugcccuuuucagaggcgcacacugaggcucagggugggcagcuggccagugggacuggaccauagacgcugagugcagaguguggggcugcgacggggcaagggggcagacgucaccugugguucugaacuuucucaggguugggcugggggccaaaaccacugugcuggcccucugcguuggagccaaagcucugggugguaacagcaaagggucgcuucuggauguugaacuugagaccuccagucccaggggcggcugugagggcagcgaaagcuaugguuaggcccuuccccggcacauccagggguccccaggggacgggaggaaguggaaaugcagggaggagcgcucagguucuagaggagggcuccagcacacaugugccugguccagagcagccccacccccagccuggcgaucacaacacccagaaacaaggagcagcacacaccacgggccucacacccaggagcucuugugagggcccaaccgcuccgaccuccacguagcucugccaacuuacgcuucaugcgguuccacagcuguuggcccuucuugggcuuggcagguucgguguagguguguggcccauaggccuggcccguggcgggccccgccuggcugugcuguguggcuggagcugucccaggcugagggccacuguucagcgugugagccccaugugggggauuugagggcugagggggcugagccgacggcagcugcugagggggagccugguaggacaugcucucauccaugccggggacugggggcugcagaaggaagcaggcgcugagcacgggaggcagauucuggggcuggcgaguggcacucagcccucgcugugaggacgcgguggucacagcacucagcacucaacccucccgugaccuucccaaaugugaguucauucgaguccucaguaacucugugagguuaacauuuguuaacagcccuuuucacagcugacaaggcuccagcucagagacuaagcgacuucccagggcccuaagcuaugaagcggcagcuggcagcguuucaaugcuggaguaacagccaccgacaacacacccacuccagcgcuaccaucugagcacaagacacccaugagcacacacacucauggagcccaaggaugaggcuaccauccuucccgcuuucgagagcugaccgagaugcguaauuacaccaggggugggacagcugggauucaaacccaggucuaccugccuccugugcacuagcccggccauuccuccaagcugcacauucaaugcaaaacccagccggugugugcacgccugugggugaccaugcuagggaaaaagaugagaugucuuucaacaucucagcccuggccuuggcucagccuuaaacccaccccagguucaaacacuaugcucuguccuccucauuuucagaucaggaguugcuuggaaggaaaaaagcagcuuaaggaguacaagccauuccucauugacagcucauucaaaaaucuacacuuccucugcuugagcaggguaugggagcugggcuaggauguuaccugguucagagucccuugguguuggggugcggauggcugcugggguguggcugagccauaggagccggccaucccauacugggaaggggagccauagcucugguacaugcucugcaaaggcgcagggagggaggguuuagugggaggccuacccuuuccgcuuccccagccugcucaggaacuacaccagccaugacccucuaccaaucccucaccccuuucucucuccacuauauuaaugcaccacauccucucauauauuaggaaaagaaaaaccucuaucaaucccacaucucacuuagcuaguucucggaagaauauaaucaacgauacugagugccaacucuucuaagcacuacgacagaacaaaaggaaaacccaugcuguaaugaagcuugugcuggaauuacauguccggcuggagacaucaacauguaauacauccagcaauaaggaucaugaaacaauaagauggcaaagaaagggagagggacaggcugcgaggcaggaaugcuacuuucaaucagugugucagguagaggcucucugaaggcggcaucugagcagagaccuccaagaggcggcaacacagggagcacugcagccagggcaaagcgagagcgggccuggcgggugcgggcaucaaggaggucucugcuucgauggccauggcagaaugagcaugaggagagaagggaccagaaccggguauguaggaccuuguggcucauggcggggaccuaggaauuuaccuccugggcaaguuagaggguuucugagcaguuaucacugcgaucuccaguccauccaccacccggccccaucccggcagacuccacuucaccucgccccgacccagcagacuccaccucgcccugccccgccccacuggcugggcacucaccaugggauaguaguagcuguagggguaggcauaguuguacugcugguaccacugguaguacugcugcugcugcaaagcugaggcuucugccugggacacguacuguggaagcagagaggcacaugugccgucagcagcccaaauccacaggcacacggcccccaaagggcaagccuguuuacugguggccaauugccaagggaugaaacuggguccauguaucugcaaagugagccacugucucuaccaugagacucacgcacguuagagaccaggggcaugggcauggccucccucuucagaaccacaucacgcccuaauuuccucaaggaaacagaacuuuuucccguucagauuuagauacccuggaacgucuuuuuauguuuccccucagagcaccccgucugaaugauacaacaggacgccagacugugucccucccacaaccucuggcucaggguaccccagccccaugaggccuucucaccugugcacuggccacaggcccauugcugcuggacuuggcagagccgccggcagcuccugacuugcugaugcuggccagggccugacgggccuucucccacuccggguucucgugcaucggcgucuccaugccauucucucggccugccccagccaccaugcuguacugagaagaccugcagagagagaggacaucaagucacaccuguucuccccacuguacacaggugggcaaguugggaggcaaauuccagccccuggaucccauaucuaacuguuacuaccagucuaagccuaaguuuucuaaucuguacuaugcugauaaaggguuucugcuucagagucugcugggagggauaaaugagaucaccuacuuaagguacuuaucccagagccuggcacacagcaguuguuaaaaccaaacaaacaaaacaauuaacagaacccacagaacugaacacaggcccuggcaccuccuagggcuaugucuuucaugaaucaaugaauucugucugacaucaccccagucggcagguuaucacacuauuuugagaaaaaauaaggaaucagcagaaaaacaaauaaaugacuguguauugaguguugggaagcugccuccuaauuacacuugcuugaaugaaucaucacaauucugcaaagcaagcgcuguacugugaaaaacgaaagcucagagaggugaaagcuugccccucuccacaccacaaccaaaugcuucccucuguguuugccuuaccaccacccccacccacagggauuguggcaucaccuccccuaaggccacgggaggucccaccccagaggacagcacugggucuugcuuccucuuucccucccgacuggccuccgucccucucgccucacuaaccaaucugugcuacguugaucacccacguuggccgccaucuggaccuugggguauaagggguggaccucgggagccagacugcuuuuucacugccuaugagaaaaagaaugaguuagggagacuuaagggggagcuaaaaacacgucacaaaguggggaagaaaaguagauggacucaagagaagcugggcagaaaaggggaggcugacugaaaagccacuggggucaaggaucugaagaguucuggguguggacuagaaaggcuggagugaggggaagccccuggccccuuuguagagcuccagguggaaaacgaaggauuuggaaacagggaagccagagcagacuucccaaaggaaaggagaagggucugaaacccaugugagcaaagagaggcugugaugaaagguccagaggguaggggugccuccaucaaggggaaaaggucuacaaaaaauucuaggggccaggcgcgguggcucacgccuguaaucccagcacuuugagaggccaaggcgggcaggucaccugaggucgggaguucgagaccagccuaaccaacauggaguaaccacgucucuacuaaaaauaccaaauuagcugggcaugguggcauaugccuguaaucccagcuacuagggaggccgaggcaggagaaucgcuugaacacgggagguggagggcgguaagcugagacugcgccauugcucuccagccugggcaacaagagcgaaacucugucucaaaaaaaaaaaaaaaaaaaagcuaaggaguacggguugugaaaggaaccugaaccaagaggauggaugcuauaaugagaagagucugagggaacccuuaaggcugagaggguggaaagguuuccgagaacucugugaaaagggaggccuuucagggagcaucgagggggcuggaagaauauuggagaagagaagaaaauuuugagaggaaaaggggauuuuccggaaguuaacccuggaagcaaguggucguugagcgcuccugagaaugccaacgugaaccccaacgugaagaaauggguucuuagcacugacagacugauuucaaaaaggucuccgaagggcaguaaagagaccuacgugggaguccucagugggacuaccccugccugcuuccacgggagguucccggaagcagggguagggcugggagagaaaagggaucaccuugguugggugucuggacauaaagcuuugggaaugccaaagaagacccaaaacauguucaacgaauuaagagugggguacagagagaauuggaagaaaaguggagugucuccggagcaaggauucaggagccuaaacucccgagagagaguaacugauaaguaggauaauuaaucccgcaggagaaccggaauucucacgaguugacgggauaggaacgggagucuggagcuggggaaaagcccuagaaacgcaaaggcuuaacuuaaacaggacacagggcguggguggagacgagggaucguggcggggacacaggaagaggagccccagggcagaagggagauuagagguaaggucaggaguugggggcuggacagaggacucccagacgggucucaagaacagagacaggcaucagacgcgaggccugaggucccgggagcaccuggccgucccgcaggcugggcgaaggcaaaggaggacgccggguggaggaggccgcucggauccccacgacuagccacggagccacugcccaggccgcgccugcgcaccacgccccagaaagacgcgcaggagccgcccgucgcccggggcaacacccggucaacggcgagugaggggcgccccggggccccgagaacuccaagggagaggaacggaaaguagaagacgacggcgcacgcgcgcuagugcccgaacgcgcggccccaggcccggugcgcaggcgcaguggcugccccugcgccgccacacccugucgacgcucgcgcgcggcgucugcugcugcgacggccgagaaggccucggggcucgcggggcgcaagaccaaaaggagaugcuauccccgcccgccugcucgcccgccgcuccccuuaccaaccaggauccuucgcugcagggacacgccaacaaccacccaggcgaucagcaacacggccacgacaccgcugugccacccggcuggcucuggucuucuuuggcuucgacguccugaccgc

SEQ ID NO: 14987 - RNA, 1120 nt, Homo sapiens
caugacccccauccucacgguccugaucugucucggugagauuugaagagggaggggagcuucuaaccuaggagggaccucaccccacagccaaacucuggucccuaaggagaccccaggggcucacaaagaucccagggaggggaggaccugcccaggcuucaggggaaaaaucccucacagggaacucucuuccagggcugagucugggccccaggacccacgugcaggcaggugagucuguucccagcugucccaggucccuccuccucacuagggacaaggggccacccccgugcagcuggggauggggaauagcaguucugggcugacugaugggggugucuggaggguccugcagcugagagcugagaucuguugggugggaaaugacuuagaauccgaccucugauuuccuuccagggcaccuccccaagcccacccucugggcugagccaggcucugugaucauccagggaaguccugugacccucaggugucaggggagccuucaggcugaggaguaccaucuauauagggaaaacaaaucagcauccuggguuagacggauacaagagccugggaagaauggccaguuccccaucccauccaucaccugggaacacgcagggcgguaucacugucaguacuacagccacaaucacucaucagaguacagugacccccuggagcugguggugacaggugagaggacacucaggagucccagccccaggcucugcccucaggaagggggucggcucucaggggcaucuccgcucucacagcucaacccuggggaugaugugggaggugggagccccauuuaacacagugccuccuucucuccuaggagccuacagcaaacccacccucucagcucugcccagcccuguggugaccuuaggagggaacgugacccuccagugugucucacagguggcauuugacggcuucauucuguguaaggaaggagaagaugaacacccacaacgccugaacucccauucccaugcccgugggugguccugggccaucuucuccgugggccccgugagcccgagucgcagguggucguacaggugcuaugcuuaugacucgaacucucccuauguguggu

SEQ ID NO: 14988 - RNA, 7337 nt, Homo sapiens
caccggagcugcugaauauuuauuuggccccaggagcagugcagggaugggcuguguuggaagagagaggagagcagacgaggauggcugauugucaaagcagggggcaggacccgggggcaggagaaaccaggcugccuucccuucccggggucccuggggcaucuggguguguccgcgagggucgggggagugugcuggaaaguugucgugauuggcaucguugggggugagaagacaggaaugguucagaugguugggguggaagguggggggaggguaaccgucagaggaagcuuaaggguggggcuggcuuggcuuuggccggucucgggagucuggggucaggggcuagaguccaggcuuggccgggggcuuggggugggagucagggcgcaggcagcagccucacucgguccgggggccgcagcgagugccacugggcaaugggccgccgcggguuggccagcauguccgcccagugccgcaggccagccccgccggcggccgcccccacggccacccucccgauggccucguucuugcccagcuugucguaguccagcacggucagcuccaccugcaccuucuggggugggcgcgggaggaagaggagagaggagcgugaggggaggaggccccggaaggggcgguguccguuuucacggcugaggguaccucucgcugccacccgagggcucggggccccggagcucgggacgggggagggggugggagacgagagggacggagccugcggcgaggaggaggcucuggcgccuuucuuccugcgcagccagguuucuaaggaaaugaacccucaggacucgguugcggagcggguguguucggcgccuccugggggagcagccuccuaagagccgcaaagcugcagaacuuuaacaggggccgggcuaggguaggcgccgucccuaaagaagugaggggaggucucuuuuucuuagaaccacguuccugaggagggcggggcauccugguccugcuuaggguggggaaucuggucccgcuuaggaguggggcauccuggucccgcuugggggcggggcauccugguccugcuugggggcggggcauccugguccugcuugggggcggagcauccugguuccgcuugguggggcggggcauacugauccugcuuaggguggagcaucugguacugcuuaggggugggacaucccggucccgcuuagagcagauaggacacccacacccaauuuuaaggagucucuuccuggaguggaagaggcuuccugguccucauaggaggaaacagacugagagcauaaccucagacccccucaccugguuucuagggagaugcuaaaaagucucccuccgccuagcaauggcgauuacuaaaggucugggcucuuggagaagggcagguuugagcucaccuggacuuggucacagggcaccucgaagcugaaagcuucguuguaauagggguucagaguguucuucuugauggugguuuucuucuuccgcaccuuuuugccgcccugcagcagguggaccuugacguauggaucuggggagaggaaggaggagucuuauagcuccccacugcuggguuguuggaccaacauagaaacacugccuacacccuucgggucucccuagcucuaugccaaaauccaugccuuccacagcagccagguccucccuguccccgaagaaacccucgaggcucagaaacugucagaacgagaacccaccccacgccauccccacacaccccacucccuugcuucccacacaccugacaguccuccuacguccaucuucuucagguuuuuagccuccaggacgaugacggugagcuucccggccguggggacauagcggagggagaagcagauguccccaagcuucuccugcugaaaggagaggggcccaucaccagagccccggcuccacauccaugccuccucagggguacaauccacgccgcccugagggucuggaaagccuaugaucugauuggcucaggauguugugggcgggacugggccugggggcguggcucggggcgcgaccgcgcaugcucaccuccucccgcggagccgccugcagcucccgccaggccugcacuggccgccccagguccacggagcucauagggacccgcaccuccccgauggcgucauugcgagagaagcggucgaagucguacaccgccaugaccagcacccugccccccagcuccacguaggggaccuggagugcacagagaauccgcaguagagagcaggaagucagagauagggugaggcacagcacaaccagaaggaaggcauggagugaggcagcgagggucgaagcgaacaguugggggaacucaaaugggaaaguccagggauccaugcggaaaaaaaucacgggucaguggaacccaaaucguaccgcccaaggaccaggcuacagcccaggagucaguagugcccaggguccaguggaauagccccagagcugguagcugccaccugagcuguggccgccuccaggaaaagcggaaggggucggucccuaguguuccagggacugggcacaggcuauggaacacggggccugaaggcaggagcucaccuugaaggcgaaggucuccccaaagugaggguucagcgucugccgaugcaccuuggucucguaccgccuccguuuguccggcagcagguagacccgcacauagggguccgaggagccaccaagauccaaggcugccaaucccauugcuugcagaaugcccaccagcagcugcagggcccaggcacagugggggagguggggaacacuagucuuagccucccuuccauggcuccuuucagaagggguuggaacccccgggauccucccuccaaagcuuccccuuccuccacacccaccuggccacucuggaagucauaauccagggaguacugcagucguccuagcucaugcuugucugccaccugcugcccuggcccggauggugcuggcuccagcuccucuacuucuggcugcaccuuaaggagccagggguaagggugggugaagucuuccccugauagcaguauccaucaggcucagaagccaagggaggcucacaggucccuugggcuauaccugagcucucacaggcuaagcagauucaguauuugacuagugcugucugccacaggcaggaaauagacgugguaacacagaugcaguauguuugugaagguuugauuaguggugucugcuaugggcaggaacuagacaugugcuugucaugcuuagauuaaaacaagugcugauagugucccauugcccacaggaauaaugcagguuuuauuucacaugcuaauggauguacuggggugcuaguccaaacugccauguuuacuugugaucuuagcacagcaaaacauggaggagaaauggcauauuuacuguguacuugccauucuaaaguugaaugaaaaagcagaaggugucuccuuaaccuaggccagcaauucuuaaaauucaaugugaaccugaauuccccugaauccuguggcaaaaugucugaggucaccucuucagggauucugacuugauaggucaggugcuagugccagaauuugcauuucaacaaguacccagugugauucugcugcagacggucuuugaacaucacugguuuaagggacagggauggggcuggacaccaggacccuaaauagcauccuuuacggaugcuaauugaacagcuccuuauugagaaggaaggaggggaaauaccaaguuagugaccacagacuugaggcucagagagggacagugaguucuccaaggucacacaaccaggaaaugguccuucuugguuggaaaccuagggcugucuggcucccaggcaaccacugcacucugcacugagagacuuaauuuucagacccugcagugaccacuuuccauuccaacggccucauccaaugcaaaugucuuuuauccucuccaggcugcugcugcacuggccucgucccuggaucccucgccgcagaucuguccuacacaggguuccagaggagucauccuaacaccaucugacccugucccucucaugcucaaaacauauuuguagccuucaucaccuucaugacauggauacugcugaguucuccagacacuucacuccagagugcagcuauugugagaaaugacucuuuguuccccaaauaagccucagaaucuggauauggggccugaaucuggauauggggccucaacacaugcuccaacuuggacuagaauguccuucucucuggucucaguuaacucugucccucaggucucagugcagaagucaccuccaccacgaagccuccucugucugacccucuguuuuaaacuuuuuccuacuguaaauaugucccauuuucugaaaaaaaucagcauauuuuaaaguauucuggcacaaagcugguuuucagcuuucagagccauuuauuuauuuaucuauuuauuggagacagagucucgcucugucacccaggcuggagugcaguggcgcgaucacagcucacugcagccuccaccucccgguuucagugccucagccucucgaguagcugggauuauaccacaccaccauggcuggcuuuuguauuuuuaguagagacaggguuucaucauguugcccaggcuagucuugaauucaugaccucaggcaaucuguccaccucagccucccaagugcuaggauuacaggcgugagccaccgcacccggcccagagccaaauauuuauauguuucuguagguuucuauacagugggaugccuuuucugugcuccuaugagacccuguaguauggcacauauuacccuguguggugagugucugugucagugccugacucucccaccagacugggaaguucuugggaauagcaacuaguucuguuccaucucuggguccccagaguccaguugagggcuagacacacagggaggaugagccaguaagguggguuccuauaggacagaagggagcagggacugggaccagcugggccauugagaggagcagggugcgggaaggggccagguggaggggcugggcugggccacaccuugucuauguaacucuggcccagccccuucacuuccugaagguggaccugggcuugggccuggcucuucuugccuguccgccuccgacagcucuuccgguagagacagaaacagcagcugaagaugaggaggccugagaccagcacgaugguggccagggcccaggggggcacugcagagggguggagacaacacacauugaggccugggcagcacgcaggcugauucaguccugauuacacguggaagcuggaaugcuggccuccuuuucccuccagccauuuucauugcauuucuuccuguguuuuucuuccaccuaauguggccuauagagagauucgaugccccaacccaggcugacaccaucuggauuugcuugcuuguuaguucugccuuuccuuacccgaccccgccccccauuucugcucaacuccugaugcuuuuacaagaagcccugcuccucaucgggccuguuuccuuaucuguaaaagaagagcuagguggaccuuccaauucuaagaucccauuccaugcaacaccccuugauccgguuucgauuuuuuuuuuuuuuuuuuuuuuuuuuuuuuugcaaaucuguuccuuccuuuuaccccauuucguucgcauuccaguccaggaugacgacccgggaucccagccggauuuuccagcccgccugcccgaguacacccguccgaaucccgccccucggaauccuggccaggcuuucucucugcucggccccccacccccgggucuugcucaccugggccguggcugaugcgacuggagucgggaggcgugucgggcgauggaggccccgggguugggggcuccgggaacaugguggcgggguccuggagucuuuucugcagagacacucaagcacccuagucccccauucccaccccagacguccuuugagccccacgcacaacaaagaacuccaacucccaugaggccuuugcgcgaacagccgcgcagaaaccggacagccaccgcgagucaugcugggaguuguaguaucagccuccccgcacuugagaggggguguccaggaccuaguuccauccuaaagggauacccucuuccuccacggccccacaggcaucccgcugacuucugccucguccucgccccuccgcagggucugaaccggaagcgggcgaaggcagacgugggaaccagcagaccgcguugcccagagcaacagccgggcuccucucaagcggggugagagcaaagcugguugcccgggcaacggguuguugccaggacaacgggcggggcugacgcacagacgcggagucccggcggggcaggcucgcuccggggcccaccggugccugggaaccccccaauagcccgacugggauccugaggucccgcgagguggggagcgggcagccugugguccgagcgcccacagccgacugcucccuccgcaccugguccugggagcugagacgcagguucccucuucccucuccccaauuuugcuggagggcgggucgggggcugcccggugccugugcugagcccccucauccuucuuggccuguuggucucuccacgcauccgugcugcucucgugaccgccucggucuccacgcugccucuugaccccacauaggcgucuucccugugucugccuccccaacccgccugucucucuucccuaucgccuggccucugucuccagggucucucccucuccccuccgccugcgccccacuccccgcccucggcucuuugucuucuccauaccugucucgcguccccagaucccugucucuccgcuucaggcugcugcccucccucugguugucuccccagugccccagcccccacucgcacaccccuuuccucuagggaugcggaugcggaugggcugagggcgggggucccagcagcuccuaccugcucggcggcuggacgggacacucccgggagacgccgaggcgccagccccgcccggaccccacccccugcacgugggcgguggcgcugucccgggugcugaucgcggagcucuccggggcgggggagccgcggagcggagcaggaucccgugcgcgcgugugugcccgugugcgugugcgcgcgugugugguguguauugugugugcccguauuuggucucggguaggcggaaagcccugccccgccccuccucccgccuccacccgggaaccucgaugacgcccacagauguuuauccuggugcuuuagcauu

SEQ ID NO: 14989 - RNA, 878 nt, Homo sapiens
gaugccgaaaggaaagaaggccaagggaaagaagguggcuccggccccagcugucgugaagaagcaggaggcuaagaaaguggugaauccccuguuugagaaaaggccuaagaauuuuggcauuggacaggacauccagcccaaaagagaccucacccgcuuugugaaauggccccgcuauaucagguugcagcggcagagagccauccucuauaagcggcugaaagugccuccugcgauuaaccaguucacccaggcccuggaccgccaaacagcuacucagcugcuuaagcuggcccacaaguacaggccagagacaaagcaagagaagaagcagagacuguuggcccgggccgagaagaaagcugcuggcaaaggggacgucccgaagaagagaccaccuguccuucgagcaggaguuaacacugucaccaccuugguggagaacaagaaagcucagcugguggugauuucacacgacauggaucccaucgagcugguugucuucuugccugcccuaugucguaaaaugggggucccuuacugcauuaucaaggggaaggcaagacugggacgucuaguccacaggaagaccugcaccacugucgccuucacacaggugaacucagaagacaaaggcgcuuuggcuaagcugguggaagcuaucaggaccaauuacaaugacagauacgaugagauccgccgucacugggguggcaauguccuggguccuaagucuguggcucguaucgccaagcgcaaaaaggcaaaggcuaaagaacuugccacuaaacuggguuaaauguacacuguugaguuuucuguacauaaaaauaauuaaaauaauacaaauuuuccuuaaaaaaaaaaaaaaagaa

SEQ ID NO: 14990 - RNA, 11077 nt, Homo sapiens
uccguccccaccccaacaugaaaaguaauugcuuaaauaaauaauauauguuccugcccaggccuagauggggaagagccagggcagaagucuguggacagacuucuuggagacccaagaauccgggaccccaguccccuccuccucggggacccaggaguccaccugccucccaccccugcuccugaaauaaauaaguauaaauaaggcacagaugccccccaggccucacggaaggacugucucuaacuagggggagauaauggcggggggaucaccuggcuguuucgcccccaguacugaaauaaauaaauaaauaagaucuggcuuuggaaggacggugguggcuuugggccccgggucacagccgagucuucagcagcagcaguccccucacggcccagucaagugucaggugcagcccccccaggauggcgugggcggcccugaugcccccccaggcugaggaggggggcgccagcgggggcgccggcggguccggggguggcuggggcagggccaggcgggacaucuguggggagaggagagaggugagucacagguagggggugcagcgggggugcagggcaggggugcuguggagcugcagcugaaucggggcugcauauucacagggggacuguggcgcguggggugaaguguuuaggccgggagcucuucaggcugugggguuccgaaaauggaggcuggagucaggacgggcuuccagagcugaguguggggguugggggugaagucuguggagucagggcuggcaucucgguucuaggugagggaucgggccugggacuguuagagucgccggggcuggaaucucagagcuggguuuuuguuguuguggcugcuguuagaacaauuaagaagccaggcgcgggggcucacgccuguuaucccagcgcuuugggaggccgaggcgggcggauggccugagcucaggaguuugugaccagccugggcaacacggugaaacccugugucuacuaaaauacaaaaaaauuauccggguguggcagugugcaccugaagucccagcuacucaggaggcugaggcaggagaaucgcuugagcccaggaggcggagguuccagcgagccgaaauggcaccauugcacucuagccugggcaacagagcgcgagacucugucuccaaaaaauaauaauaauaauaauaauuaagaaacagagucuugcuaugcugcccaggcugucucaaacucauggccucaagagguccuucugccuuggccuccccugccuugggauuacaggagugagccacugcuccccaccagagcugggguuuuacagacaguaucugaggucugugggcucgagucuagggucaggcccuggaucucaaggcugaagucuuagagauggggucucuggguucaaguucaggaacucaugggugagggcuggagucucagagcuagaaguuggaauuugagauccagggucuuuggaguuaggcccaagaaccaggguuugaagucuucuggucucagggcuuugggccuggcuuuggaagugagggucuuggagucguacaggcgcaggcucaggaucugaggugucaggguuuucgauguugggagugagacauagggccucagggcucggggucuagguccuggaggucuuggguuuguacagccagggucccaaggcuggcuuugggucaaggucuuguaucuuagggccugggaucuuuaagaugucaggaucucagggcuggggccuggggucucagggucuggagguccaugguuuucuuuuccuucuuuuuuuuuuuuuuuuuuuuuuugagagagagggaguuuugcucuuguugcccaggcuggaguguaauggugcgaucucggcucacugcaaccuccgccucccagguucaagcgauucuccugccucagccucccaaguagcugggauuacaggcaugcaccaccacgccuggcuaauuuuguauuuuuaguagagacaggguuucaccauguuggucuggcuggucuugaacucccgaccucaggugauccacuugccucggccucccaaagugcugggauuacaggcgugagccaccacgccuggccagguccaugguuuucaaugucauggggccagggucuccaagucuugaggugaggauuugaauucucaaggcuuugggcuucaggauggggucuugggucuuaggggcugggaucuggggacuuugaggucauggaugauggagucucagggucuugggugagaauuugaaguuucugggcaggauuugggggucuagggccucagggucucagggccacaggaucuugggacugcagggucagggucucagagcaggacuguuagggucagggucucagagcggggcuguuacggugucagggucucagagcgggcuguuagggugucagggucucagagcggggcuguugcacucgggucuggggucucaggcuucaaggacucaggccacaggauuuuggggccaggggugggggucuggggugucaggucuuggggccaggacauaccaggagcugcagccggcgcagcagccgguccagucgggccugcagggugcccagcucgggcuccagggucuucagggaagagccaccugcccggcgcagccacugcacgugccgcagguaggacaguagguccgcucgcagccuugucagcacaccugggagcuggggauagagccgggacaucagagaacacccgaccagugccccucauccuccccgcccccuucacugccugccucccaccuuguccccagcccacucccuugcccuuaccuguagagcucccagugcccccgcacucauggccagggugggcagggaauccagguugugguccccgucagcugggaauuugucccucuggcagggaaaaaagcugugagguggccccugcccagccucggggcucccuccaucccccacgccaggcccccaacucuuccccucccucacucugccaccugagagcccagaaccccuccaaguggcugcccgcagacuccucuccguuccucucugccucucacuccugugcuggccccagcccagucucuccuaccagcugugcagccagcugccgcguguccgccaggagagagcgggucaggagcacggugcuguccagcucggcccgagggucuggggaaacucgaggggggccaggugguggcccaggggcgacagcuguaucuggccacaggcucagcacgaccaggaccaggcggcaaacaccugggggcaggauaaggcagagagcucaggcuggacuccgggucugagagaggagggccugggccuggacucccgggucugagggaggaggaacuggggucuggacuccuccugggucugagggaggagaggcugggggccuggacuccuaggucugagggaggaaggccuggggucuggacuccugggucucggggaggagggucuggggccuggacucccggccuuagggaggauggagcuggaggucuuaagucccaggguggaacgcccgcgggcaggucgcagggccaggcgggcuucccucucccucccuggcucuggcugccccgcccgucggagcagacgcggcccggggcggguagacgggccgggcgucucccguccgcccccggacgccggaaucugggccccggggcggggcauggugggggaggcacaggccagaaccugcccccuccccgggccgcgggagcccgagcuggcugggagcaggggaaggagccagaagccaggacggagcccgggagacacggaccucucccacgggagaccccuuagacgcccucccaggagccccgccgggugggcggcagaagcccgggccgcagcgcaccugggcggagaggggcagagccaugggcccggccgggccgcgggagcgggagagcuggcggcggggggcgcggggggcgcggggggcgcggggguccggagcucgcuccccgcagcccaccccggccgccccgcccacccggccacccgccagccaaucagcgcuccccggccgcccgcgccucgcacacccccagcccgccccccgggcccgccagccgucggucuguccgcgccuccgucggccgcaucugcccggcucuccccgcuuuccccccgcgcccagucucucuccuccccccggcuggggucgcuacucccuggcuugcuccgcucuccgcggacccugccucaguuucccuccggagccucucugccggaaucccagggagucucccgguccccgcgggcucccuggggccugggucgaugggggucaccucccucccggcaccagucccugcgucccugccccugcucggucuccgcgucucgcucccucucggggcccugucuggcccgucccuccugcggcgccucugauuggcugccuccauccgcuccugucugugucucucucugcccaucuccuccgccgccuccugucuccgaagcugcucuccuccccggcugccugucuccgggucccucucugugcgacucagcggggucugcucccacccccgccgugggucccucuccucccugccucccuguccccuccacccuccccaugaaccaacuuacaguucauguccccacagggccagggguuccccagggcagggggcagggagccgggggccuuuaacccuucccuguccgcugccgggggagccccgagggucagcugggccgcggccuggggaggggaggcaugugcccugagcagcagggccgcggcagugagggaguguggacgccugggggguuauauagggggcuggggcgggcgggcggggggcaggcggcaggggagggcggccugacacauccugacucacccucccugccugccuuuuccauucagacggagcggcugccuugcagggcucacgccgccgcgcucggaggagggcacggaaggaaaaguuggaaaaguugaaaagggaaagggggggguggucggagaggggcuggugaggucauuggcguccccucccuccaccuccacgggccggagcagacacucaggcucaagcgcuggggcccgacuguggguggggguccggcuggaccaggacuagcagagagagauggggaggcaggaggacggaaaggcagagaaaggccggacggagggacaagacaggggccuggagagguggaggcaggaggaagagggaguggaagggaaggagagagagagagacacacacacacacagagugaaggacagacugagacagagacagggagauggagauccacagagauggaggcagccagagagacacaccagagaagcaaagaggaucagaggggcagcccuggagacagagggagagguucugggagucagagaucagagagcgggaggaagacagcaggagggacuuggggagacccagggagaccccgaggggaaaggaacagagacaccaagacucugagacagaggaugccgcagcugaagaaaggcaccaggcaaacagagacacggggcagagugacagggacggagaggccccagggacagaaaaggggagacagagauauuagaaagacagagacgcugagauguuggggacucagcaaugggggcagagaguaaaagccuuucucauuuuuuguuuguuuuuuguuuguuuguuuuuugguacugagucucacucugucacccaggcuggagugcaauggcgcgaucaauggcacaaucucagcucacugcaaccuccaccucccggguucaagcgauucuccugccucagccucccaaguagcugggauuacaggugugcgccaccacacccggcuaauuuuguauuuuuaguagagacggggucuuaccauguuggccaggcuggucucgaacuccugacuucgugauccgccugccucggccucccaaagugcugggaugacaggugugagcuaccgugccuggccucguuuuugguuuuuuugagacagagucucgcugugucacccaggcuggggugcaguggugugaucucagcucacuguaaccuccgccucccagguucaagugauucucaugccucagccuccugaguagcugggauuacaggcacccgccaccaugccuggcuauuuuuuguauuuuuaguagagauaggguuuugccauguugcccaggcuggucucaaacuccugagcucaggucauccucccgccucagccucccaaaguggugggaauacaggugugaaccaccacgccuggccuuuugaaaagccuuucucaaagaggcagguggagacaggaaggaggaggagagacggagacugaggaccaagaggcgcugagacacuccauagaggcaagaccuccaugugcgacucucccccucugugccucaguuuccucaucugugaagggggguuaaugaugcacccucauccgccuaaaugccacgaugaggauaaagcgagcucauucacgugaagcacaaagucagugcugaccauccuuauuccccucguuaacuuuucugaacacaucagggacacagagaaaaagaugucgccuucgagagagauggggcaggagcaagauggggugaagacgggacaguggggacacggagacaguggccagaaccaccggggccagagcccuggacgucaccgcacagagguggaggcaggagaggagugcaggggggaggggacccacaggccaggggggaggcagcgacgccuacccaggcucacagugggccagccccaggcaugggggcagaggagacccgggauucaccacagagcaagcgaggggcagagguaccaagccauguccccgagagcccccagaccuagauggcagggaaggacaggaugggacugagagcgcggagguggugggggcucugaggcucugugcagacccccucgugucagccuccgagacugccgggcugguuggaggcuuccccuucccaauccagcaccacuggaagggcaacugcucagguccccaaggaggugaggucacagcccccccacggugggacaugaccucaucgccucagguaagagcucucucucccucucucuggucugucacagccaccccuuucagggccccccaggggccuuccccagcaccagcuccugcugggacccaggccucugaccaccgggucuccgccccucagggggccugcuuccggcugagucaguguggggggcccaaggcugcgucagugaggggagagcugacguagccccccccagaccggcgggaccagccaaggugacucaggccaccagcuugggggauggacuagcccgaggguaugggggacuggccuggggccagcuggggagcaagaaaaggguucugguaaugccagccccguccaccuacagggaccagagcccaaucccccagccccuccucccucagacccgggaguccaggcccccaaccccuuccccuucagacccaggaguccaggucuccagcuccuccucccucagacccaggaguccaggccccagccauuccucccucagauccaggaguccaggcccccaggcccuccucccucagacccaggagucuagacccccagcuccuccucccucagacccaagagucuaggcccagccccuccucccucagacccaggaguccaggcccccaaccccuccuccugcagacccgggaguccaggcccccagccccuccucccucagacccgggaguccagguccccaaccccuccucccucacaccugggaguccaggcccagccccuccucccucagacccgggaguccaggcccagccccuccuccuucagacacaggaguucaggcccagccccuccucccucacacccaggaguccaggcccccaaccccuccucccucagacccaggaguccaggcucccaggccuuccucccucagacccaggaguccaggcccuaaauucuaguucaagaaagguagaggaggaucuuggggcccuucugcacuuuggggagcauguguggggaagguaaugggucugggacaaaucuggggucccagccgcugccaguuuccugucucgucuggguccccagcccuggguugugggcucagacuccguccccgcaguguggcugcaggagguacagguagauggggcgggugcagagugacggggcugggagugacuggcaacuccugggucugcccaggccagggugggacacauugggcuacuucugugcaaacaagagaaagagagagagagagagacagagcaagagaugaagaucggaaaagaaacccagaggcaggacuggggagucccaagaaaaugacagaugacagagacaaacagagcuggagagacaggggcagcaaaggccccaggaggcagccagcgccacggaacccaguggaagcuagagaccagcuuggaggcucggaaacagacugggcagccagggcccaggcccugggguggucacagacacugaggagaagccucggggacaugggggauggccagggaguccuggcucccgcgcggccccggggggaagccgagccggcagggugugaggucagcaggucccaggcuguguguguguccgucugucagucccuggggggucccgucuggccucuggggggugacggggcaggccggccacagaggcagcccaaaccugucauuagcggugagggccgugacggcggggcccccccagucccaagccgcgguccaaggccaggcggccccgccccccacccccuccuugaucccugaggaaucccgggaauugggaaguggguccagaugauguugacacaggaaacggucagcagcugcccggccucagccccacaaccccucugacccucacccccggcccccugcagagcccccucuaaccugugucaucucugacgaaggcagcccggggcccacucaguacccaccaggauguuuacaggagagauggguaacacggggagucaccccacggggcuuccugagaaauggggucuggcuccuagaccauccucccagacucacaaguucaggcccccagccccuccucccucagacccaggaguccagguccccaggcauuccucccucagacccaauucuggcucccagccccauccuucagaccugggaguccagcccucagaccuaggagucugggaccccccagccccuccucccucagacccaggaguccaggcccccagccccuccucccucagacccaggaguccgggaccccccagcuccuccucccucagacccaggaguccaggcccccagccccuccucccucagacccaggagucccggacccggaccccccagcuccuccucccucagacccaggaguccaggcccccagccccuccucccucagacccaggaguccgggaccccccagccccuccucccucagacccaggaguccagggccccagccccuccucccucagacccaggaguccaggcucccgccccuucucccucagacccaggagucugggaacccccagccccuccucccucagacccaggaguccaggcccccagccccuccucccucagacccaggaguccaggcucuagccccuccucccucagacccgggaguccaggcccccagccccuccucccucagacccaggaguccaggcuccagccccuucucccucuaaugcaggugucugaguuuacaacccccuuuuccuucagaugcaggacuucuagcccagagacugucccagggagcuaagacucccuccucacugugcugcaaagcugaauggaugaguuggggugcacuagggauuaugguuccaacccagccccccauuccgguuuccucuucuuggaagccaaguuuucucucagucacuggggagugguggggggaaucaauguggaagcuucaggaucuccguuuagccgacucccucccaccacucccuaaccucuguucacagauggggaaacaaauccaggagggaaaugugggcucccuguccaggagccaccauuacagucuccgagcagcucuggcccaccaggcccucaaacucagcaggggcccacauggccuguccccuucccuguuuguuuuuuuuuucuuuuuucuuuuuuuuuuuugacacagagucucacuccuucacccaggcuagagugcaguggcacgaucucgacucacuguaaccuccacuuucuggguucaagcaaccuccaccuccuggguucaagcaauccuccugccucagccucccgaguagcugggauuacaggcaaguaaucaccacgcccagcugauuuuuguauuuuuaguagggacggggcuuccccauguuggccagucuggucucgaacuccugaccucaggugacccgccugccuuggcuucccaaagugcugggguuauaggcgugagccaccgcgcccagcccuaucaccuucccugcuaaacauucccuagacagcaggccuggcagggcugagaugaaaagccuuucucaagaccccuggaccaggagacccccggacuuaggcuccggccccuugucucaucccccucccaggucuucucauugcgggggggacuuucccuaacaauggggcucagugaggccucugugucucacagcuccccuuccccugguuguuaaggcgaaaaacucccuagcaacgggguuuccugaaccuucgggccacccgaauccaccuucucagguaucaguuuccuuaggaaagaaacucccuagcaaagccucccaguuccccaccccucagggcgccccgggugauauggagacacgccccagacucccacgcccuuccagacuucucuuucccaccauaaguggccaaagaggcucuucuaaaccugagacgcccccacucuuccaccaggucccuaaagaaucaacacccuagaccaggcauggccaggcuggugugaagcccuuccacguccguag

SEQ ID NO: 14991 - RNA, 11077 nt, Homo sapiens
cuacggacguggaagggcuucacaccagccuggccaugccuggucuaggguguugauucuuuagggaccugguggaagagugggggcgucucagguuuagaagagccucuuuggccacuuauggugggaaagagaagucuggaagggcgugggagucuggggcgugucuccauaucacccggggcgcccugagggguggggaacugggaggcuuugcuagggaguuucuuuccuaaggaaacugauaccugagaagguggauucggguggcccgaagguucaggaaaccccguugcuagggaguuuuucgccuuaacaaccaggggaaggggagcugugagacacagaggccucacugagccccauuguuagggaaagucccccccgcaaugagaagaccugggagggggaugagacaaggggccggagccuaaguccgggggucuccugguccaggggucuugagaaaggcuuuucaucucagcccugccaggccugcugucuagggaauguuuagcagggaaggugauagggcugggcgcgguggcucacgccuauaaccccagcacuuugggaagccaaggcaggcgggucaccugaggucaggaguucgagaccagacuggccaacauggggaagccccgucccuacuaaaaauacaaaaaucagcugggcguggugauuacuugccuguaaucccagcuacucgggaggcugaggcaggaggauugcuugaacccaggagguggagguugcuugaacccagaaaguggagguuacagugagucgagaucgugccacugcacucuagccugggugaaggagugagacucugugucaaaaaaaaaaaagaaaaaagaaaaaaaaaacaaacagggaaggggacaggccaugugggccccugcugaguuugagggccuggugggccagagcugcucggagacuguaaugguggcuccuggacagggagcccacauuucccuccuggauuuguuuccccaucugugaacagagguuagggaguggugggagggagucggcuaaacggagauccugaagcuuccacauugauuccccccaccacuccccagugacugagagaaaacuuggcuuccaagaagaggaaaccggaauggggggcuggguuggaaccauaaucccuagugcaccccaacucauccauucagcuuugcagcacagugaggagggagucuuagcucccugggacagucucugggcuagaaguccugcaucugaaggaaaaggggguuguaaacucagacaccugcauuagagggagaaggggcuggagccuggacuccugggucugagggaggaggggcugggggccuggacucccgggucugagggaggaggggcuagagccuggacuccugggucugagggaggaggggcugggggccuggacuccugggucugagggaggaggggcuggggguucccagacuccugggucugagggagaaggggcgggagccuggacuccugggucugagggaggaggggcuggggcccuggacuccugggucugagggaggaggggcuggggggucccggacuccugggucugagggaggaggggcugggggccuggacuccugggucugagggaggaggagcugggggguccggguccgggacuccugggucugagggaggaggggcugggggccuggacuccugggucugagggaggaggagcuggggggucccggacuccugggucugagggaggaggggcugggggccuggacuccugggucugagggaggaggggcuggggggucccagacuccuaggucugagggcuggacucccaggucugaaggauggggcugggagccagaauugggucugagggaggaaugccuggggaccuggacuccugggucugagggaggaggggcugggggccugaacuugugagucugggaggauggucuaggagccagaccccauuucucaggaagccccguggggugacuccccguguuacccaucucuccuguaaacauccugguggguacugagugggccccgggcugccuucgucagagaugacacagguuagagggggcucugcagggggccgggggugagggucagagggguuguggggcugaggccgggcagcugcugaccguuuccugugucaacaucaucuggacccacuucccaauucccgggauuccucagggaucaaggaggggguggggggcggggccgccuggccuuggaccgcggcuugggacugggggggccccgccgucacggcccucaccgcuaaugacagguuugggcugccucuguggccggccugccccgucaccccccagaggccagacgggaccccccagggacugacagacggacacacacacagccugggaccugcugaccucacacccugccggcucggcuuccccccggggccgcgcgggagccaggacucccuggccaucccccauguccccgaggcuucuccucagugucugugaccaccccagggccugggcccuggcugcccagucuguuuccgagccuccaagcuggucucuagcuuccacuggguuccguggcgcuggcugccuccuggggccuuugcugccccugucucuccagcucuguuugucucugucaucugucauuuucuugggacuccccaguccugccucuggguuucuuuuccgaucuucaucucuugcucugucucucucucucucucuuucucuuguuugcacagaaguagcccaaugugucccacccuggccugggcagacccaggaguugccagucacucccagccccgucacucugcacccgccccaucuaccuguaccuccugcagccacacugcggggacggagucugagcccacaacccagggcuggggacccagacgagacaggaaacuggcagcggcugggaccccagauuugucccagacccauuaccuuccccacacaugcuccccaaagugcagaagggccccaagauccuccucuaccuuucuugaacuagaauuuagggccuggacuccugggucugagggaggaaggccugggagccuggacuccugggucugagggaggagggguugggggccuggacuccugggugugagggaggaggggcugggccugaacuccugugucugaaggaggaggggcugggccuggacucccgggucugagggaggaggggcugggccuggacucccaggugugagggaggagggguuggggaccuggacucccgggucugagggaggaggggcugggggccuggacucccgggucugcaggaggagggguugggggccuggacuccugggucugagggaggaggggcugggccuagacucuugggucugagggaggaggagcugggggucuagacuccugggucugagggaggagggccugggggccuggacuccuggaucugagggaggaauggcuggggccuggacuccugggucugagggaggaggagcuggagaccuggacuccugggucugaaggggaagggguugggggccuggacucccgggucugagggaggaggggcugggggauugggcucuggucccuguagguggacggggcuggcauuaccagaacccuuuucuugcuccccagcuggccccaggccagucccccauacccucgggcuaguccaucccccaagcugguggccugagucaccuuggcuggucccgccggucuggggggggcuacgucagcucuccccucacugacgcagccuugggccccccacacugacucagccggaagcaggcccccugaggggcggagacccgguggucagaggccugggucccagcaggagcuggugcuggggaaggccccuggggggcccugaaagggguggcugugacagaccagagagagggagagagagcucuuaccugaggcgaugaggucaugucccaccgugggggggcugugaccucaccuccuuggggaccugagcaguugcccuuccaguggugcuggauugggaaggggaagccuccaaccagcccggcagucucggaggcugacacgagggggucugcacagagccucagagcccccaccaccuccgcgcucucagucccauccuguccuucccugccaucuaggucugggggcucucggggacauggcuugguaccucugccccucgcuugcucuguggugaaucccgggucuccucugcccccaugccuggggcuggcccacugugagccuggguaggcgucgcugccuccccccuggccuguggguccccuccccccugcacuccucuccugccuccaccucugugcggugacguccagggcucuggccccggugguucuggccacugucuccguguccccacugucccgucuucaccccaucuugcuccugccccaucucucucgaaggcgacaucuuuuucucugugucccugauguguucagaaaaguuaacgaggggaauaaggauggucagcacugacuuugugcuucacgugaaugagcucgcuuuauccucaucguggcauuuaggcggaugagggugcaucauuaaccccccuucacagaugaggaaacugaggcacagagggggagagucgcacauggaggucuugccucuauggagugucucagcgccucuugguccucagucuccgucucuccuccuccuuccugucuccaccugccucuuugagaaaggcuuuucaaaaggccaggcguggugguucacaccuguauucccaccacuuugggaggcugaggcgggaggaugaccugagcucaggaguuugagaccagccugggcaacauggcaaaacccuaucucuacuaaaaauacaaaaaauagccaggcaugguggcgggugccuguaaucccagcuacucaggaggcugaggcaugagaaucacuugaaccugggaggcggagguuacagugagcugagaucacaccacugcaccccagccugggugacacagcgagacucugucucaaaaaaaccaaaaacgaggccaggcacgguagcucacaccugucaucccagcacuuugggaggccgaggcaggcggaucacgaagucaggaguucgagaccagccuggccaacaugguaagaccccgucucuacuaaaaauacaaaauuagccgggugugguggcgcacaccuguaaucccagcuacuugggaggcugaggcaggagaaucgcuugaacccgggagguggagguugcagugagcugagauugugccauugaucgcgccauugcacuccagccugggugacagagugagacucaguaccaaaaaacaaacaaacaaaaaacaaacaaaaaaugagaaaggcuuuuacucucugcccccauugcugaguccccaacaucucagcgucucugucuuucuaauaucucugucuccccuuuucugucccuggggccucuccgucccugucacucugccccgugucucuguuugccuggugccuuucuucagcugcggcauccucugucucagagucuuggugucucuguuccuuuccccucggggucucccugggucuccccaagucccuccugcugucuuccucccgcucucugaucucugacucccagaaccucucccucugucuccagggcugccccucugauccucuuugcuucucuggugugucucucuggcugccuccaucucuguggaucuccaucucccugucucugucucagucuguccuucacucugugugugugugugucucucucucucuccuucccuuccacucccucuuccuccugccuccaccucuccaggccccugucuugucccuccguccggccuuucucugccuuuccguccuccugccuccccaucucucucugcuaguccugguccagccggacccccacccacagucgggccccagcgcuugagccugagugucugcuccggcccguggagguggagggaggggacgccaaugaccucaccagccccucuccgaccaccccccccuuucccuuuucaacuuuuccaacuuuuccuuccgugcccuccuccgagcgcggcggcgugagcccugcaaggcagccgcuccgucugaauggaaaaggcaggcagggagggugagucaggaugugucaggccgcccuccccugccgccugccccccgcccgcccgccccagcccccuauauaaccccccaggcguccacacucccucacugccgcggcccugcugcucagggcacaugccuccccuccccaggccgcggcccagcugacccucggggcucccccggcagcggacagggaaggguuaaaggcccccggcucccugcccccugcccuggggaaccccuggcccuguggggacaugaacuguaaguugguucauggggaggguggaggggacagggaggcagggaggagagggacccacggcgggggugggagcagaccccgcugagucgcacagagagggacccggagacaggcagccggggaggagagcagcuucggagacaggaggcggcggaggagaugggcagagagagacacagacaggagcggauggaggcagccaaucagaggcgccgcaggagggacgggccagacagggccccgagagggagcgagacgcggagaccgagcaggggcagggacgcagggacuggugccgggagggaggugacccccaucgacccaggccccagggagcccgcggggaccgggagacucccugggauuccggcagagaggcuccggagggaaacugaggcaggguccgcggagagcggagcaagccagggaguagcgaccccagccggggggaggagagagacugggcgcggggggaaagcggggagagccgggcagaugcggccgacggaggcgcggacagaccgacggcuggcgggcccggggggcgggcugggggugugcgaggcgcgggcggccggggagcgcugauuggcuggcggguggccgggugggcggggcggccggggugggcugcggggagcgagcuccggacccccgcgccccccgcgccccccgcgccccccgccgccagcucucccgcucccgcggcccggccgggcccauggcucugccccucuccgcccaggugcgcugcggcccgggcuucugccgcccacccggcggggcuccugggagggcgucuaaggggucucccgugggagagguccgugucucccgggcuccguccuggcuucuggcuccuuccccugcucccagccagcucgggcucccgcggcccggggagggggcagguucuggccugugccucccccaccaugccccgccccggggcccagauuccggcguccgggggcggacgggagacgcccggcccgucuacccgccccgggccgcgucugcuccgacgggcggggcagccagagccagggagggagagggaagcccgccuggcccugcgaccugcccgcgggcguuccacccugggacuuaagaccuccagcuccauccucccuaaggccgggaguccaggccccagacccuccuccccgagacccaggaguccagaccccaggccuuccucccucagaccuaggaguccaggcccccagccucuccucccucagacccaggaggaguccagaccccaguuccuccucccucagacccgggaguccaggcccaggcccuccucucucagacccggaguccagccugagcucucugccuuauccugcccccagguguuugccgccugguccuggucgugcugagccuguggccagauacagcugucgccccugggccaccaccuggccccccucgaguuuccccagacccucgggccgagcuggacagcaccgugcuccugacccgcucucuccuggcggacacgcggcagcuggcugcacagcugguaggagagacugggcuggggccagcacaggagugagaggcagagaggaacggagaggagucugcgggcagccacuuggagggguucugggcucucagguggcagagugagggaggggaagaguugggggccuggcgugggggauggagggagccccgaggcugggcaggggccaccucacagcuuuuuucccugccagagggacaaauucccagcugacggggaccacaaccuggauucccugcccacccuggccaugagugcgggggcacugggagcucuacagguaagggcaagggagugggcuggggacaaggugggaggcaggcagugaagggggcggggaggaugaggggcacuggucggguguucucugaugucccggcucuauccccagcucccaggugugcugacaaggcugcgagcggaccuacuguccuaccugcggcacgugcaguggcugcgccgggcagguggcucuucccugaagacccuggagcccgagcugggcacccugcaggcccgacuggaccggcugcugcgccggcugcagcuccugguauguccuggccccaagaccugacaccccagacccccaccccuggccccaaaauccuguggccugaguccuugaagccugagaccccagacccgagugcaacagccccgcucugagacccugacacccuaacagcccgcucugagacccugacaccguaacagccccgcucugagacccugacccuaacaguccugcucugagacccugacccugcagucccaagauccuguggcccugagacccugaggcccuagacccccaaauccugcccagaaacuucaaauucucacccaagacccugagacuccaucauccaugaccucaaaguccccagaucccagccccuaagacccaagaccccauccugaagcccaaagccuugagaauucaaauccucaccucaagacuuggagacccuggccccaugacauugaaaaccauggaccuggccaggcgugguggcucacgccuguaaucccagcacuuugggaggccgaggcaaguggaucaccugaggucgggaguucaagaccagccagaccaacauggugaaacccugucucuacuaaaaauacaaaauuagccaggcgugguggugcaugccuguaaucccagcuacuugggaggcugaggcaggagaaucgcuugaaccugggaggcggagguugcagugagccgagaucgcaccauuacacuccagccugggcaacaagagcaaaacucccucucucucaaaaaaaaaaaaaaaaaaaaaaagaaggaaaagaaaaccauggaccuccagacccugagaccccaggccccagcccugagauccugacaucuuaaagaucccaggcccuaagauacaagaccuugacccaaagccagccuugggacccuggcuguacaaacccaagaccuccaggaccuagaccccgagcccugaggcccuaugucucacucccaacaucgaaaacccugacaccucagauccugagccugcgccuguacgacuccaagacccucacuuccaaagccaggcccaaagcccugagaccagaagacuucaaacccugguucuugggccuaacuccaaagacccuggaucucaaauuccaacuucuagcucugagacuccagcccucacccaugaguuccugaacuugaacccagagaccccaucucuaagacuucagccuugagauccagggccugacccuagacucgagcccacagaccucagauacugucuguaaaaccccagcucugguggggagcaguggcucacuccuguaaucccaaggcaggggaggccaaggcagaaggaccucuugaggccaugaguuugagacagccugggcagcauagcaagacucuguuucuuaauuauuauuauuauuauuauuuuuuggagacagagucucgcgcucuguugcccaggcuagagugcaauggugccauuucggcucgcuggaaccuccgccuccugggcucaagcgauucuccugccucagccuccugaguagcugggacuucaggugcacacugccacacccggauaauuuuuuuguauuuuaguagacacaggguuucaccguguugcccaggcuggucacaaacuccugagcucaggccauccgcccgccucggccucccaaagcgcugggauaacaggcgugagcccccgcgccuggcuucuuaauuguucuaacagcagccacaacaacaaaaacccagcucugagauuccagccccggcgacucuaacagucccaggcccgaucccucaccuagaaccgagaugccagcccugacuccacagacuucacccccaacccccacacucagcucuggaagcccguccugacuccagccuccauuuucggaaccccacagccugaagagcucccggccuaaacacuucaccccacgcgccacagucccccugugaauaugcagccccgauucagcugcagcuccacagcaccccugcccugcacccccgcugcacccccuaccugugacucaccucucuccucuccccacagaugucccgccuggcccugccccagccacccccggacccgccggcgcccccgcuggcgccccccuccucagccugggggggcaucagggccgcccacgccauccugggggggcugcaccugacacuugacugggccgugaggggacugcugcugcugaagacucggcugugacccggggcccaaagccaccaccguccuuccaaagccagaucuuauuuauuuauuuauuucaguacugggggcgaaacagccaggugauccccccgccauuaucucccccuaguuagagacaguccuuccgugaggccuggggggcaucugugccuuauuuauacuuauuuauuucaggagcaggggugggaggcagguggacuccuggguccccgaggaggaggggacuggggucccggauucuugggucuccaagaagucuguccacagacuucugcccuggcucuuccccaucuaggccugggcaggaacauauauuauuuauuuaagcaauuacuuuucauguugggguggggacgga

SEQ ID NO: 14992 - RNA, 2486 nt, Homo sapiens
guccguccaccguaucuguauugagcagucccccggggacuccccuaauccuccucuuccucgcccucugucuccucacccuccuccgucccuucccccucggugccucccuccacaucccuggacucuuuggacagggcgacuggcacgcugcccguggacggcgucuucuuggucccucggugcuuggagagcagcgagacggacuuggacaugucacacggacccgccaggaaaccgggcauaugcagcacgucccggcgcuuggcccaccugcagggagcggacggcucagcccccgcccuccgccggacccucccccugggggugcaggcgcccgcccuaucccaggcccacucgccagaacaagcagaugcugcagcucaggaggaggaggccgcugcacguccagaccagcgcccacaugugcuuccuccgcacguuuucuggacaagggaggcaggguuaagacccggggcucccgaccgccagacccacgccccagggaccuggggccaggagcccucaccgucuggacgcuggugguagcagaccccauugcgguagcagcaccggagacgcaggcagagguuggggcuaucgauggccgccuggcccccacagcucucccggucccauaugucacccucacagccuggggaccaaccaccaguggcuugcuucaucacagcgcuccgcuccgaaggccucauacacgagauuccaaggccaugcucccaggcugccuuccuggugcuuacucugugcagggccccagggguccagacuccacccccuccucccucagacccaggaguccaggccccagcccccuccuucagacccaggaguccaggcccagccccuccucccucagacccaggaguccaggccccagcccccuccuucagacccaggaguccaggcccagccccuccucccucagacccaggaguccaggccccagccccuccucccucacacccaggaguccagguccagcccuccucccucagaccaaggaauccaggaccccagccccuccucccucagauccagggauccaggcccccagccccuccucccucagacccaggaguccagacccccccguccucccucagauccaggaguccaggccccagcuccuccucccucagauucaggggucugaucugggcuccccucccugggugacccaguauuucagcggcugcucacuccauggguagaagaaucccuggauuccauuuccgucugcgagagaaagggcaguguuagggcuguguggagccgggcgucccuccucagcucccccgccucaccagccccucaccugccgagcccugcagcagcaggagcaggcccagcgcugggaucccacagcccaacaugucaccuccccagaccccuggggccacugugggaagaggccuuacaggacaucaccccagcaaccggccccgcccgccugcccgccaggccccaggauugugaguucuguugcuagggagucaggggugugcuacggacguggaagggcuucacaccagccuggccaugccuggucuaggguguugauucuuuagggaccugguggaagagugggggcgucucagguuuagaagagccucuuuggccacuuauggugggaaagagaagucuggaagggcgugggagucuggggcgugucuccauaucacccggggcgcccugagggguggggaacugggaggcuuugcuagggaguuucuuuccuaaggaaacugauaccugagaagguggauucggguggcccgaagguucaggaaaccccguugcuagggaguuuuucgccuuaacaaccaggggaaggggagcugugagacacagaggccucacugagccccauuguuagggaaagucccccccgcaaugagaagaccugggagggggaugagacaaggggccggagccuaaguccgggggucuccugguccaggggucuugagaaaggcuuuucaucucagcccugccaggccugcugucuagggaauguuuagcagggaaggugauagggcugggcgcgguggcucacgccuauaaccccagcacuuugggaagccaaggcaggcgggucaccugaggucaggaguucgagaccagacuggccaacauggggaagccccgucccuacuaaaaauacaaaaaucagcugggcguggugauuacuugccuguaaucccagcuacucgggaggcugaggcaggaggauugcuugaacccaggagguggagguugcuugaacccagaaaguggagguuacagugagucgagaucgugccacugcacucuagccugggugaaggagugagacucugugucaaaaaaaaaaaagaaaaaagaaaaaaaaaacaaacagggaaggggacaggccaugugggccccugcugaguuugagggccuggugggccagagcugcucggagacuguaaugguggcuccug

SEQ ID NO: 14993 - RNA, 13667 nt, Homo sapiens
aucaggaaaaugucuauuuauuccaaaaaauaccaagucgcagcuccucuggcuguccucaccagggaauuaauuaggggaaggggccaguguuggagaggggguggagagaggaagugaugaggagggaggcagaagcuguuggagggucuucagguguggaacuauuuaucuucucccugugaagugcccccucccaugcucccccaaccagacggggagaugccugugugugugugcuuguguaugcauggguuugugugcauuugcauuuguuggggcauggggaagucucagaugacgaggucccagcucaagacauguggaggggaauugucaguacacaccugcucccaccccucaagaccucucuccucuauggcuuauuugagaucaaaucaaggccccagggucaggcagccugugccaacugaauagggacagggcuaggggugggaucccuggaauccaggcugggcuagagcuaguggaggggggauaaaaaagcugaaaggcccagacccccaaaucccggcagcuggagaaagcugaguguuccgcggagguguugagcagaggggagggggcugggagggggugggugcucaagcuggcuccuuucuggggaagucacaguuggccugagcagugcggggcuggggaggcccuggaagggaugggaggagccccucagagcagcuagaagccgugggguugaaaaacuggcaccagggcccagguggauuuggguaacccccauuuccucaguguggugggaaccaagggccaguugucugccccaagcuccugacaagaaggagugugaggugccaguguuugcggggagacauaagagggagggggacggcccaggggaggaagaagaggccccccccaccucgcccuaggggcugggggaggggcguguagcccuuuaagagugggggaauggccgcccccgcaacauggcuauguacaaagagaauugagggaagauugugcauugggugcuggggacuuccugccacccccggaggcuccccggguguuaagguguuagggagggaggugaaggagcaccccuggucccgcagaugugcuggcagggaccauugcucuccagugucccugcugcaggaugaggccagcagaagacagcacugaaggccccagucggucaccagcuuugaccuaucccgcgggggucagggaucucugaggagaauuuggccggggccaguggagugcugauccugguaggggcccaagugacagggauugggcagggggcaguggcgucaccugaggguugaaaugcuuccucucuggugauaaugagagguugcuggguugacccugucaccaaucagauggcugggugagggacagcgcugcugucaggaggggccugggugccucaccgggggguaaggugagguuggcugaggccacaucuguggugggauugaugcaggcaucauccucggucaggagugaggcagugacauaaggagggccagaguaggggugaagucuucagagggggacagcuggccccaccccuguccuuuuaguggaaacgggaauauggccuguugugcugguuccccuuaagugaacaacuguaaguaccaugcggccccagaggacaacugaaauacagcccgucacgguacuuggcuccuaagaugauggcucuugggggaugauggcacaugguugcaguggacucugggaugacaccaggguuaugguggauccuaguggguggugacagcacuggaccucauggauccugggagaugauaacaccagggucaugguggauccuaauagauggugacaacacuggaccucauggauccugggagaugauaacaccagggucaugguggauccuaguagauggugacaacacuggaccucauggauccugggagaugaugacaccaggguuaugguggauccuaguggauggugacagcacuggaccucauggaucacggaugaugacaccaggguuauggcggauccuaguggauggugacagcacuggaccucauggauccugggagaagaugacaccaggguuaugguggauacuaguggauggugacagacagcacuggaccucauggauccugggagaugaugacaccaggguuaugguggauccuaguggauggugacagcacuggaccucauggaucacaggagaugaugacaccagggucaugguggauccuaguggauggugacagcacuggaccucauggaucacaggagaugaugacaccaggguuaugguggauccuaguggauggugacagcauuggcucucguggauccuggcaggugauaacaccauaguugaaguggauacugggagguaguggcacauguuugaaugaaauccugggaggugguggcacaugguugaaguggaucccuggagaugaugacaccaugcaucccugcaaaugaugaugacacuauugggcaucaugggucuugggaggugaugacaccaaaaucaugagggauuaugggaaaugguggaaucaucaguccuaguggauuucaguagaggaugucucugucagguguaguggauucuggaagguaaugucaucacuggucaugguggaaucuaggagaugaugacaccgucagcugugguggcuccugaaagaugaugacaccaugguugugaggaaucauggaggauggugacaccauuggcuauggggagucuuggcagauggugacaccauuagucaugguaaauccuggaagaagaugauaccauaguugugggucauagguaauccuggggaaggauuccauccucagacauggguaacacuugaccccggguguggugccaucaugaguggcggguguugugugaugcugacagugucagugagggcaagaguagguguaccccaagcaccuccccccaguagaaggcuaggacuuuguugacagaggugauugucucuagauauggcagaaagaaaagugaggccaggcuaugggacaccuaugagugccagaacuccaggauccuggugauccagaguggccuccugggagcagaaggccaucuggagguccugucucccaggagucauggcacagaugugggauccaaggccccauuuccccucagagggucuggcagagauccugcuggacaugucccuggagucuggggagggagcaaccaagcuaagucauggugggacaaggcaguaacucuggugacaccaccaauaccgauggccuuccagagugggcagugccucugaggaggaagcucuggugaugccaucacagcauuggggguaggggugucacugccaacagccuacacagaccaucaucucuggaggaggcccuccacaugggcggcuccccagcgaugcuuccuucagacaacaucucaggacagggccccucucugcucucuggcaucuucccuggggugguccuggacucugggccugcccugccuucuacaacaugguggcagcaguggaggcaucucuuugugccaucucagagcacauagcaucugggcgacaucacagaagggaccuccuccuggagaggucccagaguggguggucaucucuggugaugacaucacaggaagaggcacggucccucugaugacgucauagggcaaggcaccuucucuggugauggcaucacaggaaggaggcagggucccugugaugauguugugaaaaggggaccuuaugucuagugaggacacaaucggugaggcauuuuccccugcgacgugucccaggaagauggcuuugucuguaaugaugacaucauaggacagaggcaucuucucugcugcaaagacacagggagaaaauaucuuccccauggcgaugaugccaaaagaggccuuggaguuagagaugacaucauccaggugagauugucucugcagugacaccacaggaaggaaugucauggaacaaggcgucgucucuguuauuauaccacaagaaggaagccucugaggacaccauagaacauggacauggccuccagcgcugaccucacgggccggccucuuccucugugaugaccucaugggaacgaggcuuugucccugugaugacaucacagaacacagacauuuuugcuagugaugaccucaugagccggccucuuccucugggaugacaucaugggaaggaggccuuggcucaagcagugaaguaauaggaggaggaaucuugucugccaggacaucccagaaggaggcuuucacuccuguccaagggccgaucugggccccaggccccuggcaugugugcgccugugucgggggauccaggcugggacggggggcccgggaggccgcagccccccagacccggcccuggccucagacagucaccucguucuugcuggccgugcgcaggugcuggggcaggugguggcccgggaugaacugcagcugcuccagcgugcccuggcgcuggaagggcggccugcgggccagugugcccccgcccccgccggcgucggacauccaggccggcugcggcgagccgugcagggcguggugguggugggcgugcaggcuggacgguggcggcagcccgcgcagcgguguugggggccccccgggccccagcagcagguuggagugcgaggcggccaggcuggcccgggcgguggggucggggggcagcgcggggcugcgcgggggcgacagcaggugcucgcgacucuggcgcagggccucgggcgaggacagcagcaggugcuccugcgacaccaggcgcgcgcgcggcagcgugaacucguagcgcgaacggccaccaucgcccagcaggugcuccugggacaugacccgccggggguugggcgcgggcgccaggcccagcuccucugggccgccccaggccuccaugcgauagccgccccccgugcccggccgccgcagcgcgugcaggggcagcgugccgcggggcaauuccaggggccggcgcuucagguaggccucguccagauccuucucggcugcggggagagggggaaaagccacagccguggguccccugcgcaucuagagcccucccccucccaccucgucacaucccgcuccuaugcuccuugugcccccacaaggauccugggcaucaggcuagcugugaggccaaaaugcagauucccaggcccagcccacaaugcugggucaguagauguggaggacuuccucuucuucccccccgcgccgccuaucccuucuuuugggaguagaacccaacucuugcuuuuggggaaccacugacccccucucauccuguagcaaugugauucacacuuggaguugugaccuguuagguugugaaguugauuuugcggguagugagcagcauuuugaaaaaugaaaucaaauagaacagaagagaaaacuaucagaaaguguuuauguaauaagggaaucagggguaaguguugguucauaaaauucuuacugcagacgcguguguguguguguggugggugugugguguauaugugguguguguguggugugugugugugguguguggugugugugcgugugugguguauauguggugugugugugugguguguaugugggugugugguuuguguguggugugugugguguguguguaugguguguguguggugugugugugugggugugugguugugugguguguguguauggugugugugugguguauaugugguguguauguggugugugugugguuguguggugugugugugguuguguguguauggugugugugguguguguguauggugugugugugguguguguguggugugggugugugguauggcguguguguguggugugugugguuguguguauggugugugugguguguguguauggugugugguguguguguauggugcguguguguggugugggugugugguuguguggugugugugguguauauguggugugugugguguguguggugugugguguguguaugguguguguggugugugugugcgugugugcaugguguguaugugugugugguguguggugugugugugcguguguguauauguggugugugugguguguguguauauguggugugugugguguguguguauaugugguguguguguauaugugguguguguaugguguguggugugugggugugugugguguguguggaugguguguauggugugugugugguguauaugugguguguguguggguguguggcuguguggugugugugugguguguguguaguguguaugguguguguggugugugugguguguguguauggugugugugugguguguguggugugugugguguauguguauggugugugugugugguguguguguauggugugugugguugugugguguguaugugugugugguguguguaugguguguguguaugugugugugcgugugugcgugugugugguguguaugugugugcgugugugcguguguguauaugugguguguguguauauguggugugugugugggugugugugguguguguguaugguguguaugguguguguguggugugugugugguguauaugugguguguguguguggguguguguugugugugugugugugugauugaaauauuaaaggaugagauuuaguuuaaaagaauccaucaaggucagaugagguggcucacuccuguaaucccagcacuuugggugauugaacaggagggucccuugagcccaggaguucaagaccgaccugggcaauauagugagacuccaucucuacaaaaaaaaaaaaaaaaaaaaaaaaauuagcuaagcaugguggcucaugcuuauagucccaguuacucgggaggcugacgucggaggauugcuugaguccagaaaguugagccugcagugagccaugauuacaccacugcacuccagccugggcaaaagagugagaccuugucucguuaaaaaaaaaaaaaaggauccaccaaaaagugggguggagggaggauagauuaacaaaauguggcuaauuauuaaggcugagugaugggaacaugggacucauuuuauaauuuucucuacucgcauguauguuugcaaauguccguaauaaaaaguuucaaagauuuccuguaauuaaaaauauacacaugugugugugugugugugucucacgggucacaauaugaaaaucguuucugggccgagcacgguggcucacaccuguaaucccagcacuuugggaggccgaggcaggugagucaucugaggucaggaguucgagaccagccugaccaacauggugaaaccccgucucuauuaaaaauacaaaaauuagccaggagugguggcaugugccuguaaucccagcuacucuggagacugaggcaggagaaucgcuugagcccaggaggcagagguugcagugagccgagauggugccauugcacuccagccugggcaacaacagugaaacucugucucaaaaaaacaaaaaacaaaaugaaacaaaacaaaaaacgccgggcauaguggcucacgccuuaaucccagcacuuugggaggccgauguggguggaucacaaggucaggaguuugagaccagccucaccaacauggugaaaccccgucucuacuaaaaauacaaaaauuagccaggugugguggcaugcgccuguaaucccagcuacucagggggcuaaggcaggagaaucacuugaacucggcaggcggagauugcagugagccaagaucaugccacugcucuccagccugagcgacaagagugagacucugucucaaaaaaaaaaaaaaaaaguuucuggcuggguauggugggucacuccuguaaucucagcacuuugagaggacgagguggguggcuuucuugagcccaggaguuugaggccagccugggcaacacagugaaaccccgucucuacaaaaaauacaaaaauuagccaggcauggcagcacgagcucuuaguuccagcuagccaggaggcugacgugggaggaucaugcuugagccuggggagguagaggcugcagugaaugaugaucaugccacuacaucccagccugggugacagagugagacccugucuugaaaacauagugguaauaaagaagaaaaaguguuuccuagugaagcucucaguuuaagauguuugaaggcugcuccacugucagcaaugggccacggacugcagaauguccaaugagagucacaggaauggguucagggaugggcaugugacccagcuugcaccaauggcauccaggccugggauuuuuugccggaauuguugggagagacucuuuucugccagggucccugagcugguagaacggcagccugaacaucugcaggguggucguugccaccacgaggggagacucucugaaaaugaggcccgccgguggcguagagagcuaagagacagcucuugagcccccaaaacagccacaucgcaaucuggugaccuguagauuuuccaugaucaagucaacauguuuuuuuccuuuagcugaaguaguauuucuauuaauugcaaguccaaguccugaugaacaccauaauauguccugggaggggagaccagaagguugcauuaaaaaaaaaucagaagugauucugauacaaaaguaccacagguaauuccagaacgaacuuggaguaaaaccugggagagaagcuaaaccauuggaaggcucuugggccacuguccacgguccugaacccaggcucuggccccgcccccuccccuucaccgccgcgcugcccuugccaggacucacccagccucuugagggaagaguagcgguucagcucggauuucacggcagccucguaggacgggggcagaugcgagagguuguggaaggaccgagagcaggacagcguggaguagugcaaggaggggcugggcggcggcaaggcucgccagucuggguuagagggggcagggccagggucagucagcuuccucccucagacccaggaguccaggcccccagccccugcuccaucagacccaggaguccagaaacccagccccucuuccuucagacccaggagugcaggcccccagccccuccaccucagacccaggaauucaggccucagccccgccucccucagacccaggaguccaggcccccagccccuccucccucagacccaggcguccaggccugcagccccuccucccucagacccaggcguccaggcccccagccccuccucccucagacccaggcguccaggcccccagccccuccucccucagacccaggauccaggcucagcccuccucccucagacccaggcguccaggcccccagccccuccucccucagacccagcaguucuuuggggaguuagaaaucugagauuguagcccaucaguuccagcaguucaggcucccucuucucaccccagccccucugcucaggagacgggcuugaugcuggggaagagggccccaagagggggguacugggcauuugucagcacccacugagugccuggccccaggcuccaucaacaaugugggagagagaugaccacuuuuggcauccacacgaggaaacaggcucacuuggugaccuggccagaccaugagcgccaugaggacugggcucacaggggucucacuccugcucuauacugggcaccuggcauggcuggcccaacacaaagggggaagggaaggaggccugcucuuuuccgcagccgggcccucuuccgcacccaguguggcggcguggugcuuggggcuguugacguugaggugcagguagcuguggugcagauuaucuggggggaccgagaagggagaugaugucacugccaucacugacucccagcuggcaccguggcccugaucucugggaaggacucuggccccaaggucggccccacaugcaggaccucguuagagcuccacagaucaacccaugccauuggccacaugggggaaacugaggcugggggucuugaagguggaaagugugggcacaggcucagggcuggguaaguggucugucccaaguucuuagcaccccccccccuggugcccaggcuagagaucugagggggucgccuugcuaccucccuccaccucccacucauguccacuugguuccuucugacaucugaaucucugcccugauguguccucucccuccuggaucaccaaagcagccucuggccauccagcccauccaucuccaugaucagccucaccgagguaacugcccuuccacugcucaacagccuucccauuggcucaccaucacccacgggacaaaguugaacccaggaaugguguuugaggcuucaaaaccuggacccacuggaugucugcagccccaucucccaucccuucccucaagccgcacugcucucuccagugagcccagcgugguccugccacagggccuuugcacaugccaccaugcuguucucacugccuugaagcccuucuucccaucugccucaagauccagcucagaugucucuucuccucuccaccccugaucccagcuccguccuuguccucuugcugccuggaccaucaucccagccuccuccugggccucuuuccucucaucucugcccuuugcauggguuccagaggaccgguucuaccacccacugcuggcuguguugcuccucugcuggaacuccuccgcagcucuccaucacccucaggacggaggcggaguuccucagcccagccuggcgcucaaggcccucucugaggucaccaaccacccucucccuggccucaagucuggucaccucacaagcucugccaccuggagcuucccagccccaguaacuccucuccuccuccaggccuuugcucaaauaccucucccucggagaagcccuucugacgccucuccuccuccaggccuuugcucaaauaccucucccucggagaagcccuucuaaugccucuccuccuccaggccuuugcucaaauaccucucccuuggagaagcccuucuaacgccucuccuccuccaggccuuugcucaaauaccucccccucggagaagcccuucugcccccaaaccagaccacaucuucucaguuccccugacagcuccuuggaccucuccacugaugcauucaucauaaauuauaauaauauagaucauauuuaaaugauauacaauauuaaauaugauauaucauauuuuaaauauauaauuauauauauuuaacaauagcaacagcccacacuuacauaguauuuuuuucuguguuacacauuauucuaaucaccugccucaccaauucauuugcucuucaccauaaccccaugaagugaguauuguuauguuucuuauuuuauggauggagaaacugaggcccacagaggugaggucacuugccccaggucacacaauggcagagucaggauucaaacccagucggucuggcuccugacaaauucgaauuugguaguugugcccuuguguguaguuggcuguuagguggucugacaccgagcgcaggggcuugagaaugucuaaaccuacaucaccaaggugcccauggagccccacccagggggguccacaggagggcaaggagagggucuggcucucuacggaguuccuagcccccguccgccuuucgcagggcaggacccggcagugcaaggcgggcguagggggugagggcggguccugggcgauggggguggagccgccauggagggcggggcuacaugaugaaggggcguggccagagacggaggcugcgccggaucccacguuccacucaccgagguugggggucuucacgguguuguagagguucuugggcguccuggggggcaugcugucgggaccgccgauccccggggucagggagcugcuucgggcccgguccgggcgggucccaggccccgccugaugucucagaauguccaccagagcucuaaagguggcagagagguggucaaaggccugggggcugaggguggcagggguaccaggaaggcuucuuuccgcucccugcucucgcccuuggguaaucugucacucagccugccuuuuucgccauuggccacgccccuuucucguuggccacgcccccuagaaugacccccuuucucaggccacacuuccugcuugaagcgcugcugccuuaacucguguggaagccaucgcuucuguggucccucucacuucccugugggcucgccccacccugaaucugggaccccauucccguuccuuuugcagccuuccccauggcaacaaagggugcuccauuuacccagugaugcggaccucaaacauuaaaucaccuugacucuucuuucccccaccuucauaccuuucagcaauccuacggaucgaaccuccaaaacauaucccaaaucagaccacuacucaccaccucugcaaucucucaccuggaucauugcaacagcccccucacgggucuccccacucccacccuagccccguacacuccagucucacgcgcagcccgcauaauuuaaaaaauggacagauggcaucacgcccgagcucaggacccugcaguggccccaucacacuuaggauaaacccgggcccgccuacuucuccucaccuccugcugcccaccgccgccagcugcacgggcgcuucccugcccugcaggccaccgagggccuuugcacgcgguuccccugcccaaaaccucucgcccacagaucucugcgugguucgcucccucccuucgggucuccguucagaggccuuuucggaucacuuccucuaauccagcgcccucucucucaacacuuuccgcugauuuucuucacagcagucaucuaaaauuacacugcacaugcuuacggacugggccacugauaguuaaugagcccuuaccgugugccaggacccugcacgaaucaacucaguuaauuacaauccgaauagguggggacgaugauuagucucauugugcggacaggaaacugaggaacagagacguuaagcaacucauccacugucacauagccuguaggcugugaacuuggauuuggaagucaggcuuuuccaccagggcagagaccuuguuuuguucacugguguauccccagcuccuggcccacagaaggugcucaagaaauaugugucgaaugaaugagagucugggcuucucccucucccugcaucacuccgcaacagccgggccggcucuggcgcgacuuucucagccccugcccaccuucagcuacgccggcggccgccaccugggucucugaccaccacgcccuaucccugcagccccuccuccucggauggcuccaccucccuugcugggccccgccccaggcucgcaguccucccgcccgagagcacacgcaccugggcacguugauaucccggugcgcccggggcgcacgggacgccuugcugaaggccacuuuggcgccgacgcccacggccagggcgaagcugaugaccccgcacacgacguaggcugugcugcccccggggcccucgcccccgcggcccccggcacccccaguccggcccccuuccaaccacccggccuggccgggcccuggccccccgccc

SEQ ID NO: 14994 - RNA, 13667 nt, Homo sapiens
gggcggggggccagggcccggccaggccgggugguuggaagggggccggacugggggugccgggggccgcgggggcgagggccccgggggcagcacagccuacgucgugugcggggucaucagcuucgcccuggccgugggcgucggcgccaaaguggccuucagcaaggcgucccgugcgccccgggcgcaccgggauaucaacgugcccaggugcgugugcucucgggcgggaggacugcgagccuggggcggggcccagcaagggagguggagccauccgaggaggaggggcugcagggauagggcgugguggucagagacccagguggcggccgccggcguagcugaaggugggcaggggcugagaaagucgcgccagagccggcccggcuguugcggagugaugcagggagagggagaagcccagacucucauucauucgacacauauuucuugagcaccuucugugggccaggagcuggggauacaccagugaacaaaacaaggucucugcccugguggaaaagccugacuuccaaauccaaguucacagccuacaggcuaugugacaguggaugaguugcuuaacgucucuguuccucaguuuccuguccgcacaaugagacuaaucaucguccccaccuauucggauuguaauuaacugaguugauucgugcaggguccuggcacacgguaagggcucauuaacuaucaguggcccaguccguaagcaugugcaguguaauuuuagaugacugcugugaagaaaaucagcggaaaguguugagagagagggcgcuggauuagaggaagugauccgaaaaggccucugaacggagacccgaagggagggagcgaaccacgcagagaucugugggcgagagguuuugggcaggggaaccgcgugcaaaggcccucgguggccugcagggcagggaagcgcccgugcagcuggcggcggugggcagcaggaggugaggagaaguaggcgggcccggguuuauccuaagugugauggggccacugcaggguccugagcucgggcgugaugccaucuguccauuuuuuaaauuaugcgggcugcgcgugagacuggaguguacggggcuagggugggaguggggagacccgugagggggcuguugcaaugauccaggugagagauugcagagguggugaguaguggucugauuugggauauguuuuggagguucgauccguaggauugcugaaagguaugaaggugggggaaagaagagucaaggugauuuaauguuugagguccgcaucacuggguaaauggagcacccuuuguugccauggggaaggcugcaaaaggaacgggaauggggucccagauucaggguggggcgagcccacagggaagugagagggaccacagaagcgauggcuuccacacgaguuaaggcagcagcgcuucaagcaggaaguguggccugagaaagggggucauucuagggggcguggccaacgagaaaggggcguggccaauggcgaaaaaggcaggcugagugacagauuacccaagggcgagagcagggagcggaaagaagccuuccugguaccccugccacccucagcccccaggccuuugaccaccucucugccaccuuuagagcucugguggacauucugagacaucaggcggggccugggacccgcccggaccgggcccgaagcagcucccugaccccggggaucggcggucccgacagcaugccccccaggacgcccaagaaccucuacaacaccgugaagacccccaaccucggugaguggaacgugggauccggcgcagccuccgucucuggccacgccccuucaucauguagccccgcccuccauggcggcuccacccccaucgcccaggacccgcccucacccccuacgcccgccuugcacugccggguccugcccugcgaaaggcggacgggggcuaggaacuccguagagagccagacccucuccuugcccuccuguggaccccccuggguggggcuccaugggcaccuuggugauguagguuuagacauucucaagccccugcgcucggugucagaccaccuaacagccaacuacacacaagggcacaacuaccaaauucgaauuugucaggagccagaccgacuggguuugaauccugacucugccauugugugaccuggggcaagugaccucaccucugugggccucaguuucuccauccauaaaauaagaaacauaacaauacucacuucaugggguuauggugaagagcaaaugaauuggugaggcaggugauuagaauaauguguaacacagaaaaaaauacuauguaagugugggcuguugcuauuguuaaauauauauaauuauauauuuaaaauaugauauaucauauuuaauauuguauaucauuuaaauaugaucuauauuauuauaauuuaugaugaaugcaucaguggagagguccaaggagcugucaggggaacugagaagauguggucugguuugggggcagaagggcuucuccgagggggagguauuugagcaaaggccuggaggaggagaggcguuagaagggcuucuccaagggagagguauuugagcaaaggccuggaggaggagaggcauuagaagggcuucuccgagggagagguauuugagcaaaggccuggaggaggagaggcgucagaagggcuucuccgagggagagguauuugagcaaaggccuggaggaggagaggaguuacuggggcugggaagcuccagguggcagagcuugugaggugaccagacuugaggccagggagagggugguuggugaccucagagagggccuugagcgccaggcugggcugaggaacuccgccuccguccugagggugauggagagcugcggaggaguuccagcagaggagcaacacagccagcagugggugguagaaccgguccucuggaacccaugcaaagggcagagaugagaggaaagaggcccaggaggaggcugggaugaugguccaggcagcaagaggacaaggacggagcugggaucagggguggagaggagaagagacaucugagcuggaucuugaggcagaugggaagaagggcuucaaggcagugagaacagcaugguggcaugugcaaaggcccuguggcaggaccacgcugggcucacuggagagagcagugcggcuugagggaagggaugggagauggggcugcagacauccaguggguccagguuuugaagccucaaacaccauuccuggguucaacuuugucccgugggugauggugagccaaugggaaggcuguugagcaguggaagggcaguuaccucggugaggcugaucauggagauggaugggcuggauggccagaggcugcuuuggugauccaggagggagaggacacaucagggcagagauucagaugucagaaggaaccaaguggacaugagugggagguggagggagguagcaaggcgacccccucagaucucuagccugggcaccaggggggggggugcuaagaacuugggacagaccacuuacccagcccugagccugugcccacacuuuccaccuucaagacccccagccucaguuucccccauguggccaauggcauggguugaucuguggagcucuaacgagguccugcauguggggccgaccuuggggccagaguccuucccagagaucagggccacggugccagcugggagucagugauggcagugacaucaucucccuucucgguccccccagauaaucugcaccacagcuaccugcaccucaacgucaacagccccaagcaccacgccgccacacugggugcggaagagggcccggcugcggaaaagagcaggccuccuucccuucccccuuuguguugggccagccaugccaggugcccaguauagagcaggagugagaccccugugagcccaguccucauggcgcucauggucuggccaggucaccaagugagccuguuuccucguguggaugccaaaaguggucaucucucucccacauuguugauggagccuggggccaggcacucagugggugcugacaaaugcccaguaccccccucuuggggcccucuuccccagcaucaagcccgucuccugagcagaggggcuggggugagaagagggagccugaacugcuggaacugaugggcuacaaucucagauuucuaacuccccaaagaacugcugggucugagggaggaggggcugggggccuggacgccugggucugagggaggagggcugagccuggauccugggucugagggaggaggggcugggggccuggacgccugggucugagggaggaggggcugggggccuggacgccugggucugagggaggaggggcugcaggccuggacgccugggucugagggaggaggggcugggggccuggacuccugggucugagggaggcggggcugaggccugaauuccugggucugagguggaggggcugggggccugcacuccugggucugaaggaagaggggcuggguuucuggacuccugggucugauggagcaggggcugggggccuggacuccugggucugagggaggaagcugacugacccuggcccugcccccucuaacccagacuggcgagccuugccgccgcccagccccuccuugcacuacuccacgcuguccugcucucgguccuuccacaaccucucgcaucugcccccguccuacgaggcugccgugaaauccgagcugaaccgcuacucuucccucaagaggcugggugaguccuggcaagggcagcgcggcggugaaggggagggggcggggccagagccuggguucaggaccguggacaguggcccaagagccuuccaaugguuuagcuucucucccagguuuuacuccaaguucguucuggaauuaccugugguacuuuuguaucagaaucacuucugauuuuuuuuuaaugcaaccuucuggucuccccucccaggacauauuaugguguucaucaggacuuggacuugcaauuaauagaaauacuacuucagcuaaaggaaaaaaacauguugacuugaucauggaaaaucuacaggucaccagauugcgauguggcuguuuugggggcucaagagcugucucuuagcucucuacgccaccggcgggccucauuuucagagagucuccccucgugguggcaacgaccacccugcagauguucaggcugccguucuaccagcucagggacccuggcagaaaagagucucucccaacaauuccggcaaaaaaucccaggccuggaugccauuggugcaagcugggucacaugcccaucccugaacccauuccugugacucucauuggacauucugcaguccguggcccauugcugacaguggagcagccuucaaacaucuuaaacugagagcuucacuaggaaacacuuuuucuucuuuauuaccacuauguuuucaagacagggucucacucugucacccaggcugggauguaguggcaugaucaucauucacugcagccucuaccuccccaggcucaagcaugauccucccacgucagccuccuggcuagcuggaacuaagagcucgugcugccaugccuggcuaauuuuuguauuuuuuguagagacgggguuucacuguguugcccaggcuggccucaaacuccugggcucaagaaagccacccaccucguccucucaaagugcugagauuacaggagugacccaccauacccagccagaaacuuuuuuuuuuuuuuuuugagacagagucucacucuugucgcucaggcuggagagcaguggcaugaucuuggcucacugcaaucuccgccugccgaguucaagugauucuccugccuuagcccccugaguagcugggauuacaggcgcaugccaccacaccuggcuaauuuuuguauuuuuaguagagacgggguuucaccauguuggugaggcuggucucaaacuccugaccuugugauccacccacaucggccucccaaagugcugggauuaaggcgugagccacuaugcccggcguuuuuuguuuuguuucauuuuguuuuuuguuuuuuugagacagaguuucacuguuguugcccaggcuggagugcaauggcaccaucucggcucacugcaaccucugccuccugggcucaagcgauucuccugccucagucuccagaguagcugggauuacaggcacaugccaccacuccuggcuaauuuuuguauuuuuaauagagacgggguuucaccauguuggucaggcuggucucgaacuccugaccucagaugacucaccugccucggccucccaaagugcugggauuacaggugugagccaccgugcucggcccagaaacgauuuucauauugugacccgugagacacacacacacacacacauguguauauuuuuaauuacaggaaaucuuugaaacuuuuuauuacggacauuugcaaacauacaugcgaguagagaaaauuauaaaaugagucccauguucccaucacucagccuuaauaauuagccacauuuuguuaaucuauccucccuccaccccacuuuuugguggauccuuuuuuuuuuuuuuaacgagacaaggucucacucuuuugcccaggcuggagugcagugguguaaucauggcucacugcaggcucaacuuucuggacucaagcaauccuccgacgucagccucccgaguaacugggacuauaagcaugagccaccaugcuuagcuaauuuuuuuuuuuuuuuuuuuuuuuuuguagagauggagucucacuauauugcccaggucggucuugaacuccugggcucaagggacccuccuguucaaucacccaaagugcugggauuacaggagugagccaccucaucugaccuugauggauucuuuuaaacuaaaucucauccuuuaauauuucaaucacacacacacacacacaacacacacccacacacacacaccacauauacaccacacacacaccacacacacaccauacacaccauacacacacaccacacacacccacacacacaccacauauacacacacaccacauauacacacacgcacacacgcacacacauacacaccacacacacgcacacacgcacacacacauacacacacaccauacacacaccacacacacauacacaccacacaaccacacacaccauacacacacaccacacacacacaccauacacauacaccacacacaccacacacaccacacacacaccauacacacacaccacacacaccacacacaccauacacacuacacacacaccacacacacaccacacagccacacacccacacacacaccacauauacaccacacacacaccauacacaccauccacacacaccacacacacccacacaccacacaccauacacacaccacauauacacacacaccacauauacacacacaccacacacaccacauauacacacacaccacacacaccacauauacacacacgcacacacacaccacacaccacacacacauacacaccaugcacacacgcacacacacaccacacacaccauacacacaccacacaccacacacaccacacacaccacauauacaccacacacaccacacaaccacacacccacaccacacacacgcaccauacacacacaccacacaccauacacacacaccacacacaccauacacacaaccacacacaccacacacacacgccauaccacacacccacaccacacacacaccacacacacaccauacacacacaccacacacaccauacacacacaaccacacacacaccacacaaccacacacacaccacauacacaccacauauacaccacacacacaccauacacacacaccacacaaccacacacccacacacacacaccacacacacaccauacacacacaccacacacaccacacacaaaccacacacccacauacacaccacacacacacaccacauauacaccacacacgcacacacaccacacaccacacacacacaccacacacacaccacauauacaccacacacccaccacacacacacacacgcgucugcaguaagaauuuuaugaaccaacacuuaccccugauucccuuauuacauaaacacuuucugauaguuuucucuucuguucuauuugauuucauuuuucaaaaugcugcucacuacccgcaaaaucaacuucacaaccuaacaggucacaacuccaagugugaaucacauugcuacaggaugagagggggucagugguuccccaaaagcaagaguuggguucuacucccaaaagaagggauaggcggcgcgggggggaagaagaggaaguccuccacaucuacugacccagcauugugggcugggccugggaaucugcauuuuggccucacagcuagccugaugcccaggauccuugugggggcacaaggagcauaggagcgggaugugacgaggugggagggggagggcucuagaugcgcaggggacccacggcuguggcuuuucccccucuccccgcagccgagaaggaucuggacgaggccuaccugaagcgccggccccuggaauugccccgcggcacgcugccccugcacgcgcugcggcggccgggcacggggggcggcuaucgcauggaggccuggggcggcccagaggagcugggccuggcgcccgcgcccaacccccggcgggucaugucccaggagcaccugcugggcgaugguggccguucgcgcuacgaguucacgcugccgcgcgcgcgccuggugucgcaggagcaccugcugcuguccucgcccgaggcccugcgccagagucgcgagcaccugcugucgcccccgcgcagccccgcgcugccccccgaccccaccgcccgggccagccuggccgccucgcacuccaaccugcugcuggggcccggggggcccccaacaccgcugcgcgggcugccgccaccguccagccugcacgcccaccaccaccacgcccugcacggcucgccgcagccggccuggauguccgacgccggcgggggcgggggcacacuggcccgcaggccgcccuuccagcgccagggcacgcuggagcagcugcaguucaucccgggccaccaccugccccagcaccugcgcacggccagcaagaacgaggugacugucugaggccagggccgggucuggggggcugcggccucccgggccccccgucccagccuggaucccccgacacaggcgcacacaugccaggggccuggggcccagaucggcccuuggacaggagugaaagccuccuucugggauguccuggcagacaagauuccuccuccuauuacuucacugcuugagccaaggccuccuucccaugaugucaucccagaggaagaggccggcucaugaggucaucacuagcaaaaaugucuguguucugugaugucaucacagggacaaagccucguucccaugaggucaucacagaggaagaggccggcccgugaggucagcgcuggaggccauguccauguucuaugguguccucagaggcuuccuucuugugguauaauaacagagacgacgccuuguuccaugacauuccuuccuguggugucacugcagagacaaucucaccuggaugaugucaucucuaacuccaaggccucuuuuggcaucaucgccauggggaagauauuuucucccugugucuuugcagcagagaagaugccucuguccuaugaugucaucauuacagacaaagccaucuuccugggacacgucgcaggggaaaaugccucaccgauuguguccucacuagacauaagguccccuuuucacaacaucaucacagggacccugccuccuuccugugaugccaucaccagagaaggugccuugcccuaugacgucaucagagggaccgugccucuuccugugaugucaucaccagagaugaccacccacucugggaccucuccaggaggaggucccuucugugaugucgcccagaugcuaugugcucugagauggcacaaagagaugccuccacugcugccaccauguuguagaaggcagggcaggcccagaguccaggaccaccccagggaagaugccagagagcagagaggggcccuguccugagauguugucugaaggaagcaucgcuggggagccgcccauguggagggccuccuccagagaugauggucuguguaggcuguuggcagugacaccccuacccccaaugcugugauggcaucaccagagcuuccuccucagaggcacugcccacucuggaaggccaucgguauugguggugucaccagaguuacugccuugucccaccaugacuuagcuugguugcucccuccccagacuccagggacauguccagcaggaucucugccagacccucugaggggaaauggggccuuggaucccacaucugugccaugacuccugggagacaggaccuccagauggccuucugcucccaggaggccacucuggaucaccaggauccuggaguucuggcacucauaggugucccauagccuggccucacuuuucuuucugccauaucuagagacaaucaccucugucaacaaaguccuagccuucuacuggggggaggugcuugggguacaccuacucuugcccucacugacacugucagcaucacacaacacccgccacucaugauggcaccacacccggggucaaguguuacccaugucugaggauggaauccuuccccaggauuaccuaugacccacaacuaugguaucaucuucuuccaggauuuaccaugacuaauggugucaccaucugccaagacuccccauagccaauggugucaccauccuccaugauuccucacaaccauggugucaucaucuuucaggagccaccacagcugacggugucaucaucuccuagauuccaccaugaccagugaugacauuaccuuccagaauccacuacaccugacagagacauccucuacugaaauccacuaggacugaugauuccaccauuucccauaaucccucaugauuuuggugucaucaccucccaagacccaugaugcccaauagugucaucaucauuugcagggaugcauggugucaucaucuccagggauccacuucaaccaugugccaccaccucccaggauuucauucaaacaugugccacuaccucccaguauccacuucaacuaugguguuaucaccugccaggauccacgagagccaaugcugucaccauccacuaggauccaccauaacccuggugucaucaucuccugugauccaugagguccagugcugucaccauccacuaggauccaccaugacccuggugucaucaucuccugugauccaugagguccagugcugucaccauccacuaggauccaccauaacccuggugucaucaucucccaggauccaugagguccagugcugucugucaccauccacuaguauccaccauaacccuggugucaucuucucccaggauccaugagguccagugcugucaccauccacuaggauccgccauaacccuggugucaucauccgugauccaugagguccagugcugucaccauccacuaggauccaccauaacccuggugucaucaucucccaggauccaugagguccaguguugucaccaucuacuaggauccaccaugacccugguguuaucaucucccaggauccaugagguccaguguugucaccaucuauuaggauccaccaugacccugguguuaucaucucccaggauccaugagguccagugcugucaccacccacuaggauccaccauaacccuggugucaucccagaguccacugcaaccaugugccaucaucccccaagagccaucaucuuaggagccaaguaccgugacgggcuguauuucaguuguccucuggggccgcaugguacuuacaguuguucacuuaaggggaaccagcacaacaggccauauucccguuuccacuaaaaggacagggguggggccagcugucccccucugaagacuucaccccuacucuggcccuccuuaugucacugccucacuccugaccgaggaugaugccugcaucaaucccaccacagauguggccucagccaaccucaccuuaccccccggugaggcacccaggccccuccugacagcagcgcugucccucacccagccaucugauuggugacagggucaacccagcaaccucucauuaucaccagagaggaagcauuucaacccucaggugacgccacugcccccugcccaaucccugucacuugggccccuaccaggaucagcacuccacuggccccggccaaauucuccucagagaucccugacccccgcgggauaggucaaagcuggugaccgacuggggccuucagugcugucuucugcuggccucauccugcagcagggacacuggagagcaauggucccugccagcacaucugcgggaccaggggugcuccuucaccucccucccuaacaccuuaacacccggggagccuccggggguggcaggaaguccccagcacccaaugcacaaucuucccucaauucucuuuguacauagccauguugcgggggcggccauucccccacucuuaaagggcuacacgccccucccccagccccuagggcgagguggggggggccucuucuuccuccccugggccgucccccucccucuuaugucuccccgcaaacacuggcaccucacacuccuucuugucaggagcuuggggcagacaacuggcccuugguucccaccacacugaggaaauggggguuacccaaauccaccugggcccuggugccaguuuuucaaccccacggcuucuagcugcucugaggggcuccucccaucccuuccagggccuccccagccccgcacugcucaggccaacugugacuuccccagaaaggagccagcuugagcacccacccccucccagcccccuccccucugcucaacaccuccgcggaacacucagcuuucuccagcugccgggauuugggggucugggccuuucagcuuuuuuauccccccuccacuagcucuagcccagccuggauuccagggaucccaccccuagcccugucccuauucaguuggcacaggcugccugacccuggggccuugauuugaucucaaauaagccauagaggagagaggucuugaggggugggagcagguguguacugacaauuccccuccacaugucuugagcugggaccucgucaucugagacuuccccaugccccaacaaaugcaaaugcacacaaacccaugcauacacaagcacacacacacaggcaucuccccgucugguugggggagcaugggagggggcacuucacagggagaagauaaauaguuccacaccugaagacccuccaacagcuucugccucccuccucaucacuuccucucuccacccccucuccaacacuggccccuuccccuaauuaauucccuggugaggacagccagaggagcugcgacuugguauuuuuuggaauaaauagacauuuuccugau

SEQ ID NO: 14995 - RNA, 7871 nt, Homo sapiens
cggggagacucgggucuuuauuagcaagcccagccugcggcacccugccccgccccggcuggcagugagucggggucucugugcggggcgggaggggaaucacugccucuccucaaaacgugugcaccagcuggacugcggguagagucuggacaaucuggauggagggcaggcccugaggggucauaacaccaggcccagcuccugcggggaccacuugcaccaucugggaggcuggagccccggggagccccgcggggcccgaggcugggccugacggcgguggggccaggagcugcagcguggcggugccuccuccaguguugcugcuguccagcagcucaguggcuggggcgcugcggaugaugaggaguuucuguccgggugggccgguggcaggcggcuccgucagcccaggaggaaguguuucuaccuccuguacgcagagucgagucuguucgccaucggccccgcucagcaccagcacgcucugcaagcccucguccgucuggagugucucaaagaggacauccuggaccacaccagugcuggccucgccaucccccgccuccccggggcccgggccagugagcaacuccucagcugccccgcucugaacaaccagcagguugggugccucaguagccacagcucccccacuggaauuggagagcuggccggccacgggcuggagcuggaccguggucaccuccugugcuggcuggagcuggaccgugguuacuuccugugcuggcuggagcuggacuguggucaccuccugcgcuggcuggagcuggaccgugguuacuucuggggcuggucggaggggcuggagcugcaccccacucauuuccuguggcccugccuccccaccccccacauucugcagaacgaugaggcucugcccugucccgcuggccccagcgcuggccgcucccugcaccccuagacccccagggccuggcagccagaccacucccgcccccuggcccgcuuuccccacugcccgcgggcccugccuugcacggccgcccccagccccagcacuggaggagggcagcaggaugagcuugggaggugcgggagggggcggagguguagggggcugcacgcugcuggggaucagcuggaggcccugggcaguuugcaccaggaggaacgucugagaguugggcgcugcuggccccaagcucggggccugggccgugccccccgccaccucgagggagagcguggccuggagguggggcaggacguggacaucuuggguggcuggcggggcccgcgcagcagccaguggagcagggggcugggggccggcggcaggggcuguggugcugggaggcguguuggccggggcgugcguccucaggugccgcugcagauaggcggccauaacgaagccgcgaccgcagauggggcaggugaaggggcgcuccgccgagugcgugcgcuggugcagcagcagguuggaggagugggugaaggucuuggggcagagcgggcagcggaagggccgcucgcccgugugcacgcgcuggugcugccgcagguuggaggucugcgcgaagcucuugccgcagacaccgcaggcguggggccucucgccagugugcacguggcgguggcgacgcaggcacgacguguugcggaaggccuugccacacuccccgcaggcguagggccgcucgccagagugcagccgcaggugguacugguagugggacgaccacuugaaggugaggccgcacuggccacaggugaaggcccgcaggcccgugugcacccgcugguggauggccagcagggaggagcgcuugaaggccuugccgcacucgccacacugguagggccgcucgcccguguggucccgcaggugguagcgcagcccggaggagcccuugaaggacuugccgcacucggcacauuuguagggccgcuccgcagaagcgggggcggacggggguggcggcgggacgggggcggcaggcgccagcgguuccugggggcaggucaccuccgcagccucagccugcgggggcgggcgcccggccgcggccucuuccacguggcacugcugaugcgccaggaggcuggccagcugcgggaaggagccgucgcagcugccgcagcggaacgcuugcccgccggcagccccguggcugugcugguggcgggagagcccagccaccguccggaaggacuugccgcagggcagacaggcaaagccaggcgcgggggcggcggcgggaggagggggcugcggcagaggggacgguggcuggucggccuugggcgccucggcgggugccuccuggggcuggggcgccgcaucgggcccggggcacggcuggugcuccaggagcagcuccucgcugcugaaucccugcucgcagccaucgcagcgguacaccagcuccaccguggucuccgccgccgccaaaaagagcucaggcaccacgggcgggggcgggggcggcggggcgggaggcgcgggcgggcuguggggcuggaggugccgcugcagguaggcgucgcacacgaagaccuugccgggcucccgggacugggggggcggggccgcggaggcgguacccggggcgggggcggcgccgugcgugcgcuggugcagcagcagguuggaggagugggugaaggucuuggggcagagcgggcagcggaagggccgcucgcccgugugcacgcgcuggugcugccgcagguuggugcucugcgugaagcucuucccgcagacuccacagguguagggccgcucgccggugugcacguggcgguggcgccgcaggcuggacgaguucuugaaggccuuggggcaguccgggcacggguaggggcgcucgccugugugcugccuuaagugguacugguagugggacgaccacuugaaggccaggccgcacuggccgcagaugaaggcccgcaggccggugugcacgcuacgguggaucugcagcagagaggagcgcuugaaggccuugggacagucggggcacugguagggccgcucgcccguguggccucgcuggugguagagcagggccgaggagccuuugaaagccuuggggcagucugggcacuuguagggccgcucgccugugugcgugcgcugguggugcaggagccgggacgaccaccggaaugacuugccacacuccccacauucguacugggccgccggggcaggggccgcagggccuggcuucuccccggcccccuccgcaguagaggccggcgccauguccgcgugggagccgaccaucacaccugggggagggauucugggucagcggcucacccccgcacuggaucaucucaaccccaaacccacacacgggcucuuuaagggacagggacuaccuccccaggucacccacuuugcaggggaccuuccuuaggaugagggucuccaauggucccaguuugcuugggacuugagcaggugccagcgaugcugcacuuucagugcugaaauggaaacuccccagcaaacuguggccacccuccuuaggaggcuagccaggucugagaaggcuggggcccgccuucaagagagcaagcacugccuguaggagucugcucccucccucuccagacaggcagggucccugaagaccacacgcagagaggcucuccuggcuccuccuugcugcucucccucuaagaccuuauccuccaucucggccucaacacuccucccacugccauacccuaagccuuuucauuuuaacuaaagccuccucauggggccaggcacuguggcucacgccuguaaucccagcacuuugagaggcugaggcaggcagaucaccugcgaucaggaauuugaaaccagccuggccaacauggucaaacccugucucuauuaaaaauacaaaaauuagcccggcaugguggugggcgccuguaaucccagcuacucaggaggcugaggcgggagaauugcuugaacacaggagguggagguuucagugagccaagaucgugccacugcacuccagccugggugacaagagugaaacuccaucucaaaaaauaauuaaauaaauaaauaauuagcuggacgugguggcaggcaccuguaaucccagcuacuugggaggcugaggcaggagaaucacuugagccugggagguggagguugcaguaagccgagaucacaccacuguacuccagccugggccauagagagagacuccaucucaaaaaaaaaaaaaaggaaaaaaaaaguguccucaugguugagccuggaacaaccuacuucccaacaccacaaagccuucuaggucacucuagcuuggugcuccaacuccccaaauccuuagacuccagcccaucuaccauccagcgcgcccuuucaccuccagccaacccacauccucacuccugcccgacccugcacaaacgcugcagguggccaugacaggcacccccuugccuggccucagucucacuuucccuucaagcccacaaaaucugcggcccccucaccaucacccucccuggcucacacuacaugucucuggcccaugcacuccccaggugacuaccugacaugcuucuuucuccugaaaccuccagccccuccucuccccuccuguucuuggcaggcaacccuguccuugaucaugccucugugaaaauaaaagcaaucagacgcgaaguuucucacauucugaccacgauacuagugguucucaacugggacaaacugugccuucaacccaggggacaucccgcaaugccuggaggcauuugggguuaucuguuaacuagagaggcaagugcuccuggcaucuaguggguggaggccagggaugcugcccaacauccuacaauucacaggacggccccacagcggagaacaaucccauccacaaugucagcagugcgagguccagaaacccugcgcaauccuuccccacaggccugacccagugcccguggacugugccuucccacccacauccuccacuuuuccuccucuccuggacguucccaucugcagaaccaacaaucuaugucucccaucuuuaaaaaccaaaaagcucuucacuccacuucccuguccagcugcagacucguuucuccauuccuucacagcagagcagcucaagugucagcccgcucuuucccagcgcaaaccccuucagucccacgcgggugcccccacuccauggccugggcggcgcguggcccgcaauggcccacuugucacuggguccguggcccgccucccccuggccuccgggauaccucgcucccucacugcccuccgucaccugucaccccaucucaguccccagcuugguuccuucucaccucccugaccucuagaugugggagcgcccggggcuccggcaccacuuuguccucugucuguccucucucccugggagcccccacccacucucaggacuccacugucuaugaacaaugacuccaggccuccagcucuauaagaccuacccucugaaugccacaccaccugcuagacuguuccaccuggaugccucauuagacaccuccaacuuaacaugcccaaaaucuaacuauggucuucugcuccucgcccccaacuucuacuccacccauagcuucuccaucucugaaaauggcagccgucuucuuccucaggccaaaggcuccucgccuccucucucucgauugccccuguccgcagauuccccuuccaggcggaacauauccaagaucuggccacuucucacaggccuccaccuugaucugaggcaccacugucucucucccaggcagcugcaacagccuccccacggaucgccguguuuccacccgugcccugcccacccgucuguucccaauacagcaacugaagcgaacccgucaacagggagggcugggcauugcauuccuguacucagaaaucugccacaguucuggucuucgagccugccgacuuccugcagccuguccccucccugacuuguccuacugcuauccucacuggccaccugccccuggucacucuggucacccaggauggccaggcacgccugcucccaccucagggcaccugccuagaaccacccccuuccuuuccaccugugcccgccacucgcucuuucaccuccgagucuucgcugaaauccccucugcaagagcuucccugacagcccuauuuaaaucuacaaucccuuccaacuccccauucccuuuuccugccuuauuuuucccccgcagcaauuaucaccuucuaauguaccaggauucucagccucagcagugcugagauguggggccagaccauucucuguugagggcuguccugugcacugcagggugucgagcagcagcccuggcccccggccucgacccacuggacgccugacauuggccuaugaagcccuccucuacgcuguccacaaagcucacuccugcaccuccgagucuuagccgcagugucgccccuggggagcaccguugcccccagaugagaaccgcuacuauauaaccagugugcuuucuguuuuauucugccuccccaugcuagaaugucaacgccgggaaaauaggggcuucugucugguucacuguuguaugccaucccagugccuacaauaaugucuggcagagugugugcgcaguaaacaaauuuuaaaugaaugaaggcuaggcauccccgucggacaagcuacaagaacuuguguguuuuuuuuguuuuuuuuuggagacagggucucacucugucaccgaggcuggagugcaguggcgcgaucucggcucacugcaaccuucgccucccggcuucaagcgauucuccugccucagccucccgaguagcugggauuacaggugcacgccaccgcgcccggcuaauuuuuguauuuuuaguagagacgggguuucaccauauugccugggcuggucuugaacuccuggccucaagugauccgcccgccucggccucccaaagugcugggauuacaggcgugagccaccgcgccuagccaagaacuuccuuuuuaaaagauaaguguacccuuuaauauguaagcagguuagaucgcgccacugcacuccagccugggcaacggagcaagacuccgucuccagaaaaaaaaaaaaaaaaaaaaaacaaaccuacugaugcuaagaagcugcacgugccuuugagaagccccagcaucuccuuaaaagagauauccgugcccugaaagagcggggucccauuuaacaagaagacauccccuuuaaaaggccgcgccacacccguucagcaggcuggaccuccccuuuaaggggaugcugccacuggagccccaucuccacuuuuguugagcuaaaccagggaucgcuuugaagcaaccaggacucaggaguuuuugcuucaaugucugggaaacggucacuggccuuuaaugagauaaccgccuuuuaggggaaaaacauuguuuuaagucagaaagcuucuguaaaaaugcaaagccugacccgcccucucaauguggccccuugcccuuuaagagggcggacccggccuagcuggcaaaugucggaggugaaauagugacuccccuuuaagguaccccuuccgguuucacgcccccccccccgccccacccccugcaacuucuccgcccuccggucccuccccccacccccacccccuccggucucucaccugcggccccaaucgggggaacgaggguggcagccccaggaccuucccgcgggggucgacgggaagguggggccccggcagcggcggugcagcuguggggaccggggagggggggcaggggcgcacucccucccaacggcccccggcgcgaggcacccaaccuuuaucggcggccucucgcgcacacaaaccc

SEQ ID NO: 14996 - RNA, 3056 nt, Homo sapiens
gggcaaagucaugguccuagcccccgccugggagcguggagucuuaagucuugcguccugggucgcagauggcuuguucugcauccuggggccagccacuacguagggcucaguuccccuguccugaaaccaaaaaaggccgcaggggucauuauaguggggagguggugacaucagacuccagggagugcuacuuguucacuguaggucgccccgcugccccccucgugugagaaguagggggauccuuaugcggaaggguucugcgaccccgggcgccccguggguggaguggggucccuggggaugggggagucgggcgccaggaugcugagcguggccggcuccucccgcgaaggccccggcacggaugagaauccacgcgcuggcgucgccgcccggcgcucagguugcucagcaacgagggaacguggggcgggagcucgcgcugguccccagcccgccgcccgucuccugccggcuuccgcucccguucuuccccagguccccuuuccccguugcuccuucucuagggauaggagaggucgcuucccggcccuccgcagggucacagcucgguuccucccagcccgcccuccggggagcuuagcaacgguugcuacggcccggagcgggcgccgccccgccccaccgcgcgcggucugacgucacuuccgcccgcgacccccuuccagacccgcucccgaaaccuugucgaaggaccaaaggcgaccggugcaggugcuugcugguccuuguucuuguggcgcgggacggggacgacugugggggagggggcgcuggggaccgggguggagcgagcgugguccguucucuggcauguggggaggguguucguggaccccagugccugggagggagccccgugcugcaguguuggcguccgcagcgcguuugggaguguagaucgcugaauaauacgggggaggggggaucccgggagacuuuagcaaggucgcugaguauuguggggggcgccuguccugccgagauccucgcuugggggccccgaggguucucaguguccugaucugggaagugccguugcugcucccuaccccucgggggagcuuuggggacagaggugccccccugacgcugaccuacuuauguucucaccaggugcacgacgccagcucccuucuggggggccggggccuggggguugccauggcccccagccaccugucagugcgggagaugagggaagaugagaagccccuggugcuggagaugcugaaggugagaggcaggggccccagggggccugggaguggcugcagugggggaauugcaaguggauucagccacccccucccacccaccugagccagccuggaccccuggagcgggaucuuuuccuccugagccucagccgcccugcugcugaaaaccacagcagguguggcaggugggggcucacccccccagcccuacugggaccccagcaccaacgcccucccuggucucccaucuccagucggcugugcacgccagcacaacagccagcucugugccucggaccccaacucuucaaagcacagcccagcaccccaaccuagcccagcagccucccuccagccuccacuccagccugaggcaaccucccuguccuuacuucccuggggccucacugcggcauugcuacugaauugagugcccccacagcuccuaauucacucauccauccaucauucgcucucguucauucauucacuccauacccagugugccacacugaacaucggacugugcugccuucccuucccauuugggagcucucaccccgccccgggcagggucuaccuccucucuuuguccaggaggcccuagcguuucggauggcugagccaccccuccugcccacaggccggcgugaaggacacggaaaaccgcguggcccuccaugccuugacacggccgccggcccugcuccuccuggcggcggccagcagcggccugcgcuuuguccuggcuuccuucgcccuggcccuccuccugccgguguuccuggcuguggccgccgugaagcugggccugcgggcccgauggggcucgcugccuccgccggguggccuggggggccccuggguggccgugcggggcuccggugacgugugugggguccuggcucuggccccuggcacaaaugcaggggacggggcccgggucacccgccugucugucucucgcuggcaccgccgccggggcgugggcaggaggcugcuggccuucgcggaggcccgggcucgggccugggcugggggcaugggggagccccgggcccggcucgugguccccguggcuguggccgccuggggggugggagggaugcuggagggcuguggcuaccaggccgaggggggcuggggcugccugggcuacacgcuggugagggaauucagcaaagaccugugaagcuacagacugacagccagggcaggggaggagggaggggcgccagcaccugaugaucgccuacugucugcggguucuuuuaccugcucucccucagugaguccucaaccacccugggcccagaaacagaggccugccgaggggaggagccuggccucuguccacccgucagcagugugaagucuguuguguuugagcuucucagaguggaaugacuccuuuuccuuccuggcccucgggggccucucgaggucagccucuccaaccccuaccucagcuccugucugcacugagaaaccuccccgggugaugucugcaaagucugugcuguccgugccccaggcugggagagcuaucuggggagggggagaggaggccgagcagaauacaccccagaguuaggguuugcgacuccgccucccugggaccuggauugggucagaugccuguccuuggaggggacaagguugacugcuuaggaggcgcgacgcacagggcugccaggccuggccccucucugggaagguugagagcugagacgggcagcccugucccuuccuccagauccgucugguuuuuuacaccguuuguuaauaaagccugaaaccgcugugugc

SEQ ID NO: 14997 - RNA, 30683 nt, Homo sapiens
ccccugccgccucccugcagccucuuucuuccuccuggcaaagcguccagcccugccugcuccuccucgggccugggcgccuccagcaggcacuucccucccucccucucuccccagcugccuccuccucuucucuccccgcucuccuuccccuuucaccccauccccugcccuggcugcaaccaugagggucuuggccugccuccuuggugagugauccauucuccuuggggacucggggggccuaggcccccaccucugaccccuuagcuuguccaguuuagggacucaaacuuccgggacuggucgcuggugcuccugcauacccugacaucccuucugaggaucccugcucaaucugcccagccuucugccagcccagaagcccaagggaccugcccccugcccgccccccagcccugacccugcgggggaucucccagacaucugaccuuuagccaagcccauguguguguguguguguguguguguguguguguguguguguguugggguauucaagaugaggggccugcgcuggagaaagggccacccccggccugccccucacacugccccacccuccgcccucccuuccagcggcccugguggggauccaggcuguugguaagugcccagacuccucccaucugcccgcccccccccccaggccucccccuucugcccauccaggccuggccucacccccacuggguccccggcccauccgaauuccacugugaccuuggccccagcuccgcaagggaaucccccaggugucuggccgcaucucucugagcacccaggagucugggcccaggggccagugagcagggccacuggccuacagacaguaccugcaggacagccaccugccccuacaguugcccuggccuuggggcccccaggaugccccuccccagucacagccauuccuccaacccucagagcgccugcgccuggccgauggcccccaugggugcgcuggccgccuggaggucuggcauggcgggcgcuggggcaccgugugugaugacggcugggaccugcgcgaugccgccguggccugccggcagcugggcugcggaggggcacuggccgccccgggaggcgccuucuucggggagggggcagggccuguguggcucagcgagcuggcuugccggggcaacgaggggcagcugggccucugccaccaccggggcuggaaggcccacaucugcucccacgaggaggacgcgggcgucgucugcgcaggugaggacacccuggcugcuccuucagggggagcuccuuuggagaugacccaggaaccccaaguccuuagccccagcaagucugaguguucagcaguucagagacacccaaccucccauccccuccaaagccagguggcuaacucccucuuccagggacccaaauggccuggauuccccuccucuccucauagcuucugucccugcccccccgccgcaggucagcguguggcuaacuccagggacgacucaacaucuccccuggauggggcucccuggccagggcuguugcuggagcugagccccagcacggaggagccccuggugacacauggugagcccaggggacugcccugccaacccccacccagcgugcccuccugccccccccgaggggagagggacugcccugccaacccccacccagcgugcccuccugcccccaccgaggggagagggaccucugcaguaugaacucccaggggacacacagcccgcccccugccccgccccgucuccuucauagccuagggaguccuccaucacuucagacccucagagacggaggccugggcccccaggugggaggaaggaugaggggcucagcuccugaccccuggcugucuccacucccagccccccgcccagcugggaacccccagaacgccucccggaagaagagcccccggcccaagcaggccaaguccacccgggccccucugcugacgacaggagccccccgccaagguaagcucccugcaggcucccccgaccccaaggcugguugcugugaggcccagggcccagaaaaacugaggaccugcgggcgcccucuccuuagccggggcccuggagggaucccaguguuccccgcgucccucccccggggauuuagacggccaggccuggucuccccucuucuuccugcccugucaggaggcccagguguccuggcccgcucaggucguggacucaccucuucacgggcugccggcggacagaucucaggccaccgcucccucaggccuguuuccccagguggaaaucgaggaagggguguuugaaucauuucucacuggccacaccguccccucccugcucaccccacagagcggcugcgccuggucucuggcccccacaggugcgccggacgccuggaggucuggcacggcgggcgcuggggcaccguaugugacgauggcugggaccugcgcgacgcugcuguagccugccgggaacugggcugugggggggcgcuggcugcccccggcggugccagauucgggccuggugcagggcccguguggauggacgaugugggguguggaggaggagaacaggcccuccgagacugcccccgaagccccuggggccggagcaacugugaccacagcgaggaugcggggcuggucugcaccgguacgucgggcuggggccuggcccccuccugucuuccucagaccccagcucccucuugccccuccaggaagcugcagcgggccugcucccagcucugccuccugcccgccugcucucugcaugcccagcgcccacucaccacgcucuccagccccuccuuccacagcuccugccguucuccuugccaggaaugggaggagcaggcuugaggcuugggcuagugcucagcccugucccggggccuaggccagugaccguuuguuuaagccucaguuuuccugaaggagcgauggagcuaagaaugccugccucaggcuugagccaaguccuggaacgcaagaagcccugccugcccucugccaccgggcuggccauggcaggggaccgucucggagaccucuugucucuguggccaaccucugcuccuuccccauccucaagggagcuggugggaaggagggagggagggcggugacuugggggcauggagggagacugaggcaggguggggacacccacgggugagccuccaucuccccucauucacgcccccucagcgcggggucuccuccccucaugucucccagggggucccuccccucuccuguaccccuuggaccugggauagaacccagcaaacagcgguugggggguguuaggugagagcucaggggcucccucccuccuucucuccuuccuuccuuccucccucuuucccuuucucuuuccuuucuuuccuuccacaaaucuuuacacaccaccacggcaggccccacccugcuggacugcccgauccauugacuguaggaggccggcaggcagagggcacccaccuggcauuucaucagcguugggguggggacaguacacgggcugcaggcaaagcugggugccugcccaggauggguaggaaaugcugacaucaguggguauccaggggggagagaagagagaaagaggcugacccuagucucugcuguaugcugggcccugcgcugugcacguuaccuggggccgcucugagccucccgcagcccggacgggguggauccucaucccucucuucacagauguggggccgaggcucagagaggugacguaaauggcccaagacccaggugccuagcaagcuccagccccagccgcugaccccucugggucuguauagacccacgcuccaugccugucccacugcacagucggccauagggacgugguggggacacggaggucagagugggagugagcagcagagaaggcuuguaugggguggggguggugccuucgugugccuaguguacaagcugugggggaagaagugggaccuucggagcagaguucauuggagggaaguugaggcucuggagaggagagggugaaggugccaagaaaggaaacaaaugaacuaaggcgcccggugaagcugggagcuucgccagcaucugauuuaauucucauggcaaccccgggagggagacgcuccccuccccugucugcagaugaggaaaagcagacagguguguuagacuccucccuaguucugugcucuucucuagaacagugauugggggcaauucugcaccugccucguugggggacagagagagggacuccagaguccuccaaugaugagucaacucuuaccccaacagaaauguacccgaagagccaggcaugguuacaggcuaacaccuguagcccacgugcuuugggaggauuucuugaggccaggaguucaagaccagucugggcaacauagugagacccuuucccuacaaaauauaaaauaaaaaaaaaauagcagggcaugguggcgcaugccuguagucccagcuacuugggagaggcugaggcggggaggauuccuuggguccaggaggucgagacugcagugagccaagauugcaccauugcacuccagccugggugacauagugagauccccuccccccaaaaauaaaaaaaugaaauguacccuauguauccuaaggccagcgagagguuaauaucuagacuaguggcucucagcuggcaagggagugagggcuuucucauccccuuccuccccaaaggacaucaggcaaugucuggagacguuuuugguugucgcagcuagggggagggguugccacuggcaugugguggguagaggaugcagugcaggacaguugccacgauaaaggaggaugcccaaugccaguggugcugagacuuggaaauccggcucucuaggauccgaggggccaggcaugggagguggauccaggggaccagagccagagcucccagcguccccagcccccaccgccccaaggcaagggauaugggggaugcgccagaguuggacuccgggccagugacuuccugucuuggaaccuuuuccucauuuggauagugaagauggaauauuugcuucccagagucaucuugggguugcagccugccugagcauagcuuaguccccgcucauccacccucguuuccuggcccugugcucccucucccacuauccaggcccagcaccucggcugcgccuggccgauggcccccacgggugcgccggccgccuggaggucuggcacgggggucgcugggggucggugugugacgacgccugggaccugcgagacgccgcuguggccugccgagagcugggcugcggaggggcgcuggccgcccccgggggcgccuucuuuggggaggggucuggacccaucauccuggacgaccuucggugucggggaaacgagacggccuuacgauucugcccagcucggcccuggggccagcaugacugucaccaccgcgaggacgccggggccgugugugacggugaggggguugugguggaggaccgggaggugggcgugguggugcuuggagcggaggggcaaguucggcgggggcgggggggucccuacgcgcccuuccugcccucucuccggacuuuccacucccccaucuuauuccccucugaauccucacccugcgucacugguucucagcuggggguggcuuugcccccaaggggacauuggacaguguuuggaaacauuuuugauggucacagcugggggugggggugcuccuggcacccagggguuagaggccagggguguugcuuaggauccugcagugcacaggccgccuccacagcugagaacaguccagccccaaauggaaacagaggcgaggaugagccucagccccguggcagcccuggcuggcccugccuccuggcccccggcggaagccagccuucuccucugcauaaggucaccccccgcuucucugccaccccuaagcuaccaugcccucugcucucucuguucccgugcuccgcauucacaccccucuccccaggucagggauguggaaagcgugggcugugucuagggaggagguucggcaggaagagaucucugcgugcagcugagaggacugaggaaggaugacgcaggaggugggggugccggcuccgggauggaggguguguguggguggcaaucacuuacccccugcuccacaggcaugccccugggcuacgucccucccacggcccccacggacagcaacaacuccacgcccagggaggcugccuccaggcccccguccaccaugacgagccaggcuccagggacggcaggcguuucaccuccuccagccuccccuacuguccuuugggagccuggaccggaagccggugagucccuccaugcuccccaagaaaacaggguccuuccuucuguuuccuucccucagcucugagacugucucauggggggccucuugcaaagagaaagguggagaagaggagcacaggggccucgcccaggacacugagcuggguucaaugcucugcuguugcgucugggagcgugugauaauucuugaacaagggguccuaacuuucgucauuuaccaagcccccaaaauucuguagccaguccuggauaagagaaaggaugcugggcugagagucugcucuauucccaagcugcacgguguggcuguaggauccaucaugggguacucaggccagcuucaaggaacagcccugcucaaacauuaccuuuacuuuccagagucucugguucuuuagcaaaugugaucaaugguucugccugccuccuuucauauauauauauauauauuuuuuuuuuuuuuuuuuuuuuuuuuugagaguggauuuaauucugucacucaggcuggaaugcaguggugugaucauggcucacugaagccucaaccucucaaccugcaggcucaagugauccucccaccucagcuucccaaguagcugggacuacuaauuuuuuguauuuuuuuuuuuugcagagaugggguuugccauguugccuaggcuggucuugaacuccugaucccaaaccaucugccugccucggccucccaaagugcugggauuagaggcgugagccaccgugccuggucucuuucaugaguauugaaaggacuguuguuuuaaaauauagguguuauuauuacugagguauggugaggccaggaucucaggagaugacagccacuaaaaagauugugacugacgguucucaagaggauggcgugccacacggggccacacagggaagcaccagggccaggcaggagguagacggagugagggggaagcauggcaggaaucuuuuauacauuuauuuagagacagggucucacuugguugcccaggcuggagugcagugguguaaucacagcucccugcagucucaaacugcugggcucaagugauccucccaccuccgccuccuggguaacacagcugcaugccaccgagccuggcuauuuuuuuuuuuuuuuuuuuuuuguagagacagggccucacuauuguccagguuggucucaaacuccuggccuuaggugauccuccugucuuggccucccuaagugcugggauuauaggcgugagccacccggccaggugcaggggucuuucuuguguuuuuugcaggaaggaauaggugagacagguugagcaggcuuagaacuggcugguuugaagaauuucaguggggccgguggggaggguggcgacucagaggguuguccuuagucaucugguacuuggcccuggggcaaugaggacaggugcagaauggcccagggugugagagcccaguggagagggugguuugcacacgaaaggcaugcucaagccauuuaccaucucuaggaauuagcuaacccugggaggggcagucccucaggaucaggaaugcuccaagaugucaaagcaucagaaauacagaaaauaaaaaggcgugguuaacacagcugucuccucaagaugggaaaaggccgaacaaaagcagcaacuuauuuucaccaugaucaccauucccagaggucucguuccccuuuuccugaauaauaauaucagcuaacacugaacgagcaugcacuggcuccuggugacugaugcuguucccaguucucuccgugucucaguccaggugaugcuuacagccacugugguguggauacugauaggucuccauguuacagaugaggcagcaccgcugagaaaugggagagccaggauucaagcaaaaacacuuguuccagggcgcacguucuuuaaaaaacaauugugauaaaacauacaugacauaaaguuuaccauuuuuaccagucuuuuuuuuuuuuuuuuuuuaaacagggucucgcucugucacccaggcuggagugcaguggcacgaucuuggcucacugcaaccuccgccucccgguucaagcgauucuccugccucagccuccggaguagcugggauuacaggcugagccacugcaccuggcccaugccuggcuaauuuuuguauuuuuaguagagacagaguuucuccacguuggccaggcuggucucaaacuccugaccucaggugaucugcccgccugggccucccacagugcuggaauuaacaggugggagccaccgugccgggccugcugcucccugucuuuuaaaggacuuccucugagaagccuucuccagcuuccucaggcagaauuuuucucaccuucuccucguugugugucugccuugcccuuuggguacuuccacuacucccuuuagcucgcugagcuguaaugaagugugugcaugcuacuuucccugaagaccgagagcuuuucaaagcagaggcugugccugacucauaaacaacaacaaaacaccuuauuaucccugguggucuagugguuaggaaaauaaaaucuaagaaagaagaaaaaaacccuuauuaaaccaauaauaaugagagaaaauuaaggguggugaacaacugcauggaaaaagacuuauuuuaauugaggugacauucauguaacauaaaguuaaccaguuuaaguauacaacuuaagugguauuuauacauucaaaaugcuguacaaccacuacuauuuggcuacugugaauggugcugcuaugaacauucacauacugguaucugugugaauaccuguuuucaguuuauucuggguauaucccuaguagcagacuuucuagauuauaugguaauuugauguguagcuuuuugaggauccuccaaacucugccugacucauuaucccucaugccuaaugcagaaaauggcacaaaaaaggccucaugaaauacuugcugccuggaggaaaggauggaugaauggagggaaggccuagauggaugaguggaaaggaagauggggggagggaaagguggaugaagagucaggaggcugggcggcuuccccgacucuaauucuuugggucucuucuaccccaggguccccccagcugcgccugguggcugggcccagcaagugcucaggucgacuggagguguggcaugaccagcgcugggggaccgugugugacgauagcugggacaugcgggauucagcuguggucugccgggagcugggcugugguggaccucagcagccagacccugcugcuggccgcuuuggcuggggugcgggccccaucuggcuagaugaugugggcuguguggggaccgaggcuucacuguccgacugcccugcugcucccuggggaaagcacaacugcgcucacaaugaggauguuggggucaccugcacugguaaggaggcccuagcuaucuguugacuccaggagggcuuccuggaggggaacaguaacuaacaugggcacuaacauugauugagugcuuccuaagccccagcccugugcuggguguuuuugcacauauaaccacauugaaaucacauaauaagucuagggugguguguguuaugcccauuuuacugauaaagaagcugaggcacagagagguuggguaacuugcucaagaucacacagcaacaacuaacuggcagaucugggauucccacucagagaagcuucugcuuccucuuccuuccaggaaucaaggaaauuucccacuaagaaaggagcuuuagcuuuccuacgaugaaaggaagcaggcagggcacugggagauggaaagaagccaaagugagagccaguuaacauaaacucaggcaaugccuguuauuaaauugcagaggcugagccaggugcaggguccucaugcugggcucaugaauggaaugaacauggucuuggucuuugaauagcucacagcucauguagagaaauacucuaacaaaucauugcaaaccugugugacucguuauaguuugagguuaccaagaccacugucagacucaauaauuugcuagaagaacucuuagaaucaaagaaucuguuacacucagcguuaucguuuaucacagugaaaggauacagauuaaaaucagccaagggaagaggcgccugaggcagggcucaggagacaguaggugugagcuuccaacuguccugucccaguggaguuaugcagacagcacuucauuaucccagcaacgaagugggacaacacacaugaggaacugccaacuagggaaguucccccaagccuuggcauccagaguguucguggggacuuggccacguacauguggcugaccauaaaucacacuguuagcauaggcgaucuggcauggcccaagugccccagggaaaaaaaucucuuaucaggcaagguguuccaaaggcuucgaagucaucucccaggagccggggaaaaggcgaaaccuuucuuugggcaggguuaauccuuuacugcacacgugugcuaaucagaaagauggaagauggagaguggugucucaaaggauggaggcaucaccucugcuggaagcuacggcucuucccucuguccccgucuuccugagggccacgggggcaccacagaaggauucugaguucgggaguggccugucggaccuggguaccccacugguggucaguaagaauugacagggagguagggagaccugucagaagguauaggaaaugaggcccugacucagagcagaagcugaggagauggagaggagaggucaggugugaaagggugagggggucaguuauguccagauuguaaaugccaagaaggcgggggcagugucggguuuggcuugccauaggcuacccgagggucuaauaugguguguggcucauaggaggugcucaauaaauauuugugacaauaaaugaaugaaugaugaaugaaugggaacugggugagugacuggagagaaggaggggccuggguagaugaucuugucaucauggugucucugucuucucuuccugccccacucaccuuccagggcccccaggccuggacuccaucucagaccccuucagcuggagcuggauuccuggacuggggagagaucgggaugccuggcucccgggagagcuggccaccaagcccucugcaagugugacugccaguguucuggagaaaacaaccacgaaggccccagggaaaaugccuaagaguacuaagaagugggugacaaaaaaugcaaagagaccaaccacucaacccccagugaugccaaccacgaaacacuccagggcccaaagccccccagaccuaaccucacagaccacugcagcacugaccacugaggccucccgaagaccuaccucugaguuuaccagaaggccgaccacggaggccccccagagauggaccucucacaccacugccacgcugaccccucaggccccccgagaacggaccacuaagaccauggcaaugcugaccacucaaggcccccaagaaaugaccucugaguccacuaucaagaguaucccucaggccucccuggagccaucugcugagaucccagaagggucuccagagucacccaaagacccggcccccucucccaguguuagcaccacuggggaaucaggugaguggccgugagggguguggggagagaaugggagaggcugacccucccuccugaccuaagggccuuccacgcaggccuguuccggguucgucuggccgaugggcccaaccgcugugcuggccggcuggaaguguggcaugccggacgcuggggaacagugugugaugacaacugggaccugcgggacgccacuguggccugcugggaacugggcuguggaaagguccggccucgaguaggcaaaacccauuacggcccugggacugggcccaucuggcuggaugacaugggcuguaagggaagcgaggccucacugagcgacugccccucgggggcuugggggaagcacaacugugaccacgaggaagacguggggcucaccugcacugguaccagggcauggcggcgguggugggguugucggggguggccaggagaauggagucaggguggggccaggugacggcaccauggucgacucuaaagaacuggguaugaggggucgggguggggagaucccagaguugcuccagaagauuccaaaaggggagggaagagcagcagcaaggaccucugagaaagaggauggggucaaccauuaccccaauuucuccaaaggcuacacagacuaugacgauuauccccccuggaccugggaccccaccucaagagaggaccuggccaaggggacuaccacagcggggguaccuggacacacucuccccuggaggaccacccggcgcccggguagcuccuccccagcaauaaggcgccugccggacacaggugagaggccugauugggguggccauggagggccuccauaaaccuccauucgcuucccugcaggguuuccagaaagacccuucucaaugagcuggcugaggccucggggcacccuggaaagguuuuccuuggcuccugagacccuaaacgcauuaccuccuugggcucaauggugacacuucuucagagccaaggacaccaucuaagagaucaggcuaagcucagcaauccugagcccauggcccuccuguaagccacacaauaugcaagccuggggcccucagucaaacccacaaccaagggccauucugucaucacaucaucguccccaccccagcucccccagagcaagcgaaaccucacccauucuugaagcucacgcucugguccgggccugguauggcucagagguggggacuccuggagugcagcuucucuccuuacccuggccauccccucccucuggccagcagaaucagccuccagggccacagcuccaucccccucugcucuauggccucugucuugcugcugcagcuccuuccacaccugggaccacgccccgcuuuggcccccacaucacugucaccacauucuucugccuuuuucuuugccugucuuccuuguauccccaucucucaggaucccugcgaauccaucucugcuccuguuucucacuugcuguuggucucuuuuuuucauuauccauuucucacccucaucaucucuaucucuguauugcccaggauggagugcaguggugugaucucagcucacugcagccuugacugcccgggcccaagcgauccuccugccucagcuuccugaaaaggugggacuacagaugugcgccaccacacccggcucauuuuuaauuuuuguagagacgggcucacuauguugcccaggcuggucucaaacuccugagcucaggcgauccuccugucucacucucucaaagugcugggcuuaugucuggguuuauaagugugagccaccaugccuggccucacuucauuuuccaugaucaaauucucuaucuuuucuucucugugccaaucucuuuuugccuuucauuuucaauuucucacacucgucuuuaugccguauuuuuuucaugguaauuucuuuugcucucucucaccaucuuucucauuuuuuuucuuucguugucaguuucauauucccaucauuucuuuuucccugucuuucuuuuucaauuucucacccucauuacaucuauuucucacuccaguuuucguggucaguuucucuuuauuuuuuucucccuuguccuucugucuuuuuguuucauuaucagucucacacucucaucucuguuucucaccuaguuuuuccuggucaauuuaucugucuuucccccucagucuuucacuuuucuuucagaucucaccuucaccaccucuguuucucacuccauuuuucaugguaaauuucucucucucuuuuuugagacaggaucuugcucuguugcccaggcugaagugcaguggugcgaucucaguucacugcagccuugaacucccaggcucaggugauccuccgaccucagccuccugaauagcugggauuacagaugcacaccaccaugccuggcuaauuuuuuuuuuugagacagagucuugcuguguugcccaggcuggagugcaguggcguggucucggcucacugcaaccuccaccucccggguucaagugauucuccugccucagccuccugaauagcugggauuacaggcgugugccaccacucccggcuaauuuuuguauuuuuaguagagacggguuucaccauguuggccaggcuggucucaaauuccugaccucgugauccgccugccucggccucccaaagugcugggauuacaggggugagccacugcucccggccugauuuuuugucgagauggguucucacuauguugcccaggcuggucucaaacucuugggcucaagucaucggcuugcugcggccucccaaagugcuggaauugcaggcgggagccacugggcccaaacuguuucuguaucuuccguccucucgucuuucacuuucaguucucagcuucgccaccugcuucucacucgauuuuucacggucgguuuugcuauaucaccucauacucucaucgucuccauuucucacugcguucucuccccaggcccagcgcugugguaucuuuuccuuugucucuuacgguuguuuucugagucuccaucucccgcgccuucccugcagucucccgcgugcucucuucucucucccccucguuucucucauggucagcccccuucccuccguuucugucucccgcgggcuccucuguccguuucucaccguccccgccgcccucgccgcucccucacgggagguuucacuccccaccuaaggggcagcguuucuguccucccucugugcccgucgcagucgcuguuucuccgucuucucccucccuuccacucucccgcccugcucgccgucuggggcugccuggguuucugccucugucgccccgcgccccguaccugugcccuccugagaggcccaagccucccgcucccgcaggagagucucgccgcaagcguccuuucccgccuuuuuuuuuucuggcgcucagcacgcaugcgcaggcgcggugggcccgggaauggagggacgggauggggcaggcguucaucugccucgcaccucgugacgucacaggcgcgcugcgccuccugauuggccagccggcgcaucgcccgcaguaauaauagcugggcgaagggcaaccaggccccaagaagcgggccuugagguggggaaagggagggaggaagcaggcccuagaggcgccgugacuugggggugggugggcuccagcugugaguuagagcuaucauuccguuuccagagccggaagcgggagcuccgagaggugaugcuccucguucaaggacugccaggguugcagcgccucccuagcccauagcgcccccucgugguggaggcgggcacgugccgggcacagcggcugcggagacagcggguccggccucgggaccccucccguaggguagggaggcagccaaugagcagaaauaaaugcagaaucacaaacugcgccggugaaaugaaaagacagccaugugugccaccuuaucaauaggaagacuuggaggcguaugcgggguggagugggagacgaggcaggcaugcauucuuagcuucaggagcaauguaaccuugaaaaagugacuuggucucuuugaguccccguuucuuauuuauauuguuuuauuuauuuauuauuuauugagacggagucucgcucugucacccacgcuggagugcaguggcgcuaucucagcucacugcaaccucugccucccagguuuaaacgauucuccugcugcagccuccuguguagcugggauuacaggcgcacgccaccacaccgggcuaauuuuuguauuuuuaguagagacgggguuucaccauguuggccaggcuggucucaaagccgaccucgugauccacucgccuuggccucccgaagugcugagauuacaggugugagccaccgcgcccggccaccuguuucuuucucuggaaaaaaaauggggcgccaggguuguuggaaagguggaacgagagcucaccuagucugugcugggcaugcaugaccccaacuucaggccauagaaacuguugcuacaccuguguuucagaugggguaaaaagugaggcucagagaaguuuaacuuaggagccacgauuauaaccuguuuuaagugauuucacacguuuugcuccuuggauugggaaccauaugcuaaaauagaagcacgagucuggaguccgacucuccuaccagguuccaaucgugguuccaacccggauuagaacuaguugggugacugcaggccccaauucaaugaacaaaaugugugugaaaucguuuaaaaccgcagaauauuguuuguuaggguuauuugcugaaaacgaacaacagcugcaggauuucagggaacgagcgauuauuuguaguagagaaaucaaggaaaccucacaggggagaugauauuauuucaucagcaggccacaaggagaaaugaauucucagagaagcaaagggugggagaaauuugcauugccagaaauuuucaucgguguuauccaucucugcuagacuuuaagcucugugaaagaucuguaucuauuucaauugcugccauaauacaucgccacaaauuuagugguuuaaaacaacgcagacuuauuauuuugcaguuuuguaggucagaagucagacuugcuuagugggcuaagaucaaggcgccagcagggugguucccuuuggaaggcucuaggggagaauccauuucccugccuuuuccagcuucuagaggccaccuacauuccuuggcuuguggcuccaucccccaucaucaaagccagcaacauugcaucucucugaccuuuccucugccuucguauuuuucucucucacuguggcuugaaagguucucugauuuuauuuauuuauuuaugagacagagucucacucugucgcccaggcuggagugcagugguaugaucucggcucacugcagccucugcugcccagguucaagcaauucuuaugccucagccuccugaguagcugggauuacaggcgugugccaccacucccggcuaauuuuuguauuuuuaguagagaugggguuucaccauguuggccaggcuggucuugaacuccugaccucaggugauccacccgccuuggucacccaaaguggugggauuacaggcgugagccacggcacccagccaguucucugaguuuaaggacuuagauuggggccacuuggcuaaucaggauaauuucuccauuucaaggucuggacccuuaauuacauccacaaguccccuuuugccacguaaaguaacauauucacaguuucuguggauuggggcacacacaucuuugggcgaggggcauauuaucuugucuaucauggaucuaucuggaaucccuagugucuagggcagugcuugaaacucaguaguuaauuuuuauguuauuuguuaaaugaaugaacaaaugagagaugacauuguaagucuaagagacacuggagaugagauuggaggccuguggaauuuggauuuuuuuuuuuuuuuuuuuuuuuuuuuuuuuuuuuuuuugagacggagucucgcucugucgcccaggcuggagugcaguggcgugaucuugucucacugccagcucugccucccggguucacaccauucuccugccucagcuucccgaguagcugggacuacaggcgcccaccacuaugcccggcuaauuuuuuguauuuuuaguagagacgggguuucacuguguuagccaggauggucucgaucuccugaccucgugaucugccugccucggccucccaaagugcugggauuacaggcgugagccaccgcgcccggccggaguuuggauuuuuauggagcagcauuucuucaggcuuccuggaugauggaguuuggagauacaaacgucaguucaugugucaaaugccuacugugugacagagcauguacuaacuacugggagguaguguuagggagcaaagcaggggaaggggcaggggagacugaggguugcaguuuaaaauaggauggccaggugugguggcucaugucuguaaucccagcacuuagggaggcugaggcagagggaucgcuugaacccaggaguucaagaccagccuggccaacauggcgaaacccugucucuacuaaaaauacaaaaaaauuagccugguguggcggugcaugccuauaaucccagcuccucgggaggcugaggcaggagaaucgcuugaaccugggaggcggaggccacagcgagccaagauugugccacuguacuccagccugggugacagagacugucucgaaaaaaauaaauaaauaaaaauaaaauaaaaaauucaccaagcaggggcgugcuccuguaguuccagcuacccgggagguugaggcagaagaaucacuugggcccuggagguugaggcuguaguaagccauggucaagccacugcacugcagccuggaugagugagaccccgucucaaaaaaaaaaaaaaaaaaaaaaaggaugguuaagagacauuuuacgggccgggcgcggugccucacucuagucccagcacuuuggcaggcugaggcagguggaucaccugaggucaggaguuccagaccagccuggccaacauggugaaaucccgucucuacuaaaaaugcaaacaauuagccgggugugguggugcaugccuauaaucccagcuacucgggaggcugaggcaggagaauccuuuaaacccaggaggcggagguugcagugagccgagaucccgccacugcacuccagccugggugacagagcgagacuccgucucaaaaaaaaaaaaaaaaaaaaaaagaaaaaaagagacaucuuacuaagaaggugccauuuaagugagaaggcccugaggcccugaggugggugcaugcucugcugguucaagaaauagcaacaagguggaugggacuagagcggaguguuggguggaaacgguggcagcgggggagauggggaauggacuguaggggccagcguggaugcagggagcccgggagguccaggggagagugacaauggcucugaucaggguggcaguggagaccaagggagauguggauguauucaagccauauucugggguuugagcugauggagcugagugauggguuggggacagugaggagagggaggcagggaacggguaccuuuuaccaggucggggagcucugugaggugggggcacagcagccagaguggggauaucaggagauauuagcugugcauccuggagguccagggagcgccugggcugaggauauaacuuagcgagauggaauuugaagcugugggaguggaugugacugcacagauagacagcugugucuaauguaguucccgccacugccagcugggaagccggggagacccgugcuugggguaucgccggagguuuaucacccuaugaggucaugcagggagaagaggauccaggacuaaauaugagauuaacuuuagagguuggaugaugaugaggauaaugguagcugcuauuuuaucgcgugcucuccaugggccaggcgcuguucaaagugcauccugugguuacacucccuuccuccccaugcagccuugugaggugaguccuauccuuagcuugauuuuacagauaaggaaacugagguagggagaggucaggauugcaaaaggcugaacuuggauucagacuccagauuccacacccuugcuggcucuagccuuggagagugggaaggacagaauuaggucuguagaauccagggcgcaugcagcagggauggccucauccacaggggauggggggaggccuccugagggcauggccuguggacuaacuccuauacagcagggauggccucauccacaggggauggggggaggccuccugagggcauggccuguggacuaacuccuauacagcagggauggccucauccacaggggaugggggaggccuccugagggcauggccuguggacuaacuccuauacagcagggauggccucauccacaggggauggggggaggccuccugagggcauggccuguggacuaacuccuauacagcagggauggccucauccacaggggaugggggaggccuccugagggcauggccuguggacuaacuccuaaaggaugaauaaaggcuugccagggaaggaaggggugagacuugggagauauguacccagagggaaagagaaccauuuagaaccagguagaucugcuggggucuggagcuggaugcugucccuuagcuguguuaccccaagaaaguuucuugcccucucugggcaucaguuuggccaucuuugugaaucagcagccuccccagccacccucuccccauaagaccagcaaaaaugacaccgucuggcagcaugaaggcuguaggauaaaggugugagugaggauccccaugcacuuaguggggcagguucgcaguaucuaaggagauacaucugcuuccauacagcaauuccacaacgaggcgucgagaaauucucgcccaugagccuaaggacaugggcacaaagaguucacugaagccauauuugugacagcaaaacacugggaguaaccgaaaugcccaucaacaggagcauagauuaauacccagcuguauauccaugcaaucgaguaguacguagagguucacagaaugagccagaguuauguguaucuuuuuauucuuuuuuuuuuuuccaagacggagucucacgccuguaaucccagcacuuugagaggcugaggcaggcagaucaccugaagccaggaguucgagaccagccuggccaacaugguuaaacacugucucuacuuaaaauacaaaaaaauuagcugggcaugguggcaggcgccuguaaucccagcuacuagggaggccaaggcaggagaauggcuugaaacugggaggcggaggcugcagugagccgagaucuugccauugcacugcaacaagagcgaaacucugucucaaaaaaaaaaaaaaaaaaaaaagagaaaaagaaaaaaaaaagaaagaaauacgcguaugagaaugagaaaccagauuuccgacagugcauucugagaguacacaggaggcugccauuuuaaaaggaagacggcuucaauuuguguucuuuuuuuuuuguuuuuuugugacagggucuugcucugucacccaggcuggggugcaguggcaugaucacagcucacugcaaccuccgccuccaaggcucaagugauucucaugccucagccccccaguuaacugggacuacuggugugccccaccacaccuggcuaauuuuuguaauuuuuaguagagacgggguuucaacauguuggccaggcugguucugaacuccugggcucaacugauccaccugccuuggccucccaaagugcugggauuacaggcgugagccgccgugcccagcuugauuuguguucuucauggagucuuccuaaaacccaacaucuugaaaauacaucuuuuugguuuuuuuagauggaauuuugcucuuguugcccaggcuugagugcagugacaugaucuuggcucacugcaacuuccgccucccagguucaagugauuuuccugccucagcuuccugaguagcugggauuacaggcauguuccaccacgccuggcuaauuuuuguauuuuuaguagagaugggguuucaccauguuggucaggcuagucucaaacuccugaccucgugauccgcccaccucagccuccuaaaaugcugggauuacaggcgugagccaccaugcccagcugaaaauauaucuuuagugauucacugcuaauggguuuuuuucccuggacuauuuuuucuuuuuucuuuuuuaauuaauaguaccacuaauggugguguuuuuguuuuuguuucuugguuugcuuuuauguuuguuugcuuguuuguuuuugagaaggagucucacucuaugguccaggcuggaguacaguggugugagcucagcucacugcaaccucuccuucauggguucaggcgauucucccgccucagccuccugaguagcugggauuacaggugcccgccaccaugcccagcuaauuuuuguauuuuucguagagacaggguuucaccauguuggccaggcuggucuugaacuccugaccucaggugaucugccugccucggccucucaaagugcugggauuacaggcgugagccaccacacccggccauuaccacuaaugguuuuucagguuuccuaauggguauggauaucugguaggauuuuauagcuacccuuuuaaggugucuaauagaaauggaaagguauuugauuaagaaugguuaauaauacgaaggcaugacggaggugucugcugugccuggcaucagggugaaauuugacccuuguucuaucagcgugcagugucuuagcagguaacggagcaagggauuucuguaauugggaccacuagccacagagcuuaaggcgacaucggucaacuugcccaaggucuuggacacugcccuucugccugguuuugcguuuggaaugagaaaacauccuaacgggcucaguuggguaggaaaugaagaggaagggaauucggggugggggcggcagcgugggcagaggcugggaggugugaaaagccugcgcguugugguuguucccaguguuuugcugucacaaauauggcugcuaugaacuccuuguacccaugaaucccugggcucauggguaaggauuucucagcaccuccuuguggaauugcuuguggaagcaggcaugucucccuaaacacugcaaaccugcccuccuaacucaaggucaggguccagcgugagcagagcaucguguaggacgagacgaugcuggagaagcuggcaggggcugguuaugaaggaagauggugucugugggccguggggacucauggaaggguuuaggguggaaaggggcaggugucugccaguuuuuaagaggccuccaggaucaguguggggggccagggucucaggggaaguugguuugaugauucggauaggcaaugaguauggaguguuuuguucgggugaugaaaguguucucaauuuugauuguggcgauggucacgcaagcuugugaguggguaaacccccucaguugcaauuucaagcugaugaauugcaugauacgugaccuguaucucaaggaagcuguuguugaggccgggcacgguggcucacaccuguagcucacuuugggaggcugaggcaggagaaucacuugaccccgggaggcagagcuugcagugagccgauauugcgccacuguacuccauccuggguggcagagugagacuuggucucaaaaaaaaaaaaaaagaaaagaaaagaaagcuguuguuuguauaaagcuaggacugaauuaucauucuauucucccuaaauaaaauggcauacauauauguauauauauuauacauuuauauguuauauaaaauugcuauuauauagagauuaagugcauuuggccaaaaaaaaaaaaaaggaaaaauaguauuauagagauguuccaggcagugaauuaauaaagauguuaugguuuuucccccgcuagggcaggagccuugaggaauuaaaauaauaaauuccuuuuuuuuuuuuuuugaggcggugucucgcucugucacccaggcaggagugcaguggcacagucuuggcucacugcaaccucugucucccagguucaagugauucuccugucucagccucccgaguagcugggauuauaggcgugugccaccauacccagcuaauuuuuuguauauuuagugcagaugggguuucuccauguuggccaggcuggucuugagcuccugaccucaagugaucugccugccucagccucccaaagugcugggauuacaagcuugagccacggcgccaggcccaaaugcccuucauuuuaugugcuaguuuagugaccguuuccgucguugguagccaaaaacaucccagcugaauggagaaggucuccacgaggucagguagggcugcaguggcggugcaguugagacgggaugaugccugaacuggggcuggcccaggaggagagagacggggagucaaacucaaagggaaguuggaagacucaauccucuuccccauaucucucuaggcagcaaagaugguuacaagcuucccuggacgugggacacaccaucaggaaggggccuggcugaggggaccccuaccgcaggcaaacuaggaccaacucuuggggcuggcaccaccaggagcccaggcaguccuccaacucugagaguccauggagacacaggugagacacguggcuggggugaggagacugggacgguauuuguccugggguaaagagacagauuccagacuccccacuggaacccuuaccccagaaagacucagcagaaauauacccuaaaacaaaggguuaucggcugagcaugguggcucaugccuguaaucacagcacuuugggaggccgaguugggaggauugcuuaagcucgggaguuugagagcagccugggcaacauggugagccccccaagauaugaacauuagcuggguguggugguacgcacguguggucccagcugcuugggaggcugaggcaggaggaucccuugagccugggugcucgaggcugugguugugccacuguauuccagccugggugccagagcgagaccuugucucaaauaaagacaaaaacagaaccaagagguuauuaucuagaccgcuggucaucaacuagggucgauuuugcccccaaggggaauuuggcaauaucugaagauauuuuggauugucauggcaggaagugagaggcuacccauuggcaccugaucgguagaggccgggguggugauaaacauucacaaugcacacgacauuccccauaacaaagaaccacccagcccuaaauuacaauaguaccgagguugagaaaccccagccuagauggcauaagucacugugacaaauaggaaaaugauaggaaacccuagaugagaaagaggaaaacaggugauucccagaaaaggaagcccaaauggcugaguguauuuagaaaugcccacgcucaucaggaaccagaaaauacaaauuaaaacaauggcaaguacagaggagaaugagaaagguggguauuauccagugugagugaggaugugggaagacaggcaaccccacuggacagagcuguuugauaaagacaauccagcaguauuuaguaaaguuaagcaugauuaggcuggcugcaauggcugacgccuguaaucccagcacuuugggaggcugaggcgggcagaucacgaggucaggagaucgagaccauccuggcuaacacggugaaacccugucuuuacuaacaauacaaaaaauuagccaggcguggugguaggcaccuauggucccagcuacucgggaggcugaggcaggagaauggcgugaacccaggaggcagagcuugcagugagccgagauugcgccacugcacuccagccugggcaacagagugagacucugucucaaaauaauaauaauaauaauaauaauaauaauaauaauaauaauaauaauaauaggugugguggcaggcgccuguaaucccagcuacucgggaggcugaggcaggagaacugcuugaaccugggaggcggagguugcagugagcugagaucgcaccacugcacuccagccugggcaacagagaaagacucuguuaaaaaaaaaaaaaaaagagagagagagaagaagggaggaagggagaaaggagggaaggaaaucugcaugagcuccaugacguagaucuauaauuuugcccauuucucagaugagugaaauugaggcacagacaucagugacucugacaucaauaauuauuagagugcuuauuccaugcuagacauuacacuaagugcuuugcacaaccauggucucccugaguccuuuugacagcucugcaagggagauacgcggaucauccacagucuauagcugaggaagaaacugagauucaagcagugaaguaacuuggccguggucaccccgcuaggaagccaugcagcugggguuuaaacucggacagccugccuugagcacaagcccuuuacuuaaccgcuucuccaauccugcaaacaaaggacaagguggggaagggaugcgccugaaagacccugcccugcaggaacaaguggaaaucuguagaucugugugguucaauacgguagcuaagagcaccgggcaugguggcucacgccugaaauuccagcacuuugggaggcugaggcaggcagaucaccugaggucggggguucaagacuagccugaacaacauagugaaaccccaucucuacuaaaaauacaaaaaaauuagcugggcaugguggcacaugccugucaucccagcuacucaggaaguggacacaggagaaucacuugaacccaggaggcggagauugcagcgagccaagaucgcgccacugcacuccagccugggcaacaggagugaaacuccgucucaaaaaaaaaaaaaaaaaaaaaguuaaaugaauuaacacuuugaaaaugaaacauuugccgggcgcaguggccacgccuguaaucccagcacuuugggaggccgaagcgggcggaucacgaggucaggagaucgcgaccguccuggcuaacacagugaaaccccaucucuacuaaaaauacaaaaaauuagcaggacaugguggcgagcgccuguagucccagcuucucgggaggcugaggcaggagaauggcaugaaccugggaggcaaagcuggcagugaggcgagaucgugccacugcacucuaaccugggcgacagagugagacuccgucucaaaaaaaaaaauaaaauaaaauaaaagaaaaugaaacauuuaguuucucauucacacuggccgcauuucaagggcuugguagccacauguggccaguggcuacuguauuggcacgguagaucacagcgcauucccaucacugcagaugugagauuucauugccuagacucuaugugcaaacaacuuggguucaagucuuagcccugcaacuugcaaacuaugucugugugaccuugggcgagucaccugcccucuugcccuaauuucccccuucuguaaaauggggauaaaauuggcacucacuuggaagacagccccagaagagggucaggcuccuccugcuacucaggcccaaaauuuaagggggugcccaaaacgccaaaaucaagauacauaauaucauaauacaguauuuuuuaaaaugaaaauuaaugccaaaaaaaaaaaaacccaugaugaacucgguaucaaaaauguaacugaaggccgggcgcgauggcucaugccuguaaucccagcacuuugggaggcccaggcgggcggaucacgaggucaggagaucgagaccauccuggccaacacggugaaaccccgucucuacuaaaaauacaaaaaauuagccuggugugguggcgggcgccuguagucccagcuacucgggaggcugaggcaggagaauggugugaacccgggaggcggagcuugcagugagccgagaucacgccacugcacuccagccugggcgacagagcgagacuccaucucaaaaaaaaaaaaaaagucacugaagacaggauccuauccgccucgcugggcucccccuaauccuggcccuguuggaucccgucuuugguuaaaauguuaacuuugguuaacuguggaucuuuuggauuaauuuugauuguuuaaaaauauugcauaaaaacgcuugagcccaggaguucgagguuacagugagcuaugaucuugccaccgcacuccagcuugggcgacacagccagacuuuaucuuaaaaaauaaaaaaauccauaaaaguauuuauuuugauuacuaacauuacccuucggagcccucuuuggucucccugccuccccuggcuccgcacaucucccagucccccgcuggcucagaauccucccguaugcugcacgcuucugagcacucccgcccccucccgcaccccagcaccccacgcaucccucccucaccucacccuccugcacccgcucccgcaacccgcgugccccucggcauccccgaguccggagcauccccgcauccucccgcaguggaggacgccagguggcgccuggagccaucggaggacguagggaggaggggcccuagggccgggugaagucugccggugacccaugacgucucgaggcucugugccuuuccauuggucggcuccucgaggggcggggcgggacgcguggugggcggagccgguugaccucagaccguccgucugucuuuccuccuccuccagguuccccgaggaaaccguggcccgagcgccggccaccgcggcccgcugcgaccaggacagcgcccccaaccccguccccaggucccuccgccucuccgggacccccaggcccagcgcugaccucugacuccagucgagagcucacuccccacucagccuugacguccgaggcgaccucugacgcuccggacacuucaccacccaccccagacccggccucccggacgaaccccgaccucaucuugacaagcccugacuuugcuuuguccaccccugacuccagugugguucccgcguugaccccggagcccucacccacgcccuuacccaccuugcccaaagagcugaccucugacccuucuacaccgucggaggugaccagccuuuccccuaccucagagcaggucccagaaucugacacaaccccagauuuggacacaacuccauacuccaguacagucucagaauauucuagauccccagaccccuccccaagcccucaccccacuacuaccccugaucccaccauggccccugaccccaucacaacccuuaacccuacugugaccccucacuucccuaccaccccucaccccaccacgaccccucaccccaccaccaucacucacuccaccaugauuccugaccccaccacaaccccucaacccuucaccaccaucacucacuccaccaugauuccugaccccaccacaaccccucaacccuucaccaccaugcagcccaccacaaccccucacuccacaaccccucaccccaccacgaccccucaucccaccaccaucacucacuccaccaugauuccugaccccaccacaaccccucaacccuucaccaccaugcagcccaccacgaugccucaucccaccacgaccccucaccccaccacgacuccucaccccaccacaaccccucaccccaccacaaccccucaccccaccaugacuccugaccccaccacgaccccuuaccccaccacuacuccugaucccaccacgaccccucaccccacaacuccugacccuuccucaaccccugucaucacuacugugucccuuccaaccuccuuggggacagaacucuccucucccacucuagcaccaacagucaagcccagucugcacccccaguugaccuucacagcaccugccccucacaccuccacaucccagauacccaccuuagagcccucuccagccuuggaguccagccccuccagguccuccacagccacaagcauggacccacuguccacugaggacuucaagccacccagaagccagagccccaaccuaaccccuccacccacccauaccccacacucagccucugaccuuacuguguccccugacccccuccuuucccccacagcccaccccuuggaucauccuccccuugacccccucacccuagggccaacuccuggucagagcccaggcccccaugguccauguguggccccaacaccaccuguaagggucauggcuugugagccaccugcccugguggagcugguggcugcugugagggauguggguggucagcugcagagacugacccaggucguggaacaggagcggcaggagcgccaagcccugcugcuggggcugacgcagcugguagaagcugcccggggucuggggcagcugggugaggcugugaagagacuggcagagauggccuggaccaccagcaugccugcaccaaccaccacuaccccagaggaagaagaaagaccccugaggggagacgugugacccucuccaggauuugaggggcuuaagacacccccaaccaaaaaaaacaaaaacaaaaaaaacccccaaaguaucuaauuaaaaacaagg

SEQ ID NO: 14998 - RNA, 6405 nt, Homo sapiens
gauggagcgcagggccuccgagaccccugaggauggggacccagaggugagagacgggagccaggggaggaagacagagagagaaaagaaggagagagaggcaggaggcaacacggggagagagaggaagagaaacagaaaacagggaaacgcaaagaccucagagacccagacccagggagagaggaugacagagauccaaggacacacagcgagaccaaggcccccagagaauuggacucagaaacacacagcgggaugcacaggggaagaggacgguggagagagagaccagggugggcagggggacugugugggcugaggaugcacccccacucggggcugggggcuccuggccugcucccacagacaggggcaggcggggccucuguggcagugaccccuaaccucuccaggacacaaaaacagguggcccgaguccgggugagucacugugacucauccuccucucuggggacagugaccccuguccccugccccacccuccauccuggggcugcgccgugaccuccucccccaccacucucaguggaccccagacgcgcccccuccucacccugccccucucccguaggaggacacagccacagcccuccaacggcugguggagcugacgaccagcagggugaccccggugaggagccuucgggaccaguaccaccucauccggaagcugggcuccggcuccuacggccgcgugcuccuugcccagccucaccaggggggugaguucagccacccaagggcagccuccccaacugccccacaauaagcauucucggaagccacccagacagggggcauucccaggaggagcugauggggacccuucucaguggggguacucugaaaguuaagagcucugggaucuucugagaaacacaggccccaccccagagagggcgagggacugccuacggucccacagcaggacagguaugcaacucaaguuggaacccaagucaccaccgugucucuuacuugaugccaggggaaacugaggcccggagagggugaggcggcugugcaagcccacgccgcaguccgaggcagagcagggagggucuucaaagaaggucuccucccacccacacuucacagacaggggagcccgugcugcccaugagaagugugaggcucagagaguuuacacggcuucccucaggccccacagcaggacuggagccgccugagugucccuccgacccaucucccuggcagguccagcuguggcucugaagcuccugcgucgggauuugguccugagaagcaccuuccugagggaguucugugugggccgcugcgucucugcacacccaggccugcugcagacccuggcaggaccccuacagaccccccgcuauuuugccuucgcccaggaguacgcgcccuguggggaccucagcgggaugcugcaggaaagggugaggccacgagggacaaagguugggagugcuuaucccagguccaacucugucccaagccccgucucugucuccaacucugaccccaaaucagggcccgcccaauccaucuccacccugagcccccacaugaccucccccuuucuaauucucaacgagguuccaugccugaccucaacccuaauccauccaaucacccaaacacaaucguggaaaggcagggagcugggggugggauugaggauggacuggagucaaugaaggggguggggagggagacaggguugggauuuuaguugacucugagguuagggugugggcauggguggaguuggguggguugaguuuagaguugauuauagauucaucgugaguauggagaaaagcaugaaugggcugcagagagaagcagagacgguugaggauguguauauagacugaguuggagaugggcuauaaugggguuucuucuagaaaggagaccaggucaggacagaacccaugauauucuagggucucucgaguuuggagauuagggguagggauaguuucaggaauagauuuuggauuugagauaaaguuagggauaaauggaaggaauaaaagaaggaaggggaugaggaagguacauguggagaaaugagucucauugagaauuagaaggauggaaggaugggugaguggacagaugggugggugaauagauggguggaaggaaggacugguagauggauggguggguggauggauggguggguggguggguggauggauggauggauggauggauggaugaaaggauuggugggugaguggauggauggauggaugaguggguggguggauggaaggauccauggguggauggauggguggguggauggauggaugguggauggauggauggguggguggguggauggauggguggguggauggguggaugaaaggauugguggguggauggauggauggaugaaagguuugguaggugaguggauggauggaugaaagguuuggugggugaguggauggauggaugaguggauggguggguggguggguggaugaaaggauugguugaguggacggguggguggguggauggaaggauccguggguggauggauggauggguggauggauggauggauggguggguggauggauggguggguggguagauggagggguggauggauggaugaaaggauugguggguggauggauggauggaaggaaggauugguggguggauggacggauggauggauggauggauggaucgauagaaggaaggauugguggguggauggauggguggauggauggaugaaagguuuugugggugagugaauggauggaugaguggauggguagguggguggguggaugaaaggauugguugaguggauagguggguggguggauggaagaauugguggauggauggguggguggauggcugcauggacggauggaugaaaggauuggugggcggauggauggauggacggaaggaaggauugguggauggauggauggauggaugaaaggauuggugggcggauggguggauggauggaaggaaggauugguggguggauggauggauggauggauggauggaugaaagguuuggugggugagugagugguggauggaugaguggauggguggguggguggauggaaggauugguugaguggauggauggauggguggguggacggaaggauugguggauggaugauuaauggauggugaguggaugggugaaaggaagcaagggaggaugaauauauggauguuggauauuaaauaacagaauaacuuauuggauugcugacugguugguggaauggauguuggauggacacacuguucaauacuguuggaaggauggauggcuucauggaugaauugcugccuggccagcuggcuggcuagacggauagauaaucaauugaugaaauaaacuggggaauuuuagaaaagccucugaguuagagauggggucuagacucauacaagacuaagauuaggguuaagaaugaaauuugaguucucacuggagaagaucuggauggucaguuuacaaaagauauauaagaaauguucacagugggccugaguguuugaguuaggagaaucuuugaaagaagcuaaaagaaggagcuacugguuauaacugggguuccaguggggaaaacugggagaccagcugggaguuggucuacaggagugcagauauggcugcagguugagguugaggaugauggagagaaagucuuugggagcauguggugggaacacuggagguagccacuagucugggguucuagauucucaaaccccaagagucaaacuuuuaggacuuaggaaucuagagccucuuucaaaaauuauucagaaggaaccaacuggugcagugccucaugccuauaaucccagcacuuugggaggccaaggcaggaggaucgcuugaggccaggaguuugagaccagccuggacaacauaaaaaagacaaaaccaagacacucugacccuccuccugucuucuugaccucagggccucccagaacugcuggugaagcgggugguggcccaguuggcaggagcucuggacuuccuccacagccgggggcugguccacgcagaugucaaaccugacaacgugcuggucuucgacccggucugcagccguguggcccugggagaccugggucugacccggccagagggcagcccgacccccgccccaccagugccucugcccacggcaccgccugagcucugucuccugcuaccgcccgacacccugccucugcggccagccguggacuccuggggccugggggugcuucucuucugugcugccacugccuguuucccuugggacguggcacuggcccccaacccugaguucgaggccuucgcuggcugggugaccaccaagccucagccaccucagccaccaccacccugggaccaguuugcgcccccagcccuggccuugcuccaggggcuucuggaccuggaucccgagacuaggagccccccacuggcuguccuggacuuccugggggacgacuggggguugcaagggaacagagagggaccuggguuuuggggagcgccguguccuaugaggacagggaggagggaggcucaagccuggaggaguggacagaugagggugaugacagcaaaaguggugggaggacggggacagaugggggagcucccugaccaggugacagagacagguggccagagccugggccagaggcccuucccccagcccccagggccaccuggauggagagacagcugcacccgggaggacagagagggaacacauugcacucucccuacggaacgcugggcuuggacgcgcauuccucuuccaacugaggacccaagagcccagcuccugccccuccucucucagacgcaggauccaggcucccaucccuuccucccucaaggaccuuuccucuucccuccguccagagugucuucuuuuuuauuuuuauuuuuuuuagacagaaucucggucugugacccaggcuggagugcaguggcgcgaucucagcucacugcaaccucccccucccagguucaagugauucuccugcuucaaccucccaaguagcugggauuacacccgcaccaccacacccggcuaauuuuguauuuuuaguagaggugggguuucaccauguuggccaggcuggucucgaacuccugaccucaaaugauccacccgucuuggccucccaaagugcugggaugacaggcaugagccaccacgccuggccaucauggaguucugaugggaucacuccucuccucuaagaccuuccguggcucccgcuguccaugucacaagaucugaacuuuaggauccgacaccauauaaaccucacccuccaccucucccauuucucugggcugugggugaugucaugggcgccacucaucuguucuggaccuaaaucuacacaugugagaacacacacacgcacgcgcacacacacaugggugcauacgugugcacacacacgcacauacaugugcaugcacucacgcauacacacacgcguauaugcgcacaugcaugcacacacacgcgcgcacacacacaugugugcauacauggacacacacgcacucgcacgcaugcacacaugugugcacacacgcaugcacacgcaugcacgcacagcugcugccagacauuggcgcacuguguggccuccaccgagagcaucuucccccugacccauggcuccagaaaguggcccccacccccagcccucucuggccuccuggggaacuuguauuagaacaauccaugucucuuucugacuguccaggcuggaccuggucuucuccauauuuagauccuucccaguucugcucccacagagcaccacggauugugauugucccagcuccgucccccuuucucagacccgucaauccuaagagccaggccugguacccaugggucuccuuccucaccaaggccagcccgcgccccgcagucccauggcaccugccagacaggacacggagccuggcuuguggagguucacgccugcaggacggggaugaacuagauccaaauccaagaccccagcacccagcggaggguccagaacuggaaacuguguuuccuaagcaggaagguaugcuuccaggcugggaagugagcucacuacauacgacacggcauccugggcucgauccaucguggaagcgcugcugaaauaacagucugguguuggcccaacugugagccucguaguuuugacaaaugucucacgguuugcaucgcgaugccgacaccaggggaggcugggggagggugcaugggaacucuccgcaggaucuuggcaaccauuuuauaaaccuaaaaugauuccaaaauaaaaaguuuauuuaaaaaaa

SEQ ID NO: 14999 - RNA, 1186 nt, Homo sapiens
cggcugcugcacggcaccgagcggcccuucccuugccacaucugcggcaagggcuucaucacgcucagcaaccucuccaggcaccugaagcugcaccggggcauggacugacugccaggcugcgugcgcccugcccuccacccagccuccuggacucggccuggaccaggggaccucgggacugcgcgugaggccccggcccuccaaauccaaauccagacgcaggcccugaaaugaggggacccugacuggagaggugggggccaccaaaaacccacaaaggccccggagcugggggaccacaaacaaacaggguccuuagcuggggcaggggagcccaaaucuagggagagacuccugagccugaggucccuggaaugaguguggguagccguaaguccccaagacauggggacuuugcagugagcaaugggucuccacaaguaccucucaucuugagagcccuaauacuaaaagaugggcacccacccccaccaagggaagacugccccauucccugagagccaucauuccuaacgaccuugaucuggagaauguggagggagcaugucccugaauuuuccuagaucccuccaaaugccacccaccagagucacuggugaccccagaaaauggauauagccgaaaucugccuuuccccuuuuucauucccugugcugaaagagggaccaggguagaugcccccugcccucgaauccccccuccccgacuguggaauggaucgacccuaacgaucuuccccgccccaaacacuagaauagacuggccugaaauccccuugcccaguagaauggacugaucuaugugcacacacccccaucacauggaaugggcuggucuaggcuguggccugccaccuuccuuagagugaauagggcggacacuccucucuuuuccuguagcguguggaccgguccacgcaauucuuuauccugugaacucaucugagugggaggugguggacacugggguuuccuucccucucuccguagcauccguuggucuuucucuccaucucuguugguuugucugucucugucuuccucccaaucccuaggggaagggggcauuuggcuagggggugccccugugagccucgaccuugcccccucgucccucuccccaguguuuccaggacccccaauaaaccuuguccugucagucg

SEQ ID NO: 15000 - RNA, 53166 nt, Homo sapiens
guuuauuccaaauuuucacgucguuuuuuaauuuaaauuaucugaauaauucucugucucacgcggaguuggggaggucuguccgggaaucaggugggcagcuccuccgcggggccagggcggagacggggucuguacagucccccacucgaggggggggcacccgccugccugguuuuccaggaggaaggggcccggcgaggacagggcugggcagcccaagcggaagggggugccggcguucgggaaggggccgcggccgguccggggccgucgcgcuugggggcccggcuaagggagcccccaacccagggagcgaggaggaggggcaggggcgcggcggggagaggggcaggucauccaccgggguccacgggggaggaaggcccggguggaggcgcggaggcguggugcgaucaccgcuugaagcgguaggugaugggcagcagcagcuugcucuucuugagcgccugcaccuucuugagcgucucgucguccagggccagaaagcagcggcgggaguacucgagcaggcgcuccuuggaggggucgaacucgcccaccucggccagcuucucgggggccacaaugagcagcucggcgaugggcguggucagcgccacgguguuccuguccacgcgguggugcucgaaggcccgcgacaugcucuugagcuucuggaaggugcccaggaucuucuuguaccggcagaggaccccgucggcguccuucacugagggguggaggcggggacacgaaagugaggggcagggcacaagacugagggggcggacacgggaagggaaacggccaugggaagaaaggaucucggcgagcagaggcacgggccggugcagguggagacggagaacaacaggcaaggaaggggcagagaggaggggaagaaucgcagccagaucuuggaccagugggaaaugggaagaggcaggcccaggaaggagagugaggagacaaaaugagccaagaggccggguucaacccacgcggucccagcaccccccgacaccccgagccaucacccucgucucccugccucaggugaauucacuuauucaagucucacccuccccgugagguagguccuacugcgcaccuccuccuuacugaugaaaguuaaggaggugcccaagguggcccugcccucgacgguggaccaaaacuuaaaaguaaacccaggacaggccaugcgcgguggcucacgccuguaaucccagcacuuugggaggccgaggcagguggaucacgagggcaggagauccagaccauccuggcaaacacggugaaacccuggccucuacuaaaaauacaaaaaauuagccaggcgugguggcgggugccuguagucccagcuacucgggaggcugaggcaggagaauggcguggacccgggaggcggagauuccagugaggugagaaugcgccacugcaccacuccagccugggcgacggggcaagacgucccccccgccaaaaaaaaaaaagaaaguaaacccaggaccacacguggaggagggagagacagaacccggugggucuuucuccagcaaggcuggaggggcuuggagagaaagggggaccucugggaaggacacacagcaauucagcagcccgggccccucagcgcccgccccaugcaccccacucaccucgcugccucucccgggccuugggcuucccaaagcgccuccgacuagcaccucccuucugcuucugccgccuccucucacuggcgcugccuucuucggacgcuccgcugagggaggaggcugcugacucaggguccgaggccucgcccccagccccaccacggcugucccccuccauccgccugggcccaggcuucauccggcagugguccucuggggagauggagacacacacaugaaccaagggaccagacaucccaucacaggucccgggacugagagaggcugcaguccccgaacuggaucccccaaccugggcugguccccuaaagagacagagagacaaggaguacgguagagacgcugguggcugaguagagccaguuggggucugugggaggugguaauggguggagcauuuucucagaggccuggguuggcaagaggucuuacggaggcagccgaccaggggccucaggaccccugugacuaugcgcgguucccauaggggagggagaaauuucuggggacugggcgggaccucuggagaguagccucuggaaacccaggaggcaggcaaggccuuggcuggagucggggggucagaccgagagaaaucaggggcccuggguccagcaggcugggucccaccuccaucuagacagagggagccggcaggcggaggcccagacacagauuccucuagaaggcggguuaggggagggcucuggugccaggguccccacugggaaagugccgaagccgcagggccaaacugucugugcaaaggagucagucacccaggauggaaccaucagugagaggagacaguggcaggcccaagggcagccagaggugguuuguucccgagcagagggaaagccagauccccagaugcugggcuuccaguaacagagacaccacaagaccauagcccccuugccuaggauuuuuggggaaaggguugaauucacaaagagagaugugggagcuuuugaggggucuucccagccaaggagcuagcaaggcugagaugaggguaggugggguagaguguggguucuccaggccaugggcugucgggcaaacggccugaccauccggggaagaggauggggcugggguccaaaauguauuaaacagggcacagggucccaccagucaagagaagacgcuagcugugaacuggcuggggcugggugcugcugugggagcuaucugggcugcuucuggccaugaauuauagcagagcaagguauguggguggggacugcccaggaaucaggcaggguuugagggacagcaccugcuggggucaccacccaaaaaggcccacaaaggaagggacuuaaugucuuugauggggaaggagugcucauuaaccaaggaugggacagggugggugggaagauggccccuggugucacagaggggagggggggacaggaggaggccggauggcuggacucuuggaucuuggagaagacagggacgggaggaggagcaggggcccccugaggaaacccaaagaacuagggugggccucuuggccaaagagaugaaggaaggucccccuaggagucagaagagaggggcucucaggugccagggucccugaagucaccaugggccaaggaagcagauggcagggcacuggaggcugaugggauuuggggagcugacggagaaggcaggaggacgggccccaguagacaguucauggggaugaggcccuggaaucaagugaggaggcagcugggccugggggcccaaaacaggcaggggacuagcagauagggccaacauggcaggucccacccagccagccaaacaguggagccuugagucugggugagcggguacccaguagcgggacagggaggcauguggaucagagcaccccacacacaccugccuccauccgagcagaagagaugaauuuguccagcuggcaccgcaggaagucccucucuuccuccagguccucgaugcgcuucugcagccaggaguuccucuccagagccaugugcagcugggucuugacgcuguucaucagagccagggcggaggacgcagccuccggaggcucuagggacacagcgaggguggggggaccaggucacacccugggacucagggcuuggcuucccagcugacuccagucccuccacacccccucagcucacccucgaaguuucuccgagaggggcucagacuguaaaagaucugugggucuagguggggugccucaucgaagggaauggagaucucgaaggucucaucguccuucacuggagaggagaggccccggguuaccccagagaauuccccgggccucucaggccaccccccaaccacggcagccuggagccgaccgcacugggacccaggguagggaaggggacccagcuuccucacuuguccgccuccgacugcuccggucauucauggcgcggcuuccuacggaccccagcagccgagggccucaggggcacuggacagaaacggcagccacaaauggagagacgcagauggacuggaggguccauccugggggaggugaagugagacaggagggaccuucuggccuggaccccuggucugagggaggagggagccuggaccccaggacugaggcaaaacgcgccugggcuucaaacuccugggcuccuggagucaggggcagggggcccagccgccuagguccugggggagaagugagcuggggacgugggcuccuggguaucgaaggaaaaggaagcugaagcccuaaauugcugggugccccaaggggucgccugaccagggacaccuagccugaaggggaaggacccucucucaucgcgggccacugccaggccuaaggaagaggcaggugcagggggaaacugccccaacuucccaggguaggaggagguccagcccgugcgcgcugccuccucuaccuucggggcccccacaccccucccccgcacucgcgugggcgggcggaccgucccccgguggugggggcugggcgcgugcgcaguacggggaaaggucacgcgugggggugcgccccccccgcccccgcccuuugucccgcgggugggagggggagcggucguggaacgauuccagcgggaacaugcacuagggcgggggugcaaacgcggccaccaucccccgcccgcgggugcccgggguccgaggggccgaggccccccgcgcucacccacccgcucgcggaauccggcucggggaccgacggcggcggcgcccaugcccggcgccggggagcgucugcaaagugucacggggagccgagggaagcgcccacccacccgcgaacaggcggggcggcaggggagcgugucguggaacugagcgacggaacgggcagggacgcggggacucgcccagucgggccaggcuagcgccccucguugaagaguccccggguccaggugaggcccgccguuugcggcagaagcagagggucugcacuugcgcgauagccccuuacagcacucccccgcccuccccgaagcucaggcagggaacaucacgaaauucccauccuggagagcuggcgagucuccggggguccccggauuggguggcggugugcccaaugggcccagaaggcaggagaguguuugagacaccgagaaaguuggagcgaaaggagaaucuacuuuuaacgcucucucaggaacuagccagcgcggaccccucagagcuccccuaccuccuacagccagaccccaagguucucagggaugugggggccaaaaucgggggaguuaccccucucccggaaaaugagggccaggaacacgccacccccauccccauguugguaauuaagagcuggcuuuggagcaaagcuagauuccaguccugacuguuccugcuccuccccagccuguuaacucaccugcaaaauggggaaauuacaagcccuucuaaauuuauugugaggaugcagugaugcgacacacagaagcucagcccagcaccuggccaucgucagggcugaagagaggagcgcugcugguauuauuugaggucagauggugggguaugauggcagccucugggaggcucuuucccacucuggggaguaugaacggaagauuuguucuuccucccaaaaaaacaggucggaagagcaaaugaggccuagcacagugccuggcacaaaauaggcaagaaaaaugaaugaauaagcagauguuuauuaagcuucaggcucagcuccaccugccucuccuguucaccagaagcauccaagcucuggacuguggccagcccuuauaagagcaaggucuuaacccgauggagggagaaucuaaaugucugcaccgccugcaaagcugugaccaugauccuccccuccccacuuuacagauuaacugcagccugguccaaaaauuccagggggagccaucugcccuagauuggucuuuuccaaacuacagguucauggguggagaauucaauagaauaggaugaaaucagcaguuuaaaaaaauauuuagccgggcgugguggugcacaccuguaaucccagcuacucaggaggcugaggcaggagaaucgcuuaaaccggggagguggagguugcagugagccgagaucgcaccacgcuccagccugggcgacacagcgagacuccgucucaaauaguaauaauaauaguugauggaaaaaaaaaugcacaaacuaaagcuaacuaugguaaagaaauuuuugugggccgggcgcaguggcucacgccuguaaucccaacacuuugggaggcagaggggggcggaucacgaggucaggagaucgagaccauccuggcuaacacagugaaacccugucucuacuaaaaauacaaaaaauuagacaggcaugguggcgggcgccuguagucccaccuacucaggaggcugaggcaggagaauggcaugaacucgggaggcggagcuugcagugagccgagauugcgccacugcacuccagccugggcgacagagcaagacuccgucucaaaagaaaaaaaaaaaaaaaacuuuuguuucgaggccuagugcccugagggaggccgagguguguggaucaccucaggucaggaguucgagaccagccugacaaacacggugaaacccaucucuacuaaagguacaaaauuagcugggcaugguggcacacgcuuguaaccccaacuacuugggaggcugaagcaggagaaucgcuugaacccaggaggugaagguugcagugagcugagaucacgccauuacacuccagccugggugacaagagcgaaacuccgucuaaaaaaaaagaggccaggcgcuguggcucacaccuggaaucccagcacuuugggaggccgaggcaggugaaucaccugagguugggaguucaagaacagccugaccaacauggagaaaccccgucucuacuaaaaauacaaaauuagcugggcaugguggcacacgcuuguaaucccagcuacuagggaggcugaggcaggagaaucgcuugaacccaggaggcauugcggugauccgagauugugccauuggacuccagccugggcaaaaagagugaaacuccgucucaaaaaaaaaaaaaggaaacuugguucacguguauuuugcuuaucuguauacucuauugccauauaaaauguguuuguaacaggagauugugguuuuaaaauuguuucaguuaaaaacauucuucccagaugacccaggucuucaggagcugaggaggggauaaccccaaggcaggccaaccuucccauuccccagccaggcaagcugaggucucccugcuagacggccaccaaagagggucugagaugcugucucuaaaaacaaaccucgagugcucagagugggaaacguguuuauuguuugaucagucucaggccugguugggggguggaaggcaggacuggggucccuuccccaacaacagcgcagaagccccaggaagauggcgcagauuccugacgacccacagccaccuuuuaugaggccagagacuuuacacaccacacuccccaccuccauccagucaaggcucugccauggaacagcugauaucuuuaggcuagaggacuccauucuguguaggggcucauucccaucucagcuccagaacacggaggaccugaagauuacucacggauuccuccuucaggcagggcucugccuuugagaugcggcugcucugugucuguguccagggcccugaacaccagccucaggcucucaccaggugucuggacaggaguccaggcucccugcaaaguccugugguaccuggggcacccggcagcccggcucauggaugcuuccaccgcguguguuucugcaguguguucugcuccauaaagcggcgagggcaguguggacacugaaacgggcguuccccagagugcacccggcugugcugggccagcucacccgcaucccggaagcggcgagggcagagcgggcagccguggggccgcccaccacccgccaggugaauggaauggugccgugccaaguggcuggcgcgcuugaaugccuucccacagaugucacacucgaagggcuuuaccuccgagugggugaugcugugucgcugaagguaggacauguacucgaagacccuugagcacacggggcagcuguagcacuuuuucuggccuggagccccacuggccccuggcucccucugugacuccucguccaccagcacuguguaggggacacccugagugucaauaagcagguagugguugggccuuggaggagaugaagccuggggagauccgauggaggaggaagguccagguucuggggagcggcaaguccgacggggagggcccuccauggucucaacggaggaaaaugccagaggcugagggcagggggauggcagcaccagcauccggagggcuggcugaggccugguggaugggagaugggauaagaagguuauauagaagagggcagcucagcaccacaggcuccauccuuuucccucccuauacccggcccaggaccucugcauccugcugccccucagucccucuuuuccagucccgcucacagcuggagucuguggcccccuaaaagguccccagggucuuccuccuuggaaaaccucuccuagccucggugcuccaccauacacuguacucacaggaucucuugaccuccucugcacaaccuggaccucgcucuaaccuuccucuuugugcccucccaggucacugggugccccaccccgcaggccuccaggccucucccuccccuccuucuagcccuuuccagggucugcguguuggccuaugcuacauacucaagccuuuccugacccccuccauacaagccaagccuauucacaggggcuccgacguuaggacccccagguuccggcccucucuccagccacgugucugaacaacuccgugcucccacccguccacccaccucagguucucucuaguccucgcccggccuccaccaggcucguucuaggucccagcgcucuccgggguuccacccccggggccgcagcccucgcuuucugggccuuucuguguaaguucucgcccccuccaagcuccagaacagcccccuccggcgucugccccacucccgccccggcccagguacccuccacgcgguccagccccucccgccgcccgcccccagcccccuuccuccucccggcccccguacccagugcagcagccucucagguccgggcgacuccaagcggccccgggcuacccucgcaguugcaggcggcggcgagaaggggaccucugggugugccccaggaacuggcggcgccggccgaaagagagaagccgaagggagagaagagggucuagggaaggaagguuggggcggggcgcccgggccgucgcgaaacggcuccggccagaaacacacaccgagaggaaaguacccaagcgaggaagauccggucuccaccccccagcacccaacgugcacgcacacgcaaggaagagccugaaaauggagugcggaauguuuauugagcaaagggucgggggcgugggcggaagggggguagauacagaaaugaaccagaccgugcccgugcucuuuaucaucucuuccccgcagacaaccaccgguucaccgcuccagagagcagaaaaccaagguuuagagaggucaugucacuugcacaggcucacacagcacagcuggacuggaacccaguuccgacugguucccaggcccagggaggggcaacgacuuuggucuacaucacacagcuagaaaggggguaaggaaggaaugaugcuccucccuuuggaagguggggaaacugaggcccaggguaaggcaguaaccucagcagagccagggggugugugugggagugagugacgcugugugggucagacuugguggcccugagacgggcagggcagcacaggccgggucucgagcuuaguggaggcgcacgugcugcgccagcuccgcggcguccuggaagcggcgugggcagagcgggcaggugugcggcggcccggcgcgggcgcggugcguggcgcgaugccgcgacagguggcuggagcgcuugaaggccuugccgcaggcgccgcacgugaagggcuugagguccgagugcgacacgcgguggcucugcagccgcagagggcuggcaaagacacgggcgcacuccgggcagcuguagcccuugcgagggccgggcucuccugggggcgccucgcgcuggggcgggccccggggcuccuccuccagcugcaccguguauguguaggggaccccauuggcgucgaugaggagguggcggcccagccgcgggggucggggccccgccgccgaggaaggaguggaggaggggccuuccgccuuggggaaagggggagccuuggggggcgguggguccauggccuccggagaggaggaccgagggugggguggccgcggcggcagcagcagcaucuggagcggcagcugggagcggcggaggggagauuaguuaaaauugccacuuccuuuuaggaaaaguuuccuaaaauggaaagcauccccacuaucacugcuuguuacccuuugugcgccacugacuaccucccuagcaaaauaaaaacugugacuccagcccggcucucccacguuccaucaagcugccucggagagggccuccaacugagcucugcaaaaccccgccaccaccugccacuccuccuggguccaccucucaccacucaggucaggucugaggacguagucccccgacuuuucuucccuuuucuccucucaacccaccccagcagacaaucaaucccuaaaucuguuuaccucuuuacaucuuagaccccgggccuccugaccgccgagauuucucuaaucugugguuucuucuuuuuuccuguugcccagccccaguucaguuuacuuccccucccuuugccgcccccuacccccccaccggcccccguaucggccuccuggcccuccguccccacuacaugccgcagggccuccccaucuucauauuccguggccucccucacuuccucucuagguaccuccccagagccccacuaacccaauuccccacauuucacuagggcuuuuccauccuguuccuacacuuagcaccucgaagucuagucaccucuccccacuacggaacccaucgucuuacuacaucuauacaccccaaaauggcucaaaugccuuccuucuguauaccccgcccccccaaccuggcuaccugcuacauucuccccaaaggcccccuuuucucucgccccccauauauggcggugacaucguuacuucuuucuguacccaucaggggccuucucccaaaccccguuaugcacaccaggcuccgggacuccgcuucccacagcaccucucccaagcccacuuuccccuccuuucuguguacgucuggcaucucucuuucuccucguguucaccucuuccaggagccccaucccucucccuguuacacacagcguggucccccgcccguucuuuugcucugcuccccuuguuuaugggaaccccagcgcccgggcguuuucgcccccaucccgcuacacaccgccuguccccuggcccuggggccccuccuauugccuucacuuccccaaggagcccuggcgccucgacuuccccucccgucccuccgcccgauccugccgcucccgacccccacccccaucccggguggcuccagcgcacucccccagccugccuggccccggcgucgucccagggccaggcuccucccuccaucccggcccccguaccccgugcggcggccucucggguccggaggaacgggccgaggucccgggcggccccgggcuuccccuggcgagcgccggcggcggaaccgagacuuccgggcagcuccgggccggcggcgccggggacgcggggacugggggcgcgggggugcgagggguuggcggagucccugggaaaaggcgccggccggaagcgcgcgagcccagugcggagguuccgccgccuggagccggcgcucccaccccucgccucugcggagcgcccugcggggaggggaccggaggcgugggguccacugaagacgcccgcccccggcggccccgcuccccucccaccucccgaacggaacgauuccgccgcuugacaagagaucggccaauaaaccgagacuaagcaaaguuacgucuucgcccuaaggcccacaaggguuuguccucuuuccacugggccgucgcugccugcucggccguggccacccaccgagguagagggcgggagaagggauguuccugccggcugagcaaauguggagaccgagguccagagaccagccauuggcuccgauguggccgggccgugauucuccacccagcaaauggggaggccgaggcccggagaaggccagacgcugccagauaguuggggaagguauguucuuuccacggggcacaugcgggaaccgaggcccacagagggccagacggcugcaugcgcagguggggaggugugauauuuccagaaggcauguggcgacaccgaagcgcagcgaaggccaggcuuugccagaugcggaggugggaaaggcuggcacugcccacggggcccacuggaagccugaugcgggcucgcgggcugcgccagguccuggggcacuugaggcccgggcgcuggcugcgcaugcgaaggacuccggcgucgaaagcaacgcgcgguggcgcugcagccgcacuggagagcugcacacgcggcagcacucggggcagcugcagcuccuccuccagccacguggcgccacggccucgcaggagggcggcagcagcagcaucugcaggugcagcugagagugggggacagaagaggaguaacugucacagcgagccccaagacccuggggugccacagcuacauccuagagcacuguccaucagaacuuucugcaaugguggaaaguucuaugacagucacuagccacgugggacucuuacacucuugaaauguggcugguguaucagaggaccugaauuuuaaauuguauuacauuucccauaaucagcacgguggcucacaccuguaaccccagcacuuucggaggccaaggcgggcggaucaccugaggucaggaguucgagaccagccuggccaacauggugaaacuccuucucuacuaaaaguacaaaaauuagccggccguaguggugcuccccuacagucccagcuacuugggaggcugaggcaggagaaucgcuugaacccaggagguggagguugcagugugccaagaucgugccacuauacugcagccugggcaacagagggagacugucucaaaaaauacuaauuucccauaaucaaaauuuaagccacauauggcuccuaccuuauggaacaauuccagagaccacugucaaccaguuguaaacuggaggcccaagggcccaaaaggccucacaguuauauuugguuugggacacaagguacuuuuuaaacauuuuacugggcaguauguauauuuuuugagacagagucucacucugucgcccacgcuggagugcaguggcaugcuucuggcucacugcagccucacccucccaggcacaagugauccuuccacuucagucucccaaacagcugggacuacaggcgugggccaccacacauuuugagccggaccacucuuuguugugggggcccauccugugcacuguagaguguugagcagcauccuuggccuccacccaccagauggcaguagcacccucccccaaccccaaguugugacaacccaaaaugucucuacacauugcccguguccucuaggaggcaacauggcuccuagcugagaaccccuggucuacuuagacaauuauccaaccugagugucuugccaagaucccugauauaguuaagaugucuguccccuccaaaucuuuuuuuuuucuuuuuuuuuuuuuuuuuuggagauggagucuugcucuguugcccaggcuaaagugcaguggcgcaauucuaggcucacugcaaccuccaacucccgggcucaggugauucuccuguuuccaccucccaaauagcugagauuacagguaugcacuaccacgcccagcuguauuauauaaaauauaacaauuuuauauuuuugguagagacagguuucaccauauuagccaccuggucuccaacuccugaccucaggugauccaccugccucagccucccaaagugcugggauuacaggguugagccaccacaccuggccuccuccaaaucucauguugaaauguaauccccaguguuggagacggggcuuggugggaggcauuuggaucauggggguggauccuucaugaauggcuuggugccauccucgagguaaugagugagaucucgcugaguucacaugagaucuaguuguuuaaaagagcaugucaggcugagcgugguggcucacgccuguaaucccaacacuuugggagggcgaggcgggcagauuacgaggucaagaucaagaccauccuggccaacacgguguaaccuggucucuacuaaaaacacaaaaauuagcugggcgugguggcaggcgccuguagucccagcuacuugggaggcugaggcaggagaaucacuugaacccgggaugcagagguugcagugaaccgagauugugccacugcacuccagccuggcaacagagcaagacuccaucuaaacaaacaaacaaacaaacaaacaaaaaagcgugucaccuccugccagucuuuuccccccaccaugagauaugccaacuaccccuuuaccuuucaccaugauuguaagcuuccugaagcccucgccagaagcagcugccaggaccacacguccuguauagccugcagaaccguaaaccaauuaagcuucuuuuguuuauaaauuacccagccucagguauucacucauagagacacaaugaaacuaacacaaucccucucuugaguuucagaccauauaacuaguggcacuguaguggccacaacccccacccccacugcuauccccagaaauaaugacaacaauaagcaacauuuauugagcccucacucgggaacagccauugcuaaacgcacagcauccucagggcagagcuacaaggaaagcaccaugaggaucccuguuuuacagaugagggaagcagagcucaaagagaucgugugauuggccugaggucacacauccgcaggcgggauggccaggauagcaccugccucugcccacaccaggucagugcacaugaccccugucagcaagccacacacuucccuguaaucccaccaucgccgcugccaccccagcgcaaaccaccaccacuuacgcccagcuuauagcagcagcagccuccgccuccaucacucucucccuccccucucguuuuuuuuguugcugugucuuuuuucagacagagucucacucugucgcccaggcuugaguacaguggcacgaucucagcucacugcagccuccaccucccagguucaagcgauucucccgccucagccuccugaguagcugggauuacaggcgcgcaccaccauggccggcuaauuuuuuguaauuuuagaagagacaggguuucacccuguugcccagacuggucucgaacuccuggccucaagcgauccgccugccucagccucccaaaguccugggauuauaggcgugagccaccaugccuggccuucucccucccuucccuauggcaauuuccaagugauuuuuuaagcucacagaaucauucccugacuuaaaaccuuccccucugagacacagcaacauauugagacccugucucuccaaaaaaaaugauaauaauaauuaggcagaggugguggugccugccuacagucccaacuacccaggaagcugagacaggauugccugagcccaggaguuucagacugcagugcgucaugaucaaaaccuuccccucugcccuuagaguaaacccagacacucugcaaggcccugcguagacuggccccccagcugccuucccuucugggcaccauggugcuggcuuucccuugcccagugcaccagccucucccaucuggagagcuuuugugcuagcuccuccccucucugugauguuccuuucagccccucacaagagugacuccuuccuggccuucagguuucagcucacagaacacuuggucauagcagcuuuuagugaccgugguagcuccaggugcccugcucugcguccuccgucuguucauuuccuucacaucccacagcacaauccaugauauggccucguugaucuacugccugcuguguuacugccugccuuccccacucuccaaggcccagcuccauccuggucaacauucuacccucagaaucuaucaaaggucuuucaggaaacgguaaggaaucaauucgauauugguugaaugaauacaugaaugaauuugaucgccccauccaaaagugaagcauuaccucccuacccagcuccccaccaaagagaaccccugcucaaccccaagacaugaucaugaggaagccacaccaucuagacaaaauucuugccacaccaucuagaacuuuggacguccccauuuccacccacucccucacuccccaaagccagacaagcaccaaguuccaucaccuccacccccugagggcacugaccuccguucuccaagccaaguucuggccccuuccuucucaccuggaccaccauaucugguacccuggccuccaguuccccucccacacuggccugacccugacagaugcuucucacagcuguguugaaugcaacuucagcaccaugcauaacauucucccggcccccuuuacccucaggaccaaguccgaguuucucagccuagaauuugaggcccuuugugagguggcccagccacuuccucaccucacuucucauuccugugcuccaagcacacacggcaucucacagcccccuggccagaccuugaauuuacacagcuccacacgcaaaggcuuauguguuuuccucgcccugggaauucuuccccuuuccucuacuggcagccuucuccuuagccuucuggaaucauguauucugaccucucaaguuggcuaggugucaccuauaugcccugcucaccaguccaccagcuccucuuuuuaaaauccucccuauaguauaacccccucagccugccaugaaaggccucucacaaccuggccucagccaccuuucccacccuugcccucacccaaccuguuccagacagcugcagcgaaucauucugacuucuccauuuacaccucaaaucuugggccacugugacugauuacucauguccccaaacuucaguucacacugcauauucauauccagggucucgaugaauccucucaacgguccagcgaggcuggcaaucagaugcacuccacagcgcagagggggcagaggccacucagaucuccggccggagugaccgauugacccccgcuccagcacccucaccucccucuggcugcccaaacccuccccagccugcagucuggguccugccuccuucaggaaccuuuuccuggccacccccucuucucaagguccacuauucaucccacuuugucuucccaugggaaauagccccuucuccccucgggaaauaauacagugaugcccaggccugugccucuggggcaauugggauccaagaagcccacccucaaggcuuuccgcccuccucuuccuauaccucguccccuggucaccguagccccuccccaagccuccuucgcagggccucucaguuuccaacgcccacugcccugggggccacucugucccacaccccaagucccucacuugggcaggacucuuaagaaugccgucacugcugaaccugcucacuccccgcaauccggcccggucucccuaucccuacgcagcaaacuuucacguccggaagcggccgcagugacgacuuccgggaugcuccgacuucuccagcagcuuccggauucggagagcagcaggaaagcacucgggccagaaacgcacccacaagagaaagguuccugcgucgcgcaccuugcuacuccacacacacacuacacaaaaguuaaaaugaaaucacuauuuggcgccgugccggaugcugagggagggaauacaacagagauggcuuuugucaaaaaaaaaaaaaaaaaaggacuuuucuuucuuuuuuuuuuuuuuuuuuuuuuuugagacggagucacgcucuguugcccaggcuggagugcagugugugaucucggcucgcugcaaccuccaccucccggguucaagcuauucuccugccucagccucccgaguagcugggauuacagguacacaccaccacccucggcuaauuuuuguacuuuuaguagagauggggauuucaccauguuggccaggcuggucuugaacuccugaccucaagugauccacccaccucggccucccaaagugcugggauuacaggcgugugccaccguacccggccaggaaagacuuucuagaguaggaaagacaguacaaagucuuucuacaaauaggaccugaaaucagaaaggucuagugauuugucuguugcuacagagcaaaggcagagggcugaaauucuucaacucaugagacaguugaagacagucaggcccuaacucuugauuugcuccauggcaagaaaauggaguaccguaucccuauugguuaggugguaacgccaaggccauagaggggcagucauuggcccuggaucacacugcuagucaaagcuggcuaguaggauguaaagacuuuuauuuuaaaagucucagggcugccaaauucauuaugccaaagggaagguuaagccuggagacugaguuaugcaacacugcuaucugcuucccagaucaacagcuguugcuucagaaccuugugucaaagcauuacacguuagccagacccucacagaaaaacaaagcgccucaaguaccuccacgugaccaccaguacacauuguuguuugcuguccuccauccucccauaaaacaagaacaugggccgagugcuguggcucacgccuguaaucccaacaauuugggaggucgaggcgggcggaucaccugaggucagacguucaagaccagccuggccaacauagugaaaccccaucucuacuaaaaaaaaaaauacaaaaaaaaaauuagucaggcgugguggcgcacaccuguaauccuaacuacuugggaggcccaggcaggagaaucgcuugaaccugggagcuggagguuccagugagccaagauggcgccacugcauuccaguguggaugacagagugacucugucucaaauaaaaauaauaauaagaagaagaacaugucccuuguaacuuuagguuugcaaucuaagucuagcuccuaaaacuaaagucuguuagguuucccacugauaaugcuuaucuucccagguacagaacaaaaacgaugagcucaaucauucuuccaucugucacccucuucccaccugccuucccuccuuuaaggaaauguauaaauacuaagccuccugaaaaccuuuccauaagccacagagguuuucugugacucuugccuuucccaggucugcccucaagcucuggauauauaagcucuggagugauugaggcucuugccucaguaacuuauuuugguuaacaaugaugucacuucccucugcaaggcuaugugauggagggaaaugauauccagcucuaaagauaaccuaaagaggccggacgggguggcucacaccuguaaucccagcacuuugggaagcugaggcggaggaucaucugaggucgggaguucgagaccagccugaccaacauggagaaaccccgucucuacuaaaaauacacaauuagccgggcgugguggcgugugacuguaaucccagcuacucaggaggcuggggcaggagaaguacuugaacccaagaagcgaagguugcaguaagccgagauggcaccauugcacuccagccugggcaacaagagugaaacccugucucaaaaaauaaauaaauaaaaucaaguagguggccucagccuucucagccggccaggauaugcugggccaacuccuggaaauguugggaacagugggcagagaggcagugaccguccacccagcugguuagccaguguuggcagaggcugcuggaguacuuaaaagaccuuuccacuggaccacacacauguucauaucauagggccaggaggaugcugagugugagacaugaugcugugugaaguagagcaggcucgugaagguuuguaggaacucagggcaaggcugggaacugggcccucuuucuuugccuccuccugagcugucuucuuaaaccacaguacuacguguguagggcacccccugguggucaauaagguaaugacaguuuggacuuaaggauacaagugaggacaaaauaggugagcaacucauccugguuugggagaaguccugggacuauccaguuuuaaaacugagaggaaaaaauaaagaagaacaaggcaagaaaauagaugucuuagauuuggcaaaucaccaccaucuggcuguugacaaggagacaaguuauucccauuuuaucgauggggcugcugagaccagagaguaaacugcccauucacaaaguccagcaggugcagaguuaaaauagauuacccgccuccugagcgagacuaacgggggaaagaagaccagcaguuacccuagguggcaaguaaaucuuucucacuuuuuuuuuuuuuuuuuuuuuuuuuuuuugagaaggaguuucguucucguugcccaggcuggagugcaauggcgagaucucagcgcugcucaccgcgaccuccgccucccgcgcucaagcaauucuccugccucagccucccgaguagcugggauuacaggcaugugccaccacuccgggcuaauuuguauuuuuaguaaagacgggguuucuccauguugaucaggcuggucuggaacuccugaccucaggugauccgcccgcuucggccucccauagugcugggauuacaggccugagccaccgcaccuggcggauugaucuuuauuggacaccugcugcgacagggaacccuccuaggccucgugggggcgacaaagaccaaaauaucaaaaugucucacccaccuuagaaccuggaagaagcagguagggacuacuguguuuccucuagccugcagaagcucaaguucaaagacucguucagccucacuaaggaaccuuacguaacucacgacuagaauuuggaagaaggcccuuugguuucucaaauucagcaguaacauuucacagauaaggaaacugaggaccagagagguugaaugaaauuauggcgauaggccuggugcgguggcucacgccuguaaucccagcacauugagaggccgagguggguggaucaggaggucaggaguuugagcccagccuggccaagauggugaaaccccgucucuacuaaaaauacaaaaauuagcugggugugguggcagacgccuguaaucccagcuacucgggaggcugaggcagggaacugcuugaacccaggagguggagguugcagugagccaagaucgcgccacugcacuccagccugggugacagggcaagacuccgucucaaaaaaaaaaagaaagaaauuauggcggcuagacacgguagcucacgucugucaucccagcacuuugggaggucaagucgggaggauugcuugagcccaggaguucaagaccagcuugggcaacauggugaagcccugucucuacaaaaaaauacaaaacagccgggcaugauggcgugaacacuuguaguccaaguuacucaggaagcugaggugggaggaucacuugagcccaggaggucgaggcugcagugagcuaugauugugccacugcacuccagccuggaugacaaagcaagaccccaucucaaaaaaaaaaaaaaaagaaagaaagaaagaaacaaagaaagaaagaaaaagagaccgggcgugguggcucacgccuguaaucccagaacuuugggaggccgaggcgggcggaucacgacgucaggagaucgagaccauccuggcuaacacggugaaacccugucucuacuaaaaauaccaaaaaaaaaaaaaaaaaaaauagccaggcgagguggcgggugccuguaguuccagcaacucgggaggcugaggcaggagaauggcgugaacccgggaagacagagcuugcagugagccgagauugcgccacugcacuccagccugggcgacagagcaagauucugucucagaaaaaaaaaaaaagaaaaagaaagaaagaaggaaaaagaaaaaggggccgggcacagcagcucaugccuguaaucccagcacuuuggggggccgaggcaggcggaucacuugaggucaggaauucgagaccauccuggccaacauggugaaacucugucucuacuacaaauacaaaaauuagccgggcgugguggcaggcgccuguauucccagcuacuugggaggcugaggcaggaaacucgcuugagcccaagagguagaggcugcagugagccaagaucaugccacugcacuccagccugggcgacagagugagacuuucugucaaaaaacaaacaaacuggcccggcgcgguggcucacgccuguaaucccagcacuuugggaugccgaggcgggcagaucacgaggucaggagaucgagaccauucuggcuaacacagugaaaccccgucuuuacuaaaaauacgaaaaaucagccgggcgugguggcgggugccuguagucccagcuacucggguggcugaggcaggggaauggugugaacccugggggcagagcuugcagugagccgagauugcgccacugcacuccagccugggagacagagcaagacucugccuaaaaaauaaaaauaaaaauaaaauugcauaguaaacauccauauaccuaccauaccagguuuauaguuuuuaaauaucaucugcaguuugauccugaaaggucaucauguucagccgauuauuuuuuuaaacugcuuuauugagguguaauucacauaucacuacauauauaauucgccauuuagagguguguguguguguguguguguguguguguguguguguauguguguuuuugagacauauucuugcucugugcccaggcuggaaugcacuggcacgaucucggcucacugcaaccucugucucuuggguucaagcgauucuccugccucagccuccggaguagcugcgauuacaggcccagcuaauuuuuguauuuguaguggagacgggguuucaccauguuggccaggcuggucuccaacuccugaccgcaggugauccuccugccuuggccucccaaacugcugggauuacaggcgugaaccaccgcgccuggccucuuuguaguuuuuuugagacggagucucacucuguugcccaggcuggauugcaauggcacggucauggcucacugcagccucaaccgccugggcucaggaaauccucccaccucagccugcuaaguagcugggacuacaggcaugcaccacuacaccgggcuuuuuuuguuuuuguuuuuuguuuuuguuuguuuguuugguuuuugguagagauggcugucaugauguguugcccaggcuggucuggaacugcugggcucaagggauccuccugccucugccuccuaaagugcuagaauuagaggcggaagccacugaaccccacccaauucacccauuuaaaguguauaauucaauagucaguauauucauaguugugugcacauaucaugauagucaacguuagaacacuuucaucaccucaaaaagagaucccaugcccuuuagguaucacuccucuauucuuccuuccccccaacucucuauccccacccaaccuaaggaaccacaaagcuacacucugccucuauagauuucccuauucugguguuaauagaaucuuaauaauaugugguccuuugugccuggcuucuuucacuuaauauauuuuuaaauuuuauuuuauugacacauaauauuuuacagaguuugggguacauguauuuguuacacgcauagaauguguaaugaucaaaucaaaucggggcauuugggguaaccaccaucuugaguguuuaucauuucuauguguugggaacauugcaagugcucucuccuagcuacuuugaaauacacggacugggcgugguggcucacaccuguaaucccaggacuuugggaggccaaggcggguagaucaccaggucaggaguucuagaccagccuggccaacauggugaaaccccaucucuacuaaaaacacaaaaauuagcugggcgugguggugggcaccuauaaucccagcuacucaggaggcugaggcaggagaaucgcuugaacccgggaggcagagguugcagugaaccgcgaucgagccacugcacuccggccugggcaacaagagcgaaacuccaucucaaaaaaaaaaaaaaaaaaguaugucuucucuguaacuauguugguacccauuaaccaaccuucauucaucccuccuuccaccacacacccuucccagccucuaaguuagcauaaugcuuuaaagguucauccauguugucauguggaucaguauuuuauucauuuauggccaaauaauauuccacucuauggauauaccacauguuguuuauguuuauggacaucugggcuguuucugcuuuuuggcuguuaugaauagcauuuguuuacaaguuucugugugaauguauauuuucaguuuucuugggcacauagaaaaaugaaagggagaggaacugcagagccaucuagcuaauucuaucagccaauuucuuuuaaaaggcaggaaaucuaggcuccgugaggagaagugaagugcucagguuuuacaggaagauagagauggagagaagcgaggcaaaucugauuccaaguccaagacucuuccuggcauuuucuuuuauuuuuuuauuuuuuuauuuuaagauggagucuugcucugucucccaggcuggagugcaguggugcaaucuuggcucaccgcaaccuccgccucuccaguucaagcaauucuccugccucauccucccgaguagcugggauuacaggcgcccaccaccacgcccggcuaaaaucuucuugcaauugucuaauggcuccguguagcagggcuucuagccucaagucaugcaauagccuguuaguguuaugccagguaccgagggacucagaagccagacaacaggugaaaaggcaaggaacccagauucauuuuuaaauuuuaaaauuuuauauuuauuuuauuuuauguuuauuuauuuguugagacagggucucacuuuaucacccaggccagagugcaguggugugaucuuggcucacugcagccucaacuucccaagcucaagcaauccuccugccucagcuccccaaguuccugggacuacaggcgugcuccacugugcauguuaauuuuuguauucuuaguagagaauaccaagcccaggcagaacccacauuuauugagcaccaguugguuccaggcaucacacagaccuuuggcauucucaaucaguggcauucuaacuacaacccugccaaaugacauuauggugcccacuuuguagaugucagcuagacacuuagaggagacauugcuugcccagaguugcacagcaagcagauaaacggaucuggacccagguuugccugauuugaaagcuuaugguaauuccacuaaacagugcucuccucugcaaauauuuaauagcuuuaguggggguggggaggaaaaaaaagggaaaaaauacucaauagccuuaagcucugguacaaaguucuucuaucugcaugaauucaauuucucacucauucauucaccaaacacucacugagccauauacaugccuucucuauagggauguacagaggggauacagagaugacauacuuccagcucucaaaaaagggaaacuggaggaugaguucugggugcuaugaaugaucucuuuuaauaaagagcuucucaauaagaaauagaccaggcgcaguggcucaugccuguaaucccagcacuuugggaggccgaggcgggccgaucagcugaggucaggaguuugagaccugccuggccaacauauggugaaacccugucucuacuaaaaacaaaaaacaaaacaaaacaaaaauacaaaaaucagcugggcuguaacacccugggaacaaauccgaacguuccuucuaaaccaacgcaggccgacucgaggcucuagcagucaguggaagaccucagcggaacugaagaggcuuugcuuuguuuccacaguaaagguuuuugugguuaccucugcaccacuugcgauaacguaaugacgugucacaccuguagucccagcuacuugggaagcugaggcaggaaauuuguuugaaccaaggagguggagguugcagugagcugagaucacgccacugcacuccagccugggcuguuucucaaaaaaaagaaaagaaaugaaauuauuucacacccaagagauuagcgaacauuuuaaaguuugaguaucagauauugauaggaauguuaagcaacaaaggucccuauuuauugcuagugggagugccaaaugguaguaauuauuauagcuaacucauagcaccugcugugugccauacauuguccaaaauacuuuauauauaaugacuucuuuaaucaucauagcaacuguguaaaguagguuuuauuaucacccucauuuugcaaauuaggaaaccuggacagaaagagcugacuuaagcauuagacacaguaguagauacagugccuagggcccaugauacucuuagggacccacaacauuuaaaaauuuauuuuaggccgggcgcaguggcucacaccuguaaucccagcacuuugggaggccgaggugggcggaucaccugaggucaggaguucgagaccagccuggccaacauggugagacccuguauauacuaaaaauacaaaaauuagccgggcaugguggcgggcaccuguaaucccagcuacucaagaggcugaggcaggagaaucgcuugagcccgggaggcagagguugcagugagccaugaucaugccacugcacuccagccugggcgacagagugagacuccaucucaaaaaaaaaaaaauuauuuuaaaaucaaaagaaaagaagggaaauauagcuuuggaagaccaaggcagaaggaucgcuuaaggcuaggaguucaagaccagccugggcaaggcaagacagcaagauccccaucucuauaaaagaagaagaaaggaggaggaggagauaauucagccuaagugguguuuaucuuuauuuuauaccaacauaucacaaaauauaauuucauauauauuuaugaaugaaaugaucaugcuuaggaucauguuuaaguaucuccuauccugcccuuucaagaaaacuauuuaaagauguuuccaaacucuuccaugucucuucucagugguuugucacaaugcuucuacagugcuacacaaaagaaagagaaaugguccagagaaguguagugacuuauccaaggugauaccaccagaaugacuaaacggggcagcuaagaagagccccguccuugaugcugcugaaaaccccgcguuuuugagcucuuuccucccaaacauaacaucagcuugcggguuuuugcguccucccaggaccaccuguguugcuguuuacugaauauuuuucuccacacugccuuuuuuuuuuuuuuuuuugacagagucucugucacucaggcugcaugcaguggcgagaucauggcucacugcagccucgaccucccggccucaagcgauccucccaccucagccucccgaguagcugagaauacaggcaugagccaccgcacccggccuacaccgacguuuauaaacuuggcgucauuacguugucaugagcagugcagagguaaucacaaaaacguuuaccguggaaacaaagcaaagcuucuucaguucugcugagguuccccugacagccagagccucgagucggccugcguugguuuagaaggaacguucggauuuguucccaggguguuacaggcauccuagcgccacacagagcguacccucggagggacagacagguaauuagagagggaacaacucacauucucccgggcucagccgccacgccccgccccgccacgcccccugcugcaccacgcccccucgcagccccgcacugcgccugcgcaguagcucuuacgccaguucgagccccacccccuuucagagcgaacauuggccuugggggcggggcuugggcacaagauggccgcugcgcgcccagaggcccagagucggagcucaccgacuccggagucgcgaucccaggagccacuggaccuggugcgggcaaggaaggggccugggcguggggcucgaggugggaggaggucguaguguggggggcggguccggggcguggccuaugagggggugggcgagggagguauuuagugcuauggcccuggggguggggcuucuugugguuucgcgaggggcggggcaggggaggagacuaugucauggugggcggggugggggagggaccuauggguggugggcggggccuggaugggggcggagucugaggacgguguugucuugugggacggguuuggguccagggaagggggcuuaccagggauaauuugcauaauuuggguggagccuuguaaggggcggggccucauaaauucuagggcuaauucuaggguagaagguugggaaggugacccugaaaaacgugggggauuaugauuggagcaccuaugucgggguaggggauaauucuucaagggucuuagugaugcuucucgaaugcccaagggagaauuuggggguagaaguggguggucuaggugacuuuggaacuuccuccacguuaccccacucagaauuagacuaauugaggacauucauucauucaacaaacauuuacugagcuccuacuucggcucuguaaauagagaagugaccaagacagacaaggguuguguucuuuuggagccugcagucucuugagaggagagagacaauaaaggagaguuacugugauauguucuauaaaggaaauaaaaauugagccaauuucuauaaauugagccaagaguagggguggggcagcuaaauuuagacgagagaagucagcugggugccggcuuauguuuaagcuggggucagagagauaaguggagcuacaucgccacagauauuauagugacgauuugggauaagucauuuggagccacuggaggguuuugagugcgaaaaaugacuugaucugauuuacauuuucaaaagaccuucaggcuauuccugggagguggguuacaagccagcagaaauaggaacagagaugcccuuggguuuuucaauuuuggaggcgccaagugauggggcuuuaacuaggguggaggacaaaaggugggauccaugauauauuuuggacaggagaggaaauguugaugaggauacaacagaauccuggaggaugggccgggcgcggcggcucacgccugcaaucccagcacuuuaggaggcagagccagaaggaucucuugagcccaguaguuggagaccagccugggcaacauagugggacucccucuacauuaaaaauaauaauaauaauuuuuguuuguuuugcugucuaagauggagucuuguucugucgccugagcuggagggcaguggcaugaucacaucucacugcaaccuccaccuccuggguucaagcgauucucgugucuuagucucccgaguagcugggauuacaggcagcagccacaacaccuggcuaauuuuugcauuuuuaguagaaacgguauuugccauguuggccaggcugguuucgaacuccugaccucaggugaucugccuaccucagccucccaaugugcugguauuacaggccugagccaccgugcccagccagaaauaauuuuuuuuuaacuagcuggaugugguggugcaugccuguaaucccagcuacucagggagaugaagugggaggaucgcuugagcccaggaggucaagguugcaaugagccacgaucgcgccagggcaacagagugaggcccugucugaaaauaacagaggagcccaagcuuuaauaauuggggcgugcuggggcgguccugaggcagguuccacaggcuccucuuucuucuccucuugcccagguccuggugccugaugacugccggccuggcacacccccgagugaccucaucgagauccagguggugaaggugacggacaccacgcuggucccugagcccccggagccagguucuuuccacugugccuugugcccugcugccuuccggcugguuuccgagcugcuguuccacgaacauggccacuuggcuggggccgagggaggcgggcaggguggggacccgagccggugccacgugugcggccacagcugcccgggccccgccagccugcgcgcgcacuacagcuugcacacgggggagcggcccuaccgcugcgcgcucugcccccgcgccuucaaggccuuggcgccccugcuccggcaccagcaccggcacgggguggagccgggcaccucucggaggccuccggacacagcggccguugcagaacagaggcccgggguggccccggagagggcggagguggugauggcggcggcggcggcgggcgcagcgguggggaagccuuuugccugcagguucugcgccaagcccuuccgccgcuccucagacaugcgagaccacgagcgcgugcacacuggcgagcggccauaccauugcggcaucugcggcaagggcuucacccaguccucggugcuuagcggccacgcccgcauccacacuggcgagcgcccguuccgcugcacgcucugcgaccgcaccuucaacaacuccuccaacuuccgcaagcaccagcgcacccacuuccacgggccggggccggggcugggagacucuggaggccagcugggcucgucggcggcugaggggucggggagcgggugugggguaggggacccugcggaggaggggcggggggagaccgcgaaggugaagguggaggccgaccaguaggcugcagaccagggacauggguuaguuaaggcggagguacgaggccgacccggggagggggacgggguggggaaacggaggcaggggacagaagaggggagauugggggagagaugacagcugcagggaugguugugagccgcuagugauggagagcagagggagagggccaggcuccagacucccacacgcccacacagcaccucugccaggccuaggagaggacaggugcagcucuugcagcucugcgggugugcggccaaaggcaaggcccacgggcuggaugucacuuccccgacugucucuugguuggcuuguccuugugcaagacccagccugucacgacagagccugggcacuucagaggaggagccaggaucgaauggaaggggggaauugggguccaccauagucuucugcucugguccuccacggguggaccaggauggagucuccugccuaccucacugcauugcacuggaccugggaugccuauccacccucuggcagaagacacucaccagguuaucugugaagagacucugggaucccaucaccucaaagccagaggguccccaagucaccgcugagagcacuugagccucaaggauguaagccugaccauaggaucuugacuccaacagcggcaacccccacccccauugugguccguccuuaacccauccacucuucuucggaggcaacugagaacacauaaagcaagcagcuaccuagcaucccccuccuaaagcuuuagacucagagcccagggucccccacaagccucaagguagccucagguuucucuaauuuccuccacucccaguucgaagcaaacagcuuacugccuaguccccgccaaucccaagggcgggcuggcugauggcagcauggugggcuggccuggguguggagugaaagagucacuguggugggggcgagaggaggacuugggagcuggaggugugacaccuucaguucuguuccuauuaaaggaccuucugaagggcuucucugucggucuuguauucggauuguccgcuuuggggaguugggggaggaggggccucaccaugguuuugccaccagcagucaguugcaucaucucuuccuccaagcuucuguuuccccaucaucagaauggggggugaguaggccccacugugguuacguguuaugugguucagcuguaggagaggggggucagggaaguuuggcaaaagcacacucaacaugcuuugcaugcuuguugagugagagccucugauuugcacaccuuucuguucacccagugggccccaugagauaacucacaggcaacucacaaugugaacagaacucauuccauuuuccucaaagaaaccuccaugcuucugaugucauuggcaccaccacccaagcuggauaccugggcagguuuaaaccuucuucauccucauucuuauguccagucccuuaucaguuucccucaguugagccaguuaauaucuuuggaacuggaacguguuuucggcaucacuacacuuguagaccaacaguggucucacacacagacaacugcacagcaguccagugccugcauuuuuuuuuuuuuuuuuuuuuuuuuuuuuuuuuuuuuuuuuuuuugagauggaguuuugcucuuguugcccaggcuggaguccaauggcacaaucucugcucacugcaaccucugccuccuggauucaagcacuucugccucagccuccugaguagcuaggauuacaggugggcgccaucacgcucaguucauuuuuguauuuuuaguagagaugggguuucaucauguuggccaggcuggucucaaauuccuuaccucaggugaucuacucgccucggccucccaaaguguugggauuacaggcgugagccacugcacccggccaccugcccucuucauucuccauauggcauccaugcagauccuugucaccaagacacagcuccuuguggcuuugagacgauuuggaaaugugaaugccuacaggagcugggugaaaauguaaauacacgagcaagacggccagguucaaggggaaaauaucagcaacaugaaauaauggcgauugccaccaggucucagaauugguauucaacaaauuggagagugccucuucagaagaggguaauggcugcucagcuccggaacacagauuggguugccacaucuuccaguuucuuucagaaguuccauuaguucacauuauguaaaaucuuuugauuucccaauguuggcagucaagucaaacuuuuuaaaaaaugcacagacuaaacaaaaauguguuaguggucauauucggccuugcagcugccaguuuccagccucuagccuauaaaaucacccaagccccacaguuuggaauucaagacccuucaggguuuagcccccaggaacccaaccuccagccauacuaaucugucuuaaaugcuccagaauagcaggguuuaguucaacacacuaaacucuccgccuggaaaucuuugccacuucuuuuuuuuuuuuuuuuucuuauuuauuuauuuuuuugagacagagccuugcucugucgcccaggauggagugcaguggcaugaucucggcucacugcaagcuccgccuucuggguucaugccauucuccugccucagccucccguguagcugggacuacaggcgccugccaccugcucccaccaccacacccggcugauuuuuuguauuuuuaguagagacaggguuucaccguguuagccaggauggucuggagcuccugaccucgugauccaccugccucggccucccaaagugcuaggauuacaggcaugagccaccgugcccggccucuuugccacuucuuuaccuggaaaacuccaguugguuuaugucaucguucagggaucaccuucuccccaagaagcuuuucuagccccccuuccacucugacaggugacuccucugugcucccucaagcccuagugauacuuccaagucccuuacacugugaggcuccauuuccauguuacugcugaacccugaacccugggggcacuggcacaacgucugucucaugcugggucuucagcauuagaacauggagccacacaggguagcugcucucccaugggucacacaggacucacccaagcagcgcucuuaccuaguuucaucuucaaguuucuuuuuuuccuuuuuuuuuuuuuuuuuuuuuuuugagauggaaucucgcucuugucgccuaggccggagugcaguggcgcaaucucagcucacugcaaccuccaccuccuggguucaagugauucuccugccucagccucccgaguagcugggauuacaggcaccugccaucacgcccagcuaauuuuuguacuuuuaguagaaaggaugguucaccauguuggccagacuggucucgaacuccugaccucaggugaucugcucgccuugggcucccaaaguacugggauuacaggcaugagccacugcaccuggccucaucuucaaguuucuguacugaaguacucugggacugaaguccaaauuauuuauuuguugagauggagucucacucugucacccaggcuggaugcaguggugcgaucucagcucacugcaaucucugccuccugaguucaagugauucuccugccucagccuccugaguagcugggauuacagaugcccaccaccauguccagcuaaguuuuguauucuuaguagagaugggguuucaccacuuuggccaggcuggucucaaacgccugaccucaagugaucugcccgccucggccucccaaagugcugggauuacaggcgugaaccaccaugccuggccuggaguccaaauucuguggauuuuugagaugucccuggagcaccuuuguucuucaggaccccaggcccuucuucuaacaaaugagauaacuaaacacacauugccaggcauacaucuugcuguucccagagccaacaugagagcugugaacgggcuuuugaaucucccaaucauuacccuggaggacaagugcuaagagggagcuguaucaugaccaucagucugcacaugguugugaggcagccacggcagccggaugggaguucucuuuuguguuacuugaggccaaggggcacguccaauucaucuguuuccccagugcccagcucagggccuggcaggcaggaggucuccggaaguggugguggagugaacaaaggcugaaagcauccggaaggggaagagucggggcauguuaagucaguuccugagagcagacacuuaccugucuuguccaucuccauuugcccagcucagacuaacgcugggaauacagcaaauccucaguaagucccuguugaaugagagugagugagagacagaggcgcccggcaucaaaacugcagaggaaacaaguuuuaacuuugugcuuugccaccaugugauccccacucucccugggugggaugcaaggauggacuccagcggcccucaugguaagauuuauuauucuccgcucuguacaagccgcgucugccaccccgccccccacccccccaccccaaaaagcacccagcacucccuugugcccucccaacucugcucauacuccacuguccagccagauuccaaaggagggggaggggcgguucagacccaucuccgccaaaacuuacugggggcagagugcugcuggggcgggggcugaugcgggucacaaacgaggguuggacggaggauaggguucagugucugaugggaugaggggagggcagagaggucgaggaugggagugauucagucuugagccugucgggcgugcgcccugaaggucgccaguccgugugaaguucugaaggauggggcaacagcgaggaggggggaagagucugaucaguccugggaggugggaguccagaagggggcuuuugaugggagugggaugggaaccccucggucaggcauccuucccggccaaggugcccgccccugcuccaggccccccgagguucucggccuugugcgccaggcgguguuucuugaggccguagguguuggcgaagcccucgccgcaggaggagcagcggaagggccggccgcccuggugggcagccaggugcuuacggaaguagccgggauccuugaaggccuugaggcaggcggggcagcggagcucgggccgcggcggcucaugggcgcgcugguggcgcagcacggagcucagguagaagaagcccuugccgcagugcucacagcgguaggcgcgcucgcccaggugcagccgcuggugcuccagcagguuggagcgguagcggaaggucuugccacaggcgcugcagcgcuggggccgggccacagcgugcagccgccggugcucugccaggcuggacgacugcgcgaagcgcuuggcgcacacgccgcacuugaaggcccgcucgccagugugcaccacgcggugcugccgcagguaccaggagcgcaggaagccucggccgcacacgccacaucgguacggccgcuguuccguguggcagcgcugguggcgcaucagcagggccgccucccagaagcgcuucccgcacaccgggcagcggaaaccccgcuucugccgauggcugcggcgguguaggagcaagucguaggcgcccgcgaagcucuggccgcagaggccgcagcccaggguccgucgcaccaggugcacguacuugugagucacgaggcccaggaagugcuugaaacucuggccgcacguggcacagcugaagcgcucggggccggaacuggcacccccgccagcaccugccaccgccgccccgccugcguccucacccccagacaccccugccagugccgccacggccgcccccaccucccccgccagcccguuguccagcacgcuggccgcauccgugccgcuggagccguccgggggcugcaggccgccgggugcgggcgggagcaggcgcucgggggcggccugguggaccagcuugugccacaugagguucucgaugaagccgaaggucuugccgcaggcgucgcagccguauggcuucucugccauguggaccuccuugugacucaugacgugaaagagauccgggaagugcucgccgcaguccgagcaggcguagcucagcccaucggugggcccugcagacgugcccgaggccccgggcccacaggcccccggugugccuuggguggaggggaggccggcugccccggccagggcgcagggcagcuggagccggugcaccuggcgguggcgggugaggcucugcggguagccgaagaccuugccgcagagcucgcacuuguagggccgcucgcgcgugugcaccacgugaugcuugcucaaguggaaggauucgcggaagcgcuucccacacacggggcacugguggggcuucucgcccguguggaugcgcucauggcgcuucagggucucgcggcgcccgaagccgcgcccgcagaugccgcagcagaacgucuuuccugggacgcuggcgcccgagccucccgccccgcugguccccgcgccgccgagcagcagcgggugggcgcccaggagcgggacgggcacagcgccguacaccaccgccgccgcggccgccgccgccuucucgcugucuguggugggagggucggggggcaggagguacgggcccggggggaaggugggcgggggcugcggggccgaggccgccccguccuugggcgccuccgcagcggcagcgggcggggcgugggcggccuuguggcggagcaggcucugcggagccgaguaggacuugccgcacaggucgcagggguacacgggccgaggccccccggcgcccgcccccgcgugggccgccuggugcuugaggagguaggaggcgucgcggaaggccuucccgcagaugccgcagggcaggcgcaggaggucggccgagugcgucuucacguggcgcuucagacucucccugcgguugaagcuuuugcugcacacggagcaggagaagggcuucucgcccguguggaugaucuggugcugguggaggugacugggcuucuugaaaaccuuccagcagagugggcaggcgaacgggccaucgccacccccgguggcaggagggggcaccccaacaccagcaggggcggcgcucccgucugcggagggggcaggcgccacgggcguggcuggagggcccgaggacaccguggagggggcggcggcgguggcggcgcuggcagcgggugcugggaggcccagcggcgggaggugggggccgggcuggggcgggccccccgcggccgguggcacguccuuguggcagcggcgguggcggaugaggcuggacacgugguuguaggugcggccgcagacgccgcauucguagggccucucccccgagugcaccagcaugugcuggaccaggugcgaggacugcuugaaggacuucuggcacacgccgcaggggaagcgccgcuccaucagguacuucagucuccggaaguagcccuugucguccuugguggggucgcaggccgccgccgcgggggguccuggcggggucugcgagggggcaggaagcggcccuggggcccccgcgggagcgcccagcccaggcgucacccccggcccggacgcgggcccuccucgcuucagguucccaaacaagugcuggugccccgagagguccacgaugccccacugcggaguggggaaagcagcgucaaagaggggaggagggggcgccccgaaggcgggcggcaggggcggaucgggcuucuuggcuugggaagaggaagaggacgaagaugacgacgaggaggacgaagaggaggaggaggaggacgaggacgaggacgaggagggcaccuccgccuugggcuugaagguggacuggggcggguagucauacugcgggggagggggcugcggcgggggcugcggcggggggccgggggcgcagggcagggccgccaccgccuuggcguguuccccauacaguuccaugggcucgaagcgcuggugguugaggaauuccaggaagucgaagggguagcucuggaagugcaccccguccucgcccccgaugccgcugcucccgccacccccggcgccgcugcccgcuggguucgccuccaucuccggcgggugggagacgggagacccugugaagaggaggacggggcugaggacacggccgcggcgcugggucuccccgcaggugaauggagcugugcgcccacucauccauccuugugcggaucacccccuagccuuccagauuuaggcuuccagucccucugccuguccaccccaaagggcagcccuuccucuuggcucccuggccccaggacucuccuacucaccuucaccuucccucucuguguucucaacucccacccacuccccaccucuuuuccuucucuaauuccuuccaucucuccccaucuuuucugggguccugacacagcuuuguagaggggacccucuccuccacaccaccugcaggcccucuauuauuuguagaaacgggguuuugcuuuguugcccaggcuggucugaaacuccuggacucacgccauccuccagccuccaccucccaaagugcugggugauuacagaugugagccagcgcgcuggccugggccgucucuacuuucucuccuuuucagacuccaauuguccaagcauccugggggccucuggacucaguuuucuuuccaaacccucucagacccucugcugucucuccauacuccugcacccuaccccacccacagcccuccguccucaucccuucagguuuuauccuaaaaugagcauaaugauaaggggaaucacaguuucuaucagcguaauuaggagggaggacucuggggccagaaucaaauguaagcccugccacuucuagcuguguggccacgggcaagugacugaaccucucugugccuccauuuccucaucuacaccuggggaccacaaagcacaugccuaccucacaggacugugaggauucaacacacacauaugugcaaggcucuuagggggcgguuccuggcacucuguaagcacuccguacauagaagguauggacugggcacaguggcugacagcugucaucccagcacuuugggaggcugaggcaggagagcugcuugagcccgggaggugaaggcuacaaugagcugugaucacaucacuguacuccagccugggugacagagcaagaccuuggcucuaaaaacuaaaauuaaaaaauugaagauacgauacuguuaucacuguuacuacuaguaguagaaauggggaagucaggacaagccuagagaacugaaaaaagucaguauggggagugcacucuuuuaauauuaauagacaguagaaaggagaauuugcuugccugggagaaacaaauuccagcaagggggcuggcauauagucagaagguggucugauacaaucaaaacacagacccugggcuuggacagaccuggguucaaaucccaucuccacugggauccacacuuucuccauguuuaaaaugggggaaccccuauaccgcagggagauucaacaggguuggaacagaacauaaugaaacacaugcaucagcagaaugcauucaacccccugagcuauuuguaccauccaugacaucacacaccugggcuaagccuagcaacagaagcagggagcuugaguuccauccuugcccuuaguggggcuucuccugacccccccauguccuugcccuuaguggggcuucuccugacccuccacccccggcaucauucucuggcaccuccuuuacacgacuuuucauuccagauggcagguauccauguguguaccccacaccacaccagacccucagcacccguaacugaucuccgaguucuuggucuacuugcuggccuggggaagcaccuccaccaagugggcggagggugagucggugaagggcccaugaggucugacccgcuuccuguccaucaucccuacccgaugggggccaggcucuaagcccagcccgcuaugggggucaaggggguuccuaccaaggccuggacccuuuauccucuauccaucgggcugcucucuccucccacaggugaggggugagugucucuuccacccccaccccaaacgccauccuggagugagauauuuuuagucuccagcuccggguguccuuguccuuggacaagacucaacaucccaugcccuucacacccccuccguuuaaucugaucuccggaaagaggacaggcuuggcuggggugguaauuggaaggcuguagguggaaccuaaguuggggagacagcucuggagggggcugacuggccagggaggcaaacacaggccauaaggaugcagggaauagggggugauuuagggcgcuauggggagggagggcaagaguguuuggggaaagaagccccugacuagcuugucuccacuagagcacagguuaaucguagcugucacugacuggacaucuccuagaggcccgccacgguucuaagcacguuacacauauuaauucacugacuccccacaacucuaaauaggggcagcuguucccgccguuggauaaauuagaaaacuaaggcauggagaggcaaagugaguugccauggucacggaguaggagucuggaucaaugggcuugaaccccauucccacccuugcccccacagcaguguuucacugggcuguuccccgagugaacaaaggugaggggagaacuaucaggauaagagcuuuauuuagggaugucuucuggguuaugaggggugucuauacaaggggccuggugggagaggguggugguuacuuucucuucugccuacaguguucuucgccagauuucaacaagacucccucuggagccuccuugggucucuacucagcacuccccaccccaucacucuccagucccucauccagccgcagguguuucauuauaguuauugccaccaacucaugucauuccuuuucuguguguuuacuguuuggccccucucuaggaaagcaaggacuuggccugucuugcucgccccugugaccccagcacuuagcguagcacuggcccagugugggugcuugacaaauaucugcugguaugugaaaaggaaacaccaccuuccuaaauuaccaauggguccacaaagaaaucauacauuagaaaaugcuggccaggugcgguggcccacaccuguaaucccggcacuuugggaggccaaggcaggaggaucaccugagguuaggaguucgacaccagucuggccuacauggcgaaaccccgucucuacuaaaaauacaaaaauuagccaggcuugguggugggcgccuguaaucccagcuacuugggaggcugaggcaggagaaucgcuugaacucgggagguggagguugcagugagcugagaucgugccacugcacuccagccugggcaacaagagcgcgacuccaucucaaaaacacaaacaaacaaaaagcaaaaaaacugcuuagcaauuaaugaaaaugaaaacacaacauaccaaagcugaggaggugcagccaaagcaaugcucagagggaaaugcacagcugugaaugucuaucuugguauuuguggaaugaacaaagcgaugagacuaagcugaucaaacucccagaggaacggagggggacauguagcagaaauggagcuaaaugaucccaggaauuccugggagaagcaauucuggggacagugauguuaugaggagggcacugagggcaggguguggagaugcugaaggggauacaucagugguggacagaauugaucaggcuuaugauaaucuccacuaggaaaccagaaacauucccucuuucauacaacucaagccuaaacugguaucuuuuuaagaggggaugucauaggaggguuuuaugcagagagaagcaugauggggagggacccaccccuccaccaccaccaccaagggacaggagucccacagcaaguguauuaacgguucacauuuauuguuugaccaguuugauauuuguuauugccuggaggcagcacaguccuguaccaugacugggcccaucuuauaaguggggaaacugaggagcagcauggggaaggcauuccuccaaggucauguggccaauaaagaggaaagcagguaacugauuccaggucuuucugaugccagacugugggccguucugcugcaacaacgcugccuugugaugaaauucugguuuguuaauaaagaguaacgugcgcauauaacacuggaugugugcuuucuaccagcccagcacucuuguaacucugaugugugugagcucaacgaauccucccaguaacccuagaagaugguuacaagcauugacucugaaauacaaaggaagagacugagggccagagagauaaauuaaacuuccaaagucaggccaggcaugguggcucaugccuguaaugccagcacuuugggaggccgagguggguggaucaacuauagucaggaguucgagacuagccuggccaauauauagugaaaccccgucucuacuaaaaauaaaaaaauuagccgggugugguggugcacaccuguaguuccagcuaguggggaagcugaggcaggauaauugcuugaacccaggacacagagguugcagugagcucacgccacugcacuccagccugggugacagagugagacucuguuucucaaaaacaaacaaacaaacuucuaaagucacauuguuaacuaguggcagggccagugguugaagaaaggcagcaaggcuccagagucccaucacaugcugucuuucgguauuucucccuccaaaaugaaggaggacccccgcccccaaucccacuucauacuggaaacaugcauugcuccacccaucucccugccaacaaaucccaagucucuuggcuugacccaagaccagaacaagucaccaacauuuguugaccucuaacaagcauuguacuuaggugccuuauguggcuuguuucauucaaacuucacaacaaauguguuauuauuauucccauuuuacugacaggaggacuauaaccaaagcaugucuauccucggucccaaaccaaacaguaaccccaucucauucaaaagccacaguccugacugggcacgguggcucacgccuguaaucccagcauuuuuggaggccaaggcaggcggaucaccugaggucgggaguuugagaccagccugaccaacauggagaaaccccaucucuacuaaaaauacaaaauuagcugggcgugguggcacaugccuguaaucccagcuacucgggaggcugaggcaggagaaucacuugaacccgggaggcggagguugcagcgagcuaagaucacaccacugcacuccagccugggcaacaagagcgaaacuccuuuucaaaaaaaaaaaaaaaaaaagccacaguccuuacaaugaccuccacagucuccuggcugcucuucccaugugcccacucuauuccugcugcagggccuuugcgcuggcuguugcuguugccuguaauauucugacucucaggcaaccaucucgcucaccccuucaccuccuccccaucuuuggucaacugucuucucaaugagccucucaguaaccaaugaccugucacccaggcccacauccucaucucccuaacccugcuucauuucucuccuuacugcucagcaucauuuauaaccucacauaaucuacuucuuugccuugauuuuguuggucuccccauccagaugaucggcuuccugaaggcaaggauuuuuaucucuugcucacuguuccauccccaggaccuacaacaguuccuggcuugauacauuuuuguuugaagaagugaaugaaugaggcuaggaaaggagggagugauuugcucaaagcugugaacccuaguggaauccagggcucauccucccaaucacuucgcuccugggguuagggcgcuguuaagagcagcccccaagugggccacaguuguccaggagaaggggaauuuuuacucuuguauaacuuuuugguguguggcuuuugggagggacaagaugacaagacauaggaaaauccugggggaggccauccugaaccacagccccccaggucuaucucuuuaucccgugauauucugaacacgcacauauacucuugguuuuuguuuuuauuuuuuuucacugcagccucgaacuccugggcucaagcagcccucccaccucagccuccugaauagcuggggacuacaggugcccaccaaccacacccagcuuuuuuuuuuuuuuuuuuuuuuuccuguaaagacagggucucacuauguugccgagguuggucuugaacuccuggccuccagcgauccucccacuuuggccuucccaacugcugggauuacaggcaugagccaccucgccuggccuguauuuugucuuuuaaucaucugcccccucaacuagcauauccacuccaugaggacagggauucuugucuauuuuguucucuguuguacccccaauguaaaguaggugcucauuaaacaguuguucaaccaguguuuacgaaugaacguaugaaugaaugaagaacauucugggcucgguagagcugacaaaggcuagauaauuuaucccagugcccucaccuccaaagccuuuugagaccaaagcuuccuuccucuuguucuugccuucaaaucuuccacuccacccucaccggccuccccugcugcuccuccacucaccgugcucaccgccacuucagggccuuugcacuuguuguucuugcugccugcucacccagaucuuugcauggcuaagcugccacuuguaauucagcuuucaccucuaaaguaguucaucaggcucucagagaacccacaaaaccccguguaucuuugucgacucgugucugaucaacuagacugugagaccccgcacagugagaacacuguguguaucgacccccuucguggcuguauauuauacccuucagcuagaauagugaauaugcguucaacgcagaaggaaugccuacgagaaaagaagucacacccuagugaaguccagggucuucccuagggaguccaggacgauagccugagagcugggugagaagcugcaggucagggcaacaguuguucacgccauaggaagaggaugaggcacauucugggaaggaaggcuucaccgccucacugcgggacacuguucuguggcagaaguaaugaagacgggcugaccgcgaugaggguggggugagaggagguacgggaguaugucaugggagccuggagcuaagcaggcggauauuucuaccugaggcgggagaggaugugagugugaaggaacucuagagggagcugugccgcugcgauggggggguggcuuugaaaggggcauucuuaaggggaaucacuggaggaccugcagaagggaaaaaggcauucuuggugcugaccagaauagaaaguauuuucacacccacgaaggggcguucugcuggggagggagguggucagggccauugggggcuguugcuguauggacagagauaacgggggacaguucugcugcaaggcacuaaggaaacacucuggggagaauuauauagaggauacuaauaagaggguucacgagcagcugcccuacauggggaggggcaaugcugauggcaucuggaggcugaccuggaggaagcaaugacggggagcgcuauguggaggggauccuacgaggagguaucauuugggggcccuggcagccguuuaggggaucgccacgaaugaaagcgcuuuggcagccauccuagcugggggcguucaugggggagcuaucugcagugauccuaccggggagcagugauugggggucccuuggcaagggcccggcgggagcugcacugacuugcuagggguugggggacguucuggggaccacagcgggccagggcggggccccccgcccccgcugcacccgggcccccgggccacgcaccccgucacucaccggcgccggggucuccgccgggaggaggccgaggaggcggaggaggcgccgccgcuccggggagacccgagggcccgaccggaagugccgcccccuccccccuccccggcagccccgcaccgcccgccugcccgcccgcccggaagcggaagucgcgcccguucccgaggcgccggcguggaggaucggaaagaggaggcgguggcggggaccaggaggggggaaaugcgcuugcgcacugacucggggacgcgagcagugaaagcccgggccgauuccggugggcgaacugagccaggugcgccugcgcuuugaaugcccgccucuucuacgggaaccccgcgacacgcucugggcguccgguuaagccacaccuccggcucgggucucacacugaagccccgcccccuggcccugaaccacgcccaucucacagcgugauuauaagcccccuacugccucaaagucugucuucguccccucgcccucaugcaguuucuccuguucuucccccucuccaagcucccacucucuggaacuucaccccucccuaggccccgcccccuccauccaagccccgccccuucaccccauagcauuuaaguugcaccucgugacuuuugagugccucccaccucuaaagcauucuuuuaaaucggugguugucaaggauaguugggaggccagcagcauccggcugccugcucagaccaugcggaauagaagcccugggguugggggucuagggauccguguuuugaaauacucugauucugcugcaugcuggucaagagccauggauuuaccacacuugacacugcccgcucauauaaucgcuauaaucccggcucccaacucagccccaucccaaacagccaaacccagacccauucagccccuccugcuaagcuuccacucucccaggaacuucccuuagauuaaguacuuccuucucuccccaucgccuccauagcagucgugcgcccccaucagcaccuucuaagucccaccuccaauacccuguucccucagaguuucuccuuuaagccccggcccccggcccucggcccugaaccacgcccaccucagagcugaauuauuauaagcuccgccccucaccuuaaaauccguucucuuggccuggcgugguggcucacgccuguaaucccagcacuuugggaggccaaggcaggcggauugcuugagcacaggaguucaagaccagccugggcaauauggcaaaaccccgucucuacaaaaaaaaaaaauacaaaaauuaggcuggacgcgguggcucacgccuguaaucccagcacuuugggaggccgaggcggguggaucacgaggucaggaggucaagaccagccuggccaagauggugaaaccccgucucuacuaaaauuacaaaaauuagccaggcgugguggcgggcgccuguaauuccagcuacucgggaggcugagggagagaacugcuugaacccgggaggcagagguugcagugagccagauugccccacugcacuccagccuggacgacagcaagacuccgucucaaaaaaaaaaaauuagcuaaauaugcuggcgcccgucuguagucucagcuacuccggaggcugaagcaggagggucgcuugagccuggcaggucgaggcugcagugagcggugauagggccacugcacuccagccuggaugacagagcgagacccugucucaaaaaaaaaauuauccguccuccuugccccacucucacgcaguuccuccuguucuuccccagcuccaagccccuacucucuauuagaucaacucuauccauccucuuuaaaccgcucucacuuucugcggaccaaccccuaaaccucuuuaagccccacccaacucuaacccucuucuaagcccccgccccaggucccagccuaacugccccgcaaucucagccccaccccucgcuccuuagccccgccccaauccacaccccuuaucucuaaaccuuacccagaccguccugcucauaccuuugucuuaauuuuuccuuccaaacaguagguccucaggacaaggagguggggcaaaguggcugcagaauuucugggaauuggcuaggagagaggcggucggaccuacagucaggucugcauggaagguucaauguuuuuaguuagauuggauguguacugggaauacagcugacccuugaacaacagggguuugaacugcagguccauugagaggcggacguuuuuucacccaaacaccgguggaacauacaguauacgaagggcggauuuuccuacauccgcggguuccgcagggcccacugcuggacuuguguaugcccagaucuugguaucugcgagguucguggaaccaauuccccgcggacuccgagggacccauggacuuuggggucugauggagauggggaaggggccaagguuccccccaaaaccauucuuuggcgagcaccacgcucaugaggcacaggaagugggguccucuccaauuccccgcacucccgacaggacgguguagccgaggaagaacauuugaaggcaggagaggauggcaucccggcacggaacacacacaggcagccagcaggcagagauuuauuuccacagccccugccuccaagggucuguuagucugggggaggggggcugaaggcagcuggaccccaaaguuuaggucuccacccuccaccugcucccacaacgggaagaccaccggaaacaagggugucccggcccccuggcucaggcccagcaccagccaaacucccugcucuaaaccuggcccagggagcgauggccgggggugugggucaggccggcuccccuuuccccucugucuccuccuccuccucggccccugcuguggccgggaugcccuccucgucccacggcgguucagacccuggaucuggugcacacagggguacccccauggccuccgggugcuugcgcuucgcauggcgccggagcguguuggccucuguaaagcgcagccggcagauggggcacugguacgggcgcucccccgagugcacgcggugguggugcgccagcucgcccgccucgcggaagcggcgggggcacagcgggcagcggaagggccgcaggccggcauggauguugcagugccgccgcagguggcuggagcgcuugaaggucuugccgcaaaccuugcacuggugcggcuucagcucugagugcgagaugcuguggcgcuccaggucggagagguaggggaaggcccgcaggcacaccgggcagaaguguggggccuuccuggggccagagcccucaggcccagccgcugaaccuucagagaccguauagggcacacccugaucaucgaucaggaggaggucgcucccgccacugcugccuacuggggcugucacccccugcaccugcaccagugggggcuccugcccugacuugggggggcggccccgcuugcgagggagggaggccuugaguguccgauuugaggagguggcucccccaggacgacggccucggcggccccggggaacaggaggagauaaggccagagguuucucuuccuccccgggcaaaggcgaaggcaacgggucugggcuggggguguccauugagcaguggggggcuugggucugggcacuggagccagcuaagaggagagaggggcagagucagugcucacagggucuagagcaccccugugucccccaacaccucgcccaucccucucuccaagucucuugacaaagguguguuugacauucauccagauacacaauuuuagcuaugcugguggguaaaacagugagaugaucuuguaucagcugauaaacaggcacuucccugagcuccaccagacaucccuaugccucccuaacucuccuucuggaucuagaaguucaagaucaacaugagcaacaccccuccccaccuccccacaaaaaaaaaccuuccagagaggauagaguccaacugagagugcagaccaguauugugauccuugaaacggagagcccaucaaacuccagagccauagaggccucacgaaugcucucaucccucccugcugacuggcagaaguggggaagggguuccagaguggaaaaaagggacuggucccaggugauauuugacccugauuccuggaugaggaaacauaucugcgauguuaagagccugggcccuggagucaagacaucauucguucaaaucuuuacucucugcguggccuugggcaagguguucgcuucucuaagccuuaaucaagacuuuugcaaaaugggacacauaguucuacguacuugcccagacaugccaugagcauaauacccacaaaguguucauacacagaagcuuucaggacacauuagccauuguuaucaggagcagcuaagccucacaucaacccucugaauagggcauaucugucccauuuugcagauggggaaacugaggcacaggaaagccaagucaguugccuaaguuccucugccaguaaauggcagggccaaaacuggaaacaggucuugugacccgaaugucccagagaauggagaacaaauaaacccaaggaggaaaggggacauuacgagggcucaguccuggguuugaauucagcucugccuauaacuagcaauugacuuugccaguuuccuccucugaaaagugaauaaaccaggguugucaggagaaucgaauaagacagugggcuuuaaaaugccccucgaacacugccuggugcacaguaagcacucaauaaacuucaccaacgccaccaccaucuucccggcgcccacucagauacugggagcaugggauugggguguaacggaggggaaggggaggcacaggugcagcuggaagcaggugcugcaggugccccccugcaccccccccuccccuuuaacagccacauagacugcuguccagagaggagcaaccaccuuuccauacgguucgcucccacgggguagccuagucuaggagucuggucuuuggaacgguggaaagggggagacuggucccccgacccuccccguccccucgccccgguacugacgcgcccaucggcccccgagcugcgaagcccaagcgcggggcgggcccugcgggggcgacggccaaugagcggcgccggguaagcgggcggcgggggcugccaggaagggggucugcgcgcgcgcgcccggacggcuucgcggggcgcgagcgcgggagcaggaacagguguuggaggcgcgcuccgggagcgcgcggcccggccuccccuacccccacacccccccucccgccugcgccccccgccucucggguaccucauuugcaugucgccggggcucgcgagugugcgcgcgcgcgggggcaacggggccggcgcgugggaaggggagggggugagggggcccugccccucggcggcggcgaggcgggggcggcggcgcgcggugccggccccgccccucggagaagcgccgggccccucccuuccugcccuucccgcccgccugcgcgcccgcgggaaacaaaggggacucgcuggguccuaacgaccggucgcggccacgcccggaagccgcgccugcgcaccggcggcccugguguguccccagugggaaauaacccagcaccacauccccaaccaccucgaaacgccuuuccucucacaaagcccacagucgggugacccaaagacagauaccgaaugaugaggagcgggaaaauggcugc

SEQ ID NO: 15001 - RNA, 3899 nt, Homo sapiens
gaacauuggccuugggggcggggcuugggcacaagauggccgcugcgcgcccagaggcccagagucggagcucaccgacuccggagucgcgaucccaggagccacuggaccuggugcgggcaaggaaggggccugggcguggggcucgaggugggaggaggucguaguguggggggcggguccggggcguggccuaugagggggugggcgagggagguauuuagugcuauggcccuggggguggggcuucuugugguuucgcgaggggcggggcaggggaggagacuaugucauggugggcggggugggggagggaccuauggguggugggcggggccuggaugggggcggagucugaggacgguguugucuugugggacggguuuggguccagggaagggggcuuaccagggauaauuugcauaauuuggguggagccuuguaaggggcggggccucauaaauucuagggcuaauucuaggguagaagguugggaaggugacccugaaaaacgugggggauuaugauuggagcaccuaugucgggguaggggauaauucuucaagggucuuagugaugcuucucgaaugcccaagggagaauuuggggguagaaguggguggucuaggugacuuuggaacuuccuccacguuaccccacucagaauuagacuaauugaggacauucauucauucaacaaacauuuacugagcuccuacuucggcucuguaaauagagaagugaccaagacagacaaggguuguguucuuuuggagccugcagucucuugagaggagagagacaauaaaggagaguuacugugauauguucuauaaaggaaauaaaaauugagccaauuucuauaaauugagccaagaguagggguggggcagcuaaauuuagacgagagaagucagcugggugccggcuuauguuuaagcuggggucagagagauaaguggagcuacaucgccacagauauuauagugacgauuugggauaagucauuuggagccacuggaggguuuugagugcgaaaaaugacuugaucugauuuacauuuucaaaagaccuucaggcuauuccugggagguggguuacaagccagcagaaauaggaacagagaugcccuuggguuuuucaauuuuggaggcgccaagugauggggcuuuaacuaggguggaggacaaaaggugggauccaugauauauuuuggacaggagaggaaauguugaugaggauacaacagaauccuggaggaugggccgggcgcggcggcucacgccugcaaucccagcacuuuaggaggcagagccagaaggaucucuugagcccaguaguuggagaccagccugggcaacauagugggacucccucuacauuaaaaauaauaauaauaauuuuuguuuguuuugcugucuaagauggagucuuguucugucgccugagcuggagggcaguggcaugaucacaucucacugcaaccuccaccuccuggguucaagcgauucucgugucuuagucucccgaguagcugggauuacaggcagcagccacaacaccuggcuaauuuuugcauuuuuaguagaaacgguauuugccauguuggccaggcugguuucgaacuccugaccucaggugaucugccuaccucagccucccaaugugcugguauuacaggccugagccaccgugcccagccagaaauaauuuuuuuuuaacuagcuggaugugguggugcaugccuguaaucccagcuacucagggagaugaagugggaggaucgcuugagcccaggaggucaagguugcaaugagccacgaucgcgccagggcaacagagugaggcccugucugaaaauaacagaggagcccaagcuuuaauaauuggggcgugcuggggcgguccugaggcagguuccacaggcuccucuuucuucuccucuugcccagguccuggugccugaugacugccggccuggcacacccccgagugaccucaucgagauccagguggugaaggugacggacaccacgcuggucccugagcccccggagccagguucuuuccacugugccuugugcccugcugccuuccggcugguuuccgagcugcuguuccacgaacauggccacuuggcuggggccgagggaggcgggcaggguggggacccgagccggugccacgugugcggccacagcugcccgggccccgccagccugcgcgcgcacuacagcuugcacacgggggagcggcccuaccgcugcgcgcucugcccccgcgccuucaaggccuuggcgccccugcuccggcaccagcaccggcacgggguggagccgggcaccucucggaggccuccggacacagcggccguugcagaacagaggcccgggguggccccggagagggcggagguggugauggcggcggcggcggcgggcgcagcgguggggaagccuuuugccugcagguucugcgccaagcccuuccgccgcuccucagacaugcgagaccacgagcgcgugcacacuggcgagcggccauaccauugcggcaucugcggcaagggcuucacccaguccucggugcuuagcggccacgcccgcauccacacuggcgagcgcccguuccgcugcacgcucugcgaccgcaccuucaacaacuccuccaacuuccgcaagcaccagcgcacccacuuccacgggccggggccggggcugggagacucuggaggccagcugggcucgucggcggcugaggggucggggagcgggugugggguaggggacccugcggaggaggggcggggggagaccgcgaaggugaagguggaggccgaccaguaggcugcagaccagggacauggguuaguuaaggcggagguacgaggccgacccggggagggggacgggguggggaaacggaggcaggggacagaagaggggagauugggggagagaugacagcugcagggaugguugugagccgcuagugauggagagcagagggagagggccaggcuccagacucccacacgcccacacagcaccucugccaggccuaggagaggacaggugcagcucuugcagcucugcgggugugcggccaaaggcaaggcccacgggcuggaugucacuuccccgacugucucuugguuggcuuguccuugugcaagacccagccugucacgacagagccugggcacuucagaggaggagccaggaucgaauggaaggggggaauugggguccaccauagucuucugcucugguccuccacggguggaccaggauggagucuccugccuaccucacugcauugcacuggaccugggaugccuauccacccucuggcagaagacacucaccagguuaucugugaagagacucugggaucccaucaccucaaagccagaggguccccaagucaccgcugagagcacuugagccucaaggauguaagccugaccauaggaucuugacuccaacagcggcaacccccacccccauugugguccguccuuaacccauccacucuucuucggaggcaacugagaacacauaaagcaagcagcuaccuagcaucccccuccuaaagcuuuagacucagagcccagggucccccacaagccucaagguagccucagguuucucuaauuuccuccacucccaguucgaagcaaacagcuuacugccuaguccccgccaaucccaagggcgggcuggcugauggcagcauggugggcuggccuggguguggagugaaagagucacuguggugggggcgagaggaggacuugggagcuggaggugugacaccuucaguucuguuccuauuaaaggaccuucugaagggcuucucugucggucuuguauucggauuguccgcuuuggggaguu

SEQ ID NO: 15002 - RNA, 3821 nt, Homo sapiens
agcaggcggccgcuucggcugcuuccgaaaacacccgaacguaggguuucgccgacuucccagguuuccguaacuuuuccgagauuaucuccucaacguucggagguuuccguguguccucgugugccacugcgcccaguccccucugcgaguucggguucuuccaacaauucaauccgucccagucuuuggcuucuuccacggacuugcuccgaucuucuccgccggcccuguccaagcaaucggccacuuccgacaauccuaaccgucccggccuucggcucuuuccggagauuuccggaucucgcccucgggccccuccugggauuaagcucgaguccguguuucggcucuuuccggagaugccacuugcucacgccuccgaucagagaacuucggcuccuuccgccaccgcuucgugaaggccucacucuccggggacagcuucgacuuuuuccguggguaccucggcuccuuccggcuucgggaacggaaaagggaaggagaacagagacgagauggaucaggggaagggauagagaaggggacgagguccuaguucucggcaccuggcucuccggguggggaaagugaaagaaaaaaagggccggccucgcggagggccugagaagguugugccagacaaaagcagcaagagggaugaagggugcgcgcgaccgcugcggagguugccagcgcggcuuuuugcgccugcgcaggguggaagccgcgggugaggggaaacaggcuucugcgccugcguaaaagucguucuguggcgcgcucucccacugcucccgugaaggggguugcggggaccagguuucaguccccauugcgcgugcgcgagauuucccuuacaacggugaaagugcuuaauccccagccguuaaauccggccacccucuugguugucucggcaaccacaucaacgcgcuccggcucuucccgccgcgcaggcgcggcagacggaucaucuggcauuacuuccgggagacagaugaucuggcguuacugcccccuggcggcccaacggaaguauccuccagacuuggccuggccgcuagguggccucccucgcuagaggucaucgacucacgccucucgcgccgcgcuccggucuggguagcccagcggguaguguccacgcuucuuuuuacuuuuuuuuuuuuuuuuuugagacggagucucugucgcccaggcuggagugcaguggcgcgaucucggcucacuggaaccuucgccugccggguucaagcgauucuccugccucagccuuccaaguagcugggacuacaggcgcccgccaccacaccuggcuaauuuuuuguauuuuuaguagagacgggguuucaccguguuagccaggauggucucgaucuccugaacucgugauccgccugccucggccucccaaagugcugggauuacaggcgugagccaccgcgcccggcuguguccgcgcuucuuuucccgagcucugccuccgaguuuucuggggcgcagcugcuucacucuccaucucugccuccggggggcuaauuacaccguauccuacccguccucccgccugaccacccacccccuuggaagcccccgcaaccccgucaccgucuucggggcgacggccgcccccucccaggcacgucccccuccuaggaagaggcugaggccaaguuuauuccaaauuuucacgucguuuuuuaauuuaaauuaucugaauaauucucugucucacgcggaguuggggaggucuguccgggaaucaggugggcagcuccuccgcggggccagggcggagacggggucuguacagucccccacucgaggggggggcacccgccugccugguuuuccaggaggaaggggcccggcgaggacagggcugggcagcccaagcggaagggggugccggcguucgggaaggggccgcggccgguccggggccgucgcgcuugggggcccggcuaagggagcccccaacccagggagcgaggaggaggggcaggggcgcggcggggagaggggcaggucauccaccgggguccacgggggaggaaggcccggguggaggcgcggaggcguggugcgaucaccgcuugaagcgguaggugaugggcagcagcagcuugcucuucuugagcgccugcaccuucuugagcgucucgucguccagggccagaaagcagcggcgggaguacucgagcaggcgcuccuuggaggggucgaacucgcccaccucggccagcuucucgggggccacaaugagcagcucggcgaugggcguggucagcgccacgguguuccuguccacgcgguggugcucgaaggcccgcgacaugcucuugagcuucuggaaggugcccaggaucuucuuguaccggcagaggaccccgucggcguccuucacugagggguggaggcggggacacgaaagugaggggcagggcacaagacugagggggcggacacgggaagggaaacggccaugggaagaaaggaucucggcgagcagaggcacgggccggugcagguggagacggagaacaacaggcaaggaaggggcagagaggaggggaagaaucgcagccagaucuuggaccagugggaaaugggaagaggcaggcccaggaaggagagugaggagacaaaaugagccaagaggccggguucaacccacgcggucccagcaccccccgacaccccgagccaucacccucgucucccugccucaggugaauucacuuauucaagucucacccuccccgugagguagguccuacugcgcaccuccuccuuacugaugaaaguuaaggaggugcccaagguggcccugcccucgacgguggaccaaaacuuaaaaguaaacccaggacaggccaugcgcgguggcucacgccuguaaucccagcacuuugggaggccgaggcagguggaucacgagggcaggagauccagaccauccuggcaaacacggugaaacccuggccucuacuaaaaauacaaaaaauuagccaggcgugguggcgggugccuguagucccagcuacucgggaggcugaggcaggagaauggcguggacccgggaggcggagauuccagugaggugagaaugcgccacugcaccacuccagccugggcgacggggcaagacgucccccccgccaaaaaaaaaaaagaaaguaaacccaggaccacacguggaggagggagagacagaacccggugggucuuucuccagcaaggcuggaggggcuuggagagaaagggggaccucugggaaggacacacagcaauucagcagcccgggccccucagcgcccgccccaugcaccccacucaccucgcugccucucccgggccuugggcuucccaaagcgccuccgacuagcaccucccuucugcuucugccgccuccucucacuggcgcugccuucuucggacgcuccgcugagggaggaggcugcugacucaggguccgaggccucgcccccagccccaccacggcugucccccuccauccgccugggcccaggcuucauccggcagugguccucuggggagauggagacacacacaugaaccaagggaccagacaucccaucacaggucccgggacugagagaggcugcaguccccgaacuggaucccccaaccugggcugguccccuaaagagacagagagacaaggaguacgguagagacgcugguggcugaguagagccaguuggggucugugggaggugguaauggguggagcauuuucucagaggccuggguuggcaagaggucuuacggaggcagccgaccaggggccucag

SEQ ID NO: 15003 - RNA, 1032 nt, Homo sapiens
uuuuagauauuugaaauacaacuuuauucugauucuaaacgaaaaggaaugggaaugacaguaacaaacaagauuucaccgcugaauauugugaugugacuguagcagucuauauuugaaacucaaggaaucaacuguguuccaaaacagcuaaauaugcagguccaaacaaugaagguauuuuuugaacugccacauucacugcgaagcccacucaucuccuucagcaucccacagaugaagcacauguuccgcuuagcuagauaauaaugagguggcacacacgcugcacaacugacaucacaggacagcugccuauaaaacuagacuucugacgcugggcuccagcuucauucucacaggucaucauccucguccgggagagcaguugucugagcaaccucuaagucgugcucauacugugcugccaaagcuggguccaugacaacuucugguggggcgagagcaggcauggcaacaaauuccaaguuagggucuccaaugagcuuccuagcaagccagaggaagggcuuuucaaaguuauaguuacuuuuggcagaaaugucguaguacugaagauucuucuuucgguggaagacaauggauuucgccuucacuuuccuguccuuaauauccacuuuguugccacucaacacaguggggguguuuucacacacucauaccagaucucuaugccaguuaggcacauucuuguaaguaacucucgauguuacaucaaacacuaugaugguacucugggcuuggauauaauagccaucucucaguccacugaauuucuccaggccggcugugucccauacauugaacuuaacagguccucuguugguauggaacacuaggggaugaaccucaacacccaagguggcuacauacuucuucucaaauucaccagucaaaugauguuucacgaaagucguuuuuccaguaccaccaucaccaaccaauacaaguuugaacuggaccuggggcugucccugcgcagccauugcgguguuccuuccagaagcgucu

SEQ ID NO: 15004 - RNA, 1025 nt, Homo sapiens
agauauuugaaauacaacuuuauucugauucuaaacgaaaaggaaugggaaugacaguaacaaacaagauuucaccgcugaauauugugaugugacuguagcagucuauauuugaaacucaaggaaucaacuguguuccaaaacagcuaaauaugcagguccaaacaaugaagguauuuuuugaacugccacauucacugcgaagcccacucaucuccuucagcaucccacagaugaagcacauguuccgcuuagcuagauaauaaugagguggcacacacgcugcacaacugacaucacaggacagcugccuauaaaacuagacuucugacgcugggcuccagcuucauucucacaggucaucauccucguccgggagagcaguugucugagcaaccucuaagucgugcucauacugugcugccaaagcuggguccaugacaacuucugguggggcgagagcaggcauggcaacaaauuccaaguuagggucuccaaugagcuuccuagcaagccagaggaagggcuuuucaaaguuauaguuacuuuuggcagaaaugucguaguacugaagauucuucuuucgguggaagacaauggauuucgccuucacuuuccuguccuuaauauccacuuuguugccacucaacacaguggggguguuuucacacacucauaccagaucucuaugccaguuaggcacauucuuguaaguaacucucgauguuacaucaaacacuaugaugguacucugggcuuggauauaauagccaucucucaguccacugaauuucuccaggccggcugugucccauacauugaacuuaacagguccucuguugguauggaacacuaggggaugaaccucaacacccaagguggcuacauacuucuucucaaauucaccagucaaaugauguuucacgaaagucguuuuuccaguaccaccaucaccaaccaauacaaguuugaacuggaccuggggcugucccugcgcagccauugcgguguuccuuccagaagcg

SEQ ID NO: 15005 - RNA, 540 nt, Homo sapiens
ccuccacaggaggccuacacgccgccgcuugugcugccgccaugucgcuagugaucccugaaaaguuccagcauauuuugcgaguacucaacaccaacaucgaugggcagcggaaaauagccuuugccaucacugccauuaagggugugggccgaagauaugcucaugugguguugaggaaagcagacacugaccucaccaagagggcgggagaacucacugaugaugagguggaacgugugaucaccguuaugcagaauccacgccaguacaagaucccagacugguucuugaacagacagaaggauguaaaggauggaaaauauagccagguccuagccaauggucuggacaacaagcuccgugaagaccuggagcgacugaagaagauucgggcccauagagggcugcgucacuucuggggccuucguguccgaggccagcacaccaagaccacuggccgccguggccgcaccguggguguguccaagaagaaauaagucuguaggccuugucuguuaauaaauaguuuauauaccu

SEQ ID NO: 15006 - RNA, 540 nt, Homo sapiens
agguauauaaacuauuuauuaacagacaaggccuacagacuuauuucuucuuggacacacccacggugcggccacggcggccaguggucuuggugugcuggccucggacacgaaggccccagaagugacgcagcccucuaugggcccgaaucuucuucagucgcuccaggucuucacggagcuuguuguccagaccauuggcuaggaccuggcuauauuuuccauccuuuacauccuucugucuguucaagaaccagucugggaucuuguacuggcguggauucugcauaacggugaucacacguuccaccucaucaucagugaguucucccgcccucuuggugaggucagugucugcuuuccucaacaccacaugagcauaucuucggcccacacccuuaauggcagugauggcaaaggcuauuuuccgcugcccaucgauguugguguugaguacucgcaaaauaugcuggaacuuuucagggaucacuagcgacauggcggcagcacaagcggcggcguguaggccuccuguggagg

SEQ ID NO: 15007 - RNA, 2469 nt, Homo sapiens
caccgguaccgugguggaagcgcgcccugggcugccgggggcgcggccgcgguggcacuuggacccgaggaggcggcaggugagagguuccggagcuuuccaggcgcucugggguccagcaggagcuggugcccgggccgguugggucucaggccugagaagaacgcagacgucucgccucaucgucgcucuguggcuuuaccggcgugagacuacauuucccgccggcccucgcggcgugcgcuuucuggcgcccccuuucugcuuccagccucauagcccaggugcauggaccccuuaggugggugcgcaggggucuccgacccccugaaauugcggauguuuugcauucacuguuaugcgugccuuuuuuuuuuuuuaaucugagaggaaaucuuguuucaugagguucucagagaguuacaagaccccagaagacuuagaaccgcuaguuuagaaaaacuuauacuugggaacauuuuauauguucaaauucuauguccagcaauggggaaacacuugaguggaucacaggccauccuuuguaaauaggauaucgugcaguuaauacaaauaaugcuuauaaaaguggucauaauaaggaaaagcugccuauuacaucauauuaagcaacauucauaauuauuucacuuacacguuacuuagaaccaaauguuuguaaugcaguaggcaccuuauauacuccuuuacagaguacuucuuguuuaacagugagcucaagaacugguuaaaugacaacacugcgaauacuuggguguuuuuucuuccaauuuuuuuguuuuguuuuguuuuuagccuguguguuagugaguuugacuucuuuuugcugaauguucucaaaggauucaguaguuaauaucuuugcuugucaguuuuugauagucauuuuugauagucacuuggcaucccauuauauggcugugccaaaaaugauucaaccucuuggcuacuuguggacuugccuacuuacguacuaauuuucaguucuccuauuuagcaaauauuauuggacaugcagcuuugugcacugcugugucucuauggaaggacacauuuaugugcugauaauggagcacugggcgugcuguguguaauuugucucuuacuguuccuuccaacucuaucccauuuguugaugcaaggcaugcuccaugaaguggcaugcacaaagccucaguuugggcuguagagcuuuuuguauauuuggcgguugggaaaagagccagguagacuuucaaagguguuauauuugcugcaggagagaguuaaauggccuaguccuggaaaggcuuuauucuaggcuggggcuaugcaaaugaugcaggccuucuaugcucccuggcuugagggaagcccuccuuguccuugagguaacaugugggucucagucacuagaacagcccucagcaucccugucuuagacuugcauuugcagcaaaacagaaccacuggauguuuaggggaaaugggagggaaaggaccacugguuccccuuugccuugcagcagcuaaagcugguuuccugggguugggugaggaucccuuugccucccccuccuucucauuuucuuggugggcagagggcaagcagguggggacuuguaacuuggcauucuaggaacugugaggcaagccuagccucucauguuugcucuuuccucccccagcucuaccgucgcaggacucugcccuuccccaagagaggaaccagaaggaggaccuaucagcccuugaaauucuaaaagucaugucccuugugaguuuuuaaaucccauaaauauuugcuuuccuuaucuugaaacuuuccaccuggguuccauccagaaauuugguucucagacuuucccauuuuagggaauaaaaggaccaggcaggagucuccucucccauuguccucuccccucugacaaaugcccacagauuuauucucuauagcauucugcaucuccugaugguuuucgucugcuaggaggagaaacucauuucccuguaugaaaugagagcauccuuuguaagaacugaaguuugaagagauggaaugaaugcuuaggagcaaucacauauagaaaagcaggggaggugguguugguugguuucaguuucagcgcaugguacaguguccugcuuugggaaugauuaaugauuggauauguaauugagguuuggcugggaauccaucaaaaauuugaugccagaauuaaagucuaguuugacguuggacagagcauuugaaucugggacauccuccauuaguuucuuuagcuuaagaggaagaaaaguacagagcugaggauggugagcgauguagcaagugagaugaucaucuaggugggugaguggucagggcuuggaaaagccuuagagaucugauccaaccucgggauccaaaauaagaggauguuugagucaguuguuucacuugauagaaaauugugcacucaauaaaag

SEQ ID NO: 15008 - RNA, 922 nt, Homo sapiens
ugaguggggagaaugucaccagggucggcaccuucauccuggugggcuuccccacggccccagggcugcaguaccugcucuuccuccucuuccugcucaccuaccucuuuguccugguggagaaccuggccaucauccucaccgucuggagcagcaccucccuccacaggcccauguacuacuuucugagcuccaugucuuuccuagagaucugguacgugucugacaucacccccaagaugcuggagggcuuccuccuccagcagaaacgcaucucuuucgucgggugcaugacgcagcucuacuucuucagcucccuggugugcaccgagugugugcuucuggccuccauggccuacgaccgcuacguggccaucugccacccgcugcgcuaccacguccuugugaccccggggcugugccuccagcuggugggcuucuccuuugugaguggcuucaccaucuccaugaucaaggucuguuuuaucuccagcgucacguucuguggcuccaacgucuugaaccacuucuucugugacauuucccccauccucaagcuggccugcacggacuucuccacugcagagcugguggauuucauucuggccuucaucauccugguguuuccacuccuggccaccaugcugucauaugcgcacaucacccuggcuguccugcgcauccccucggccaccggcugcuggagagccuucuucaccugcgccucucaccucaccguggucaccgucuucuauacagccuugcuuuucauguauguccggccccaggccauugauucccggagcuccaacaagcucaucucuguuuuguacacaguuaucacccccaucuugaaccccuugauauacugccugaggaauaaggaauuuaagaaugccuugaaaaaagccuucggcuugac

SEQ ID NO: 15009 - RNA, 1723 nt, Homo sapiens
agcggcucuucccuggguggacgauggacagccagagcaggaaggugguggugugcgacaaugacacuggguuugugaaguguggauaugcaggcuccaacuuuccagaacacaucuucccagcuuugguuggaagaucuauuaucauguaaugcccaaccuuguuuuuuccuuuauuuaccuagccuuguuucucccuuagcuaagagaaccagacaaacuccaucuuggcucuuucacuggcagccccuuccucaaggacuuaacuugugcaaggugacucccagcacauccaagaaugcaauuaacugauaagauacuguggcaagcuguauccgcacuccccaagaauucaucugauugauaacgcccaaagccccgcguuuaucaccuuguaauagucuuaaagccccugcaccuggaacuguuuacuuuccuguaaccauuuaccuuuuaacuuuuugacuacuuaacuucuguaaaauuguucuaacuagacaccccuccccuuccuaaaccaagguauaaaaguuaaucaagccccuuccucugggccgagagaacuuugcacguuagccgucucucggucgccggcuaauaaaggacucuuaauucaucucaaaguguggcguuuuccuaacucgcuaggguacaacaaucagaucaaccaccaaagugggaaacauugaaaucaaggaucuuaugguuggugaugaggcaagugaauuacgaucaauguuagaaguuaacuacccuauggaaaauggcauaguacgaaauugggaugacacgaaacaccugugggacuacacauuuggaccagagaaaccuaauauagauaccagaaauuguaaaauauuacucacagaaccucuuaugaacccaaccaaaaacagagagaagaugguagagguaauguuugaaacuuaccaguuuuccgguguauauguagccauccaggcaguucugacuuuguacgcucgagguuuauugacugcuguagugguagacucuggagauggcgugacucacauuuacccaguauuagaaggcuuuucucucccucaucuuaccaggagacuggauauugcugggagggauauaacuagauaucuuaucaagcuacuucuguugcaaggauacaccuucaaccacucugcugauuuugaaacgguucgcaugauuaaagaaaaacuguguuacgugggauauaauauugugcaagagcagaaacuggccuuagaaaccacaguauuaguugaaucuuauacacucccagauggaggaaucaucaaaguugggggagagagauuugaaacaccagaagcuuuauuucagccucacuugaucaauguugaaggaguugguguugcugaauugcuuuuuaacacaauucaggcggcugacauugauaccagaucugaauucuacaaacacauugugcuuucuggagggucuacuauguauccuggccugucaucacgguugaaacgagaacuuaaacagcuuuacuuagaaagaguuuugaaggaugaugcggaaaaacuuccuaaauuuaagaucugcauugaagacccaucccgcagaaagcacaugguauucuuggguggugcaguucuagcggauaucaugaaagacaaagacaauuuuuggaugacccgacaggaguaccaagaaaaggguguccuugugcuagagaaacuuggugugacuguucgauaaa

SEQ ID NO: 15010 - RNA, 50509 nt, Homo sapiens
guccugcucaugucuuuaacgaccgguuuucuugcccagguguaauuagcauggucaaugcgggagcgaugaguggcucuggaaaccugauggauuuccucgaugagccguucccugauguggggacguaugaggacuuccacaccaucgacuggcuaagggaaaagucacgggacaccgacagacacaggaagguagguggcauuccgaaaggacacacugcaaauggcuaagccauguuuucauucaaaaguuacugagcuggggcuuagguccacguacgugucaugugcuggguuagggucuaaagaagaaaagagccagugggaggagcagauauauuggcagaucauuguacuagcaggagcuuugggcaggacguugugucauauggagggauugugguguggaggagagggaggggacuuugcaggugccauuucuggaaccuguuuucucauccaugaggauggaagugauuaugccugaaaaggaaaugagauuauguguauaugaaagcacauaugacagugccuggugucuaguuggcaaucaguauauauuuuaauggaccacaaugguuaucugucaagugcugugggaucauuuagguucgguuagggaaggguuuuucagcaaggguaacauuucaguugggucuugaaagaugacuaagauuuugcuaggcagaggaacggugaggauucuaaacaucaggaaugccccccuuuuuuaagucacagaggcaugaaagaaucugauguaucugggcaauucagggagcuccgaggaucugguggaggauuccugcagagggagggauagggaugaguguggaaauggaggcagcagggccacguggggaacggccaugcuggcgguggagaggaguuugcauuucaugcugaaagccacagaagacaauaaagaugcgcugcaaagggagaaacaggaagcuuggaaaugaguccaggagaccgaaggcagugauguguagguggagagaggggaucaggauggagagguauuuugaggcgccacggacgggauucaggggaggugcuggggccaggaggggaauggggucacagaacaccaggcuuuggccugaugaggaugaugccuuugaugccuagaggaagcaaggggggacuggcagacugcggaggaggccauugaguucuguguagaugcguugguuugagcugcgcugcggaugggugaucacagguggcgagaacucugugguucaagggugagggaagggccggggggagaaugaggucccugugugcaaguggaggcugaagcuuuagaaacagccacgguggcgugggugugcagagacagaagggaagagguagucaaauccccaggcagugcccagaguuaccagguccaggggaggcagauggggagccugugacaagaggggacccugccaagagcaguccccugugaauggaaaggguguuguguaggggccugcucacaaggucacccucuauggagaggucagguaggaggcgagccagcggcaugggggcuggcggugaggggagagcugcuucagacgagggugaggagugacauggacagugugaccaugucacaucgccucacgagggcuggcacgaaaggaggaggggaauguguagggagccaggcucagucaugaagauguugcagccucuuggcucugcagugcaggaauguggggucgaggcagcauucccucuagagcacagcucagcagacugcauccugcgggccaaagccagcuggcaccuuguuuuagaaauaaaguuuuauuggaacucagccaugcccauccauuuccauauuuuuaugacuccuuuugugcuacaguggcaggguugaggaguugcaacggagaccauccggcccgcaaagcccaaaauauuuacucucugguccuuuacagaaaacauuugcccaccacugcucuaaaaggccgugagggaaugaugaucucagaggagcauaggauucuguuagcacagggagguguguguagguaguccaucugcugugggagacgugaucugugccagcuaauucuaaguucgugcugcuaaaauuuaaccuugaaaacaaaaggaggagaugaagucugugugaagaggcuuuuuaaugaaacuuagcaauguaaguuaagauaguaacucauauucagaauggagacaccgaaccaaugucccccuucagcauagcuuuuaaaucaucaaagaucaaaucacauuuaguauguuuuuuaauuaagugaauuauuugagugugugcucgaauucuuuggagacuuuuguggcaucuuuauagcucugugaacuagaaagcucgucguaccguugcggcacauaacugaaagaaucacaucagugggaauuuagcugcuugaugacauucauuuuauuuucuuaauuacccuguuucccgaggaaacaguuucaaggaaaaaagcaugaauucgaaaaugcauucggaucaguugcuguaucugcuuuguucuagaucaccagcaagagcaaggaguccauaugggaguucaucaagagccugcuggaugccuggucgggauggguggugaugcugcucaucggccugcuggcggguacguggaugggcaugcggcacucccgugggaagcugcagaggccgaaaccucaaaacacgaacccucugggagauuuggaauauagcgcgugucgcuugucgcuuuuaccccugugggagggauuuauuacuugaaauaucuaagggcaaaaugcauggcuguauauuuaaccuaaaauccaucaucaauaaggcaugcccaaggcaugagcucaggcacaggcuucugaagagcugugacgauagagcugguagccuuuccacacagagcagaguuuucuuacuauaccggauuugacugaaaacacacauuuuuuuuggaaacggucuuguuccauugcccaggcuggagggcaguggaaugaugccaguucacugcagccuccaccucccgggguugaacaauccucccaccucagccuccugaguagccaggaccacaggcaugcgccaccaugcucagcuaauuuuuguuauuuuuucauagagauggggucucacuguguugcucaggcuggucucaaacuccugggcucaagccauccuccugccucagccaaaguguugggauuacaggugugagccacugagcccagccaagcacacauuuuauauucgguuauucuugauuauguagaugacaacaaaaucagggacuguuuuaucuucaauaacaaaaugucauaugagauugccuuuugcuacuacugguaggcucugggaugaacuggaaacauccugcaacagucagcaccaugcuagacacccacgggagcugaggcaggcccaggggccuccaucauccugacccucaggaacucugcaucuuuccuuuuuagaaucccaacaccguguuugcgagcaguagauguuuccagaguaaauggaugcuaucuggaggggaaacacgucuuuuuaauaucaaacgcaccagcccuuccgggaaauaguuuccugaaacuuauguccuuuuaggagauugugaagguuaaugucuaagaauaaaaaauuuggcaugacgaagagguuuccuuaauaaaaauccccugcauauaacaacauaauaguuaugguuagagaacagaucagggaauugacuagaacacaggcagaauauauguaguaaguggucuaagaaggacagaacacaaauggggcacagauagaguuuugugauuccaggggcuuucaguuuccaggugaucuugauuuauucccuagcucaucggaggaggggcuugguugccagggaagggcucuaccucccucaccugccucagcauuccguaaagagcuaagaggaaugcucagagggggaguucuuuccuacuagucacagaugcugucuguccguuucuccaagccuguccuuccuuuaccaguggcauuucccgucauguacuggcagcagccagggcaggaaauuagacuucauugucacaagggauuggacgaccaauuuugcuugacugcuucuauaaaggccuuugaaggugggccaggugggaguuugcuaugaauuuugauguccuuauuuagaguagauugauaaaaccuuauagugugucauuuuucuuggcucguaggaaggagaaauaaauaggguaaaugaagaaacucagaacaggaauagauguucugauaacggcacagcuuagauucauugacugaccuaggagcccaacugggcugacuuuaaucugauuuugaccagcuggcuuuauuauccacuugauuuccaucagcucuuucacgagggggaauuaaaaacaauaugcugcugcccuggcuucacuuaaacaguaucucuggagaggaccucuagcuugaauacagccugccccuccccucugugauuguaaugugcagccaggggugagcaccacuggccaaaggagagcccaugcgcacgucagcaggggaauacaugggagggugagaauggggugaugcugaaaaugaagggacuacaguguucuuuugauuuggaugcacuuugaagggacagccagagagccacgucccacucacuucccccuuccucgcuggacuaacaguggagaggaccuggggucucacugccuggccggcuguccccucaguggcuguugucuucggacuccccucauggguaggcccacagcaucuccgcaugugcuuaucagaagucaccgcuaggugucacuguuggaccacgaaagaaagcugaggccugcugaagcgcagucagaaccagaaucagcaaggaagauugggugugcaguagggggguugugaaugaaugaauaaugaugaaacuuggggugaucauccuguuugccccuggauaucugcaggacccucccaucuucuucaccuucuucuucaaauacugcacgaugucacuuaucuguggaguccaaaaaaauaaaaccagugucauagaaacagaguagaaagguggcugcuagagggagggguggggacaggauggggaaagagauguugaucagagggcguaaguuucaguuagacuggaggaauaagcuuuagugagcggucgcacugcauggugaccacaauuaaugaucauguauuguauauuucaaaauugcuaaaagaguagacuuuaauaaucucaccacaaaaauaaacuggggaggugauucgguuggugcgaagguaauugugguuuuugccauuaaaauaacggcaugaucggaucuuuaauuagcucgaucaagucuuucuauaauguauacauagaucaaaacaugacauugauauacacaauuauuaugugucaguuuuaaaaaguuaaaaaaucaagauaaugagcucuuugccuuuguuuuuccuguggaaaaacaaagaacuguggauaguucuaaauuugacauuaccggacccuguggaaagaccucaugaaauacuaaauauuaugguucuugcgugcuguugcuagggggcaguguuuacuuagcugacucugcaaacuagcauuaagcggaaccaagcuugcauccaggauuucaugaucuagagaaaauacuuugagcauguaggauuucuuuucacuggguuucaguuuccaacuuuaaaucaggaaauaguuuucaccauuccacaagguauauguacuucaaaacaucauguuguauaugauuacaacauacaaucuuauguguccauuuuaaaaugaaagaauaaaucaggaaauagcuaaugauaucucuaacuuaauuagacuaauuauauauauuuguauauuuggaaucaagucuuucauuauugaauugcauguuuaaaaauuucaaaccugucugauauuuaaaauuuaaaaaacaauaaaauuacaucccucucucuguaagccucaccucccucaccugcucuauggauguauauauguauguauguaaagcuuuauugaaauauaacucacauuccauauaauucacccauuuaaaguauacaauucagugguuuuuaauguaucacagaguuguacaaccaucaccguggucgauuuuagaauaauuuuaucaugcccaaaagaaucauuauacccuguagcuaucaagccccugcuccccaaccaucccccuuccagcccuaggccacuguuaaccugcuuucugucucuauggauuugccuauucugggcauuucauauaaauggaaucauacaauauguggucuuugugauuaacuuauucuacucagcauaauauguucaaaguuuguccauguuguagcacgugucaguacuucauuccuuuucacuaccaaguacaauuccauuguauggauagaccacacguuguuuauccacuuauccauugauggauauuugaguucuuucuacuuugugacuauuuugaagaaugcugcuaugaacauuuuuguucaaguguuugugugcauggauguuuucauuucucuuggguauaugccuaggaauagaauugguuuuuuugagacagggucugguucuggcgcgaucaugguucguuacagacugggcuugagcaaucugccugccucagccuccugaguagcugggacuauaggcgcgugccaccauaucugguuaauuuuuuuuuuuuuuuuuuuuuuuuuuuuguagagacaggaucuugucaugcuguucaggcuaguccugaacuccuggccucaaacgauuuguccaccucggccuuccaaagugcugggacuacuggcauaagccacugcgccuggcccuuauacuuuuuaacagagccuuuaauauacuuauuuucuccugucccagguacaguuacacaaaggcaggggccugggucuacucuuugcacugcuguauucccaagacauggaugaguaacugccguguaguagguacauguucaguaacuaucccuugaaugaaugaauggaccugaguuuucugauuuuuucauucauuuauuuauugcaauauuuuauucaacauggauauauagugccaaccaugcaccugacauggauauaacaauggacaagacagauaggguccuugcccacuuagaguggacacagggucuggaugccaggccugaccccccacugugguaugaaaaccaaacaaugaaaccuuuuuuacccaccacuuauagacuaguggaaguacacacacacacacacacacacacacacggagaaaaagagaaagagagcuaauugugauauuaggaugcgagagguguggugauggggaaggacaggcagccacaggaaugccagggaaguacaccuaacccaggcuuaggaaaucaggaaagacuucccagaggaggugauauaaaugcuggaaucuggaugauaaguaggagucugaugggaggggagggcagugcuugcugagauggugcagguaggagagcguggcacauuccaggaacauggagugggcaggguguggggaguuagugagggaaagagaugaagcuggagagaucugaggggccagcugucagggugggugaccuguugaggauuuggguguucucccaagaauaauggguaaccauggcagggcuuuccacaggggaguggcacaggucagucuggcauuuggaaagccuauuugaccacaguguggagaggccaugaauggggcaggacugaggcuggagaccagagaggaagcuccugcagcaguccagccagcaaugacuucaacacggugaucugaaagacagcccgaguggggaugggggaaacugcagugauucaagagagauuucagagguggagcugcugggauauggggauugccuggaaggggguugcuuucccagauuucuaguuugcacaguagugugccuggaugguggguuccucucccaguugggacgaagcugaggcugggaggaggaugcuuuaguucggugucggauggugguggacugaaguggagauaucuaguagacccaagaaggcaaauagacuuguguucuuugacaaugcccauucauuggcuuugacugccuggggcuuugcuacaaagauuugggaggguagguccacaagugugugucaugauugauuagugaugucugucaugggcaugucaaaagaauugugaaggggaauccaauagagugugcuauuauugauuggugaugucugcugugggcaucggaagcugacggcugggcuauguagugauuggcucuguaauagccagugggcucuaugugcuuggaaaagcauagcuugagauguacauuuauaccuaaugguaaauaguaggauaugaauaagguugccaggguugagagcauaguauaaaaagagaaaaggguuuagggucaagcuuugaggaaauggccuuuagaaguuggguggaggagucagaaagaucagaggagucagagcaaaccagagagugaggaggaaagcaggagagcaugauguggaagccacgggaagagguguuucuggaaggguggaguggucaacagagucagaugaugcugagagcucuggaacuggggucagcaaacuuuuucugcaagaggccagagaguaaauauuuucagguuuguggcccaugugguuucuaucucagcucuucaguucugccacuguagcaugaaggcagccacagagugcauguaauugaaugguguagcugugcuccaauaaaacuuuauuuacaaaaacaggcugugggccagauuuggcccaugggcuguaguuuguggauccuguucuagaggaaugagcuaaggccauugccuuagcugcaugggaaucuccugguagauugaggggauggacugggccaagggaaggaaagagauuggauggugacuagagggaaaguggaaacagggaggguuuuuuuuuuuuaauguuuaaaugcugauggcaaggagaggaagagguugaagauacaggagaaggaaaggggaaugggaagaacgaggccccauggaggaaggagauguagagcugaggugggcgguguccgaugcaacaccaggagaagagaagggaggggugagugcugaugccagguguggaugcuuuuggugaggauguggaugcagaaccgauccuguaauaaugaugcagugaaaaggcugaaaaaugaagaugcuugaaagcauucucugccuuugugagagaugagaaugcauuauucuggaaagagacccaaggccgccuuuugugauccauucaacugcacauuccguuuucucccauuucuauuggcuuuuaaaauacuuauuuaguuuuauagacccauaauucuuuauaauuuaaauaaugcagagaguuuuaauaaacaggaucuucccgaauuugguucucauuugguggcaaaaccuuacucauuuaugaugugaggccgucguaguuguuaugaguccauuuugucugaauuaucauguuucccugagaaauauuaaugugugugauucuaggauccugccccagaagccauugagagaguucugucuuuuacacuauaaauacccaaugucaaaaacuuggaaagggaaaaauugcaaaaguugcuugucucuccuacccaguucaagcuacugaacccuuuguauuucucauugggcuugugcugccuugcccauaacauaaauguucaagugcugcaaguuuaaugaaagaagcuuccuauguaagugacagccccauugcaaguuuauugccugcucuggaaucugggccaucauugcugaugugccccugucuggccgccguguuggucucauucuugucgcaucauggggcgauuccucuuaguggcucguguuacuucuuccaggcaccuuggcuggggucaucgaucucgccguggacuggaugacggaccugaaggagggggucugccugucugccuucugguauagccaugagcaguguugcuggacuucuaacgagaccacuuuugaggacagagacaaguguccccuguggcagaaauggucggagcugcuggugaaucagucagagguggguauuugggcaggguccuggcuggggaccccugccguuccaugcgugcuugggaaugcugcugggagauuugugaaugucugugauuucaccuucaagugccugcucugaaguucguggcuuaacacuagaugacgggcuuuuuccagcucuaaugcuaccacucaaacuucacuugcaaaacccuuccccacuguuucaugugcacaaugcauauauauauauauauacacuuuaagccucauauuuggcuuuaucuuguuauauuuggcuuuauuuuuucuuaccgaaggugguuugcugaucaugcugaagaaacaagguugacuuugauaucuucuaauugagaagaacauaacuuuuuaaguuauccuuuaaaaaaaacagcuuuagugagauaaauucacaguucacauuguucacccguuuaaaguguacgauuuaaugcuuguaguauauucaguuuugcagccguuaccacaaucuaauuuuagaacauuuucgucauccuuuccaaaacucugucuccauuagcagucacucccaugucccccaaccugccagcucugagcaaccacuaaucuaccuuuugucucucuagauuugccucuucuggauguuucauguaaaugaaaucauacaauguguggacuuugugucuggcuucuuccaccuagcaucauguuuccagacuucuuccuauuguagcaugaaccauuacuucauuuuuuuauggccgaauaauauucuauuguaugaauggaccacauuuuauuuauccauuuguugguugcuuuugcuuuuuggcuaugaugaaugauguugcuaugaacauuucuguacagguuuuugugaagacauauguuucauuucucucaaguauauaucugggaauggaguugcugggucagaugguuacucuauguuuaaccuuuugagcagcugucagacuguuuuccaaaguagcuguaccauuuuacauucccaccagcaguguaugagacuuccaauuuguccaccuuccugucagcacuuguuauuaucuguuuuugauuauagccauccuagugguuaugaaguggcaucucauugugcuuucagucaucuuccauugcauuuuaugaccacauuauagaggauguucugggccuucuauaaagagaaugcccuaggcacaggagauaauaguggugaaccacagaccuauagcauuuagagcuucagaucuuuauuaaaaucuuaguucaggaaagaguuaacuucuaacccauuucagugguuaccaccaugacuaugaguuauuaaaggaucagaaagccacgugaggaggaaccagguugucaagcuucacauuagggguaaugugaggaucucucaagcuagaacuaaucuuucaagguauauguaaucuauuuauacaucuccucccuuccccacuuuuuuuuuuuuuuuuugccugacugacuuaccacagcugaagacauuuggaaugcacuuugccauuuuugcuaaaccucuuucucaguggaauugaaaauuaauuccuucaaaucucagaaggagacagggaucuugaaaucucacauguucucagugcucuccauuacuuccaaaaagaaauucucuacuuggguugaugggagcgggcagacagaauuggcugugcgccauauuuuuauucuucucuccuacuugcaauguguguuuuggggaaauacagccauccaucuuuucagcuguuuuuaagauuuauacuuugauucgaagaauuaccuuuaguaagagugagaguuauuuuuagccuccaaaaaaguacauauuuaagugggugaaagguauuucuuaguccgauuucucaccgcauagggugugaauauaugugcuuguaaaggccagagcagucuccuggaacguguuuuugcauuuaauaggcacacauguggcuguccauggccugacuuguaggugaccucucuuuucugcccccuuuacuuaaguaauccagaugguggcaagaagcugaggucuagagaguguggucuguacccagcagaccaggccuuucacgcauaggaccccagacuguguuuuugguucagaaaaccuucuccauacaucagauaauuuggaauaaaugguucaaugaauuauucugaaagugaucacguuuuucuucucugauagugccucucaaauguuagugcgcauagaaccuccuggagggcuuguuaaaacauauugaccugggccccagccgggagugucuggugucugguucagcaguucucgggugaggccugagagucugcaugucucauaagccacugauguggcuggaccauggaccccacccugagcagcaguauucuaaaauacaggcccgacccguauucauuggcagugcgggugcuugcugugcuugggcguggccuuaaugaaagcuaagagagaccaagccaccacagacaagacaaaacuaaucugccagggucucggaggcaggauuuucugcaucacaccuuugauuaacucuaugcaaguggugauuaaaaccaagcaucauccacgguuuccauuacugcugagccuucccuguguagaaggcgcguguaaacagcucccagagaaacacccgcugcucuguuuguguguacugacuguagcaauagcaacagcugauaaaccuacgcuggccuuuugguuuauacaggacugggaccaaaccugcccaaucccgucaaagcuuuuguugucaagacagauggggagggguugagucuguugcucaggucagcuguggcuaauguuuccuuuuguguuuugugucuguugucuagggugccagugcuuacauucugaauuacuuaauguacauccuaugggcgcugcuguuugcauuuuuggcugucucccuggugcguguauuugcaccauaugccuguggcucuggcauaccagaggugaguucuggcugauuuuuuugguaccaauaauaagaauagcaaauucuucuguagcacugucaugccaagcacaguuccaagcguuuuacuucuacuaacucauuaaguuucucaauaagacuaugacguagguacuauuauucugcauuugauaguugacgaaacuaaagcacagagagguuaagugacuugccccagguaaccaagcugguaagcugugaguugaacccaguguucugacuucaggauuuacacacugucuucaagauuucugugcuauugcuucucagaugauaaaagccuugucuuuguaaaccaggcauaacucuuaaagccuguggaaucagaguucauuaaccacacacauaaacacgcuguaauaacucaucagugcaucugugauguaaugugagagacgauaguggagguuuguugcugugaaaguucacugaugaugaaaucucucuugccauguuuugcucuucugguggcaagcuaauagcaaucuuuuaaaaaccugaauucugccuuuaauacauguacugugaacguacccccgugaauuucgaguucuuauaaauaguuuucagcacuuucauguaaccgaagcaugagggaagugaccucaccgauuaagaggagugccugagaccaaacuugaaaccuaugaggaccuacugggcagaaucaugauaauugagcugauucccgaaaagcccagaugguggaaauuuuagccagaaguaauuuuaaaaguucugguauuaucacuguaauccaugcaguucaguucuccuuuggguugaugccuuagcgaugcacacaggcagugggcuagagaguuugaagauguaguugugggcugaguauggcaguaaauccacacccuuugggaggacccugcagcccugauggugguccaggcaguuugcagaaagggcugaagucaugaaaagacaaucagaggcaaaauucaacauggucuuguuucaggaaagauagaaaaaagaagucuuaauaugucaugcugaauuuuugaugguugauguuaacauauugcuucaggaaccugaaaaauaagcuguauuaccaaccuguuuucucagcgcagccaguucugcuauaaugcaacauacgcauuccuaaaaaucaccaugccaugcaaaaucacacaacagaaaccacagggcuuuauggggaacaugaauuaggggcacaauacacaaaacuucaucacugacacauaugacaaaaagaggaaccuaguaaaaacaggagcacagcuguacacauuaaguggcuaagaaauauguaaauaccacaauaaauaugucacuuccugcaaagaacuugaaguuugcuuguggaagugggugucgcaagggcugcaacuuacgcguugcugugaagggcauaaggaagguuaucugaaguuguaggggaaguugagacagcaggcguagauggguguggcacccuggcauaugugugaaccgguagauguuugacucguguauuuuguguuuuccuacaugacugggugcaauuuucugcauuuaccugguauuucuccuggaggaaaugcgcauaaauagacauaaaauuugaguuaugcucaaauuccucccuaacaugaguggcauuggaacaaauuugcauuuucuuuuuuucuuuuuccuuuucuuuuucuuucuuucuuuuuuuucuuuuuugagacagagucucgcucuguugcccaggcuggagugcaguggcacaaucucggcucagugcaaccuccguuucccagguucaagcgauucucaugccucagccccccaaguagcugggguugcggauguguaccaccaugccuggcuaauuuuuuuuuugguuuuauuuuuaaguagagacgggguuucaccauguuggccuagccucaugugauccauccgccucggccuccuaaaguguugggauuacaggcgugagccgccacgccuggccuucuuguuuuuuuauuguuuuauauagagacgaggucucacucuauugcccgggcuggucucaaauuccugggcucaagugauccucccgccucagccuccuguggagcugggacugcaggcacgugccaccaugcccaacuaauuuuuguauuuuuuuguagguuuuugccauguugcccaggcuggucuugaaauccugggcucaagcaauccucccgccuuggccucccaaagugcuaggauuacaggagugagccacagugcuugaggcaaauuugcauuuuccaaccaagugucguagcagagcugacuguauuuuauuugaugucuaaaacaucucaguuugugaucccacugcccaacaguaggcauuuuugacucaagcauuuugcaaauaaggagauggccgauggggaauugguggaaaauagaagcaguaagaggcacacuggguagucccaucucucccuuccaagaacuguagauguguggcucagcugguguccuuauagacagggaguucgaauaucaguucuaucuuugaagggcuggcuggacuuugucaucaucuaaauugggcauuuuauuggugauagcugaacucagaaggaguaaaauacugaguugaggauuuguuucuuuucuuuucuuuuuuugacaaggucucacucuguugcccaggcuggagugcaguggcaugaucacagcucacugcagcuuugaacucccaguuucaggcaguccuccugccucagccuccugaguagcugagacuauaggugugcaucaucauaccuggcuaauuuuuguacuuuuuguaaaggugggcuuucaccauguugcccagacuggucucuaacuccugggcuuaagugauucgccugccuuggccucccaaagugcugggauuacaggugugagccacuguaccuagcugagcauuuguuucuuaugugacaaaagugcaagggauacauagacauggaugaaauuaaaaaaugugauguuaagugaaaaagcaaguuuuacaaggagaaaguaugauugauagaacgucuauaaacagcuaaaaugaaaaaacguaugugcuaaaacuauagagaaaggggaagaaaugguaggaaguggugaggggaaggaggaagguucgacuggggaggcaaacacgagguagccacucuucuguuucuuaaacuugguagugggcacauggguacucgcuuuuauuaguauucuuuuaacucuauauaagugcgugauggauucauuucucuauuuccuaaauaguucauaacaaucuuuuaaagaacuuucaggaaccaaauggagguuugacccagcaguagcaaagucuucauguuacuauaguagagcuggaaauucuuaacauaaggauacaguauuuuucccaguucuuggaggagagggucagaguaaaaaguaaauauaaauaaauaaaucauggguaaaaagaaucuccucccagucagcacccaacuaaauauggaaacugacuucaguugagacaugaagcuguucuucauucauucuagcaaagauauugacugaacuauuuggaaaacauguuuaucauugucugaggugaucugccauaagcugcuauauggcacacuguguaagaaugaacuuugacugugaugcacuuauguauauuuaaaaaauugcucauccucccuagcauuuguuucuaaaacauuuugauuacuuagagugaaaaauuccuuuggaaacauuuuuuaaaaugcaaauuuaggucagguacgggggcucaugccuguaaucccagcuacuuaggaggcugaggugggaggauugcuugaggccaggaguucgaggcugcaguaagcuaugauugcaccacugcacuccagcccggacaacagagcaagaccuuguuucuaaaacagaaaaaagaagcaaauuuaaagaagguuuuuuuuauuuuauguaauaaaugcucucuauaaaaguucuauaaagcacauuuaaaggugaaugcuugccuguaaucccagcacuuucagaggccaaggugggaagauugcuugagcccaggaguucaagaccagccugggcaauguagugagaccucaucucuacaaaaaaaugaaaauaagcggcagagugugguggcucacaccuguaaucccagcacuuugggaggcugagcuggguggaucacuugaggccagaaauuugagaccagccuggccaacauggcaaaaccccgucucuacuaaaaauacaaaaauuagccggcgugguggcacgugccaguaaucccagcuacuugggagguugaggcacgagaaucgcuugaaccugggagauagagguugcagugagcugagaucacaccacugcacuccagucugggugacagagcaagauucugucucauaaaaaaaaaauaaaaauagccagguuugguggugcacuccuguagucccagcuacucuggggacugaggugagaggaucacuugagcccaggaaauugagacugcagugagcugugauugugccacuguacuccagccugggugacagagccagacccugccucaaaaaaaaaaaaaaaaaaaaaaaaaaaaaaaagagugaauacucagcuuuuguugcacgugggacuugagagagaacuggguaaggguguccucuuucuacuugcuuccuuuugucaguagaaccacugucgugucaacuauaugagaaaucauacccucucagaacuuacucuguguugauguuucaguuuauuaaaaaacauaaaacauaaacacucuuacaaauauuuauuuaucggaaagaguucugguuuucagguuaacaccagcaagucacaaauccgcugcaguacaucucguuaaagcccugcucgcuucagucucuaugaauucaaauuaaagcaagugauuggauuuugccaucuacugggaaugaauuugucuuauuuagucccuaauuugaucaugagaauuuuauaaaaucauguuagagaauuacaaaauaccuauuacauuguucaauucaccacaugucauggcuggcaaaggcucagguaauuuagaugcuuguaauuuucuaaaugguauuacgcuuuuaaacuauacccuuggguccaaauccacauuaacuaacugacaaaaaauuauagauaauuuuauuugaggcaacacaaaagggcagaauuguggcaggcguaauaaaacaucccuuaaauaaagggaucugagaucccagagcacgggcucaauuaagcuaacuaccacuaguuaaggacgggucuaaccaccacuaguuugucugccacgaguucaaggcuaguucaggaaacaccaucugacuguauagcuaggagaccuugcacauguucuguaggaaggagcucacugaguccuucaggaacauacacacucuuggaugagcucacuucaugacccuccccaaaucgcccaaggugacaugaugcucaguagaaggaccuggugaaagaacaaagaguguuucacggcucucccuuaaauacuguauugagaaauaaggaaucucugugcugcucuuuucaggaaucaagcagugcucuccaccugggcugcauuuucgagucaccuacagaggcuguaaaaauccucauacccuggaugcaccucagaccaauuauaucaaaucucuggggugagagccagccagcaguguuuucuaauuccccaggugacucugaugagugccacgguugagaacgacuguaguagcuauuugagaaacugauuacuuggcagagcaaugcccacaaggagguguuuugaaguuacauaaauaacacugacaagagauaaccuugucccauuauguauuacauaaugggaaaaccagaaauugaccacagauuucauugacugauucacuuggugucuaauuaaucugugauuacaggcuuguaaguugcuaacccggcaguaaacauucaguccauuucagccaauugggggacggguuggagguagaaaaguuguuugaucauugaugaugcuucuauaucuaagagaauaccauuuuggcaggggagaggcccuugguguaugaaguuaaucacugugauaggcacccaguugaauucuaaaagcauuaggcaaagacucaagugaacguuuaggaagaaagccauuauuugguauuuauaaaaugcagcaggucuggaaauggagcaagauaacacucccuauagucaaaguccuuuacaauaaaagaggguaggauuugauagaagagaaggggucaugauggauucaaacaucuuuacaucccccaaacauauaucauuggaauguugagcgucuucuucauuuucuacuguuguauuaagaauauuuucaaacauacagaaaaguugaaagaauuggacaguaaaaauucauuaauucauugccuccagcagggguuggcaaacuuuuccuauaaaagaaagagagucaauauauuaggccuuggaggccaaugggcaagauggagcaacuauucucaccagaaagcuaguagucuuuuuuuuuuuuuuuuuuuuuuuuuuuuuuuuuuuuacauacuacuuuuaaaaauguuaaaacuacacuuggcucgugggucauacaaaaauagguagugggccagauuuggaccacagucuguaguuugucaaccccugaccuaaaguucaacugucauuuugcucuuguaggggcaaacaccuuuuuagggguuugcggcugggccugcgaauuaaauugacauauaagacagaucaacaggagaaaagcauacauguuuauuuaaugaauuuuacaugacaugggagccuucauaaggagugaagacccaaagaugaaguuaggguugaauacuuaugugcugaauuggacgaguaguaaucuaugaaagugugacgaggcagaggagccugggcugggggguuagcugggugaaguggccaggaggaugaggguuagucuaacaagguugguucaugcagauuucccucagccucaacuuccugucuuugaugauaagaaugaugcuuccuucuaguaucggaagggcaucuuucacaugggaauuucaucuccagcuuuuaagaaacaaaaugggccaguugcgguggcucaugccuguaaucccagcacuuugggaggccaaggcgggcggaucacaagaucaggagauggaguccauccuggcuaacagggugaaaccccaucucuacuaaaaguacaaaaaauuagccgggcaugauggcgggugacuguagucccagcuacucaggaggcugaggcaggagaauggcgugaacccaggaggcagagcuugcagugagccgagaccgcaccacugcacuccagccugggcaacagugcaagacuccaucucaaaaaaaaaaaaaaaaaagaaaaagaaacagaauggucaggugauguucuuguucuuguaccugcuguuuuucaagagccuuuaacccaaaauagucaguuugccagaguggcauauuuugggguggcauauuccuuuuuuuuuuuuuuuuuugaaacaggaucuugcucugucacccaggcuacaguguaguggcacgaucacggcucacugcagccuugaccuuccgggcucaagugauucuccuaccucagccucccaaguagcuaggaccacaggugcaugucaucaugccaagcuaauuuuaauuucuuuuuuuuuuucuuugcagagauggggucucucuauguugcccaggcugguuuugaacuccugggcucaagcgauccucccaccucggccucccaaagugcugggauuacaggugugagccacugugcccagccugggguagcauauucuuaacuacuucacucuccuugccuugucacauagucagccagcucuccaucucuuaaucuaggauauauuucagagucaaaaguuaacaguuaacaucaauagguacaugucucuucucaacauaacaaaagguaaugugaacaggauaaaaugccauaaaucaagugagaccuuguuaaugauuuauucaguccucuuuaggaucuuuugguacucuaggacuccuuacgauuuaccaugcauugaguuuuuaauauuucaguuaauauaaaauuauaguuaaaucaaaaaugaaaaugguuucuguuccaugcuauugagugaaucuaaacuuugaacgugucucucagaggaauuauagcucuuuuccuagccauggauugaaggaguucauucccucuuguucuccauccucuguuucagauaaagaccauuuugagcggcuuuaucaucaggggcuacuuggggaaguggacccugcuaaucaagacagucacgcuggugcugguaguguccuccggucugagccuugggaaggaagggccgcuagugcacguggcuuguugcuguggcaacuucuucagcagccuuuucuccaaguacagcaagaaugagggcaagaggcgggaggugagccagcucagcuuccaucugcagcgaaacuuucuucucaaagcccccuccugcugucugacuugcagguuugcacguuuguuuucauggaaggccuugaagcuuauguagaacuauuuguuuuguaggugcuuucagcugcagcggcugcuggagucucuguugccuuuggugcaccaauuggaggcgugcuuuucagucuagaagaggugagaaugggcagcugagggaauucgugauuuugagcagcaaggcccguugaggguuagaaucaaagaaguauuggauaagauuccggcaguuaauuaaggagccacaauuuccacuguuuuuuuuuuguuuuguuuuuguuuuuguuuuuguuuuuuuugagacugagucucacucugucacccaggcugcagugcaauggcgcaaucuuggcucacuacaaccuccgcuucccggguugaagcaauucuccugucccagccuccugaguagcugggacuauaggugcacgccaccacgccuggcucauuuuuguguuuuuaguagagauggggguuucaccauauuggucaggcuggucuugaacuccugaccucaggugauccaccugccucggccucccaaaguacugggauuacaggcgugagccacaauacccggccaccagcgauaaauuccuguuuucaaguauuguuucaaaaauugccaaggugauuuuuuaaaaagauuuacaguauucucccucucauaaccaacuuaauuaagcauuuuugauuuugguaacccaaacggguuauuccagggguuggcaaacguuucuguaaaaggccagguaguaaauguuuuugguuuugugggccaugcaauuucuguuguagcugcucagcucugcugucauagcaugaaagcagcugugaacaauacguacacaaaugggcaugucugcauuuccauagauguuuccuuaugggcacugaaauuugaauuuuaugguuuucacaugucacaaaauauuguucuucuuuugaauauuucaaaucaaaagauuuuuucaccuuuuucaaucaauuaaaaauguaaaaaccauucuuaacucaugugccauacaaaugcauucacugggcugcacgugacuugcagcccagaguuuuccaaacccugaucuacucuguuuucuguagaauccaauccagagguuuauuugcuucuaggggagucucugugccaugaacagaauuaugauuaaauacuuuucucuuaaaaauauagcccaaacccaccuugauuaguguccauuccacuucuagacauaguuagauuccuccagguaucuuugcugaugcguuuuggucacauuaaguccaggcucauggaaugaguguguccacucuuggacuuagagugugacuuuccugccaaccagagggcuuggcucugagcagcucuuucuccggccagucuuuaauuuuccacuuuuucaucucaggucaguuacuacuuuccccugaagaccuuguggaggucauuuuucgcagcccugguggcggccuuuacgcugagauccaucaaucccuuugggaauagccgucucguucucuuuuauguggaauaccacacgcccugguacauggcugaacucuuccccuucauccugcuuggggucuucgggggcuuguggggaacccucuucauccgcugcaacaucgccuggugcaggaggcgcaagaccaccaggcuggggaaguacccggugcuggaggucauuguggugacugccaucacugccaucauugccuaccccaaucccuacacacgccagagcaccagcgagcucauuucugagcuguucaaugacuguggagcccuugagucuucccagcucugugacuacaucaaugaccccaacaugacucggccuguggaugacauuccagaccggccggcuggugucgguguuuacacggccauguggcagcuggcccuggcacugaucuucaaaaucgucguuaccauauuuaccuuuggcaugaagguaagugaaagggaaggaagaugggguggggacccauguccuucuggggacagcacccuacucucuaaaauaaaauugcggugggaaaaaaaggggaacuggccuuucuugaauguucucaugugccaggcacuugacauuccuuuaaucaauaggaaauaacuucuaauaaacaauaagcuuaugaaauagagauuuuaaucccauuuuacaacugaggaaacuaaggcucugagaucuuaaguggcuugaucagacccacagcuuaugggagacagagcuaggcaucaaacccacuucacacauucccagaacaggugguggugaccacagguuuccugccgcuggccaggugaugccaggugguggaaaaagcccagguuuggcucaguuuggcucauuaaacaugcauugaguaucagcuguaucuuaggcaucgugcuaagucugagggauacagaacccaaacagaaagcugcccuugcagagcacacagcucugggagaaagagaugcagaccuggaguucugacauugugaugagcaccacgcugguaugacgggagcacagagugagugugucccccgucuggguagggcugggcaugacaggggcucuuugcacacauccucuuugaagaacagagcuguggaugacagcacaugcuuucuuuuccuccucccucccucccucccucccucccuuccuucccuuccuucccuucucuucccuccccuucccuucccuuuucccuuuucccuuuccucuucccccuuuccccuuucccccuucccuuccuuucgucuuguucccaggcuggaauacaguggcaugaucacagcucacugcagccucaaccuccugggcucaaaugauccucccaucucagccucccaaguagcugggaucauaggcgugaaccaccacacuuggugauuuaaaaaaauuuuuuguacagaugaggcucuugcuguguugcccuggcuggucccaaacucccaggcuccagugauccuccugccucagccucccaaagugcugggaucauaggcaugagccaccacaccacacccaacagcacaugccuucauuacucuuguuccuaaagccagagaagagacagcugguuuccucuuucauuguguuaaaaucauuuguuaaaaucauuauguuaaaauacuuuaaaagccccuccuaaagaacuuucuuuuauggaaccugggauuuuguuauuauagcuuuuuuuuuuuuuuugaaaugagguaaaacccauaaaacauaaaugaucauuuuaaaguauacaguucaguggcauuacauacauucacaauauugugcaauuaacaccuguauuuagcuuuagaacauuuucaucccccaaacggaaaucccaucuccauuaacagucauuccccauuuuucccuccugcagccccggcaaccacuaaucugucucuagauucgccuauuuuggacacuucauauaaaugauaucauauaauauguggccuuuggugacuggcuuuuuucguuuagugcaauguuuucaagguucauucacauuguagcaugugucacuacuucauuuuuauggcugaauaguauuccauucuauggagaucccacauuuuguuuauccacucauccuuugauggacauuuguguuguuuccaccuuuuggcuauuaugaauaaugcuaucauuacuuacuuaaagaaacuuuuauuagaguauaucguucauauagagaaguguacagcuugauggaguuucauaaaacacacacacacaccuguguaaccagcacccaggaccagaagcagaacauuauccaccucccagagcccccuuuuguguuccauuacuauugcuuucuguguggcauuucuaugaauugucuuuuaauuuuauuuauuuuuauuaaaaauauaaaauagagaccaagcucccuauguuucccaggcuggucuuaaaccccugagcuccagugauccuccugcuuuggccucccaaagugcuaggauuacacacaugcgccauugugcccugccugaauugucuuuuuuuuuuuuuuuuuuuuuuggagacagggucucacucuguuguccaggcuggagugcaguggcacaaucaugggucacugcagccucgaccuucugggcucaagugauccuccugccucagcccacugggacuacagacacgugccaccaugcccagcugauuuuuguauuuuuuguagagauggggucuugccauguugaccaggcuggucuggaacuccugggcucaagugauccgccugccuuggccucccaaagcguuagaauuacaggcgugagccaucacacccagccugaauugucuuuuuuuuuuuuuuuuuuaaauuuaauggucgggcaugguggcucaugccuguaauccaagcacuuugggaggccaagguggguggaucacuugaggucaggaguucaagaccagccuggcuaauauagugaaaccccauuucuucuaaaaauacaaaaauuagcugggcguggugacacacgccuguggucccagcuacucgggaggcugaggcauaagaaucacuugaacgcaggaggcagaggcugcagugagcugagaucacgccacugcacacgggccugggcgacagagcgagauuccgucucaaaaaaaaaaaaaaaaaaaaaaagaaaaaaauucuaagaaguuguuuacuugagugugucauaguggucaaauacaaaccugaauuugggccuuaagaacaaggaugaguaggccuuauuaaacagcuggcugucucugaucugucaucuccuagcaaagggauuuguuuucaugucucaggaagaugcugguaacauuuuaugaugcuugcugagaaaagucuccuuugauguuacagggauauaaaugauguagaauaaggggaagcucagaaaggaaugauuuccuaaggaguauucugacucuagaaaucacacccaaggauccaaacuucacuugaauuagguuaaaguucugcuuccauccucagauggguaaccaccuggggcuggcuggcaucauugcagcugcugcccauggucagcggucacgugucauuucagcgaacacagggagucaggcuuguucuauaguacauguguggucauuagauaaacuaaaauguaucuucauccagcaggguagagaacacgcugguaccaagaucucuuaguuuacauucuauuucuuugcugccccuauccuggcuugaaaauauucagaauacuuauuagaaaauguacuucauuaggaagagggaauugccucccucgucucucucugacagguauucagcuaccaccuacuagagagggcagggagccauugaagugcuuucuggaagauccaggguggcugcaaugauggacuuagcuucuuuauuuuaccugggagcagucgcaggcccuucuuuuccauuuucaugcuguggcuugacauuuaauuuuaaaagccauucugaaugacauggcaaggggcgagagaaaguggugucucaacugacagaugcucacuuugaauguuauuugcaguggggcuuaucauucuuuaauccacagcaggcaaacccagccagcuuuugaaggagagggaaucaaaguauaaaauugcguccucucuaaguugcaguagauaugacugacuaggcaggucaaauuauuugucccaccuuuccccagcugaccuauuuugcagaguugcaccuccucugaagacugaagcuaaaugcaagcccgucgagggggaauguguuucuugggggucgugaagcggggacuuggucuuuuucccucauguugcuuuucucugugucuccucaagaucccgucgggccucuucauccccagcauggcugugggcgcgauagcgggcaggauggugggaauuggcguggagcagcuggccuaccaucaccaugacuggaucaucuucaggaacuggugcagacccggugcagacugugucacgccagggcuguacgcaauggugggagcugcggccugccucgguacgaccauggguggggcagggagggggaccggggaacuaaucuggcuuagaggacugccaagaaggaagacauggacuugaacauuuucuuuacucaggauaggcuggguuguguggcuauaacaaguaaaccccuaaaucacaauggcuuaacgcaccaaggcuaugucucgcucacuaugcagacacacacacacacacacaaacagaugcccucaacuuaugaugggguuaacauccugauaaaugcaucauaaacugaaaauauuauaaguugaaaaugcauugaauacaccuaaccuaccaaacguuguagcuuagcuuagccuaccuuaaacauguucagaacacuuacauuugccuacaucugggcacaaucaucuaacacaaagccuauuuuauaaugaaguugaauaucucuuguaauuuauugaauauuguacuggaagugagaaacagaugguugccuguguacuugaggcaugguuucuacugaaugccuguugcuuuuguaccacggaaaguggcaaaauuguaaguuaaaccaucguaagucagggacugucuguaaauaaaaaucuugguuuagcagaaggcgcuucuccaccuaaucauucaggggcacaaaggugggucuguccccugucuauaguccuuaagaauuucugugauauucuguuuaugggguucuugaagagcaccaugcuugcuuagucagaagcuugcagagcccauguaggauccacucaccaaaaagcuugugugggccacggugaauagacaacccgggauccgucauuggagcagaggccccagugagaugcaacuucaggcuccccaacgcaaagccacauuugacagggccuggccuggguuccagaggcccaguguaggaagcauguaggagagucugcuuggaacaggugugaggggaauuuacagccugucugucauuuuccccaaaucaugcuuccgugagcugcccggcuugcacuuuggaaucuuacuccuccccucuguugcagguggaguuaccaggaugacggugucauugguggucaucauguuugaauuaaccgggggucuggaguacaucgugccccugauggcggcggcugugaccagcaaguggguagcugaugcauuugggaaagaaggcaucuacgaggcccacauccacuuaaauggguacccuuuccuugacgugaaggacgaguuuacucaccgcacacuggccaccgacgucaugcggccccggcggggagagccgccacugucggugcucacccaggacagcaugacugucgaggacguggagacgcucaucaaggagaccgacuacaacggcuuccccgugguggucuccagagacuccgagcgccucauuggauuugcccagaggagggaacugauucucgcaauaagugaguaaagagagggaagcucacauuuuaccaagagccgaauggcauccuuuguaccccuaacauuauccaagauuuuugaggugaugugcauuaagccaggggcucucaagcuuucacaugucucugggucacccaggggucuggcucaaaagcagauucugauugagcaggucuugggugggauccgauacuacaucccucacaaguuccccauuaacgccgauauugcugguccccacgucacacuguaaggaaaaaggcuuuaaacccaagucuuggguagacauucuugguugcaaagugacugcauguuugcaagcagcccccuggcccugcuccgcugcugccuuucagcaauuguuggcuaaagcugagaaggaagagaggcgacagccuggaguggcccgggcugagcugucucagagacuuucagguguaccaaccauccggcugagaucacgaguucucugccccagacaccccuugccaccacacaagucuuuugcuucacuuugugauaugaugucagauuccacaguuagaggcccuuguggguaaaugugcagacaucgcugaaaccaauugcgugagaugauuuuccucuuguguuugaaugacaaucagcugcacugaggggcaggcuguugaguugggggaggggaguaugggaugaugcccaggucagggugucccaacgacagguggaucagagaagcaagcccaugggccccaucagccgagggauggcuccaacagaaggguaaacaggagguaggagaauuccuaagacagaggggccuagggcugcgggcugagggccagaggucugguugugaguugcugggaccccaggcaaggagaagcugugagccuuggagggguagaguccugcugggccucaagguggcaggggcaaggaccagcauagcacauccacgggcacgcucaccauccuugcucugugaucuguacaacauuccagcaucucaugauagaccagggcccauggcguggcucccaugugcacacgacaguuuuacuauauaucuucuagaguauucuugaagcuugucaaugggacuuucccuggucugauguuggaauggcccacuguuaauacaucuccaccaggcaacugcuuacuucucucccuguccuuuguuuccuguuuccaaggcaccucccuuaaaccucuucccaguguuacauagcuuuaaaauaucuuuaaggcaucuucaucaaaggcuuuauaacaauaaguugagauaagcuauccucucccauuuuagcuugacacucaaacauuuuuaccucccccaaaguaaaaauugauuuuguauuuuagacaccguagcaaguuugugcuuaaguguucggcgaugcuucuccuuauuauagguccuguugcuuaacggguagguaggugccuuuguguaaauauugccuuauaaauaaugagguuuuuuuaagguuaaguaggauuggguuuguuuaaaaauacuguaaucagcagccuuuaaaaauuuuuucauucccuaggaucuuuuaagcaaagguugaaauuuaaaaacuaagguaauaaaugucacagaaucuauuaucuauuguauagcuccaggcacaccugcuaagaggcagcuuacuaauuuugcugaaacccauuacuguaaucaagugggaagcaguaauugucaucaaccaguuagagaagaaauuuaagcuuaccaaccaaguacucuucucgaagcuauguuuggaaugucugaagaggcaccacacgguguaaauacuaccuauaugcuuucaaucagaccgauaauaauauagaaggugcuauuuacaugguuugugcagagggaaggaguguuuugcucugaggaaucagaaaagcuguuuuucuggccuguggaaauagaagagccccuguacucugguggagaaauacaggugcaugaccuguauuugaggaaucuugugccauuuuaugaguauagaaauaugacagcauuuagcuagacacuaucccaugccaauuucacuuccuagaggaauugggagcaaagauuauagacagauccaagauaguauggaucagaaaagaaagguaagugagguaaauaaggauuuuucuuacauaucauguuuaaaaauuguagcaacugcucacaugaagcugaaaauguuuuguuauguuuuggaaugccaaagcauggcguuaucuuuguuagagagcacgucguuagcaccaccuaggcaacgugacucucuucaccaucacauacuagcacacggggcuguaugcgacucuugcucaaguuccuggcaaaugggccuuuaccucucauugcucugcaaauaugaggacucgccuguacuuagcagggcucaggugcuucuugucuugaguucugcaguuaaguagagguucaaagaggacucagcggggaguugcagagaugauuaaaggguggaaaguuagaguuucagggaagaguuaaggaaacucucagguuuuuuuggucugguggaugauuuauuaggcugguacaaaaguaguugcgguuuuugccguuacuuucaauggcaagaaccgcaauuacuuuugcaccaaccuaaugauucuccagcauguggaagacgcuuaguugcagaaaggggucuacauccagcacugaacaagaagcuaagugucaggucugucagacaagggagaaagagguuucugcccgggagggcuguuaguuacuggacuaggucauggagaauaguggugucaucuacaccuuucuguuggggauguguguguguguguguguauauauauauauauauauauacacacacacacauagagggacuucuccaugcuuuaguagacagacaauaacuuguaaaacaaucugcuuuuucuucuguauaaucuuuacuuuuuuaucauaucaucuuuguacuacuucugugguugcuuucaauuuuccauuuuaaccuaucucauuaauuauaucugucuuauggacgcauuuaaaaaaauuuuuugagacagggucucgcuguuucacccaggcuggagugcaguggcgcgaucauagcucacugcagccucuacccacugggcucaagcagucuuccugcuucagccuccggagaagcuaggacuacaggcuugcaccaccaugccuggcuaagcauuuuuaauuaacaggaugauagacuauuacuucccuaaaaacacaguucaagugggaguacuccuccucagcacugcugacauuuggggcuugaugauucucugugcuggggcugucuugugcacucuugggugcugagcagcaucccagggcuccacccacuggaugucagcagcacuugcccucuccuauugugauaaccaaaaaugucuuuagacauugccaaauguccccugaggguggaggcagaauugcucccaguugagaaccauugcucuaaagccacucaauagccuaaugaauaugugauuauuuccaauuuugaaaaauuucuuggccuaucacauaguuugugaaauuucucuuacccauacuuuauuauuuaccaucucuacaucuggcauaugaacauauugcuucuaggaaauggaauguugaguaaccuuagcaggugcucauaaaauauacauuccuucauuuuuuuuuuuuuuucacuaagucuugcucuguuucccaggcuggagugcaguggcgacaucucggcucaccccagccuccaccucccagauucaagcaauucuccugccucagccucccgaguagaugggacuacaggcgcaugccaccaggcguggcuaauuuuuguauuuuuaguagggacggagcuucaccauguuggucaggcuggucucgaacuccugaucuuaagugauccgcccaccucagccucccaaagugcugggauuacaggcaugagccacugugccuggccuaaaauguacauucuuuuuuaagagcuguggccacugagacucauucuaguagaauauaugacaaaccuccuacauuaaagacaguuuuaaaaacaguuuaacuauuuuuaaaacauuuaaaaaugaaguuuauuacauuuuuucaaaaugaaaguaauacacacuccaaauauuggggaaaucagaagaaaaaggaaacauuuaaaaagccaccuacauucuuaucaccaaagaagacaugauugauauuuagugcauuuccuuuuugucuuuuaggucuuuuaaaaagaugcauuuucgguuguauuguuuugguuucuuuuucaacacagacucccaaguguuccuagggucugugggucucuuuucuuguagcacuggcucauccccugggugaggaguuaguugguuuauccuuucacacaggaaauauuucuuaaguguccaccaugugcugauaccauccuagaagcucagaguccagggaugacagcacacugccucugcccucugugaacuuacaugcaggcauuuuggugucugaugauuucugguccaaacugagagcagauguuucacccugguagagaauugcaaagagcuuucuugcugguuguucuuccauucacaggcuuuugccuguucuuagcaccucuacccacaaaguuugaagccuccuguaagucuguaauagaguuccaaaguggccuagcagaaccuuucugaggagaguagcaguugccacugugggaacagcaaggugcauagcucaggcuucuggcucugacccuagcugaugccuauauuuuugcuuggcaguaaauaccuugugugcuuuccuuccugaugccuccuaugugagauagguucaguuuuauguggcaggcagaaccagauacacugacauuuaguagaccuacucauccguucauucauaugugcauuuggcaaauaucuguuuugugucuacuguguguuaggcauuguccaggcacugggagugcacuggugagcaagaguucauugagcuaguggcuguuagaaucagggcuucuaacccaaucaguagguucaaaggagauauaagcauguuauuuauuuuauuguagcaaguggaucgaccauuuauuaaauuguauuugguuuuagaagggguucagcaaauccaugucaucaacucuugauugggguuugcaacuugauccaauccugacauucacucagugguugaaauugauggaaauccuguuagugggacuuuaagagaaucggcuggucuaugggaaugagcaaauaaguguguguugccaguugccucccugccuuaguggguaaggacagaaucaucuugguuuaggagagaaguacguaguauauaucgaacagucuacauuugaaaacgcguugugccucagagucgucugguauuuguggcagaaucauaccccauuugauguaacuugauuuaaccugacccauguaaugugaaggcauuugcccagcaggcccucuguuccucuuuuaaacagagacccuuuuucagacucagccugaccccagaugcugccaguuuuccauuagaguacucuauugcacuaaauggccuuagaggaggcaguuagaauuuuauuuuugaaagaacaauauaggugaauaguagucuuugagaagguaagaaguguauuaugggaaccaggauccauuuuaaagcaagccuugcuguacauuuucccuaaccuuuucccaugaaccaaaagaaagauuaaaauuccaacagaaggaaaaucgccuuggagaaauaucuugagaccgauggauuuauuucauguguggcuuaaaauagccuggguuucuagcaccgcguuaagcuguauuucuaaugaguuccuguuacccuacuuuucuucagcuuucuuucacauggccuuuucuauagacagaaauaggcuaauugcuaccauaacaguuuuacuaucuuucuuugagggauccacaaaauggcccauuuuuaagacaggagauccgaaggguugaggggggaugcagcuuuucugggguuguuucuuuggacccaagggucgcguuugggauugagcugcauuucugggcugugagccugggcuggccguauugguuucuuguuccucccaggauucauaaugccauuugggccaguuauaaguuaguucguaaaaagaaaaacaauguauuaaggucaucgggcagcuaaguaaguuucuugucaccucaaacuccagcccaugaugaggugaaggagcguaaggaaagccagaguggagggcccugggcuguuuggggugcccggagucugcggugaagcagugaauguccccaaaggggccaucugggucaggcccaucuugccagacuuuggcaacaaaugauccggucacagcaggggacccucacacagcauuagcugcagagagaugccaauuccacagauguuuggcuaaagccccuuauuaagaaugugugguucauccuccaaaccccuuuucugugggauucuagauggugugugugagugugggguggggaauugcucagcaagggguuuuuguguggcucauuguuccugcucaccccauucuagagaacgccagacagaggcaggagggcauugugagcaauuccaucauguacuucacggaggaaccccccgagcugccggccaacagcccacauccccugaagcugcggcgcauccugaaccucagcccguuuacagugacagaccacacuccgauggaaacggugguggauaucuuccggaaacuggggcuucggcagugccuggugacgcggagcgggugaguagccggacauguggccagaaugaccuagggagaaaaagaugagugagacauggucucagcccugaagaauguggagggccaugggguggaauaguccuugacagagaauggcaguaagcuguggugaauguguugaggaggaaauguacagggagcuugggacugagggcugggcagccgugcagccagagaagggggugguccaggcuggacugcugccugggcugagggagguugaguaaaaagggguggagccacaggagaagggcuugguguugcuuuucuaccaccccaugugacacuuggcuuagggaggagguucugcuauaacgugauguaugcgguccucaaaaucacagcacuacgcaaaaagugcuccaugcaaaccacaggacuugugggaaaaaugggguuagguacacaacagucaaaaacuucaucagugauauaugacauaaaagagguggaagccuaauaagaaugguaguaccgagccaggugcagugaguggcucgugccuguaaucucagcacuucgggaggcugagguggaggaucacuugagcccaggaguucgagaccagccugggucgcaagacccuaucucuacagauaaauuuuuauaaaaucagccaagugugcccauagucccagcuacuugggaggcugagacaggagcaucacuugagcccaggcuuccaaggcugcaguggcccaggauugcaccacugcacuccagccuuggcagcagaaugagacccugucuuguaaaaagaauagugguaguaccauguuacacauuaguuaaaugguuaagaaauacagggauacaacagaaauaugucacuucaucuuaaaaaggccugaaguuggcugugggguggguuucacaagcugugccacuuccgaauuaccgggaagggguggaaggaggggagccugaacucaaggggaaguggucacagcagguguggaugggcauggcucuucacgcaugcaugaacugaggucgcuuguggauguuugggggccgggcaugugcauuuuguguaugccgaucccacuggguucagcuggguacaguuuccugcauuugccuagagcuucucauggaugaaaucacacauaagcaaagguaaaauucauauuaugcucagauuguuccugauauaucaauuuguuugaaacaacuuuguuuucgaaacaaacaugauuggagaauggagagauuugauggccccauggcauugucccugcugccacuuuuguuuuguguugucacaaaucaggaaaccaacaaugcaaagaucgaggguccacuguaguagcaccagagaagcaguuccuuaaaggucauuccuuggccucugagugucacaaguuccauggugucagaagcuuguguaagggaaggggucggcuuggucaggguagccuggaaccuaggguuaucugcccauuuuauuccuuuaugggcugggaguaggaggcggggaauggguucuggagacauugguaccuaauaaaguuuaggccuuuauagacuccagaggcucaacuaucuaauauagcuuauauuuccagagccagcacacucuaguuuaacacagcaguucucaacugggaugauuuuaccucccagagacauugggcaaugucuggagacaauuuggggugucaugacuggagggagggaugcuauuggcaucuagugaguagaggucaggggcgcugcuaaacauccugcagugaacaggacagcuccacaacaaaacaucuggcccaaaaugucacuagucgugcaguugagugaccuuggacuggaugugccuguauagccaaaugagcaauccuauucauuccacuuucuuccugcuguccugguagcaagcacacagggggacaggcuuugcaauuugcagauuuacccagagaacuccuggccagcagagugagcauccuccuuagcucugacuacagacagagcagugucuugcaugugggaggugcaaucaauagggaaaaauaaaugaguccuuguguuugacaaggcuagggaucauuucugcugaugaauuuuaaaggagcucaagugguuuuucaaacuugaguguggaucaaaauacccuggaggauuaaaccuccagguuaaauccagauuucugggcccugccacagagguacugaucccuggaagucuagggugaggcccaagaauauucuuuccuaacaagcucccaggugaugcugcaacugccggucuggggaccccaccuugagaaccacugaagucgauuuaugcacuugaguuuccaguacucuugguauaaacaccacugugauugcccaugcugucucaaguguguagcaguuucuccuuuccuuuaaaacaauaauccaaagucaauuaucguuggaauuucagcucaggcaggaaacucugcccuuaaugcccgcucacaccucauagagccccaugaggucuuccugugaagaucugggugccgaaauuggcucugaaugugcuucaagaaagcaaaaucgcacucucucucgcucuacaucuuuuacacaaacacagaugcugcugcguuagugcuggcaagggaugcuugucugcggggccuuucaucuccuugggcuucuugccagggcaggcacgucucuggccagcucucauguuugaugugcucgcccacccuguaccuucccugcucgggauggccacgagccugagcuccaccgcuggccuggaucaccugcagcauuucucaggccugggguucaaggggcaucauaaaacuggaccaggaaucggaaugccgcaaucuaggaagccuccaguugcuaagagugaauuugggugagauuuucccuaugaaaguucuagaaaggaaaagugaguaagggagauggugucagauuuuccccaagcccugcuaggugguccacaggggccuggacaggauagcuuucgcagaagagcccagcugcucgaauuugaauuauguccuuggucauagaucuggccauuuauaauucgcugaauucgcuucaacugcuacucaaaggggcuggaaguucaaacacuugauuuaaaucaaauaggacauuucaugccacuaacgaagccugcuggauuugauguuaccuccuucuggguugauguucagcuuucuucuuuugugauaauuaccaucgcgggccagggcacaauuuaugcacgaacccaaggcagcuccugaauucauauuucccuagugcuguuauaaucaacuuaacuuuuagacauuacagucacagagcuuuaaaaggagguuuucagaacugcaaaugcuugaucuuuugauacugucuccagggugaagacaaggaaacaaaaaccaggauuuauagauaugggaggguuccguguguguguguguguguguguguguguguguguguguguaugugaguguguguguguuauaguuaucaucacuuugcaaacacuaacaagucuuauuuuuuucaaagcaacauugguuuaaucaacauuauauugagcaucuauuuuagcugggaacuguagggggcacaaaaaguguuuaaaaaaaaaaaagccaaggagcuuguuaucuacuaaagaacauggacauaauccaguuuaaguggugcuacccaaggcaggcgcuccggggggacuguucuguuuuuucuuuuuuaauuuaauuuaauuuaaaguuccgggauacaugugcaggaagugcagucuugcuacauagguaaacgugugccauggugguuuccugcaccuaccaacccaucaccuagguagguagccccauaugcauuagcuauuuauccugaugcucucccuccccacauccacgacaggccccaguaugugcuguuccucucccuguguccauguguucucauuguucagcucccacuuguaagugagaacauacaguguuugguuuucuguuccuguguuauuuugcucaggauaauggcuuccagcuccauccaugucccugcaaaggacaugaucucauuccuuuuuauggcugcaucguauuccaugguauauaugugccacauuuucuuuauccagucuaucacugaugagcauuuggguugguuccaugucuuugcuauugugaauggugcugcagcgaacauacguguguauguauuuuuauaauagagugauuuauauuccuuuggguauauacucaguaaugggauugcugggucaaaugguauuucugguucuaggucuuuggggaaucgccacacuguccuccauaaugguugaacuaauuuacauucccaccaacaguguaaaagcauuccuguuucuccacacucuugcuccacaccagcaucuguuguuucuugacuuuaauaauugccauucugacugaugugagauggcaucucauuguggguuugauuugcauuucccuaaugaucagugauguggagcuuuuucucauauguuuguuggcuauauaaaugucuucuuuugagaagugucuguucauguccuuugcccacuuuuugaugggguuguuuuuuucuuguaaauuuguuuaaguuccuuguagauucugcauauuagaccucugucagauggauagauugcaaaauuucucccauucuguagguuguccguucacucugaugauaguuucuuuugcugugcagaagcucuuuaguuuaauuagaucccauuugucaacuuuugcuuuuguugcaauugcuuuugagguuuucguuaugaaaucuuugcccaugacuauguccugaaugguauugccuagauuuuuuuucuaggcuuuuuaucguuuuggguuuuacauuuaaaucuuuaaucuaucuugaguuaauuuuuguguaagguauaaggaagggguucaguuucaauuuucugcauauagcuaaccaauucucccagcaucauuuauuaaauagggaguccuuuccccauugauuguuagcuuugucaaagaucaggugguuguagauauguggucuuauuuuugagaucucuauucuguuccauugaucuauguaccaguacuguacuguuuuggauacuguggccauguaguauaguuugaaguuggguggcaugaugccuccagcuuuguucuuuuugcuuaggauuuucugggcuauauggacucuccaccucaaaacaacagaauauacauucuucuuggcgccacaugacacuuacucuaaaaucaaucacauaauuggaagugaaacacuccucagcaaaugcaaaacaacugaaaucauaacaagcggucucucagaccacagugcaaucagauuagaacucaagauuaagaaacucacucaaaaccaccacacaacuacauggaaauugaacaaccugcuccugaaugacuccuggguaaauaauaaaauuaaggcagaacucaagaaauucuuugaaaccaaugagaacaaagagacaacauaccagaaucucuuggacacagcuacagcaguguuaagagggaaauuuauagcacuaaaugcccauaucaaaaagcuagaaagaucucaagucaacacccuaacaucauaacuaaaagaacuagagaaccaagagcagacaaaccccaaagcuagcagaagacaagaaauaagcaagaucagagcagaacugaaggagacagagauacaaaaaacccuucgaaaaaucaacaaacccaacaaauccaggaguuguuuuuuugaaaaaauuaauaaaauagacugcuagcuagaguaauaaagaagaaaagagagaagaaucgaauagacacaacaaaaaaugauacaggggauaucaucacugaccccacaggaauacaaacaaccaucagagaauacuguaucaccucuauguaaauaaacuagaaaaucuagaagaaauagauaaauuccuggaugcauacacccucccaagacugaaccaggaagaaguugaaccccugaauagaccaaguucugaaauugaggcaguaauaaauagccuaccaaccaaaaaaaucccaggaccagacagauuuacagcugaauucuuuguaccagagguacaaagaggaacugguaccauuucuucagaaacuauuccaaacaauugaaaaggagggacuccucccgaacucauuuuaugaggccagcaucauccugauaccaaaaccuggcagagauacaacaaaaaaagaaaacuucaggccaauaucccuaaugaacauugaugcaaaaauccucaauaaaaaaaaauaauggcaaacugaacccggcagcauaucaaaaggcuuauucaccacgaucaagucagcuucaucccuggggugcaaggcugguucaacauacacaaaucaauaaacguaauucaucacacaagcagaaugaaagacaaaaaccacaugguuaucucaauagaugcagaaaaggccuucgauaaaaauaacaucccuucauguuaaaaacucucaauaaacuagguauugauggaacauaccucaaaauaauaagagccauuuaugacaaacccacagccaauaucauacugagugggcaaaaccuggaagcauuccccuugaaaaccagcacaaaacaaagaugcucucucucaccauuccuauuuaacauauuguacaauucacccauuuaaaaugcaugauucagugguuuuuaguagaaaauggguugugcauuaaucaccacaauuuuagaucauuuucaucaccccaaaaagaaaccccacaccccuuagcuguuaccuccuauaccacaguccuuggcaaccacuacucuauauuuucugucucuguggacuugccuauucuggacauuucaugucaauacagucaugcacuauguggccuuuuguauuuggcuucuuucacugagcaucauguuuucaagguucguccacacugaagaugugucuguacuucuuuccuuguuagggcugaaucaucuugcauuguguggauagaccacauuuugcugaucaauucauuaguugauggacauuugguuucccuuuuuuucuuuuuuuuaaauuauuuuuaauuuuuguggguacauaggaguauauauuuauggguauaugguauauuuugauacaggcauguaaugcauaauaaucauaucaggguaaauggggucucccagcaccucaagcauuuauccuucggguuacaaacauuccaauucuuuuaguuauuuuuaaauguacaguuaaauuauugauuguagucacccuguugcacuaucaaauacuagaucguauucauucuuuuaaacuauuuuuuguacccauuaaccauccuccauccccuccuccccccucccccauuccccuuaguuuucaaaugaggaggugagacucuaagaagcaaaacacugcucaggguuaaagggaauugguugcagagccagucccaucuggauucuuccaggucuccuaucuccugaggcacaaucagcugccagguaccgggaggaccuuugauggagaacccugccagccgacccugacccuugaggacaucaauccccuccguacagcacccucugggaccaacgacaguggggaguagaccugggcgugaugggaagauauguggcagcauccuuaaguauccagauuccuggaauggcugcauuuugggauaccuguucaguaaaauacagaggauauggggccagguaacgggauuccugugucccaugcugacgguguauuauagauucacccacagaggucuauuugugucugaaagcuucuggcugggaguaauagucaaaguguuuaagagcuggugccagauaaugaacugauuuguuaugaauuguggggaguucacugcaguucuauaagguaugagguuggcaggguacaucccagggugucuagcucaguggcuauaaaccaaccgguguagaacuauuuuaguacuuuuuaaucuggauggugguucucaaccaggggcuaucuuguccccccuccacaggagacauuuggcauugucuggagacauuuugguugccauaaugggggauggggaugcugcugcaucuaguggguagaggcccaggaugcugcuguauguucuacagugcacagaauggccuaucugcaacaaauaauuagccaaccuaaaugucacuagugccaagguggagaaacccugcguaaagccuucccagguggagggcuggauggguggaaggaguccuauuggcccagcuugcauuuugcugcuaccgcaugggagggggccucacuggggauuccuaucugccuguaaauagaggcccuucccaguaacaaagccgccuuuccuagcugucacugcuuucuugaaauuaauuagaauuaucagagcuagaacaaaauuuccugacucugggaggaaaccuuguuuaaaaacauuuauuuaaauuuuuguggguacauaguagauguguauauuuauggaacacaugagauuuuuaaaauauauauauauauauauuuuauuauacuuuaaguucuaggguacaugugcacaacgugcagguuuguuacauauguauacaugugccauguuggugugcugcacccauuaacucaucauuuacauuagguauaucuccuaaugcuaucccucccccguccccccaccccacuacaggccccggugugugauguuccccuuccuguguccauguguucucauuguucaauucccaccuaugagugagaacaugcgguguuuguuuuuuuguccuugugauaguuugcucagaaugaugguuuccagcuucauccaugucccuacaaaggacaugaacucauccuuuuuuauggcugcauaguauuccauaguguauaugugccacauuuucuuaaucuagucuaucauuguuggacauuuggguugguuccaagucuuugcuauugugaauagugcugcaauaaacauacaugugcaugugucuuuauagcagcaugauuuauauuccuuuggguauggaacacaugagauguuuugauacuggcaugcaaugcauaauaaucacaucauagagaauggggcauccacccccucaagcauuuacccuuuguguuacaaacuauccagcuguacucuuuucauacaccuguuugcuauuuguaugucuucuuuugagaaaugucuauccaaauauuuugcccguuuuuuugaucagauuauuagauuuuucccuauagaguuguuugagcuccuuauauauucugcuuauuaaucccuugucagauggguaguuugcuaguguuuucucccauucuguggguugucucuucacuuuguugauugggaaaccuuuauuucuuaugugggccucuggcucugacaugccucaagucuggaggccuggacugcucuucucagcagcaauacauggcugccaaagcaaaagggcaacucuaaugagaccggggcccacuaaagcuuuugcaaccguagaagcagggugauuuggcgaaguauuggguaacagugcccuugagaaaauguguaucucugguugauugauugcaaugggcccucauuaugacaguugagcccgaagcagcuaaaacaaaucaggauggaaagaaaugguuucaggcucugccagcuggacccagcaaccuuccugugugaggagaccagagcccuuguugggccuugaaucugucaacuguguucauacucacagauggguuuucccaggagaacucagcaucucaccgcaaagaagagugcuaacauuuguuuccuuuagguagcucuuguuucaggauuauaacaacauuuaggcuuacagaacaauugagcaaaauaugcagaguucucauauauccccuucacuccccucaguuuccccuauugucaauaucuugcauuacuguuguauuuguuguaauugaugaaccaauaucaauacauuauuauuaacuaacauccauaguuuacuuuagaguguacucugugucauauauuucuguggauuuugacaaauauauaauaucauguguccaccauuacaggaugauacagaguaguuucacugcccuaaaaauccccugugcucugccuauuuaucccucucuuccacccaccaaacccugacaaccacugaucuuuuuacugucuccauaguuuagccuuuuccagaauguugcauauuauguaguuggaaucauucaguauguagccuuuucagacuggcuucuuucacucagcaauacacauuuugauuuuucuccacgucuuuucaugacuugauagcacuuuuguuuuuauugcugaagaauauccauugucuggauaugccaugguucaguuuauccagucaccuacuaaagaaaauguugguugcuuccagguuuuggcaauuaugaaugaagcagacgucuucuaagacguuuucuuuacauaacuaccaaaccaugaugauguaaaauuaacaguaacucaauauaucauccaauauccaguugauauucauucaaauaucaacucagaauuccaucaagguuugugcauugcauucuuuugccuuuuuagucucuugucuagaacaguuuccugccuuguuguuguuuuuuuaaugagagauuuuuaaacauaauuccaaauuuuauuuuagacacaggagauacaugugcagguuuguuacuugcaaagauuuccuuugaagaguccagaccaguagucucacauucugggucugauuacuuccucaugauucaguuuggcauaagucguuuuuggcagcauuccaacauagguaacgcuauggagucugcuuuucugacuuuguugaugauaagcuccauugcucggaugagguggugauggccagaacccuccauuguaaagugacauuuuucucuuuguucauaaucuguaggaaaguacuuugagaccaugugaauuuucuguuuuccagcaaccauucgcccagugauuuugguauccauugacaauuauugccuaagcuaacuauuacauuggggguugcaaaguauuaauuaucaaauucuguccugcuuccuacguuuaucaaguauuccuccccauuuaagaaaaacaaucccuguagggucaugauauauucuuuuaauguuuuuguaauucauauugucauuauucuguuugcuuagcaugcucuuucacuauuuuccucucuccuaaagauguugccaugagauggaggggaaggggucuuauuugcugucucucucagugugauacauagggaaaccaacacaagaaacggauaccuuuuccaagacuguuuaagguccaguguugucagagccaaaaaagucagaauucuggccugacaguuugaauaaucagugucuauuucaccagguguaacugauuugaauacugcuuagaauacuuacaucccuucuucauauucacuaagagauaaauuugacuaauuuugccuuaauuaaauaaaugacaguauauuacaguuagguuuucugauuucuuuuguauauuaucauauuacacagaguagaaacccauuauuuuaauagcuauaaaguauuuuaaugcaagacuaccagaguuugcuucugcauaccccuuuuuugggggguacaguggagauacagugaguaguguuuugcaaacuuaugugggaauggagcuucuuuuuuuccaaagaaguuguucacuucuccuucucucagaccuuucauuuuacccaagggacaugauguguuccugcagguggucauuuaguaaaauaaugaaacaaggcuugcuaugaaugguugugcaaaugugcacuguauaauccagagggcacaauuucuacugcaguguuugugagcagugcuccuuggcacugugugauauacagucuugguggucccauacaauggacucugggaaguggcauucuuuuuguaaguugaaagcaauggaauuuuggaagagaaggcaauuuacguauauagucagagauaaaugucaacuuuauccucccaguaagaauuacaaauagaaucacuuuuuaucuuguacuuaaaauuucuuauacuuaaaauaccuuacacuuggcauuccugugguguggucaaguuuugacaaugccuuucauaaacccuuuuaaaauugauuauagucuugaaauuuaagaggauauaguagucaucauagguuuacugccguaauaaacaagcuugcaaucucuguggccuaaugcaauaaagguuuauuuuucucacauguuacauccacuguggauugcaggugggcucuggaccuagguguuugaaucugguggcuccuaagucaauccucagagcccuucacuggcuccugugccucuggcugccagaugagaagagagaguggggggaaaugcacaggagaccugggagcagcaucugucacuuccacccacaggcauuggccagugcucccuccauuggcucugccuaaccacaagggaggcugggaaauguugucugucucuguguccacauggaaaaggcacugggguuuagggagagggaugagucgucguuucaaggcugaccucuuuucucuauuuuguuucuucuccaggagacuucuuggcaucaucacaaaaaaggauguucugagacauauggcccagauggcaaaccaggaccccgaauccaucauguuuaauuagcaacaagguggcaauuauuuucagaaaaacacugacugugucauuuaaaaagaaauaaaugauauguuauuaucccaaugaaagaucaugcauuggggacagcagaaacaaaagcuuuuuuggaaaggcggggaagaaggaugaaaccuuuaaaaacaaaaacaaaaacaucaaugaguaggcauuuuauagcuuuaaccccguaugaguuucaagcuguguuuccuaaugaguuugcuacugcugugggggcauguggguggguaaaugauguaaaugaugugaucuguacaaguauguggagcaugaaugcugacucaagaaacuuuuacuccuucugcucaaggcugauguuuguaacuuaugaacacacgugaaguguugaguccaaaagacaaaggggcaucggcaugucagcguccuuauuuauugguucuugaaguuuugcugcuauguuacugaaucauacuaaagacauuugcgcuuacuuuguugaaaaagaaaaagaaauuaaauuugaacacagugaaagcugcaaguaugccaguggguccgcucacgaccguccuguuucuugcuccuguucucagccuguuaucuggcuuauccaucaguuucugaaccaacaucaggggcaccugccaugaugagugugaagaaaucauuucucuaugcaagacuggcauccugggacugcacgaugaacuauuggagcauacaguacugcggugugucuccucccauacaaagggacacauccuuauuuugaggguauacucacccgaucauugauuugcauccccauggcauuugcuucauuuauuuauugcuuuugcccaugcauucaauauugaucagcucagcacuuccaugggccauagccgguaugcccccagccugccauaagcgugcuuucauuuucaaguagcauaugcaagaguccaaacaggcuacccaauguuacuacuuauuuuuccucucaggucuuaucagauacggcuguggagaggaugaggcauaugcguugucaguuggaaucccuccaaauggauugcaagagaaauacuaaauugauucuaaaucuguuccauuaucuucucuguaggaugcaaaacauccaguuguaauguauaagcaugcacuucauacuagcaaucacagcacaggaggacagcauuaaauuuuauauagccaauuugggcacugggcaucuuuguauuugaacuuaacgacacauuuacucuuuuagucaggauuucggucuuuucugcgggaaggaauuaagcuauguauuagguccaccauacgaucuguguaaguaagauuaucccacuugcccuuucucuuuagucuuugucccuuccuuuucacuaagugccccucauccuuuucaaucucauugucacuggauagugcuguaucacuuaggugugcauucggcugcaaauaacagaaaacccagcaaacacugaagggcuggauaagaacccugagaggggguacuccaggacugucuccauaacaucauugggauccccaucccguugcuauuucuuuuucaccguuuuuaccuuuuguccucuggcuuauugccucagaguugcaagaugguuccugaacugucagguaucaugucugcuuucuaagugggaagaggaagggagaggcaagcaacuagguacaaugucuaucaggaaagcaaagcuuccccagagacgcucagcuuguauccauugacuggaagucugucacguggcucccccuagccgcacacuagugugggaaggaaaauauugagcuaggcacauuacucucugaacgaaauucauauuaucuuauuaaggaagaguguuggucuucaggaggggaaguuugcuguauuggaugccaucaucguguccuuguca

SEQ ID NO: 15011 - RNA, 4785 nt, Homo sapiens
guccugcucaugucuuuaacgaccgguuuucuugcccagguguaauuagcauggucaaugcgggagcgaugaguggcucuggaaaccugauggauuuccucgaugagccguucccugauguggggacguaugaggacuuccacaccaucgacuggcuaagggaaaagucacgggacaccgacagacacaggaagguagguggcauuccgaaaggacacacugcaaauggcuaagccauguuuucauucaaaaguuacugagcuggggcuuagguccacguacgugucaugugcuggguuagggucuaaagaagaaaagagccagugggaggagcagauauauuggcagaucauuguacuagcaggagcuuugggcaggacguugugucauauggagggauugugguguggaggagagggaggggacuuugcaggugccauuucuggaaccuguuuucucauccaugaggauggaagugauuaugccugaaaaggaaaugagauuauguguauaugaaagcacauaugacagugccuggugucuaguuggcaaucaguauauauuuuaauggaccacaaugguuaucugucaagugcugugggaucauuuagguucgguuagggaaggguuuuucagcaaggguaacauuucaguugggucuugaaagaugacuaagauuuugcuaggcagaggaacggugaggauucuaaacaucaggaaugccccccuuuuuuaagucacagaggcaugaaagaaucugauguaucugggcaauucagggagcuccgaggaucugguggaggauuccugcagagggagggauagggaugaguguggaaauggaggcagcagggccacguggggaacggccaugcuggcgguggagaggaguuugcauuucaugcugaaagccacagaagacaauaaagaugcgcugcaaagggagaaacaggaagcuuggaaaugaguccaggagaccgaaggcagugauguguagguggagagaggggaucaggauggagagguauuuugaggcgccacggacgggauucaggggaggugcuggggccaggaggggaauggggucacagaacaccaggcuuuggccugaugaggaugaugccuuugaugccuagaggaagcaaggggggacuggcagacugcggaggaggccauugaguucuguguagaugcguugguuugagcugcgcugcggaugggugaucacagguggcgagaacucugugguucaagggugagggaagggccggggggagaaugaggucccugugugcaaguggaggcugaagcuuuagaaacagccacgguggcgugggugugcagagacagaagggaagagguagucaaauccccaggcagugcccagaguuaccagguccaggggaggcagauggggagccugugacaagaggggacccugccaagagcaguccccugugaauggaaaggguguuguguaggggccugcucacaaggucacccucuauggagaggucagguaggaggcgagccagcggcaugggggcuggcggugaggggagagcugcuucagacgagggugaggagugacauggacagugugaccaugucacaucgccucacgagggcuggcacgaaaggaggaggggaauguguagggagccaggcucagucaugaagauguugcagccucuuggcucugcagugcaggaauguggggucgaggcagcauucccucuagagcacagcucagcagacugcauccugcgggccaaagccagcuggcaccuuguuuuagaaauaaaguuuuauuggaacucagccaugcccauccauuuccauauuuuuaugacuccuuuugugcuacaguggcaggguugaggaguugcaacggagaccauccggcccgcaaagcccaaaauauuuacucucugguccuuuacagaaaacauuugcccaccacugcucuaaaaggccgugagggaaugaugaucucagaggagcauaggauucuguuagcacagggagguguguguagguaguccaucugcugugggagacgugaucugugccagcuaauucuaaguucgugcugcuaaaauuuaaccuugaaaacaaaaggaggagaugaagucugugugaagaggcuuuuuaaugaaacuuagcaauguaaguuaagauaguaacucauauucagaauggagacaccgaaccaaugucccccuucagcauagcuuuuaaaucaucaaagaucaaaucacauuuaguauguuuuuuaauuaagugaauuauuugagugugugcucgaauucuuuggagacuuuuguggcaucuuuauagcucugugaacuagaaagcucgucguaccguugcggcacauaacugaaagaaucacaucagugggaauuuagcugcuugaugacauucauuuuauuuucuuaauuacccuguuucccgaggaaacaguuucaaggaaaaaagcaugaauucgaaaaugcauucggaucaguugcuguaucugcuuuguucuagaucaccagcaagagcaaggaguccauaugggaguucaucaagagccugcuggaugccuggucgggauggguggugaugcugcucaucggccugcuggcggguacguggaugggcaugcggcacucccgugggaagcugcagaggccgaaaccucaaaacacgaacccucugggagauuuggaauauagcgcgugucgcuugucgcuuuuaccccugugggagggauuuauuacuugaaauaucuaagggcaaaaugcauggcuguauauuuaaccuaaaauccaucaucaauaaggcaugcccaaggcaugagcucaggcacaggcuucugaagagcugugacgauagagcugguagccuuuccacacagagcagaguuuucuuacuauaccggauuugacugaaaacacacauuuuuuuuggaaacggucuuguuccauugcccaggcuggagggcaguggaaugaugccaguucacugcagccuccaccucccgggguugaacaauccucccaccucagccuccugaguagccaggaccacaggcaugcgccaccaugcucagcuaauuuuuguuauuuuuucauagagauggggucucacuguguugcucaggcuggucucaaacuccugggcucaagccauccuccugccucagccaaaguguugggauuacaggugugagccacugagcccagccaagcacacauuuuauauucgguuauucuugauuauguagaugacaacaaaaucagggacuguuuuaucuucaauaacaaaaugucauaugagauugccuuuugcuacuacugguaggcucugggaugaacuggaaacauccugcaacagucagcaccaugcuagacacccacgggagcugaggcaggcccaggggccuccaucauccugacccucaggaacucugcaucuuuccuuuuuagaaucccaacaccguguuugcgagcaguagauguuuccagaguaaauggaugcuaucuggaggggaaacacgucuuuuuaauaucaaacgcaccagcccuuccgggaaauaguuuccugaaacuuauguccuuuuaggagauugugaagguuaaugucuaagaauaaaaaauuuggcaugacgaagagguuuccuuaauaaaaauccccugcauauaacaacauaauaguuaugguuagagaacagaucagggaauugacuagaacacaggcagaauauauguaguaaguggucuaagaaggacagaacacaaauggggcacagauagaguuuugugauuccaggggcuuucaguuuccaggugaucuugauuuauucccuagcucaucggaggaggggcuugguugccagggaagggcucuaccucccucaccugccucagcauuccguaaagagcuaagaggaaugcucagagggggaguucuuuccuacuagucacagaugcugucuguccguuucuccaagccuguccuuccuuuaccaguggcauuucccgucauguacuggcagcagccagggcaggaaauuagacuucauugucacaagggauuggacgaccaauuuugcuugacugcuucuauaaaggccuuugaaggugggccaggugggaguuugcuaugaauuuugauguccuuauuuagaguagauugauaaaaccuuauagugugucauuuuucuuggcucguaggaaggagaaauaaauaggguaaaugaagaaacucagaacaggaauagauguucugauaacggcacagcuuagauucauugacugaccuaggagcccaacugggcugacuuuaaucugauuuugaccagcuggcuuuauuauccacuugauuuccaucagcucuuucacgagggggaauuaaaaacaauaugcugcugcccuggcuucacuuaaacaguaucucuggagaggaccucuagcuugaauacagccugccccuccccucugugauuguaaugugcagccaggggugagcaccacuggccaaaggagagcccaugcgcacgucagcaggggaauacaugggagggugagaauggggugaugcugaaaaugaagggacuacaguguucuuuugauuuggaugcacuuugaagggacagccagagagccacgucccacucacuucccccuuccucgcuggacuaacaguggagaggaccuggggucucacugccuggccggcuguccccucaguggcuguugucuucggacuccccucauggguaggcccacagcaucuccg

SEQ ID NO: 15012 - RNA, 9768 nt, Homo sapiens
agggacuuccgguaucacuucaguggcggucauuuuugcagcgcuugggugcauccagaccgucagagcuuugggagcgcuuuguuuggcgacagucggaaggcgcgaggggagggguccucccgcugaacaguggggguucuaagggucggcggcggcgggguugacggcuuugccuaggucccuccgcccguagcugucgggucccggccccgcucugcccacagacuccgauggcugcggccgcgcugagggccccgacucaggugagcgcugccucuacugggccucacccuccauccccaaauuagugccuucuugggucacuacggucgagauccucauguccaguacagugggggcucguggguggggucccuauuuccagaacuugggugauggggcacggaagaggguuacaggcaaagggaccagcguuucuaaacucuuggagacacagugaagaagguucauaccuggagugccaaggugaggaguuuucccucaauucuuaggaugcuaggagccguggaggguuguguacagaagcggcauauggucugaguuaggucuuucgaaguuuuccaaaaaccucauggaguuagacuagaauagaauggaauaacacagaggcacagggagguugaguucuugugcaaggucccacaguugcuaagaguuggcacugaggacuggaacgcugaggcucagaaauaaugcaggcauccucaguccaccuggcucuggccuggacaggaauccagggaagccugaauccguagagcccuguauggucaccugccuuucaugaucuuuggcuuuccacagguuacugugucuccagaaacacauauggaccucacaaaggugaguggagggugucccaggcccucacugguccuggccccauccugggguuuuuucauggaucuuuuugccaccauccaguucuuugaccuaaggacucuucacaaacuggaagcuugacauccugauucuagacuggugguuauuuguagacguucuuauugcuggcagacaauggaaugaggugugaaagguugccccgccuacguacaauaauguguaagguuggcagugaagcugagcugauucagggaaacacaacucuccuuucuuucucaugggaacucagagcagcagggcaggacucaggccuggaauggcucugagaaauuggguguuuuuucuggaggugaugagaacaaugggagguuuagagaagagaacggagguuaucugacacuggucucaucagguucacuguuaaugcagcauagagaauacucugugggugugauggaggcgauagaaagaccagggaggaggcuacugcaguggccaaggugaguuuugauaguggcuucaccagugugguggcugugaagguagaagaaguggcuggauucugggucagaauuuuaauuaggccugcuugcauuuucagauuuugaggguaagagauacuggucaagcauuacuccaggcauuuugaauuuagcaucuggaaggauggaaucuccaucaaauagcauguuauaggauugauuuuauuuuuauuuuauuuauuuauuugucuauuuuuagacagucucacucugucacucaggcuggagugcaguggcucgaucuuggcucuuugcaaccuccaccucccggguucaagcaauccuccugccucagccuccugaguaguugggacuacaggcacaugcuaccgugcuaccaugcccagcgaauuuuuuuuuuuuuuuuuuuuuguaucuuuaguagagacaggguuucaccauguuggccaggcuggucucaaacuccugaccucaggugauccaccugucuuggccucccaaagugcugggauuacaggcgugagccaccaugcccagccaauuaauuuucauuaaggauaacaggaguuuugucuuuagcuauuaucauagucugagauauuccaaagaaugauauauggagacaucaggugaguagcuguccauguacaucuagaauucuggaagugguuuaagauggagaaauccaaaaggugguggccaguguuuggcccagaguagcuaugggucacaauuaggaguggguaauccuggucuugaagauaaugcuauuuauaaugcaggaaagggcugggugugguggcucacaccuguaaucccagcacuuugggcggccgaggcaggcggaucacuugaggucaggaguucuagaccagcuuggccaacauggugaaacuccgucuccacuaaaaauacaaaaauuagccaggcgugguggcaggcaccuguaaucccagcuacuagggaggcugaggcaggagaauugcuugagcccaggaggcggagguugcagugagccaagaucacgccacugcacuccagccugggugacagagugagacuccaucucaaaaacaaaacaaaaaaacagaaaagggaagguuggggcuaugacugugucucaugcuuggacacgugguagagguggugagcaucacaaacaguugugagagaaaaguggucaugggaagauuguaggaaagaggaugaucugguguaucaguccauuuucacacugcugauaaagacagcaagucucuaggaaguuccagacuuucccauauuuuccugucuucuucugagcccuccaaacuguuccaaccucugccuguuccccaauuccaaaauugcuuccacauuuucaguuaucuuuacagcacagccccacuuuacucauacugauuuacuguauuaguccauuuucaugcugcugauaaagaugugcuggagacuagauaauuuguaaggaaaaagagguuuaauggacucaugauuccgcguggcuggggaggccucacaaucaugguggagggugaaaggcaugucuugcauggcagcagacaagagagaacuuguucaggggaacuccccccuuauaaaaccaucaaaucuugugagacuuauuuacuaucaugagaacagcaugggaaaggccugccccuaugguucgauuaccucucaccaggucccucccaugacaugggaauugugggaacuacaauucaagaagagauuuggguggggacgcagccaaaucauaucaucugauaaguggucaaggcuuccaaggcauuagggacauaagacagacauggagauaaagaaauaauugguagaagaugacacugaggccagguacaguggacuguguccccgcaaaauucauaugcuuaaagccuaauuccagugugaugguauuuggagguugggccuuugggagauaauuaggucaugaggguggagcccuaaugaaugggauuagugagugcucuuaaacaaagaggccagagagcuacuaucuagugcucuuuccaacaagugaggauacaagaagucagcagucugcaaccuggaaagagucccuaccagaaccugaccaugcuggcacucugaucucaggcuuccugccugcagaucugugagaaauaaauuucuguuguugauaagccacccaguuugugguauuaugcuagcaggccaaacugacuaaaacacuaggacuagugcuuauucaccaugguaaaaacucgccaggaauuuguugugacccuuggugagucuggggagggugugagucaagcaguugaauaaguuuaggaguacaaguguucaucuguaugagucauuagguuggagguagagagccacugagagucugugccacugaggccacugauuuugaaugaggguuaagaggugagaagaagguuguugauugaagaggggacaucaagugcagcacaaguggaggacggccaucggugucugacaucaggugauucuugguggcugagguugaagcaaggaacagagucaggaagauagcccuucagagcagggugggggcugucuaugacaguaggaaccaucagaggucuguguagcacuggaugaugucucaauuuggcaggcagagggguggagguagccgugggagugagacugagcgaguaugguucaaagaaugauguguacauggagagggagugugaacugaaggacccaggccccuggcauugaggacuuaagggucaaaggugaagccacauuugauugugucuaggaggcacuaucugaaagacccuuggggaacugccugacaagaagggauacacuccuacauaccgggcccaaaguuuagauguggugcauccugcccaccuccugguuggugcuguagaaggauacagugaucauugggaccaugaaaagagagugggcaucugugucaccagggccuguauuuccuuaagguggggaugauugcguggguggaugaacuuguggaggcguugauuguggagugaccuguccccaucaugacagggcugugugaccuuugaggacaucgccauuuacuucucacaggacgaguggggacuucuugaugaggcucagagacuccuguaccuugaagugaugcuggagaacuuugcccuuguagccucacuggguaaggcccuaauaccaacuccaguguccuggucugucuauggucuuuugcugacuucuccacuuucuugggauaugugcuaugggauccagcacugugcacugccugaguagcccuaacaccugcugcccaguggucugggaacaccugcugcccaguggucugggaacaccugccacugggcagcagguguucuucagucagccaaauggaucucuguuccuugcucucuucuuggcugggugucuguguucagauccaugacaccuugugucccaaguucccugcacccccaucugcuagcugacauuuucuuguggcuaccugugucaugauuguagucauugucauugucuauacuuauggggacaaugggcucuucuuacucacuccuucuaguuuguuuguuuguuuguuuguuuaaugauauuaacuuucuugcccaugggcuguugugugcugagucguucugcaucagugcugaucacucacauguucugucuuucugguaggacuuggcuucaugaaggucccacauagcuagacaacugagggugugcagagaaaccugguugcuuuauagggugaacauggucucagagaaggccugggcuuguugaguggcaacugguugggggcaugauauccgggcuguuuuccgaucacauaaggagccuguccugucuucaccacuguuugggugcacaugccacuggccaaaucucauuucuauauuuucuucucaguacuugacacuucucucucuuauuauuuuuaucuaugacuucuagcaccuggcuaccuccaccuuucugaucuucaugcaucaucugcuucucugcacugcucccucugcaauguuuuccaacauugacacacacauaaugucucaugaaguauguauauaugaccacaugaagauaugugaucauaucacuugcuacucaguuucaauuguauuuuccugggcuugggcacagucaaccuucugcacagcaugcaggugucaccagcagacaagguccuccugaagacuauguggugaguuuuaggaauuggaaggcuacucaaggauaauuuuugaggcuguugguagaggaaugguuugaaggcaaugccauucccuguccuucaucccauccuuguguccuuuauuuggugaggccucccucauucugugaucuuuagagauccaguauugcaaagcaaccccuuccucaacuugcccccagcuccauuauccucaaaacaaaccuggugaaucauucguuugguauguguguaauggggcuucuugcucucagcauagucaauguauauuucaucagcgguucucugcuuucagguuguggccauggaacagaggaugaagagacaccuucugaccagaauguuucuguaggagugucacagucaaaggcagguucauccacacagaagacucaauccugugagaugugugucccaguccugaaagauauuuugcaucuagcugaucucccugggcagaaaccauacuugguuggagaauguacaaaccaucaccagcaccagaagcaucacagugcaaagaaauccuugaagagggacauggacagagccucauaugugaagugcugccuauucuguaugucauugaagcccuuucgcaaaugggagguuggaaaggaccuuccagccauguugcggcuucugaggucccuggucuuuccuggaggcaagaaacccggcacaauuacugaauguggggaggacauucgcagucaaaaaagucauuacaagucaggugaaugugggaaggcuuccaggcacaaacacacuccuguuuaccauccaagagucuacacuggaaaaaagcuuuaugaguguagcaaaugugggaaagccuuccguggcaaguacucacuuguucagcaccagagaguccauacuggagaaaggccuugggagugcaaugaauguggaaaauucuuuagccaaaccucccaccugaaugaucaucggagaauccacaccggagaaaggccuuaugagugcagcgaauguggaaaauuauuuagacaaaacuccagccuuguugaccaccagaaaauacacacuggagcaaggccuuaugaguguagccagugugggaaauccuuuagccaaaaagccacccuuguuaaacaccaaagaguucacacuggagaaaggccuuauaaguguggugaaugugggaauuccuuuagucaaagugccauucuuaaucaacaccgaagaauucacacuggagcaaagccuuaugaguguggccagugugggaaauccuuuagucaaaaagcuacccucauuaaacaccagagaguucacacuggagaaaggccuuauaaguguggugacugugggaaauccuuuagucaaagcuccauccuuauucaacaccggagaauucauacuggagcaaggccuuaugaguguggccaguguggaaaguccuuuagccaaaagucuggucucauucaacaccaagugguucacacuggagaaaggccuuaugagugcaacaaaugugggaauuccuuuagccaaugcuccagccucauacaucaccaaaaaugucauaacacauagaggccucaugaaugcagcaaauguggaagcgccuucaacucaagaucuaucaucauuuagcuccugaaaguccacacuuaaguagagccuuagaccuacagggaaagugcugucucuguaguauuguagcaguagagagccuuugugagggagccaucugccugaaguugaaccucauucuuccuuguuucucugguagaaaccaucuacccucuaccaccuugcacagugggcacuggucacuccuaugugcuaagacaaggcagacaucuguguguucucuuaagucuuuggaggaaaucuugagcagucuaagccuuuagagaaaauucauucuuuuuucugacugaucacagcauacgugugacccaguuugggucaggagggcccagccuugguucugcuggacacuuaugugcaaggauucccuucauguaaauucuuggucucacaugacacuuggucauucuuccagccuccaugucaccacguggugaauggcugccucacauugcuccaguuugugcacuaauaaaagccuuauauuugaaucuaccuguagucuugggguucuguuuacugugugggguggcugggagacagacuucaacucuauaugaaggaauggauggcuuuugugggccucugcaggaaaguaagaugacagaguaauucuaauucugguuuuggucauacuugcuuugcuaccuaaaaucuccuaggaaaaaaugcaagguuuugguuauucuaauuuguggccuggaucccuauucuuucugugagacuagaggucauccugaggagaggccagcuguuaugacaagcaugugugcuucagggaauaggacaauuuuauuccauuguuuccagaggaugucauaugaugcccagugcugcugagaagcuuuucaugggguucuauaaggaggcaugcccugauaucaaacauuccauaggccgaugucacgcagaagacaacgcgagucacaugugaacuguaauugguacagaaauaccuggguauuucuguacuguguguacuguagcaaacuaguuggaaugugccucuuauaaaaguacauuuacaaaucuucccgugacuguggcuuugagcagucauaggaccuagaaaucuguguauguccaauagcugagguuauuuucagcaaaaauaauuaaaggguuuuauuuuuuaauucuuguugguuuucuagguuguucaccucaagugcauugcuguagaggcagaaaaaggaggauaaagauaacagaaguccuauaggccagggauguauugauagcucuugugauuuccaccaguguugcuguugucucaaauugccacagccuucauugcuugccaacauuuccugcauggagggacucaugguugcccuuccccaggccugaagagagagugcagucaacaugagauugcuaggcauucugguuucugaaaguugggugaucagauacuuuauugugaaacauguuuuacaaacuuucuugauguguaagugacaugccauaguuuacauccauuuaugguguauaauuugaagaguuugucauacaagccugugaaaccauaaucaugaucaugaacauauucaugauucaccucuugcuguuuuacaaucucugcguguacuuuccaggccuucaggaguccugucauuuacuuucccuacaggagaauaguuuguguuuucuaggauuuuaugugaauugaaacguaaaauacuuacuccauuuuuccugaugaugcacaauuuuuuuuuuuuuuuugagauggagucucagucugucaccaggcuggagugcaguggcaugaucuuggcucacuccaaccuccuccuggguuccagcgauucuccugccucagccuccugagaagcuaggacuacaggcaugcacuaccacgcccaacuaauuuuuguauuuuuaguagagaugugguuuuaccauguuugccaggauggucuugaucucuugaccucgugauccgcccgccucagccucccgaagugcugggauuacaggcguaagccaccacaccagcugaugcacaauuacuuuuaagauuuaucaauauugcuuaugugaauaguucauuuguauugcugagaaauagucuguggauaugucacaauuuggauaaacaguuggaugcuuuccaguuuugggcuguugcaaauaaugcuacuaugaacauaggcauauaacucuuaauaugcagaaaugcuuuauuucuccugugucaguaguacaguguacgugaaugcgucacuuuuaaagacaaggccagacuauaaccuaacuguaccauuugcauucucaucaacaguaugugaaccuucuuauuucucuacauucuugccauacuugguaugguuagucuuuuuaauuuuaguuguuuuaauagcuguauaauagcaucugucugugauuuuauugcauuuuucugguauuuuaugguauugaacauuugaacaucuuguaucuaguugccaccuguauauccucuuuggaagaauguuuauuaaugucuuuugcuuauuuuuaaauggauguuggugauacuuuuucauuaauaaauagacguauaacaaagac

SEQ ID NO: 15013 - RNA, 2115 nt, Homo sapiens
gccccagucacugagccgccgccgaggauucagcagccucccccuugagcccccucgcuucccgacguuccguuccccccugcccgccuucucccgccaccgccgccgccgccuuccgcaggccguuuccaccgaggaaaaggaaucguaucguauguccgcuauccagaaccuccacucuuucgguaagcuaugggaaaggucgcgggcccggguggggcagcggggccuuccgggcccggagacguguuccgggaaguugccaagcgcuccgggccuucguaagcucgggcaggggaaacuugaccagggucgcagggcagcgggaucaaggccugggccccggggucggacccugagcgcgaccggaaggagcaggcgguaggucagcccuugggcgggcccggcgucucaguggcgcauuuacuaauggcuccugggccuccucgggccacacccgccccucccgucaccauugcgucacguccguuacgucaccacccguugucacggauccggagggaaaggcggugccagcccuaaguggcaagcgggugcaccaaugggggugggaggcuuagccccgccucgggagcucggguuccggcggguugcaucagcuggguggggcaccgccuggcagcccggacucccccgacaugugaucggcuucccagggagggcgggaggcccgggcguuccccgagccuggggaagcuggccgucccggacugaccugcucggggagagccagcaaaggacacauucggccuggcccaagcccugacgauuucaguguuguuuucugcacgcgcaaaacaccuggggaccgaggggauggcaguggcauccuaucuuugacagcucugaacgagcuuaaccuuuuuuuucagaccccuuugcugaugcaaguaagggugaugaccugcuuccugcuggcacugaggauuauauccauauaagaauucaacagagaaacggcaggaagacccuuacuacuguccaagggaucgcugaugauuacgauaaaaagaaacuagugaaggcguuuaagaaaguaggucuucagugagauuuugggaaagucauaauggauuuguccacaagggggugccagcuguguuguauguauuguuagcggaaggggugauaaaugcguucaugcucuugcuaggccuaauucguuuuccuuugugcuugcagaaguuugccugcaaugguacuguaauugagcauccggaauauggagaaguaauucagcuacagggugaccaacgcaagaacauaugccaguuccucguagaggugaguucagucacuacuugauuugugccucucugcuggcaaaucucagauccugucuguuagcuucugcuggggacauaaaaguuggcuuuguaaggcugagcaaaaccucaguuggguuuuaaaguacauagacuuauuucuguuuuauaggaaaaagcagaagggacuugucuaccuuugguuuacuguuucuguggaucuacuucacagaugcaaauuugaauagcauauagaugcauuguaaaauaagccaaaugcuggguuguuccuguauuuguaaggacaugaguuuuuaaaaaugaauuuccugaguauuaauacuaaaauacuguuacaugaucagcucuugauauaauugaagagauuucagauaccugaugagucucauucucacacuaauucagaaccuuggaaggcacugaguguucaaaaaagguagcucuuaacugaggacccucuguugaaccauugugcgcaccccuggcucuugggcaguguaguagcaggaagacaggguuguugccauuagaaauggaggcuuuaacucucccugucccccauuuaaaacuuugcccuuuugucuuuucagauuggacuggcuaaggacgaucagcugaagguucauggguuuuaagugcuuguggcucacugaagcuuaagugaggauuuccuugcaaugaguagaauuucccuucucucccuugucacagguuuaaaaaccucacagcuuguauaauguaaccauuugggguccgcuuuuaacuuggacuaguguaacuccuucaugcaauaaacugaaaagagcca

SEQ ID NO: 15014 - RNA, 1035 nt, Homo sapiens
cuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuc

SEQ ID NO: 15015 - RNA, 496 nt, Homo sapiens
aggagagaggacccaggaaggggugggcagggaaugggguccaguagcaggagagaggacccaggcagggggggugggcagggaaugggguccaguaggguuccugucccacugaggcagaggguucugcuuuguucacagcccauggaggugcaggaaggcuauggcuuugggucaggugagugggucugccuaguggguggggaagggccccagugcuguuucuaccccaaccugccagucuucuuucuccauuuucuaaggagaugaucccuacucaagugcagagccccaugugucaggugugaaacgguaaguauggcaccuccccugggggugagguggauggaggguggggguguacucaugccagguugcugcaucuacaggucccgcucaggugagggcgaggugagcggccuuaugcgcaaggugccacgagugagccuugaacgccuggaccuggaccucacagcugacagccagccacccgucu

SEQ ID NO: 15016 - RNA, 496 nt, Homo sapiens
agacggguggcuggcugucagcugugagguccagguccaggcguucaaggcucacucguggcaccuugcgcauaaggccgcucaccucgcccucaccugagcgggaccuguagaugcagcaaccuggcaugaguacacccccacccuccauccaccucacccccaggggaggugccauacuuaccguuucacaccugacacauggggcucugcacuugaguagggaucaucuccuuagaaaauggagaaagaagacuggcagguugggguagaaacagcacuggggcccuuccccacccacuaggcagacccacucaccugacccaaagccauagccuuccugcaccuccaugggcugugaacaaagcagaacccucugccucagugggacaggaacccuacuggaccccauucccugcccacccccccugccuggguccucucuccugcuacuggaccccauucccugcccaccccuuccuggguccucucuccu

SEQ ID NO: 15017 - RNA, 7415 nt, Homo sapiens
uggagacuagugucaaaucucuuuuauuacagagggguugugguaaaagauccugggcauccacugguuaucucggaguggcaggggcacucagucccuccgcagguucuuaagccguuccuccaggucugcaucagcaucagcuagggcugaggcugcggccucugcuuuuuucccaccagcagccacacuaagcgagcccccaguugaggggaggucugcagagaaaguggggguuugagcagguggggucaggcagcggaggggaguaaugcagggaaagggagggcuuggagcuguggcugggccuugggugggaaaugggguccaggauuuggagcacucacucgacagcucaucuguuaggcuaagucccagcucauccagaaccugggacaccacagcaucacuagggaagagagagaacucagugagggcuaugcacuccgugagggccaggcaaacaucuccacccucccauccaguuuccccauaccucuccucuucaucuuccucaucacccauggcaucaucaauggcaucauucaucaucuccuccuucauauccaugaucucugccugccgcucaaacuccaucaugaucuucuggaucuggggcaacuucagcuggaagugacaggagugugagugugauccccaugggucgugggagugggaagggggauugggaaaagcgcaccugucuguucauggugcccauggccuuggugacacccuucauggcuugugccaucgaguuguuggacuugagugucuggaucuugagggacacagccuggauguuggcccgcaucaauacaaacuugcgcacauagcgccgggugcgcaccaagucuuuugccaugaugcgaacagcauccugcagaguagacaaggguaucaaggacacaggaaugagauuauccuacacuucuugacaccccauuaguugguugucccuccccaccagcccaauuugcaauuccacuugaaguuuccagagacucuggcuaacccaauggucacuggucccucccuccuucugaccuaacccuccucugccucuugggccaccaacucccugggcuccuuuguaagguccuccucacuucucuugaucuguaaaugguaaaagaaaggccccaggcucacuccugaggguuccuuuucccuccauguuuucagucauucuuuugacuuacaacagccauuccucaauuuuuauucccagccuagacaaagaaucugucucuuccuucaccugauacaaacccauaccucgaacuauccagaaucacauacagaccuaucugaggcucagcuuuugauuuccucuccaaacaucuuucuugcccaucccaagaaaugguaucuucucugccuaccuguucaggccaaaacccucucacccaucaaaggcuguguuccuucuucaugcucucccuacugguuccggcugucucuuaccagccucuuggccauagcuuauagcuuacccuuaccuuuuuuuuuuuuuugaguuggagucuugcuuuguugccuaggcuggagugcaguggcacaaucuuggcucacugcaaacugugccucccggccucaagcgauucuucugccucagccucucgaauagcugggauaacaaguaugcaccaccaugcccggcuaauuuuugguagagugggguuuugccauguuggccaggcuggucucgaaauccugaccucaggugauccacccaccucagccucccaaagugcugggauuacaggcuugagccaucaugccgggccagcuuauccuuauaguuaacugguuuuuuuuuuuuuuuuugagacagagucucgcucugucacccaggcuggagugcaguggcaugaucuuggcucacuguaaccuccgccuccuggguucaagagauuguccugccucagcccugcugaguagcugggauuacaggcgugcgccaccaugccuggcuaguuuuuuuuauuuucaguagagacgggguuacucuguguuggucaggcuggucucgaaguccugaccucaggugauccaaccaccucugccucccaaagugcugggauuacaggucucugagcuacugcgcccggcccuguaaucccuaaccuuccaacuuagcucccacuuuggcccagaguucugaauugucugguccaugcccaacucuugaagcucaccugucaucucccauuuuuuugaggcucuuuuuuaacauuugcugcucugucugcuuaacacauucccugcccagaucuguaggcucacucucaucacucaagccuuggaucucauaccaguuccuuggaggcagccuuccagacccucaaacuagggaagcccugcugaccuuucacuccacucguuuugcugaaagcaccuguguuuggugucuggucucucuuguucacugcuguuagagccgugccugauugacagcaaccugcccgaccacccacacucaccaucuggccuugcuuggccaucuucuuaaugucugcaaugauuuucuucuccugggucucuaguuucugucgcucgcgguccagcucccgcauggcacgguucagggcccucugguucugccgcaguagcuccucuggcgucuuccggcgcccgaacaauagguccaugaugguagaagcucacuggcaggccugagacagaugugagugaggcccaguuguagggcauggggcccaggagggcaagaagcagaacagggucacgggagccuugccaaaugggaaggggcuaacggagacuggaggcaggaaugaggagccaaaagggagcagcugagaacacugggauugucccggggacacauaaagggggacagguagaccugaaaauuauccaagugcuggcccgagccccuccuucaucgccaugccccaaaagaaguuauggcuugcaaguucagcuucccucuccagaacuaugggugaggcccuggaguccuugauacgacugagagcgggggaugacgcgggccggugcacugguguuuuggagacugugggcaccgaggacagagcaauuguggggguucugauagaggaggacaggaugggcggaaacgcuaaguaccaagaacaggugaauguggggcugugaagcucaggacaaggcauuaggauuuggggacccugaaugcugagggagacgguugggggcgcuggggcauccuguacacugaggacgggaugauggagauucggucgcacuauacaccgaggacagucagugggcccggcaccaaagcaaggugguguuggagaccucgauguugacgacagggucccagggagaagcgaggcaccggacacccgggcgaguagaaggccucguacgcugccgcccgcacgcccgcccgggauccacgguccagcaggggccacucaccggagcugggacggacacccguuuccgcuuccgggucacgcuucucuuucugggauccccgacuugcccaccaacuaaggccccucgguccugucgccgccgccgccguuuccggauuaaacgacgugacguaacaugccccgcccgcacccggaagguugggaaacuccaggagcgcgcgugcgcccgugccccggaacgggccagcguccgagcgcaugcgcaacagcucccguuuccucugcgcguccgaguguuucauguuuugagucccgcccgagugacccaagccaguaccggggugggcgcuuuccacccaaccuccacuugaggacccagcuuauucgugagaccuugacuucugccugaggccucagauagaaggagccucagaaggcuccuccuccucggugggcccacccacacaagaaaggggcaaagcuagagauggcuuguuucuuccacuuugcuggccucuuggccaggaagccacaggucacuggauccugccuacgcuucucauccuagaguaggcuucaucccaaccaaccccaggcacagucaugguauccccaccaacuuuagagcugccccaggcacugggcagccuguuguagggugcuccaaugccaccugugaccacaccuuccaccaccccagcuuugcaggcccuaauggaccucagcugccccucccaccccauagaaguaagaagcagaggccaugcaguaacauuccccuuuaauagccuggugggaccuccagagguggagggguggguugccugggcccagcuacccaggcccguugcccacccacuccacagcccagagugggggcugaacaagcacccagcaggggggcuagacaagccaauucauuucccaucgcugagugggucgggggaggcagcgccgaccuuaaucacaugguguuaaaaaaaaaaaaauaacuaggggcacguggcaggaaggggaggcaaggccaaggcaggggauucccccaccggccgccccccaaaccccuacccauggcccccaauaaauauuugcaggggaugccagggcuuguggccguggcggggguggguaugcgccaacccuauuucaggcagcgcucaaaguagguggagccgauguagccaccccgcauggagcgcugcacguucugcucaaacagccgccgguuguucugcaggaccucugcggccuccuuguucaguggguccucgggguugggcuccuguggccaguacagguagggggggucaacaggccagagggacagaaggccaaucuccccagacccaaccaccuauuccuacucaccaagaagagauacugcaggccauaaauuauggaguuuaucguaaggacuggcuuccaguccucucuguggacagagagcaucagggucagggcuuggugagugggagacugccacaggccccucugguguugggcaggucagauccagggcauaggagagugagcaugugagaggcugggagggaggguguggagcaggacaggccaaggagaaaaccaaggucaggccaugaggaagaugacugggaaaucaagaaaccacagacaacaaaggggugggaagggacagagucugauguagugcccacaagaccaugagggaggccuggcaggcagcgcugaggagggcauuagagggccaguguccucaccugaggauguugaggcagacguugcccucgaggucaauguuggggugauagaccauugucucacacuucaccuuggggggaucaugcggguaacccuggcccaccuggcuccaggaaaagaaaagagagauggguaggugccuggaagggccucagcugcugccuccucuguccagggagccaucccugcccgccugggacucaccuuaaaacugaacacaaacuucccacucuuguagaagcccugggaggaaaagggggagaagaaaauuuuaggguuccauccuguggggcccgaugggcagaacaugucucccuccucucaguggggacacccuugguuugcuccugggaauucagccauaugcacccucaccucaucaggacagaugaccagcuugaaguugaggaggucgucuggaucugagaagcugauaucacacgucuugggcagguucagcucguuuaugucuggguuuggguagcagagagucgggaacagaaagagggaggggaagagagagagagagggagccagcaggacacuuagggcggguguuuguuagcagagcccccaucgucuccuccuggacccccaggcgccucuccugggcugugcuccacaccuccagcccucucccugcuccccagcuuggcucuuguggauacacagcauaccccaaacaugcauguucagcuguguaugcgugucccaacuccuggcccagggugacccccaacuuuucuguauccacagcucccaaaugcccccacucccaaacauccucugaccgcccuaaaccccaggcuccccauccaugaccuccacucuacaguaucuaccuguucacccaaacucaaagauccugcccacccccaccaacccucaguccucacuguccuuccucuucucugucucucagacccagcuuuccaugugacccccacacucucaaguccccaacccccgccacccuaccccacccccucugacucugagguucacagcacaauagccuaaauuuccccucaccccugucuccaaucccugguacucauuaaccuucccuccuccaccugucaccccaaaccccaaauugcugugacucaggcaggcccaugagucccugguccuccaaccuacuucacccguuugacucagagauucccagagaccccagcauaauaaacuaaauccucuuccacucauauccccaaccccuggccucuacuaucccucucuucuccgccugucaccccaaacccaaguucccgucuaacccccagacucucgagucgucaguuccuccacuccacugccugacucugagauuccgagucccuaguagcagacaccaggccuuccuaauauccuaaaccaccacauaccgggccccuaucucugacccccuccccgugacugcaugaucccaacccucaagacuugaccuccgaccccccccacgcucggggcccuucaccucugacccucagcaaccgcauuaccccuuccugacucccacaucacccugccucaggcccugaccuccgaccuccggcuccaaccccauccccugacccccuacccuucuggauccgcagcugcgccgccgacgccuucuugcugcugcccuuggugccgcccgccgacuccuccuccuucuucugcugcuucagcgagaacagcuugaucauccugccgccgccgccgccgcugccgccgccgcggggcccgggaccccggccacccggccccccgccgccgcccgcgucgccuccgcuccucggacccgcagcugcggccuccuccgcugcugccgccacccgcccggccugccgcgccgcuccgcuccucuccgcgcccaccgcgcggcccgccucggcucccguaguccggcuccggccuggcccagcgccucggacucgcucggcagcgcucggccaaauucggcuguucucgggcccgcccggccccgcccccacugcccggggccgcuccuuccuugcccucgccaacucuggucucaggccccgcugcagcugcggacucggggcucccccgaccgugccguuuggccgcucagcugaucccuccgcgagggggugcggcuaggggugggaggaggacacggcagcugcggugacggcgggcggguacuggaggaucgucuuccgcggcagcagcggcuuuagcgcggaggucggcaacggccucgggcgccccgccgcuucggauauuuccgccgccugcccgcuuuggcucuucccgcccggccugcguugugcg

SEQ ID NO: 15018 - RNA, 11777 nt, Homo sapiens
agacgcgguggggcaccgacggaguucuaaugacggccgugauuggugcaggauccugcuaaucucaggaaggcccguagagaagugaggaaaacgugguggggggcaugcgcgaucugguaggcggugcugccgucuguuguaccugagaggcuugcgcaugccgacgcacggauucgaggcggggagcaugggaagaagcggccaggaguaugaccugaucauugcgaccaccgcuaggggaagggaggagaggguguagaaacggggacgagggugggggaagggcaaggaggcgcucgagcuggugcgcggagcauccugggagacguaguccagcgggagggggaagucgaagacugcgcgugcucaggagcgcggagcggcccgcugagcgcagaggugagggcgggguccucuuaaccgggagggcuaucguguggacgggggcgguggcugcagacucggggauuccggcuccccagugagaccggaagcgcggggaacgaauccgggcaguccuugcgggagcgcccagggcuagagcgagaggcuugucaaucacuacucguugccacgacgacaggcuuugggagccccgcccccgguugccuaggcgucgucuggaccuaccuuggcacccuggagcggaaguugccgccuggacuucugggaaguguauuucgggacccuccguagguaccugccaucuuggcuaugacccaagucucucccaggguuucagguugacuuggcaccuugaagaguggaggcuuggcccccaggaugaggcggcccucgaaaucgaugccacccacgggggaaugauucugcggugccauccccuucauaaacgcagauuccuuccuaaagccgcagcugcagaaggaacagcgcgaggagggaggucagccccacuugcaaauggggaaacaaguucucgaaggcacagugaucugaagaugggcggaaucagagucucgggacuuccuugcaggcuccuguuccggcagucuuggagccuuugccgcccccccacccauugcgaagcucccccauccccuuccaaccccagcuaaaucaggaagcugagauggggcauugcguagugugauguugggcuuagaagauggggcugaguagggagagagggugcugccugggagcugagccauacaagugacugcacagguugacauggaggauuagguggagugaggcuuccaagcagggaggggaaugaugguggggcccaaaugaggagccacaucgaaguagaugagagaauagaaggugaaguaagggcuggcguuggguagggggagacgccagcagugaugcugaugcccaggcuguagguguauaggugccauccaccugguaaagagagagcuguagcgcaggaaugagguugcacauguagaagaagggaaggauacaggggagagaagugucuucuaguccuaaaaaacagccugugggcuggcaugguggaacaaaccuguaagucccagcacuucgggaggucaagguaagaggaucaucugcuugagcccaggaguucaagaacagccuaggcaacauaguaagaucccaucccuacagaaaaauuaagaaauuagccggaugucguggcacacaccuguugucucagcuacuugggaggccgaucucuggagcccgggaggucaagucugcagugacgcaugaucucgccacugcacuucagccugggcaacugacugacagcaugucucaaagaaaagaaaaaaaagccuguguuuggagcagggagacugucagagacuuugcacaggcccaagcggagagaagaccagggauacagguggcuaagggagggcuuccagcugcauaagucuguggguuguagauggccuuucuuugccuguuuccucaucugccuuccacaugggguaggucugaggaucaaacgguacagcauagacuaggcagugaagcauucacuguacuccuuuugcaacagccucauccuauuucuucaccaggggcagacacuggccucagauaccugaccugguacccucuaugaggccugcggugcugggcuccccagaccgagcacccccagaagaugaggggccugucauggugaagcuagaggacucugaggaggagggugaggcugccuuaugggacccaggcccugaagcugcacgccugcguuuccggugcuuccgcuaugaggaggccacagggccccaagaggcccuggcccagcuccgagagcugugucgccaguggcugcguccagagguacgcuccaaggagcagaugcuggagcuguuggugcuggagcaguuccugggcgcacugcccccugagauccaggcccgugugcaggggcagcggccaggcagccccgaggaggcugcugcccuaguagaugggcugcgccgggagccgggcggaccccggagaugggugagugaguguccacgagugggguucaggacuggagcaucauccagcucggccucacccugggcagcaccacgcuuugccagacacacguucucccuugugguacagaaguggccaccugcaacagagacccugugcaaggcugcccagggcagagggauuccagggccagacuccccagcccauuccugcaucaccugcagucacguggacauaggagcugcaggcuaggggaauauggggaagguacuggaaggccacgaugucagagcaggggagggacugcagguggucccuucauucuuugcucagggccuaggggagguagguccuuggaggaccuagucaguagguauuuacaaggcaggccccugggauccuacagugggaugggcacccacaaaccccagguugcggccagccuuacucucugguaggacuucugauggugggggcaccuccccaggucacaguccaggugcagggccaggagguccuaucagagaagauggagcccuccaguuuccagccccuaccugaaacugagccuccaacuccagagccugggcccaagacaccuccuaggacuaugcaggaaucaccacugggccugcaggugaaagaggagucagagguuacagaggacucaggugagggcaugcacggugggcgcgccuaaggucugguugggugggccagggaaccuggccugagcagucagucugaaguccacugggccagguuuguuauaaauggaaugguuuccaucugccagcagcccccacauucuacccagucaggucuccccuccaccgcagccagugcugucacuaccccucacacaccaagccugacugccacagcccuguacccacgaaccccauggcauggagcaggcuguugggguuucccaguacagauggcaugugguguucaguccccaaggagaugcguuaggcaauaugugcuugucacuggggaacagacagcaggcagagguauaauuaggagcugcugagggaggaccucguaguguuagggguaugaccccuuucaccucccaggcagggcaccugaacuagcugcucacacccugccauuccuauguggacccuuguacaauaccucugacccccgcugaccaccuugccccaugguucacauacggcuacaggggcacaaaccucagcccaucucaucccacugcagcucaaccccuggccuuccaggguacucugcuucacccagccccugagcugggcccucagcuacccugcacugcccuccccaacccaagcccacaaccaagaaucccaccucucugcaucccagcaccuggcacaccacuaagaagggcagugggguggaaacucacucaggcugccugauaccaguuuuccucucuagauuuccuggagucugggccucuagcugccacccaggagucuguacccacccuccugccugaggaggcccagguaaguccugcccagguccauguucuccuccuuucccuggaaguugcuggguggggucagguaggucccucccugagcccagccaggcacagaggagcagugaccacugugauuucagagaugugggaccgugcuggaccagaucuuuccccacagcaagacugggccugagggucccucauggagggagcaccccagggcccuguggcaugaggaagcugggggcaucuucuccccagguaagugagaugggguguggugggacuaggccuuccgcauggacagcaccaucucugccgaccccacuccuggcccuacgcaggcagcccucuuacuccagcauccccaaguucccccauucccuagaucauccccuauaagguucaaccuccucuagcaucuucugcccucaaaaaaagccacccaccacuaccacugaucccacagccccucuacuuucuagaaacuccccacccuaguaaaaccuuuugcaagcagggcgaguauuccccguacccacauucucucccaguccugguauccuggauggccuccugggcuugcauccugcuggucaggcaucaggacagguagggcugggaccugacaaggacagcagguuaguagacagagcaggugggcaggagggaccuugacacaggauagggauccugcccaaucaucgaagcauuacggaccagaggcccccugccaucuaccucucagccaccaccuuugucuggcaucauccaggcuccuccuacaacccaucuucuguuauguuccuuccuguuccugagacccagggucuccucuuucuuaguucacaccuuuguuuugguggagcuuuguggguguucugguguggaagauaaaauucugacaugucccauaucugaaacacauugucuagcccucaacauuagauugaaguuuggcuggaagaauucuuuuuauuaguacagucacagaccuuuuuuuaucacuauuguuggugagcuuuuucaguuugaaauucacaucucucaguucugggaaacugccuugaaauuuuuuuuuauuuccuucccuucuauugcucugcucccuguuucugggaugccucuuacuuggcuauuggcaucugggauggguccuuuaauguucuuaucuuuucacuccaauuuuccauuccuuugucuuucuacucuauuuuccuggaaauuuucucacuuguaucuuucagaccuucuguuaagauuuucauuucugguagcuuuuuuuuugguggggggagggggucucacuauuucacacagacuagagcacaguggugccaucauagcuuacuguaaccuugaacuccugggcucaagugauccucucgccucagccucccaaguaucugggacugcaggcaugugucacuguaccugacucauuuuuaauuuuuuuauuuuuuuguagaaacagguucucacuauguugccagggcuggucuuaaauuccuggcuucaagugaugcucccaccucagccucccagagugcugggauuacaggcaugagcuacuucaucuggucucuuguagcauauuuuuacuuuccaagaguguuuuuauucucugaauguucaucuuuuuagcugucuccuguuguucuuucauuuacaaugucuuuccuuauuucucugagaacagcaguaacuuuuuaaaaaaaaacaguguguucucuauucucuccuaguuguuggcuuauaugcaagagaggggcaccacaaaucuggcugacagcucugagcagguagauguggggcuuacuggcuggaagggacauaggggaaccccacuccccaaggagacccuuuucuuaggguaugugagcaagcagcuugaguaugaguggaugcugcaaacagauccauagggcaauguggcuaggccauuuugggggcacucuuccuccaagcauguuucguuccaucgucugaauccugcaagaagguaacuucagccuccugccagcauccuugggaaagagauuaacaucucagcauccaaugggacuguuuaccuaauaacccugacuuucucaguacgguuucucacccuuaacauagccuucugccaggaugggagaagaaauccagaaguaagucauggcagugcauacuguuggcucagaauucugugcagacagagcccacagcagcagcccugcccagcaucugcuucugaaacagccucuccagccuggcuggugcccugcucauucacuugcauggccagaaguaccagguaccuccaacuccugaguuuuuagaaucuucuuagccaggcgcagccgcucaugccuguaaucccagcacuuugggaggcggaggcagguggauuguuugaguccaagaguucgagaccauccugggcaacauggcaaaacccugucucuacuaaaaaauaauacaaaaaacuagcugggcaugguggcacguacuuguagucccagcuacuugggaggcugaggugggagaaucacccaagccagggaagucaaggcugcagugagcugagauggugccagugcacaccagucugggcaaugggggugagacccagucucaaaaaaaaaaaaaagagucuugggaauaaaacugugccuuuucuuugcagccagagagguuuaucuaucuaucuauuuauuuaugaaauggagucuugcuuuauuuauuuaaaggacaggguuuugcuguuuugcccaggcuggucuugaacuccugaccucaagugauccuccugcuucagcuuuccaaguagcugcaauuacaggcucaagucaccacaccuggcucagagaggucuuuuuaugucuucaucaggagacuauucugaauagcuaauacauucauauguuaggaaauucaaaaggcacaagacaguauacaguggaaugccccuucccugccugggccacacagucuuacucuccagcagccaacacugcuuguuucuuaugugucuuuguaaaaagauucuguacauacagaagcaaagacauucccagacacauguucauucccuuuuuuuuuucuuuugagauggaauuucgcucuuguugcccaggcuggagugcaauggcgcgaucucggcucacugcaaccuccaccucccgguucaagccauucuccugccucagccucccaaguagcugagauuacagucaugcuccaccacgcccagcuaauuuuguauuuuuuuaguagagacgggguuuccccauguuggucaggcuggucuggaacucccgaccucaggugauccgcccaccuuugccugccaaagugccgggaucacaggcgugagccaccaugccuggcccauuccucuucuuuuuuuuuuuuugagacggagucucacucugucgcccaggcuggagugcaguggcacaaucucgacucacugcaagcuccgccucccggguucacgacauucuccugccucagccucccgaguagcugggacuacaggcgccggccaccacgccuggcuaaauauuuuguauuuuuaguagagacgggguuucgccguguuagccaggauggucucgaucuccugaccucgugauccacccgccucggccucccaaagugcugggauuacaggcgugagccaccgugcccagccccauuccucuccuuuaaaacacacaugggcccggcgcggcacgucacgccuguaaucccagcacuuugggaggccaaggcgggcggaucacgaggucaggagaucgagaccauccuggcuaacacggcgaaaccccgucucuacuaaaaauacaaaauauuagucaggcgugguggcgggcgccuguagucccaucuacucggguggcugaggcaggagaauggcgugaacccgggaggcggagcuugcagugagcugagauggcgccacuacacuccagccugggcaacagagcgagacuccgucucaagugcgcacacacacacacgggcugggcgugguggcucacaccuguaaucccagcacuuugggaaggcgaggcggguggaucauaugaggucaggagaucgagaccagccuggccaacauggugaaaccaugucucuacuaaaaauacaaaaaauuggcuaggugcgguggcucacgccugcaaucccagcacuuugggaggcugaagugggcagaucaccugaggucgggaguucgagaccagccugaccaacauggagaaacccugucucuacuaaaaauacaaaauuagccgggugugguggugcaugccuguaaucccagcuacucgggagacugaggcagaagaaccgcuugaacccaggagauggagguuugcagugagcagagaacacgccauugcacuccaaccugggcaacaagagcaaaacuacgucucaaaaaaaaaaaaaauacaaacaauuagccaggcaugguggugcacgccuauaaucccagcuacucaggaagaugaagcagcagaaucgcuugaacccgggaggcagagguugcggugagccgagaucacaccacugcacuccagccugggcgacacagcaagacucagucucaaaaaaaaaaaaaaaaaaaaaaaaaaaaaaaaaaaacacacacauggaugcuuauucuccacccuguuccacaucuggcauuuuuugugcaucuuccaacuuaaguacacagcagcaagugcucuacaucuuuggguagcuacacagaaccccacuguggcucacuguggacacaccauugaaaaccuuguauguaggucacuuaguacaaggaggaacacaacuguugaagaaguaccuaaaaauugaauuacuugaacaaagugugggacauuugcuguuuugauggauuuuaccacacugucuucccauuuaugcuuaccagcaauacauaggaacacuugggucccugcagucaggguguggaaauggcagaugaguucagcccuaaggugcauuuuucuuacuaggaggagauggaguguauuuuaugggauauaagcauuagcuacauuuccuguccuguucacauccuuugcccaugugucuaugagguuauugaucuuucuuacugauuuauuguagcucuuuacuuaggagguuaauuagccuuuugccuguggagaguuuuuugguuugccauuuguccuuuuuuaauuuuuuuuguuuuuuggccauuugucuuuugacucugaugugguuuuugcugauuuccuuugauguauucuaguuuaucugacuuuucuuuggcgacuuauggacuuucucucaccacuaaaagcccucacugcucucucagucuucuugauuuaaccuccuccaggcuuccgccuucuccaggcccugauucucaguuggaguugcuggugccuccuccuucacccagcgucugacgcuggagugcucacaguguggcugggacccacuucucuccucuguagauacccaccccuguguugaucacuugcaggcccggguucugugugccauguguaugcccuagagcccuugcucacguuuccccacagccuucaugaagucuguguuccucagaugccccacagacaucacaagcaaggcacauccaaaccccagaccacuauccaggagccugcacccucuuucuguuggcuccaccuccagccuccgagacccacccacuucccugcauuugcugagaccaucauuuuccaccuagacaaugcccccacgcuugcccuacagcccuuccaaaaacgauuuuuuccaaccuaaaucagaccuagaaagcuuuuucacauagcccagucuuccuccuugugcuggguucugucucauuaucaccucaucagggaagucuguacagauagaaucccuaccccugcauuugucgccuccgucugccucuuuggucaguuucaggucccuguaguucacacuguguccccagggaugaagugggucccggcacggugggcauucugucaugaaugaaugguccccuuguguaugcaggguucgcgcugcagcuaggcagcaucuccgcagguccagguaguguaagcccucaccuccacguccccugggaccucggcauggcuggccuuucuggccagauccaaucacccucccgcgaagguggcuuugcgcaugcgcuucugcuccccagcgaucugaggagugaacaggaccccacggacgaggaucccugccggggugugggcccugcucugaucaccacccgcuggcgcucccccaggggccggagccggggccgccccagcacugggggcggggugguuaggggcggccguugcgauguauguggcaagguguucagccaacgcagcaaccugcugaggcaccagaagauccacacgggugagcgaccauucgugugcagcgagugcggccgcagcuucagccgcagcucgcaccugcugcgccaccagcuuacgcacaccgaggagcggccguucgugugcggcgacuguggccagggcuucgugcgcagcgcgcgccuggaagagcaucggagagugcacacgggcgaacagccuuuccguugcgcugagugcggccagagcuuccggcagcgcuccaaucugcugcagcaccagcgcauccacggcgaucccccgggcccuggcgcuaagcccccggccccuccuggugcgcccgagccucccggccccuuuccgugcagcgagugccgcgagagcuucgcgcggcgcgccgugcugcuggagcaccaggcgguacacacgggcgacaaguccuuuggcugcgucgagugcggcgagcgcuucggccgccgcucagugcugcugcagcaccggcgcgugcacaguggcgagcggcccuucgccugugccgagugcggccagagcuuccggcagcgcuccaaccugacgcagcaccggcgcauccacaccggggagcggcccuucgccugcgccgaguguggcaaggccuuccgccagcggccuacgcucacgcagcaucuccgcguacacacgggcgagaaacccuuugccugccccgaguguggccagcgcuucagccagcgccucaagcucacgcgucaucagaggacacacaccggcgaaaagcccuaccacugcggugagugcggccugggcuucacgcaggucucgcggcucaccgagcaccagcgcauccacacgggcgaacggcccuucgccugccccgagugcggccagagcuuucggcagcacgccaaccucacccagcaccggcgcauccacacgggugaacggcccuacgcaugcccugaguguggcaaggccuuccgccagcggcccacgcucacgcagcaucugcgcacccaccgacgagagaagcccuucgccugccaggacuguggccgccgcuuccaccagagcaccaagcucauucagcaccagcgcguccacagcgccgaguagcuccagccgggacgcacuguguccgccauggucagaacaccuaccuccccugguuauugugaggcuggcgauuacauaaguauaagcagguccgcccagggcuuggcuacuguagguguccaauaaacaguagauggaaacugggucuccacccacucagugccucccuaccugugcguccuucacuccccacccuccagccccccgagugcugggcuggugugcucccucuguaaccacgugguuccugugaggguucaccuccacaacaccccucuucacccugagagagguggcuccuagcaucaccuaccccgcgugugggauggccgcuauacccagcuucuaguuuacagagggaauggaccagcagcagguggggcagaacugcc

SEQ ID NO: 15019 - RNA, 844 nt, Homo sapiens
uuuaaaauggcacagguuaaucuggaaacuuuauuaucauaauuaaucaauaucaaaguacagauaauuggguaggaagaugaaacaaaacuaguaauguucuccaggauuaggcuguucucauacauggagcuaauauaaguggaaagacacacguuagucccauaaaagaaaacaaagcggcucaccagcaagaagaaaacaugacuggcuucuguuucaggaaaagauuguggagacagacugauacugugaauaugaaagaccgucuuuugaugccuuaagaaaauagucaccauguagaaacuaguccaaaucaugaggaacaagaagaggaaaccuugaguaaacauggcacuuugaaauaucauugcaugguaguauauaaacagucuuguuuuacaguauaucagagaauauacaaguccaacauuaguggauuugcugguggcuacggugcuuauaaugacccacauauugauuagccuguuguuuaggaauaaaucaauaagggaaaauuuauggggagauuugagguuugagccaugcccacuuggaaugacaaggacagaugauaacagccugaaauguacucaggagagaagaaguacauacacaaaugccccaugucauuuuauaaauguauagcccuguuuuacaaccaguaucaacaaaaguacuucuaagucugaaggaugacauuauauauggaacaccccugaugauaacuguuauaacauuagccaaaguuaggugcaugagaaucacaucuaagggguucuucugauggggccaaaauaagaagauguacauauauguaaugaauagcaauaaguuccccaug

SEQ ID NO: 15020 - RNA, 1275 nt, Homo sapiens
cauucacuuucaugcccccacauggaaagugguaggugaauaucuguaggaauacaauuuauugucugcuuguccacugaaaaguagcccugugucccuauccagucuacacucagaacuuugucuucaugagcagccagaucauacaacuucuuguaucccacaacuugacaauguuaucuaaagauccugaaaucaguugcuguucauggguaggagaccauuuuacuaaugucacgcaaccuguauuugaaguuagggacagugacaccaaagaauggucuuuaguucggggaucccacagucugguaugccuaucugugcuuccagaugcuaaacguuuacaaaguuggagaaugggaaauacaauuaagcacuuuauuuccugucaaagcuugccuucagacugucagacucaacauccuacacucuaauuguauggucccaagaugcacugcagauuucuucagcaucugaccacagaacugaggaaauugcuuccuugugaccagagagggucacuaugggagucauagcugcucuguguucucugucgauuuguggauuccuccauuucaucuucuucuucuguagggacuguagaccagaucuuuagcaucuuaucccaggagccacuacaaaauuuaguuccugagcuaucaacagcuauagacucugcacuuccagcaugaccucugcagcacggucgggcuuucacuuuguuucucucuauuccacucccauaagagaauaguuggauccauagaggcacucacaaauaagcaagacaaacuaucuuuuuuuuuggcccaggccacaucuuuuaagacaucccuauguccaacaauugucauuauugacuuucuuuccaaggaccggauuugagaggucuuaucauaagaaccagucaagauccauuccuuugccccuuuaacugaaaggauccagucaucauggaacaugcauugcucuggcuggggugcuguguacuucacauauucuauuuccacaacuacuucugaugacauguucuccaguuccauguguuugaccaaggacauucgcagaaacuggcccuuaauaaggaaauaaaacuccauauguuuguggaacucauuuuuguccuuuaguaauuuauugaugauguuacuaaggucagcaaauucagaggcggcagggauugagaaggaaacaucauuuacagcauauuucuuguuaucgguguagaaauguguuuggagcugagccaaggcaaggaguacacacaagacuuuu

SEQ ID NO: 15021 - RNA, 5590 nt, Homo sapiens
gagcaggccagggaagggggcuugucugcaccuccccaaucuugccuccucccuucucugaucuccucgaccuugauguauguagacccucuccucaaaaaccagaagaaucuucagagccuggaagggaccccagauaucacacagccccaugugacagaugaggaaacugagccaggcaguaaugauccugcccacuagcauagacuggggaggggcacaaguaggugcaccagcaccucccaucucagcugcccugagggguuggcgaggcuugaggaggaugagucagggagagaacugagccuggcgcccgcccuggugacuguaauggucaggaccccagcaugguccuugcuuugagccaguggcaggagacaaguggcuuaguuugccuccccaugucuccauuuccccuucuauaaacuggaggugaggguaacaagaccagucucacagaguugcugguaggaacugaugagguaaggcacggggcacagggcagggcucccaagaaaugcuccaugaugugagcccucaauggauuugcucucacugucauggcaaacaaacccuggcuuccugcugcagggcccgcgcccaagccgaggcagaccucaccaaucaaucacagcaugcuucacccacaggggcccaggggccuucucuagacagcacuaccaagggacagaagcuggccugugaaaggaaauggugucccuucccacucuuuaggggcugggccuccugcucaugcuuuucucauccaaggauggucagggcauuugugaugauuccagcugccagucccucccuccuuucaccuccgagccugcagucccccucuguagccucacaggcccacacgcuuaccuagcgaugaaccgggcuucugaguggcggcaggccacaaagaggccuuugaugaugucuaucuucuuggcuguggacuggagagucaggggaagagccgucagugccuggugaaggcagggaccacaccuccaccccaccagccgugcugcugcccugcauuuuggaauaccugcccuccuucccucaccccauccccaugucccagcucccauggccgcccacucuuagggcaguaagaacgagcuagcucuccuccuugccucccucucccuuuauccaggaaguauuuacugaguccugucauguggcagccauggcauuaggucugcuagacucugaagaggagacuccccuaggauugggugcaggaaggaggagaggaagcugugcaccccaugagaaggacugaugcgacccagcugauggucuacccagaagccuuccugacacacgcguggccucagguccccaagaugucugggguccgggaugagcggcccgccccacucacagcacugccagugagccuggcgaugucgcggaacuugcugaagaccccggaggcagugagcggaggugguggcagcaugagccucugggugcugcggcuguucucggccaccagccccacgucgccuuucucggcugccucagcccggacggacuccagcugccgaccuucaggggagagcgcgggugggggugucgagggugacaguuguggcugcgugucucccuucucucgcggccuggaugaauuuucuccagcugugugugcuuguggcgagucccugcaccucccugugucuaacgcucacccacuugguagaaauggcuuggggaacgugcccccagccacgcuggcuguaggaagucagcaaacaugcacguggagccaggaaagcgguggaugaacgagcaugaccacacucaggggagacaucugggccggugucaucagggcgcggaugggauuuaaagccacaggcgggacaaggucacuagggaagugaguguggacagagcagagaaggccaagggacccuuuccucuggcgggucaugaacaucucuggcagugaccaaagacccuucggcuuguuuuggagccaccagcuuacacacgugggaugugcucuggccccacuuacuguccagagcugggucccaugggcgccuggguguaagagcuggggagauggagccucaagucacggugacagcugugacaagcagcucucaaccuaucagaaccaacacacccuugucaccagauacugugugucaccucuuuucuggucugaaauaaaauguggagauaacauaaccugccuacaccuaucgagauaacgcccuaacccuaacacagaaaagaaugaaagggaaagcaauccguaaugaacgaacaagugcgcguuucaguccacagaugcucagccgcggcacagagcacaugaaggugggccucgcgccugaagcgaaacugccacaaaugggagagccgacagugugagccucaccaaugggauguuaucgaaucacacaucaaaggggacgggauucuccaaaguggccaacaacucacaacaaacccgggacuuggacagccacgggggccacaaggcggcacggagagcagugugagugugaacacgacccaucaaggguggaggcaugagacaguggaagaggccccagcugccauggauuguugggcaggaaagccagcaucugcaacuucuuuugugagaaaaacagauccuucuuuguccaagccaauguaguuggguuuucuguuaccugcagcucagaguauucuuaaccgaccccgugugugcugggucugguaugacgucagugcucccgaaacacaucuugagugaaugagugagaaaaucuugagucucaucuccucuggcucccauaagcccguaacucuuuccugauccaagucaaccuuucucagucccucuguccucucaugaaagccugaaaccccugccuucccuaaauguuggugcccauggcccuaagccagcuccagugcucccagcacauccucuccccaggcggaugagaacccaccaguggguggucaucccuccuacacugaccagcccgaacccugggcucugagccagaccuggugagccucagacccguuuccaaacuuccuggauggcccugggggcccacagauagagguugcucaugccugccccacgcuggggugauuaaugcccccugcaggugccugccccucaccagggucccaagcugccgacggcuuugucauccauccagucacccagggagauccuggaggcauuccuccugccuccucacccugacauccacugucugccagaucucuccugcccucuucucucuucucuacagcugggguccagcuccucuucccccuggaugcugccccuugccugcucacaauccuuccauggcuccccaguguccucaugauaagcaccgagcacuccaggcccuuggcaggcgggccauccgcaucaccagccuuuccacccagcacuggcggcugggccccuucaggcugcuggccccccacacaccauguucuuuccucccacuccuuccaaucccuccagucaaaguccuuucagaccucucuaagccccaaccuuccaucucagcccccaaauccugcugucucugccuccagcaucuuuccccagcccuccccuucccugcaccccacacccccugucccagcacaugccugguccucccucaccugaacugcugccccuguguucucucccacaccccugcaaaucuguccccaucaggcucuccucccucucagccuucuccucaacccuguuucacagccucucuccaccaucucuccgauccaccugaccucugcauuuucucuggcugagcuccuguccuucuggucccuccaaccacagucccccuuaccuguggccugggccacugccuugagaaggacaccaucacccacgccaagcuccaggcccugcugggguggcccaaggugguugaggcugagguagaggacagggaggaggucuggaggcgacagggccaccacggagcgcagcaaguugcucagcgucuccaccauccggagccuggaggaggggacggggguaugaacacgugguuccucaaggucaaaguguggugucggggugggguggguuuaaggggguggacacuagaaagaaauggagaaagaagaggaaagggcucagaacagucccaggcucuggggccuggagccaugaggacaaucacagauugcuggaggugaaaccgccuuugcaaaaccguaacugaggaaauuaugacaguggaaagaaaucacaccuaaccgauuccaucuugcuucuaaccuuuaagcuguccuuguucaguccugggcauaggcagaacuaacuuugggaaggaauuugguucguggcuugacucugaaacgaaauugguaauagcccuuucuggaaaagaccccuuuuugccuaaggaccugccuucgcaagacucacaaauuagcuacaagauuagaaauuuagguuuaggggucacgcagccucuggcuuccccgauugcuccuggggauaacaucacuacuguaaaaccuaagaugagugcuuaagauaguuugcagacccugcacucagucugacgccacccagacuguaaucuggcucaacaaguucugccaucccacccaggaacagaagacagcaagaaaaccucccuucgacccccugugaguccaucuucaaccugaccaaucagcacuccccacuuaccaagccccuacacgccaaauuaucuuuaaaaacucugcuccccacaugcucagggagacugauuugaguaaaaaugaaacuccggucucccgcacagccagcucugcgggaaugacucuuucuccacugcaguucccccgucuagauaaaucggcucugucuaggcagcgggcaaggugaacccaccggacgguuacagugggggaguaacuuggugugacgguaacaaugaugaagauggugaugaucagcccagagaaacgacagcugaugcuacggagcauuuucuaaauucaggagcuggcuuugagcacuuugcaccuuuuuuuugagacggagucucgcuccaucgcccaagguagagugcaguggcacgaucucggcucgcugcaaccuccaccuuguggguucaggugauucuccuccggaguagccgggacuaccggugcgcaccaccaugcccggcuaauuuuuuuuaauuuuuaguagagacgggguuucaacguguuggucaggcuggucucgaacuccugaccucaaaugauccgcccgccucggccucccaaagugcugggauuacaggcgugagccaacacggccagcccuuugcaccuuuuaacucauagaaucuucacagcuccccucugagguagguaccauuauuauuuccauuuuacggauaaagaaacagaggcaccgaaagaguccguggcuugcccaaggucacagagcgaguaaguaugaagcugagauguacaccaaggccgugugccugaggacugugcucccagccaccaagcugcaccaccucuaaaacgaaaaccguguuucugucuaaaacuucaaagcuggaaagaauggcuuuguuacugaaaaacuuagggggccucauuagaa

SEQ ID NO: 15022 - RNA, 933 nt, Homo sapiens
uucucaauguccaaggccucaaacuuuucaaucaccugggaccuccugugguugggggugcuggggcugggaggggagagcggcgggggcagcugcuguucuucggccuucaagucguguuuggucuucuccagagagaaguagcugcucuccccccggacuuugcggccacaguccaugcggucgcuacucauggcgcucuccucuucuuugcucuccagcccagguucccgcagggagcuggcagcaggaggcuggcucuggcugggacucugagcuggacucagacugcugccaucuggcugguccuugguccucauuucuuccugccagaguguggacuuggugguggggacuuucucagcacuggggaugcugcugcugcugcugcugcuggugguaacagccaccuuggcaggcccaggcuccugcgguguggggggcuccacuuuccauuucuucuucugauucugcuuguugguccggggauagaccaugagcaucuccagccacccacugacgaucuccuuggucuccgcccggaugaaaugcuccuucucaggcgucagaauacacagggagaaccucuggcccgugcggcccuccccauccaccacaucugugcacugguucauguugauggugcccugaggaagggucgugggcaucucauccagggcguagcgcaagaggccaugcucguaaaggaugaagaacugucgcugccauuucggagaccggugcacugaguugucaaagucggucccaucuggagccaggaggagccaaccgccauaaauggguuuugccugcgucagguccucgucguugaggagaugcgacucgcggggcuggaagcaguucugacacuugcucuuguugaagauguuggccuggaauuuccugcacggguucuccuuggcugccgacaug

SEQ ID NO: 15023 - RNA, 933 nt, Homo sapiens
caugucggcagccaaggagaacccgugcaggaaauuccaggccaacaucuucaacaagagcaagugucagaacugcuuccagccccgcgagucgcaucuccucaacgacgaggaccugacgcaggcaaaacccauuuauggcgguuggcuccuccuggcuccagaugggaccgacuuugacaacucagugcaccggucuccgaaauggcagcgacaguucuucauccuuuacgagcauggccucuugcgcuacgcccuggaugagaugcccacgacccuuccucagggcaccaucaacaugaaccagugcacagaugugguggauggggagggccgcacgggccagagguucucccuguguauucugacgccugagaaggagcauuucauccgggcggagaccaaggagaucgucaguggguggcuggagaugcucauggucuauccccggaccaacaagcagaaucagaagaagaaauggaaaguggagccccccacaccgcaggagccugggccugccaagguggcuguuaccaccagcagcagcagcagcagcagcauccccagugcugagaaaguccccaccaccaaguccacacucuggcaggaagaaaugaggaccaaggaccagccagauggcagcagucugaguccagcucagagucccagccagagccagccuccugcugccagcucccugcgggaaccugggcuggagagcaaagaagaggagagcgccaugaguagcgaccgcauggacuguggccgcaaaguccggggggagagcagcuacuucucucuggagaagaccaaacacgacuugaaggccgaagaacagcagcugcccccgccgcucuccccucccagccccagcacccccaaccacaggaggucccaggugauugaaaaguuugaggccuuggacauugagaa

SEQ ID NO: 15024 - RNA, 342 nt, Homo sapiens
cuuccuuuuaacaugggccccacgccuggccucuguuccugcaaacugacucccuaccccaaccaccucuuuuucucuccacaguccagggaccuugacccagccccucucagcagacgcuucaugauaggaaggacugaaaagucuuguggacaccuggucuuucccugauguucucguggcugcuguugggggcagagauugacgcccccggucuuugccucugagcgggagagucuguguguaugugucuuccccggaauccacaccaccccacccuccuccugucccgugguuucaucauaucucuuugcauaccccaugucuuccccaguugucccc

SEQ ID NO: 15025 - RNA, 30467 nt, Homo sapiens
aagggggcgccagaggccgggcgcccgguuuugaggggggcgccucgucccgccccucccuccuguccucccucccguccuccccgcuccgggccccacccggcucagacggcuccggacgggaccgcgagcacaggccgcuccgcgggcgcuucggauccucgcgggaccccacccucucccagccugcccagcccgcugcagccgccagcgcgccccgucggugagugcucccagcaccgcagcugucgccucccgacccccgcccaagccugcccugguuccucaugccugaccccugcucccugccacccuguccccagucuguaacggucuccccaggugucccccagucuucaccaguccccccagucuguaaccaugucccccacucuucccacuccucccacucuuccucccacucuuccuccagucuuucgcagccucucacacucccccagucuccuccauccucccccaacaccccucccuauccccugggcuagaagagauccucucugcagggucucccuccacgcccucauccauaucagcuaacuuggucccuccagccacucaagagccccucuccugccucaccagcuccaucggccaccgcugauagcauucuccccagcucucucucagggcccucccugccugggacaccgcccagagcccucucccucugcccacaucccagauccugccucucuuuuccauucuugccacuccuuuacgaacuccuuuugcuuuuaucuccccuacucccuggccaccccuuuuaagucucaugauuuuauggauuuuagcauauuugauuugcaguuauuuugaugcucaaauugccccauguuuggccacugggcaccccugcaagcuggguccucugucccuguaacaugcccuaucggccuuugagcacuuccucaccuucugacccaggcucacuuguucuucccugcccccgcccuggaauccaccauuucucuaaggagucccagguucuuuuaguggggaaugguauuuagagacucccaucucaccaaaaguugauucuuugaaaagaucaguaaaaucauaagcaucaacggggagcaaucguuuuuguuuuucuuuuuuaaaaaaagcaaauacccacaccuguggcugauaucgggaaugaaagaggggacaucacuacagauccuacggugaauaaaaggcuaguaagggaagauagagaacacagucugggugcuggaggugcucauugcuccuggguuggucauggcuaaccucccuaacucagaucuuuagaccuauaauaggauugcaaccucugaggucaggcugccuguguuugagucccagcuugagcauuuuccagcuaagugaucuuggguaauuuauugcugucuuccugagccuccuuugccuuguuaaaaaagcagagaugagccggcaugguggcacacaccuguaaucccaacaauuugggaggcugagguggguggaucaccugagcucaggaguucgagaccacccagggcaacauggugaaacccaucucuacuaaaaauacaaaaaaaaauuaacugggugugguggugcaugccucuagucccaacuacuugggaggcugaggcaggagaaucccuugagccccagaggugaaggcugcagugagcugagauuguaucacugcacuccagcuugggcuacagagugagacuccaucuccaaauaaauaaauaaauaaauaaauaaauaaauaaauaaauaaaaagaaagaaaagcaaagcaaagcagggaugauaauagaccuacuuuacaggguuauaaauguuaagugaguuaguacaguaccuggcaugcagugaucauaaauguugcauuauuuuucuuguuaacacccaacagcccucaugaccugggugcacccaggcaaccuucucagcuccauuucucaccccuccucuuugugccccugugucuggccaccuacccagauguuucauggcucccaguacaccaggaccuuucacauccccagaccuuugcacgcaccguccucucugccuaaauccccuugucuugccugcucuucauggagcagcucaaaagucaacccugcccugagucuuacuggugcuguggucuguuucucaugcccuccucuggaugucuggcaugugucuggguccuuacugggggcccuggguggguaggggaugaucucuggcucauuucuggguccacagugccugaagcauggagugagugauuucagugaaaaggugucaaaugauggaagggagaagggaggaagaaaugaaugaagcgauuaaggaauccguuucuuccaggcagcuucugcauccuucgccuuguccaucucuuggucuuccacuaccaccaucaaucccccuucuucaaccaugucaccauuaaucuuucuccuccuucagcugguucgcuacgaucucccuauuuuuuuugaaauggagugucgcucugucaagugcaguggcgggaucucggcucacugcaaccucugccuccuggguucaagugauucuccugucucagccucccaaguagcugggacuacagguggccaccaccaggccuggcuaauuuuuuguauguuuaguagagacaggauugcaccauauuggucaggcuggucucaaacuccugaccucaggugguccaccugccucagccucccgaagugcugggauuacaggcaugagccacugugccuggccuuuuuuuuuuuuuuuuuuuuugagauggggucuuacucuguagcccaggcuggagugcagcggcaugaucauagcucacugcagccugcagccuugaacuccugagcucaagcaauccuccugccucagccucccaaagugcuaggacuacaggcaugcaccaccaugcccagcuaauuauuuuuuuuguagagaugggggucucacuauuuuacccaggcuggucuucaacuacugaccucaagcaauccuccuaccucagccucccaaaauacuaggauuacaggugugagccaucgcgccuggcccaauuccauucuuccuccugccaccugccauccaugcucugugaccacauauuugugaccacaaauaucugugcuccuccuccuccuccacccauccugucacccagacagucuacacucagaccccuuucuuccuccuuggcugggccgccuaugcucaugcccucucccccucccacaggcagcucuccaucugcacgucucuccgugaaccccgugagcggugugcagccaccauguucagcuggcugaagcggggcggggcacggggccagcagcccgaggccauccgcacggugaccucggcccucaaggagcuguaccgcacgaagcugcugccgcuggaggagcacuaccgcuuuggggccuuccacucgccggcccuggaggacgcagacuucgacggcaagcccauggugcugguggccggccaguacagcacgggcaagaccagcuucauccaguaccugcuggagcaggaggugcccggcucccgcguggggccugagcccaccaccgacugcuuuguggccgucaugcacggggacacugagggcaccgugcccggcaacgcccucgucguggacccggacaagcccuuccgcaaacucaacccuuucggaaacaccuuccucaacaggugugccagccgcgagcccagggcgcaucuuucuuuuucuuuuuguuaagacagaguuuccgcucuuuucgcccaggcuggagugcaguggugcgaucucagcucauggcaaccuccaccuccuggguucaagcaauucuccugccucagccaccugaguagcugggauuacagacacccaccaccacgccaagcgaguuuuuguauuauuagguacaguugggguuucaccauguuggccuggcuggucuugaacuccuggccucaagugauccaccugccucagccucccaaaguguugggauuacacgagugagccacugcgcccggcccugggggcacgucuuucugucccaggggugcaucuugcugucccccuucucuguccccucccugacuguguuucccuccuucucagccccaauucccuucucucuacccaguucuucccaugccugucucugcucucuuauccaggggagcaccuaggcuagugaagucaguaugccugguucaaaucccggccagcuggguggccucaggcaaaugacuugaccucucugcccuucuuguagccucaucugcaaaaauguggaucaaucaccuugggccaggcccgguggcucacaccuguaaucccagcgcuuugggaggccaaggcagguagaucacuugaggccaggaguuggagaccagccuggccaacauggugaaaccccgucucuaccaaaaacacaaaaaauuagcuggguguggugguucgugccuguaaucccagcuacucgggaggcugaggcagaagaauugcuuaaaccugggaggcggagguugcaguaagccgagaccgugccacugcauuccagccugggcaacagagcgagacucugucuaaaaaaaaaaaaaaaaaaaaagggaucaggaucaccauggucucuaugccaugguugcugugaggacuuggaauagcaccugguggccgggcgcagugucucacgccuguaaucccagcacuuugggaggcugaggcgggcagaucacuugaggccagaaguuugagaccagccuggccaacauggugaaaccccgucucuacuaaaaauacaaaaauuagcugggugagguggugcccaccuguaaucccagcuacucgggaggcuuaggcaggagaaucacuugaacucgggaggcggagguugcagugagcugagauagugccauugcacuccagccugggcgacaacagcaaaacucugucucaaaaaaaaaaaaaaaaaaaagaacaguaccuggcacaaauuaagugcucacugaacaugagcuguggcugguuauaacucugagaugguccugguugcccuuuuucuguccggugucuuucuucgcccauaaaggaugcuuugccaugcggucccgagucccucuucauguuuucuucguguuuucccuccuucuguccuucccuguugaccccugacccucccucugcccccagguucaugugugcccagcucccuaaucagguccuggagagcaucagcaucaucgacaccccggguauccugucgggugccaagcagagagugagccgcggugaguggggccagacccuggggucugagggaggaggggcuggggccuggacuccugggucugagggaggagggacugggcccggacuccugggucugagggaggaggggcuggggucuggacuccugggucugagggaggaggggcuggggucuggacuccuggaucugagggaggaggggcugggcccagacuccugggucugagggaggaggggcugggggccuggacuccugggucugagggaggagggacuggggucuggacuccugggucugagggaggaggagcuggggccuggacuccugggucugagggagaggggcugggccuggacuccugggucugagguaggagggccuggggucuggacuccugggucuagaggaggaggggcggugucuccgcugggacuugggccuguguccucuggcccuggcuggcggggcagccgcagggagcuaguggaagcugugacugcuccaugcuggcucgcauugaugggugggggaggugugugggugaccacguggugggagcgggcaggagccgcacgucugggcaggcaggaaggaugggaagggagagaugaagagggacagggauuccgaggcagugagacagcgacgcagggagacacaaggccuggagaugaggcagagccugggcaggggaggcagagcccgggcaggggaggcugggcccugcgagcuccuggcucugcgucugggccacagauggggccgagaaggggaugggaagggaaucugggugggggccaaggccaggccuggaauuuauaaacagcugugcaaggagaguggcgggggguggauuccagccggggccuccgggcgugcugagcccucaccaccccugcccagcccagcucagcaucuguggucccccagccccacagaucugugucccccaccccccauggccuuggaggcccagaacuggggcaaaggaggcugcuauguggggcagagaggaugggaggcccuggcgagaaggcugggccuggggugggguggggacgcugggggugaccaugucucuggcugccguccagaggccccacgggagaaaggcaggaggcagcugcagaaacgauugggaggacacgcugccagcugagggggaggaauuccuggggcucccaccccagggccuggaccugggacagcgggagggagaggcucucucagccagggcaggggugccggcagggggguucaaaggccauggguggugggggaguggggaacggggucucccucccuggccuugaggauagaggaagaggaggagagaguguccagcuguugguguguauaugugugugugugugugugugugugacuuuguguauaucuugggaaagugugucauuaugaguguacuccuggguguggugguuccacgcauuuguguauagcaguggacgugccucauuguggccauggcucugagguuguaugacuuugaauuguguacaugccucugugugugugugugugugugcgcaugugccuauaauuguggcuggaagacuuuguuuuguuuguuuuugagacagagucucacucugucgcccaggcuggaguggaguggcgcgaucucggcucacugcaaccuuugccucccgaguucaaguggcucugcugccucagccuccugaguagccaggacuacaggcgcccgccgcacccauguccggcuaauuuuuguauuuuuuuuuaguagagacgggauuucaccauguuggccaggcuggucucgaacuccugaccucaggugauccuccugccuuggccucccaaagugcugggauuacaggugugagccaccaugcccggccugcuggaugacuuugugugacucugaagggcuguguagggcuaugagagacuuugugggauagugugcaacugauucugucccuauauacuguuauauugugacgugugugugugagagagacagacauaaagggcaacuuuugucuaugugucuauguggauuuaguguguaucauuguaggugugagucugacauugugugccugugugugagauggucuaggcauauauguguaucugggcugugggcugugugugacuuuguguggcugcauggggcggucagggcugcggggauuuugugggacugugugugacuaccugugauuguaucuccggauacaguugugugcuucugugugguguuguguaugugagaaugugugugugugcaggagugcaucuuuuguguaacugugugugauuacgucugugugugugccuuuggauuugggagggcaugggagguuaugugugugcgacugugucugugugggugugcaugcaugugugccucuguaccuguguguucgugcaggucucugugucuaugccgugugugcaucucacauuaucuuugugauugugugaccacaaacaucuguguaggucccagauugugaacacggguaugucugggagccugcaucuuguaguaauuggcuauguuugugucuggaugugcuacuggggguguguguguguguguguguguguguguguguaugcgagcucauguguguggcugccucugcauguaagaugugugaacacacgcaugugugauuguagcauaguaaagcccucaaaucugggcucugcuacuuuuauuuauuuauguuaugcuacuuuuuuuuuuuugagauggagucuuacucugucuuccaggcuggagugcaguggugcgaccucggcucgcugcaaccuccgccuccuggguucaagcaauucucugccucagccuccggaguagcugggauuacaggcgccugccaccaugcccggcuaauuuuuuuguauuuuuaguagagacgggguuucgccgucuuagccaggcaggucuugaacuccugaccucgugauccacccaccucggccucccaaaguguugggauuacaggcaugagccaccgcccagccuauuuucugcugcuuuuaaacugugggaccuuaggcaagccacuuaaccucucuuugccucaguuuucuuaccugcaaaaugggaauaaugggcugggcgcagugguucacgccuguaaucccagcaguuugagaggccaaggugggcagauuaccugaggucaggaguucgagaccagccugggcaacauggugaaacccugucuauacuaaaaauacaaaaauuagcugggugugguggugcuugccuguaaucccaccuacucgggaggcugaggcagaagaauugcuugaacccaggagguggagguugcagugagccgagcucaugacacugcacuccagccugggcgauagagugagacuuggucucaaaaauaaacaaacagaaaaacaaaacacacacacacacacacacacacacacacacacacacacacacacacugggaauaauaauacuagcggccucauaguuguccuaaagguuaaauuaguuaaaacauacaaagcacuuagaaggugcacacuugugugugcacacaguaggcgcuauggaagugccaacaaugccuguuuucgcugggugagugccguugugggcccaagguuccuuuuugccacgucucccaucccacacugacucaaccucucucccuucuucccuccccgccccaugagacacacuuuccgaaucugggccaguauguguguuuguggagacaccgggagggagggggggcuccaguugcugucccuccagugacuuggcccuuccucccccaaaacaacggcccccaaccccaucccggucccugcguugcccgcaaggaggcugcuuccucucaggcaggaugggugcaagcaccagcuccccggaggagcauaggggcccaugggacuccucuucugucgccucuuaccugugugucuugaguaaguccccuaacuucucucucuuuuuuuuuuuuugagacggaguuucgcucuuguugcccaggcuggagugcaguggcaggaccuuggcucacugcaaccuccgccuccuggguucaagugauucuccugccucagccucccgaauagcugggauuacaggugcccaccaccacacccagcuaauuuuuuuguauuuuuaguggagacgggguuucacuauguuggucaggcuggucucgaacuccugaccucaggugauccacccgccucagccucccaaagugcugggauugcaggcgugagccaccacgccuagcuaguccccuaacuucucugugccucaguuuccucaucuggaaaauggggucagaacagugcccaccuccugggguuguugugaagagucacugagugagcucuagcuggagggcaugaagucaguaaaucagggcuagcuccuuguucugccaguuaacucuucguccuccggguucccacucugccuucccuccuccuggaaguccuccuugacccccaggcuggggguugggucaggcacuggcccugggcucccacagcucccuggaucccccugcccacccugggcugaccacucaggggccaggucuguguccccagugggcugagagauguaaggacaaagcugaaacugccucagccuccacacacacagcagggaccacagagggugcuucccagugggugacaucaccaugacuugcugagugcuuaccguacauccagcacuguuuuuaaaaaaacaguuucauugaggauuaacguacacgccauaaaaacucaaccauuauggccgggcucaguggcucaugccuguaaucucagcacuuugggaggcugaggugggcggauaaugaggucaagagauggagaccauccuggccaacauggugaaaacccaucucuacuaaaaauacagaaauuagcugggugugguggcaccuguaaucccagcuacucgggaggcugaggcaggagaauugcuugaacucgagaggcagagguugcagugaccugagaucgcgccacugcacuccaaccugggcgacagcgagacuccgucugaaaaaaaaaaaaaaaaaaaagcucaaccauuuuuuuuuuuaaagagacaaggucuugcucugucugcaggcuggagugcaaugacgcaaucauggcucacugcagccuccaacugcugggcucaagugauccucuugcuuccuccuccugaguagcugagacuacagaugcaugccaacauguguggauaauuuuuuauuuuauuuuuuucuguagagacagggucuugucaucuugcccaggcuggucucaaacucccaggcucaagcgauccuccugccucuaccucccaaagugcugggauuacaggugugagccacucugucuggccacuuccaucauuuuuaaauguacaguucaaugccaggcauuauuuuaagcucuuuauauauauuagcucauuuauauucuuuuaaucuucacaacagucuuuuuuuuuuuuugagacagagucucacucugucgcccagacuggagugcagugaugcuaucucggcucacugcaaccucugccucccaggcucaagcgauucucgugccucagccuucugaauaugugggaccauaggcaugagccaccaacaccgggcuaauuuuuuuguauuuuuagggcuaggcuggucuugaacuccuggccucaauugaucugcccacuucagccucccaaagugcugggauuacagguuugagccaucacaccuggcuucacaacaguccuaugauuugcauuuuacagaaaagaaaacacaaguucagagagguuaagcuacuugccuaaggucacacaguggaugggggcagaggagggacucaacuccaggucuuccagacagcuaagucagggggucucaaucgcuucucucugcucuccucagcauugcuuguuggugaauaaaugagugaagaagcaaaggugagaaugaguggaugaaggagugaaugaggaaaugaauggugaaaggaaugaaugaaugagcaugggaacccauggcugggaugggugcuucauaagagcaagaaucuugucuguguguucucugcgguaucccaggcucccaggacagggcuuggcacacaugagacucucaguaaguauugcuaaauaaaugcaaaauauuuaacuucucagccuggccaacauggugaaaccccgucucuacuaaaaauacagaaauuagccagggugguggugcaugccuguaaucccagcuacucgggaggcugaggcaggagaauugcuugaaccugggagguggagguggagguugcagugagccacauucaugccacugcacuccagccugggcgacagagugagacucugucucaaaaaaaaaaaaaaaaaaaaaaaaaaaaaaaaaaaaaauuaucaucugcuauggcaagagcacagcuauccagcaugaacucuaguugcuggaucguggggagauacaacagguccuggggaggagcuggggugauagaggcauguggcaggcuuggggguuccauagaagcacagggggaucucuuagcaaacaugucaguauuuuuaacaaccuauauguacauaccgacgcacaccuguaauaacugcuuaaugaaugagcaaaugaaaaaauggaggccgugaggcugggcgcgguggcccacgccuguaaucccaacauuuuggaggcugaggcaggaggaucaguugagcucaggaguuugagacuagcccggcagcccggguaacauagugagaucccaucucuacucaaaaaaaaaaaaaaaaaaaaaaauuagccagguguggugaugcgcgccugcagucccagcuacuagggaggcugaggugggaggaucaccugagcuccgggaagcagagguugcagggaggcgugaucccgccauugugcucgagcaaaggaaaagggggaugauugcccccuguagccagauggcuugaggggcuggggccagagcgaggggggaaauucugggcacuggagagccagagcaguagugcccacugagggccuuggcuauuuugcccagacaggauuuggacagccaacaacgugaacaucuuuacaguccaauaugcaagagaaugggauacuacugagaauggcuggagggugggggucugauuucugccccuugcgccccugucucuccacucccacuccaggcuacgacuucccggccgugcugcgcugguucgcggagcgcguggaccucaucauccugcucuuugaugcgcacaagcuggagaucucggacgaguucucagaggccaucggcgcguugcggggccaugaggacaagauccgcguggugcucaacaaggccgacaugguggagacgcagcagcugaugcgcgucuacggcgcgcucaugugggcgcugggcaagguggugggcacgcccgaggugcugcgcgucuacaucggcuccuucuggucccagccccuccucgugcccgacaaccggcgccucuucgagcuggaggagcaggaccucuuccgcgacauccagggccugccccggcacgcagccuugcgcaagcucaacgaccuggugaagagggcccggcuggugcgagugaguaguccugagggcugggcgcgcauucuuggaggagguuuccucgguccucuccuaccagugcugugagucccugacuuaucagggcccagguuaguuaguucucuugaaguugggucauucuggcacagagugaagccgggaggaagaacuguauggagagacucauuccucugccuuuggauuucugugucaacuccgugucacccuggcuucucuguccugguauuucuauuucuucuuccucuuccuccuccuccuccuucucuucuucuucuuccucuuuuucuucuuucuucucucuuuccuccuccuccucuucuucucccuccuccuccuccuucuucucuuucuuccuccccuuccuccuuccuuccuuccuuccucuguuccucucucccuuccucccuccucccuuccuccuuccuuacauccucuuucguucccucuucuuccuucuuuuuuaagagauggagucucgcucucuugcccuggcuggaaugcaaugaugcaaucacagcucaccacagccuugaacuccugggcucaagugauccuuccuccuuagccugccccaaguagcugagaccacaggcacgugucaccacgcccagcuaauuuuuuauuuuuuguagagucgaggucuuacuguguugcccaggcuggucuugaacuccugcccucaagugauccuccccuuuuggccucccaaagugcugggauugcaggcaugaguauguugaauuuuugaacuuccuauaaaauauagacagacaaauacucauuauucuacccucuuuauuuuuugauaauuuauaagauugugguucaaagguuuccaaguucauugguuuauuccacaaauauuucuuuuucuucuucuuuucuuuuuuugagacggaguuuugcucuuauugcccaggcuggagugcaauggcgugaucucggcucaccacaaccuccgccuccugaauucaagcgauucuccugccucagccucccgaguagcugggauuacaggcauucaccaccaugcccggcuaauuguguauuuuuaguagaguauuuuuaguuggucaggcuggucuugaacucucaaccucaggugauccgcucuccuuggccucccaaagugcugggauuauaggcgugagccaccgcgccaggcccacaaguauuucuggaaugcuuucuguacacauggugcuggggcuggggauggagggaacagacaagguuccagcccuccuggggcucaucuuuuuuuaaauuuaauuaauuaauuuauuuauaagcuagucaaauuuagcaguggggguggggaguugcaugccaacuuuacugacacuaauaaguucugauaaccaaggccaggugcgguggcucacgccuguaaucccaacacuuuuggaggauugcuugagcccaggcauugaagaccagcuugggcaacauagugagacaccauuucuauuaaaaaaaaaaaaaaaaguucugauaacccacuaccauuggaccagccccggggcuuaucuuuugauggagggagacagaauaaguaaacagacauaaaauaacaaugaaggcugggugcgguggcucacgccuguaaucccaacacuuugggaggccgaggggggagcagaucacuugaggucaggaguucgagaccagccuggucaagauggugaaacugcgucucuacuaaaaauacaaaaauuagccaggugugguggcgggcaccuguaaucccagcuacuugggaggcugaggcaugagaaucacuugaacccgggaggcagagguugcagugagcugagauuguaccacugcacuccagccuaggcgacagaacgagacucugucucaaaauaaaaaaaaaaaaaaagaugaauuuauuacaucuuaggcgcuucacagcacccgucucccaugacucuuguuugauuguggccacagauuguccccuucucucacuccuuuccucuguccucaucucccauucccuucccagcguccccugcacuucacgcugguggccucaguccugugcacuugcugcucccucuuccuggaaaccucuucugccuucuucccccucccaccuggccauccacaaggcucacucccuccucaccccuuucaagacucugcucaaaugcucccuucucaggaaggcuguccaugcccuccuuugaaugaauauaacuucccccauaugcguccuucuuuacccuaacccuguuguccuuuccuuuccuuucuucuccucuccucuccuuucucucuuucucuguuucucuuucucucuuucuuucucuuucucuuucuuuuucuuucuuucuuuuuuuuuuuuuuugagacagggucucccucuguugcccaggcuggagugcaguggugcgauaucagcucacugcaaccuccaccucccggguucaagcgauucuccugccucagccuccugaguagcugggguuacaggcgugugccaccacacccagcuaauuuuuuguauuuuuaguggagacgggguuucaccauauuggucaggcuggucucgaacucccgaccucaggugauccgcccgccuuggccucccaaagugcugggauuacaggcguaagccaccacacccagccaaucagggcucuuugaauuccuucacugauuuauccccagugcccggaacagaauuggugcucuguaaauauuuauugaaugaaugacauugaacaaacaguugcauugaacaaaaucuccucuaugccuggccugguguuggguggugcaggagacacaacagugaccacgaugguuccaguccuguccugcuggggcucccaguccuaaauaaugaaggcaguuccagggcucaguccucacuggggcuccuggagaggagacagauccauccccaggcaccgaugacccaguguggucagagcuggggcgggguagcuggggcaggcagagagggcuucuuuggaggagagggcaucugaggggaaaugucaguguugaacccaguguagacagugugcuaacucaauuagaggcugaggauguggcugagaucagagguggugugggcuguguccgggaaucugugcuuugucccuagggcacuggggagccaugaaaaaguucggagcagggaaaggagauaauuagacucaagcuaccuuuuggaggguggauucaaggcaggagagucuaggagccuggagaccaggcaaaaggcuuggagguuccuggaucaggacaggccuuggggagggagaggagaaaggagagcgcggguuucagagcgauuuuggaugucagauggaacuuucucagggggaggcugccaggguggaggcggggcaggaagcugggcaggcagggaggccaagaagguucuaggggguggaggagccugagguguugguuuaaggagcagcgagagugggugagucagagcccccacccccaccccaggaauccuccuucggagggagcggcccacuguggaccaggcugccacuccuggaaccuucggaauucaccuugcgcuccucugcccaggcggcucugcagugucucucucucucuuuuucugucucuaugucagucuccuuucuaccucucucucagucucuuucuucuccauuuuuacuuuuucuuuuauucuaacucccuuuccuuuucuuucucgcucugccuccuccugucucuccaucucucccccgcuccgccgccgcccucucucugucuuccuccuggucuugcuuagacucccccagguucguucccgcgggucccuuggcgggagcuggagcacaaggcccagggacagagggguggguccgggccagacaccuggugcccccgccgggcugggggcggcuccggaaacccagacaaaccccggagucagggacccagccccggcccagcccgcccucucaccuuaucucuuccuggcaccuuccccugcuuccucucuggaaaagccaucagcgcccucccgccuacccuccuuuggucccuacggagccgcccuucggcccugcccccuggcuccauuggcccgcucucacaggccccgcccccagcccggccacaccccugcccugauugguccuucagaccauuaggcacucccucccccucuuccugcagguucauccauggcuccccagugccguucaggacacaggagcaugggauuuaggguccgcugugaccaaggcucacugccccuccuuugccccgugucgcacccccaccccugcuccucacauaugaguccgccacacuuggucgucaccaacaauagccauacuguuaaccuccccucaugcucuccuccaaagauaccaggccuuccuggacucucugggaggaggcauucacccuccucccagugccucaguuucccaucuguacgauggaggguguggacgaauccucuggcucuaaguccuuuggcugaagugauagcuguuagaaggggagauuuuaugaugcugugauacguaaggccaagaucuugggagggucugauucuauagacgccaagaugcccugaaccuucagaccacauucucugcaguggcccagugacauucauucagcaguugccgaucgcaugugguacuccucuaggcucuggggauacagcagggaacacagauaaauuccuuuucucauagaauuacuuuuuaguggggaagcaaacauuaaacaaaucaaugguuaugaagaaaaaugaagcggaggaaagaggggcuggcgagggacuauuuuagagcgcucugaaggagaggaagggguaagaggaaggggugagccgaguggcgaucggguggaagagcaguccaugcagugagaacagcaugugcaaaggcccuggggcagccaugcacuugauguguuugaacugagagccuaacggggcuggagacaggguggugguggaagguggaagagaugaagauuuagaaccagucagggaccaccaacguucucagcagucuaaauuugugauucuuuaaaaaaaaaaaaauauauauauauauauauauauacauauauauauaauuuuuuuuuuuuuagauggagucucucucuaucacccaggcuggagagcaguggcaugaucucggcucacugcaaccucugccucccagguuaaagugauucuugugccucagcuuuccgaguagcugggacuccaggcaggugccaccacaccuggcuaauuuuuguauuuuuaguagagauggguucucaccauguuggccaggcuggucucgaacuccugaccucaggugauccgcuggccucggccucccgaaguguugggauuacaggcaugagccacugugccuggccuaaaagaauuuuuuaacuagucuuuuuuauugaacauuuaagaccaucucauggaaaggcauucauacuuuaucagacaugauucucccacaccucaccccaccagcucccagggccucuuuucuagaggcaacccccauaaguaguuucuugugugucuuuccagauauacugcauuuuuuuuuuuuuuuuuuuugagacggagucucgcucugucgccuaggcuggagugcaguggcaugaucucggcucacugcaagcuccgccucccggguucacgccauucuccugccucagccucccgaguagcugggacuacaggugccugccaccacgccuggcuaauuuuuuguauuuuuaguagaggcgggguuucacuguguuagccaggauggucucgaucuccugaccucaugauccgccugccucugccucccaaagugcugggauuacaggcgugauauacuguaaucacgcccggccaauauacugcauuuuguaaaagcauuuauuuauuauuauuuuguuuugagacugagucucacucugucgcccaggcuggugcaauggcacggucucagcucacugcaaccuccaccucccagguucaagugauucuccugccucagcuucccauguagcuuggauuauaggugggcaccaucagcccggcuaauuuuuguauuuuuaguagagauagcauuucaccauguuguccaggcuggucucuaacuccugaccucaggugaucgacccgcuucagccucccaaagugcugggauuacaggcgugagccaccgcgccuggccuauuuauucauuuuuuuagagacaaaggcucgcugugucgcccagacuggagugcaguggcgacaucauagcucacuucagucucaaaccucugggcucaagugauccucccuccucagccccggcaauucacugggacuauaggcgcgcgccaguacacccaacuaguuuuaaaauuuuuuuuuagagaccaagucuugcuauguugcccaggcuggucucgaacuucuggccucaagugauccuccccccuuggcuucccaaagugcugggauuauaggcaugagcaauauuuaauuugugagcuuccuauaaaauauagacauaccaauauucauuauucugcucuccuuguuuauuuuucgauaauuuauaagauuguggaccaggugugguggcucacaccuguaaucccagcacuuugggggaccaaugugggcggaucaucugagaucaggaguucaagaccagccugaccaacauggagaaaucccaucucuacuaaaaauauaaaauuagcugggcaugguggugcaugccugugaucccagcuacucaggaggcugaggcaggagaaucgcuugaacccaggaggcagagguugcagugagacaagaucgcaccacugcacuccagccugggcaacagagugaaaccccaucucaaaaaaaaaauaaaaaauaaaaaauaaaaagauuguguuucaaagguucucaaguucauugguuuauuccacaaauauuuccugaguguuuucuguacagauuguacuggugcuggagauggagggaacagacaaguuuccagcccuucuggggcuccuuuuuuuuuuuuugagacagugucuugcucugucacccaggcuggagugcagugguaugaucauggcucacuguagccuugaccuccccggcuucagugauccucccaucucagccucuugagaagagaagauuaauaaaucaagacauuaggccaggcgcggugguucaugccuauaaucucagcacuuuggaagacugaggcgggcggaucacaaggucaagagaucgagaccauccuggccaacaugguggaacccagucucuacuaaaaauacaaaaauuaucaugguggcgggcgccuguagucccagcuacuugggaggcugaggcaggagaauggcgugaacccgggagguggagcuugcagugagccgagauugagccacugcacuccagccugggcggcagagugagacucugucucaaaaaauaaauaaauaaauaaauaaauaaagucauuauuugcaccacugcacuccagucugggugacagagcaagacucugucucaaaaaaaaaaaaaaaaaaaaaaaauccacuguccauuugggagaaaaaaagagugaagaaagcaaaaagcgaauaacgucuuaguauuguucuuaaaauaauuuugaccacaggaacccccgaaaggaucuugaggaccccuggguuucccuggaccacacuucgugaauugcugcuguagggcuuugucggcuucgguagaaauuuugaacuucaauaagcaaauagagaguuaugagcagcauccccugggcucauguuccuuccugaaaaaugcccucuugggccacugcugcauggagcaaggguuauuggggcaggauggggagcugggagaccugucgggccaccuugggugucuccccaggcaagagaggaugacgcucgaauggacaugguggccacugagguggagagaaaugagaagcaggggagaggcugggcguaguagcgggugccuguagucccagcuacucaggaggcugaggugggaggauggauugagcugggaagguggagguugcacugagccgagauugugccacugcacuccagccugggggacagagccagacccugucuaaaaaaagcaaaaaagaaaaggaaaguaggggagagagggagagacauaggaggaggcaaaagggacucauugauagguuggauguggcuacuuaacaggaggaagaaucaaauaucaaaucaauaaugauuucaagagcuggguaccguggcucccgccuguaauccagcacuuugggaggcugaggcaggcagaucauuugaggucaggaguuugagaccagccuggccaacauggugaaaaccccucucuacuaaaaauacaaaaauuagugguggcgggcaccuguaaucccagcuacucgagagguagaggcaggaggauugcuugaacccaggaaguggagguugcagugagccaagaucaugccauugcacuccacccugggcaacagagugagacucccuuucaaaaagaaaaaaaaagugauuucuagagccggacgggguggcucccgccugucaucccagcacuuugggaggccgaggcggguggaucucuugaggucagggguucgagaccagucuggccaacauggugaaagccagucucuacuaaacauacaaaaauugaccaggcaugguggcacgugccuguaaucccagcuacucgggaggccagggcaggaggauugcuugaacccggagguggagguugcagugagacaagguugcgccacuguccuccagccugggugacagagugagugagacuccgucucaaaauaaauaaauaaauaaaaauaaaauuucuagauuucuggccucaacugggaaggcagggcuggggaugcccuuuucagagaugggcacagcugagggcgacacagcucugagggcuaggcucaaauuccacuuagggcauccugguauggagcuauccaggaauguugacagggcaauuagcucugaguccugagcuggagggagaggcuuaggcugguaugcagauucgggaguggaccucuuggagggguguuuaaaacugggagggacucagcucacuuaguuagcagagaggaggagcccagggugagccccagcaggaggaggccaugaggcucacaguguggcaccuccgccugcagcaccuguaacuugucagaaaugcaaauucccaucugggcaguggcucuugccuguaaucccagcuacuugagaggcugaggcgggaggaucccuugagcccaggaauuugaggcugcaguaaguuaugaucgcaccacugcacuccuggcugggugauagagcgagacccugucuccaaaaaaaaaagaaaaaaaagcaggccaggcgcgguggcucaugccuguaaucccagcacuuugggaggccacggcggguggaucaccugagauuaggaguucaagaccagccuggccaacauggagaaaccccguuucuauuaaaaauacaaaaaaauuagccgggugugguggcgcaugccuguuaaucccaacuacuugggaggcugaggcagaagaauugcuugaacccaggaguuggagguugcagcgagcugauugcaccacugcacuccagccugggcaacagagcgagacucugucucgaaaaaaaaaaagacugggcacgguggcucacaccuguaaucccagcacuuugggaggccaaggugggcagaucacgaggucaggaguuugagaccagccugaccagcauggugaaaccccaucuuuacuaaaaauacaaaaauuagcugggcauaguggcgcaugccuguaaucccagcuacucaggagccugagacaggagaauugcuugaagccgggaggcggagguugcagugagccgagauugugcuacugcacuccagccucggugacagagcgagacuccgucucaaagaaaaaaaaagagagagagagagagaaaaagaaauaaaagaaauacaaauucucaugccccagcccagaccaaguaaaucagaaucucugggaguggggccugcagccuguguuuuaacaagcucccugguggacccugaugcaggcugaggugagaacccuucccacagguucacgcuuacaucaucagcuaccugaagaaggagaugcccucuguguuugggaaggagaacaagaagaagcagcugauccucaaacugcccgucaucuuugcgaagauucagcuggaacaucacaucuccccuggggacuuuccugauugccagaaaaugcaggugggaagcugcccaggagggaauguugggggugggugaugggaagguugguuucuggaagcucugagaugggaccucaaaagccagagggauggauggcagguucuggaaagcgccucccucaaauaguuccgugggagcaugguuuuaugagucaggcuaggggagugaagagaaaacccaaaauaacaguggcuaaauuaagauagagaguuuuucuuucuuuccuccauaaaaagucccagaaagugauccaggacugguuuggugcuuuacagagccagggaucuaguccccuucugucuuauuucucuuccaugccuggccuccaggcccaaggaacuucaugguacaaaagggcugugaaggcuccagccauugugucugcguuccagccagcaagaaguugggaagggggccaggcaugguggcucacgccuguaaucccagcacuuugggaggccgaggcgggcggaucacgaggucagcagaucaagaccauccuggcuaacacggugaaaccccgucucuacuaaaaauacaaaaaauuagcugggugugguggugggcgccuguagucccagcuacucgggaggcugaggcaggagaauggugugaacccgggaggcggagcuugcacugagccaagauagcgccacuuuacuccggccuaggcaaaaagagcgagacuccgucucaaaaaaaaaaaaaaaaagaaaaggaaguugggaaggggaagaaaagaguagucucuuuaagaacacuguuuauuuuauuuucauuuauuuauuugagacuuaaauauuuauauuuguaaaauauaaauauuuaaaauauacacagcugggugcaguggcucaugccuguaaucccagcacugugggaggccaaggcggguggaucaccugaggucaggaguucgagaccagccuggccaacauggugaaaccccgucuguacuaaaaauacaaaaauuagcugggcaugguguugcgugccuguagucccagcuacuggggaggccgaggcaggagaaucccuugaacccgggaggcagagguugcagugagcugagaucacaccacugcaauccagccugugugaccgaguaagauucugucucaauaaauaaauaaauaaaauaaaauauauacguuuaaaaauuuauuuauauauuuuuuagagauuuauuuauauauuuuucagagacucuguuguccaggcuggagugcaauggggugaucauagcucacuguguacuugaacuccugggcucaaagguccuucugccuagccucuagaguagcugggacuacaggcacaugccaccaugccuggcuagcuuuuuuuuuuuuuuuuuuuuuugagacagagucucacucugucacccagaccgaacugcagaggcgugaucuuggcucacugcaaccucugccuccuggguucaagcaguuaucucaccucagccucccaaguagcugggccugcaggcaugugccaccacguacagauaauuuuucauacuuuuaguagagaugggguuuugucauguuggccaggcuggucucgaacuccuggccucaagugauccuccugccuuggccucccaaagugcugggauuauaggcaggagccaccaugccugaccaagaacacuuucuagaacagagcuguccagcaguacguucuacaaugauggaaauguuucauucugcacuguccaguaugguagccacuagccacauucaaauggaauguuaacguguauuucuuuuuucuuuuuuuuugagauggagucuugcucuguugcccagguuggaaugcaguggcaagaucuugacucacuacaaccucugccucccggguucaagcaauuauccugccucagccucccaaguagcugagauuacaggcauccgccaccacgcccagcuaauuuuguauuuuugguagagaugggguuucaccauguuguccaggcuggucucaaacuccugacuucaggugauccuccugccuuagccucccaaagugcugggauugcaggcaugagccacugcgcccggccuguauuucauuuuaauuaauguaaauaagcacauguggcuaguggcugccauacuggacaggcuaacaguagaagcugcacaugcaaccugugcuugccucaguggacuugaacuuagucauacucuggcugccagggaauccagguugcaaccuaggauccccaacccuucagagucgugaucagcuggccucucugccuuggcucaggaaauucacauagggcugugaaaggaauccauuuucgcagagacuguccuggugcagucugggccacuuagaguagcccgugugagaagcagugugacgccaaguccaccccuacaccccaaagugacuucuucgguggggaggggguggucccaggaaccccugaugaucugaucaucucaaaucucaccuccaaauuuggcagccagccacucaguccuuucuguguggugugguagcacugugacaggaauuaagcuuucuuaacuuucuuuuuucucucccccccugcacacuuuuuuguuuugagacagggucuugcucugucacccaggcuggaguacaguguggugcuaucuucgcucacugcaaccucugucuccugggguucaagagauucugucucagccucccaaaguaguugggacugcaggcgugcaccaccacaccuggcuaauuuuuaauuuuuuuuuuuuuuuuuuuuuuuuuuuaagaaauaggguuuugaggccaggugcaguggcucaugccuguaaucccagcacuuugggaggccgaggugggcagauugccugaggucaggaguucgagaccagccuggccaacauggcgaaaccccaucucuacuaaaaauaugaaaaucagcugggcauggugguaggcgccuguaaucccagcuacuugggagucugagccaggagaaucgcuugaacccaugagacggagguugcggugagcugagaucgcgccauugcacuccagccugggugacagagcgaaacucgucaaaaaaaaaaaaaaaaaaaggaaagaaaagaaaagaaauaggguuuugccauguuguccaggcuggucuugcacuccugggcucaagugauucucccaccucagccucccaaagugcugggauuacaagugugagccacccaagccugcugaguuuuuuuuuuuuuaacuuuuaauguuguacgugcuggcugggcagcuggaguuggguagagggcgguuaggguucuaggcugguguggaugcucugagaaagcuauacuugaugcgaaaauauugaaauccuucucugcuagcuggcaaagggccgcugcucucacucaucagaggggccccagccuccccacccuccaguaauucuggggcacaggagaaagccucugggaccuuguugcccaaguaucuucucauuggugggugcccgagcggaacagguuguucagauguucaaauacuucugcaugugucaguaaagagcugccacucuggcuggguacaguggcucacaccugcaaucccagcacuuuaggagguugcggugggaggauggcuugagcucaggaguucgagaccagccugggcaacauagcaagacuuggucucuacaaaaaauuuuuaaaacuaguugggcguaguggcgcacaccuauagucccagcgaauugcgggggcugaggagggaggaucacaaaaauuuagcuggguggguggugugugccuguggucccagcuacuugggagacugaggccagaggaucguuugaggcugggaguuggaagcugcagugagcuauguuggcaccacugcacucuagccuaagugacagagcgagacccugucaaaaaaaaacaaaacaaaacaaaacaaaaauggcugggcgcgguggcucaugccuguaaucccagcauugggaggcugaggcgggcgaaucaugaggucaggaguucgagaccagccuggccaacauggugaaacgcugucucuauuaaaauuacaaaaauuagcugggcaugguggcgcaugccuguaaucccagcuacuugggaggcugaggcaggagaaucgcuugaaaccggaaggcggacguugcagugagccgagauugugccauuugcacuccagccugggcaacaagagcaagacucugucucaaaacaaacaacaguaaaaaaaccccacaacagcuacccccgagcuucuccaguguccugauaccaccuugcagccugagggccucagggauggcgccgcuugaauucugggugccccugucccccaccacaggagcugcugauggcgcacgacuucaccaaguuucacucgcugaagccgaagcugcuagaggcacuggacgagaugcugacgcacgacaucgccaagcucaugccccugcugcggcaggaggagcuggagagcaccgaggugggcgugcaggggggcgcuuuugagggcacccacaugggcccguuuguggagcggggaccugacgaggccauggaggacggcgaggagggcucggacgacgaggccgaguggguggugaccaaggacaaguccaaauacgacgagaucuucuacaaccuggcgccugccgacggcaagcugagcggcuccaaggccaagaccuggaugguggggaccaagcuccccaacucagugcuggggcgcaucuggaagcucagcgauguggaccgcgacggcaugcuggaugaugaggaguucgcgcuggccagccaccucaucgaggccaagcuggaaggccacgggcugcccgccaaccugccccgucgccuggugccacccuccaagcgacgccacaagggcuccgccgagugagccggccccccucccauggcccugcuguggcuccccagcuccagucggcugcacgcacaccccugcuccggcucacacacgcccugccugcccucccugcccagcuguaaggaccgggggucucccuccucacuaccgccagacaccccgguggaagcauuuagaggggaccacgggagggacaaggcuucucuguccgcccuucacaccuccagccucacguucacuuaggcacaucacacacacacuggcacacgcaggcauccauccauccgucauucauucaaauauuuauugagcaccuacuaugugcccagcccuguucuaggcacugggcauuaccauagagaacaaaauagacaaauacaucugcccucauggaaggugacguucccaggagagggcaccuacacagucacgcaaacacacacuaauuccuggcagggcccccagccccuccccuggcugagcagcccuguggcugaaaugacuagcagauaaacagacccccuucugcuccgcuuccuccugcccagccaggcaacacccucaaccggcuccaucacauccucaggucucgggaccauggggggcucagaggggagacacaccuacugcuuccucagaugggccccuccgcagccccuucccuugcucggggaaagcccccaauucugcccacacccauuuauuuccuuccuuccuuccuucuuuucuuuccuuccuuccuucuuuuuuguuuuugcccccaauucugcccauacccauuucuuucuuuccuuccuuccuucuuuuuuguuuuugcccccaguucuguccacaccccuucccuuuccuguccuguccuuucuuucuuuuuugauagaaucuugcucugucgcccaggcuggagugcaguggugagaucucagcucacugcaaccuccaccuccuggguugaagugauucucgugccucagccuccugaguagcugggacugcaggcacgcgccaccacgcccagcuaauuuuuguauuugaguagagacgggguuucaccauguuggccaggcuggucucgaacuccgcaucucaggugaucugcucgccuuggccucccaaagugaugggauuacaggcaugagccaccgugcccggcuucacacccauuucuuuaaaaaggaucccguagcaggcagaaaagccccuuccauccugcuccucugauacugugcccccuuggagauauuuccguccuccacccacgugucuguggcuggaacugcccagccugcuccuggcccccuggaagccuccccacagcugguaaucuggacuuaaggauugcugggccaccgccucucugccuaccaccauuccauauuuaaguggagccccuacguagaaaggccccggggcuuuauuuuagucuccuuuucagggaugucgugggcgggggaggggguucuuggugcuacagcccucuccccaccccuaaagggacgccgacgcuguuugcugccuucaccacauauuagugcuugacccuggcaggggaccccauggaaaagauggggaagagcaaaauacauggagacgacgcacccuccaggaugcucgcugggauucccacgcccaccacugucccccaccccauggcugggaggggccucugaacggaacaguguccccacagagcgaauaaagccaaggcuucuucccauguggcagugaggcuggcuugggacagggaucgcccgcccucccccagggaaagagagaccugggcaggauuugggguggggggaggcccccuuccgugcucucaggggcgggguggaguccgugacucaaugcagcgaggccuggugacucaggccugggcugggggccagaacggcauauuuuccgaggaaaagugacucuggggcccuccccccgggacaucccuuccucccaccucccgcggcgggggccugggaaccaagcccuggggcgcgcgcgggguguguguguguguguguguguguguguguguguguguguauucgggcacgaagugcucucccagcucccgcccugcccggcaacgugcccuugcacaaccuggguacauaacucccgacgcguaacaccaggaacacgcugguuucugguuggggaaguggugaccuugcccacacgggcugccaggagugugcgcgcgcucacgcaccggggacucuuggccagagcugggcagcgcaccgugcgcgccgagucccgcgcacucacauccaggccacacccacggcgucccgggacacgcuggccgcgcacucaucccgcccacgcgggcccaguuucgcggcucgcggcgcccccuggcgga

SEQ ID NO: 15026 - RNA, 27621 nt, Homo sapiens
ugcguugaggucucuugacgccgauuggggggucacgagucacgggcggcgugcggcggcuggugggggcguguccggcggagcgggcgcggcguuacgaggccgcugguuggccagcgcuagucacgugguuccuggccgcaagcgacgcgcgccggugcgacgucaacgcagccgggcgaguuuuaccgaucuguguuccgcggcccggccgcggcugagucuucccagggucagggucaggcgcuuugcugagucccuuuguggccgccauggacaauuccgggaaggaagcggaggcgauggcgcuguuggccgaggcggagcgcaaagugaagaacucgcaguccuucuucucuggccucuuugggugagaaccgggcugaggggucggccgggaccuaggcugagaggacgaaggagucacgcucggagguggcggguuagggcacgcagagcucgggccgaggggacggagaggaaccugcaauaaggugacauggccugaggcggcagaggggacgcaggcugagggccaagagccugggccggggcaacacgguuugaggagagacggucugacauggcggaagggauuugggcugaggacacacggaccgaggcgacacuaucuugaggcgaggaaggggacccaggccgaagacaggccagcgggcgggggagaaccuggaccgagggaguacguccugaagccuuggaggggaccggccuggggggacggagggaguccgggagagaagccagguccagaggcuuuucggagcucuaggggagucuguuugaaggcucucaggcggcagugauggggccuggggcugaggacgccugcccgagggacugaccuuuucaaccccuggagcaguggauuugcgugggcccugggcggugagggugaaggcugaagggggcugacaccaggcagaggggcucagggcuagaugauccuaggagcggugagccgcgucugaaguguggggggugcauggggugaguacggcccugguuagcagugacuaguuuaaggacagcugaacggaggaacccgggaugauggagucaagacuguggaggucucagcacuuugggaggccgaggugggcagauuaucugaggcggggaguucgagaccagccuggacaacauggugaaaccccgucucuacuaaaaauacaaaaguuaucugggccugguggcggguaccuguaaucccagcuacucgggaggcuggggcaggagaaucacuugaacccggagguagagguugcagugagccgagaucgagccacugcacuacagccugggggacagagcgagacucugucucaaaaaaaaaaaaaaaaaaaaagaaagaaagaaagaaaaaagccugaggaggccuggguugaggcuggagacuccugggugggggaaugcguggugguggcuuggccaaggagauggagggauaacagggagagacagggggacugagagaaccaaaacgggggaucaaauuccugcugugugauccucgaguaauagggaugacagagacaugcugagaagagggaugggaaaaggccugggagacagaacuaacacauaugacguggcauaaaacucacguuagcuccuaaaagcugacacgaccauccugugauaaauuguaguggcuuagaagugccaagagcccaaguagcucugccacuuacuucaugacuuuggguaaauuguuuagucucccugcuaaaggagaucacaaaucaaaccuaccucccauuugcuaugaguguuagaauugagccuggcguggaguuacaucucugagaguguuagcuguuguuaaugugacuuccagaaggaaacagguucggagcgugcagagagcugauggggguucaagguggacgcccgagcggagaggucugggaggggucaggagagggagagacugagaaacaugagugugcuaagaggagcugaaagggaacagaaaagggauccacgaagacuuaguaggguugagaggagcaugaggcucugggcagaggaaggagaagggaguuuggcagggggcgguggugugggagguggugggaucugugcugaugggacgacccgaaagggucaaggggagguuguggaaacugagaggagaccugggaaaggacuagugggcuuguagagagaacagugugugguggccacucagaagcagagccuggggacgguggugggacugggaacaucugcagaaggcuggagaaggggguuugggaggagggccuggggaugggaagagacugugguaggagccuggcagaggcugguaagacacgaaggagagggaucuuuacaagagaggaaggaacaggaaaagggcucuaggccacgccccuuguuugagguuggauaauguuuagcaaaauaacuugaagaacaugauggcgaauugccugguguggagaaacauccggggcugauggacuggauugauuaggugaaaaauguuuuauuuuagaggcugcgaggagagagaggguguguguguguuucuuuuucuucacaaggggagaaguucaagugcuguguuuggggguggggccacgagcuggguuuuuggugauaguuuuccuggguggcucugggugucuggucccuuuggcccagggauuagugggcuguuggacugugugcuuggagggagcagcuaagucagccccaaggcauuugcuaccugauugggaaggcaggaugaacagcaaacaccaauaaaguggaauuaccuacuguaaggaggggcucgaugaugucauuccugugacugucugagcucagaggaagcagcgugaaccagggggaggcucuuggugaggagugagcugggccccaaggaaucccaggacuugcuggggaguggggccggggagggugcucuaggcagcagggauggugcaacagagaucuaccgugacgggagguucugccuggaaagacagggaacugagauccagagggaucagaaauggcuuccugggggagaggccccaacccuggggggaugaacaugaguucuggggugcucucuggcagggagcagcacuccaggcaaggauuauuauggagcaugccuuaggaagauggaacacagggaguuccacguuagaccauaaagguggaagcggcaggugaggccagacaaggaaggucuggugagcaagggcugggccuggaggaggcacugaagaucuccgaggaggcuaagggaggcccauccuggcgagcuccuguuugccuucuagaaaggacugcagcagcuggugugggggagagugacagcaggaggcuguugcagugccgguaauacuagcagaugcugguuauuaagugcucgcucugacucagacccuggccugggccaggcucaaccugcugauggaugguauggauuuaguccuuacaaaauccccguggagguagagaaacuugggggcuuagagaaguugacuuauuugcccagccccacaguaagugggagaaguggcauucaaacccaguucugugugauuccagagccuucucacuuagccccuuugcugugcuaccacgguaguuucuccucaagguucaugaccaucucugggcacuacauuuaggaaggauguuggcaaacuagguguguuggagagcugccacccucuuaacuguccucccauggcuguuuucuccaaauaugugaaaaaaagagcugguguguucaucucaguuccuuccagcucccagaggagcugaccuggugcugugggaguaugagugagguuagggcagagggcagggaggaugggaggcuggccugaccggagcuugugugccugggagcugggagcacagccagaggccagcuugggaggaccugcuuggcgggcgggaaucacucaggcaccuccuccucucugaucuggguuugcuuguguucaacauuucauaacccaccuuuauucaagguccuugguagcugccgggacuggagaagggagcguugcggcucagcuuguccuuggugccucucccuuccccuuugggaaccccagcaaugacagcaucccacauugaggggccucugccccugucaaagggcaagucagagagcccgcaccugggacgcaaggcgaugggugucugugcugucgccugccuuggugcucagaugccacccuugcucuucauuauuucugggcugccagacgcuagggggcuuugaugcaccagcagccacugaaggcgacagcaccagccaguuaggagaagcucaaagccauaccuguuccuccccuuggugaugggggcgcagcucaaacuucugcucuggaagcaaaaagacggagacuuccuaacuacagcacagugagccagcagcagaaggggauggcugaguccaggcacacuaguuccuccucccugcugcgugucuccuggggaauccagagugccugcugugccguuuggggauccugcagguucugaauggcggcucuguucccuggggcuuuuccucaucccugauguuucccagccaccuccccuguccccaaaauagccaaaauaaaaacuuccuuccucuuggauacaaacguguagagggaguuucuucaucugugaaaugaaaaucaugguaacuguuuccucaggugguuuuaaggauaaaugagacgaugugugggaaguggugggagcacguugccuggcucugcuaauguuuauuaagggcucacugucaucuuuauuaguagguauugucauuggaaguugagcuagaagugcuggagaaauagguggcagaggguguucuguauacaaacagugcauuccuaagaucagaucuugacaaaucaguuccuguuugaacuaccuguaggcaauaacggcgggacccugggagggccagcuugucuguacagggccugcccagggccuuggcugagacuggugugggcacgagcuuccagauuucucuccagaccgccuuccucugcagagcgugcagaaaccccggcgccauuuccagugggcacccuggugaaucacagugcccugccagcugccaagauccacaacugaaaacuuggcaucucuugcccagucucagaguggagucuuuccugagggcacacaagguuucuggggaauccgagaguuccuggcuuuccugauggauaggacuuugcugccuggccauacaaacauuuccgucuccuuuuugggauggggcuacugagaggcaagggucuuugagaacaccuuuuaagaaaaaggaaguacauucgcccuuggucuguggugaaauguaaucccguuggggugcaggagggcauccguauaagaaaauaagaaacagggcgccugccaggcugugugccguguggcaggugagauccuggcucugagcucaucucgaagggccgugggccuguauguauuuugagcauugugcaguaagggguggggcaugggaggccaggacucuggaagccgaaggaggagcauuacuuagcuaaucugggauggagaugaagcccaugcugcuauucugaaguagggaagcgugccuggaaucgguccucugcggggccugaugagagggaugcucucguuuacugaacgcccgugguguggccagcucucugcugggcacgccguggggugcugccugcaagauugcucgugcuucagcagcccugcaagguguggagucuuaugccuaguuacacauaaggaaacgcaggcuggcacacgaugagcuggcgcugaggccaggccugucugacuacugucagcauuuauuuuauuuuauuuuauuuuauuuauuuuauuuuauuuuauuuuauuuuauuuuauuuuauuuuauuuuauuuuauuuuauuuuuaccaccacaagaaacucucuagaauucccauuccuggguggcaggcaccccuuugagcguauuucucuuccuuuguguaauagcaaccauugagcaccuuuuccauucugcgcucugugccaaguauugacuaugugucauuucuaauccucacaaagacuccucccaggccagauucauugucuccauuuuauuucauuuuucauuuuuugagagacagggucuuguucuguugcccaggcuggagggcaguggcgcgaucauagcucauugcagucucaaccuccugggcucaagugauccucucaccucagcuucccaaguagcugggacuguaggcauaugccaccaugccuggcuaauuuuuaguagaguuggggucucacuguguugcccaggcuggucucaaacucgagaucaagcaacccuccugcuucggccucccaaagcccugggauuguaggugugagccacuguggccagacaugcugccauuuuguagauaaagaauggaaucucagcacuuugggagcagaggcaggaggauugcuugagcccaggaguucgagaccaguguaggcaacacagggagaccccaucucuuauuuaaaaaaaaaaagccucagggauaacuagccccaggucgaacacuuagcaaaguaccugaaacggacuucagcccaggucucgccaccccaaagucauucucuuucuaccccuugucuuugcccagacaggcaugucacaagaggguccuguggcgauuucagagcugggcaguuagccugugacacuuuauucuuucaccguuguuaacuggggcuuguggagagaugggaaagcagagcugggcucaggccccgcccugcaggaacucauacucugcuuggucaggcaaggcccacugcagaguggcgggaggcagcuggugguuucccgcuuccaggugauacugguggcggugccuucaggaugcugagccucuggcagcucccagcuccagugcagucaguggacuagcagggcugguggcccccggcucccugugccaggguggacccugcaccacaggcagccuuaacuuuuucugacguuccuucugccuguuggcuuguuacuggcaggcucgguagggggcuggcuuaauucauacuccuuugccuagaggaugcuccacgcagccccagcagagagcagccucugcucgugagaugagggaagccuaggcaguacaggcucccuggcuucuuuaaucuagaggaggggugggggcaggcagggaccuuguccucccuccuuauuuucccaaggagccuugggcauggggaaggaagccuuccugaucacugagugagaggcaagggcaggacuggauccccagggccccaguccucuuuccaagcccugcugcuuccuggcaggguaagcuuggacaagcccuccgcccucucugagccccagcuuccucgccuguaaagcaagggcagcacccaaagggcucucgugaggagcugugggcuccuuccaggggagugccugggaggcagggaacgccaugcgccagccgugauuaaggcacauggucucgagagccgugcaggaggugggcuuacagggaagacacaggcaugugacgggcccuaggacaccuuccccacugagggugcugacuggagacuuggggcagugggccuuaagucugaggaggaaaccguaggccuguggcuguggcuuccacagaggcaagagagauagagugaguccaggacccgaaaugggggccugacuuuguccacccugccucgugagguccuucgggagcugcagguggugggucucagggcaugguguauuucuggcagccaggaagugccugguggauggaggaaggaaggagggggcuaagacucugcccugcacaacccccuggcccaggucccaucaggcaucuguguauuccuggcagugcccagccuuccauauggcagucccugagguugguggcuguguuugggagaccugagacuccuuccuccgccuuggagggggagagagcaaagcugagcggguaauuauagacagcccugcaucaggcagcccaaaccaguucccucuauucccggaguggcucagagccgugggaugggaggagugaagcagaggcagcuugggggaggucagugggggagggacagucagcugucacaugcgcugccacccaggcccucaggagaggaggcccagcuagauuuuccuuucguguacuguuguuaucuccuggcacguaauaaaugcucggauaccuguuccccaggugaauaaauguguaugugaauggcuucuucaggaucuuccacuggaaccuaggcacgucacuuucccccuuuggggacuucacucccauuucuaaaagaagaggaugggacccuggagaucuccugucauccccuggccaugguaaugggcaagaccgcggggugcaggggaagaaggaggcaagccuggggccugagcagguguuaaucccucuggccuuuccaccccacagaaucauugaccccgugcaggguuggcugugcuuagccugggaucacagaguuucagcccgggcagcugguaggcuuuguguccguccugaaauaaacccggcugggcugacucugcucauuguugauugcccgcugugggccacucagugacgugggucauuucugcccauccagggucugugcuuuuucagagagugcauggagcuggauaggacuuagucacacucaaaaagaagggaaggcugagcugggggaccuguggggugggcagaccugugauuaaggucugaaaaugucccuuuaagagaacauuccagagaagguccuucugaggguuuuuugcagccaggccccaaaggacccuucaggauucucagccagaagguuuugaaaguuucuuaccucuccaaggccaggaauggguucuaaagaagucauuccaggcugggcacgguggcucaugccuguaaucccagcacuuugggaggccgaggcgaguggaccacuugaggucaggaguucgagaccagccuggccaacguggugaaacccugucucuacuaauaauacaaaaauuaguagggugugauggcacacaucuguaaucccagcuacucaggaggcugaggcaggagaauugcuugaacccgggaguuggagguugcaguaagcugagaucgugccacuguacuccagccugggcgacaagagcgaaacuccaucucaaaaaaaaaaaaaaaaaaaagaagucacuccaaacaaggcccaagguguguugggcuggcugaggugaggugggugagggaagacagagugcagcagggcgagugcgggaagaacacauugcucagggccacuucccagggacagcagagggugggggacagcaucagcacagccccagaaggcagaggguaggcuuuucaucuggcaagaugacagagaggauaggaauaaauagauuauuuaccuggugugauguggauucaggaggccaggaucccuggcccaaccagcccgcccaccgugggggcauuuauuugccugcugacauugccaggccuggccgcugaucugaucgcugguggcugcuuuccagguagucggucucagucaauuuuuccuucucaaacucaccugaucagcugaauuaccugggccccccaaaccccaauuguuaaaaaucucauuugcaggccccauccagacccuacugagcgaaucccaaaguguguggcugugggacucugguuugaugaaaugagcacuucauguggcugaaagggaugggcagguuggacacacugaauccgcagugcagagggaaggaaugcucacaucccagcucccaaaauuaccuuugagccccuccacagcugggguugguguggacaaguucccagguauaauguugggccaguugacacagggugugggaugggauggugaggaugauuugaaugggaaaguacccacuccucccuuuucucuuccuuaaaaauaaacuaaacacuaguuaugccagugaagagaggcccugaaauccauuuggugggacuccagaguguguggauuuuauucuacugauuauguagauauugggaguuugagcaguuacagagacuacagaccucgcgggcuaagccugguuguauuauuaagggcagaagaaugcagugggacuuacggguuugagguacuaaugaggucccccaagucaagaggaggcucauuauguacauguggaggucaagaagccagagugaagcugcccaaacaggguacccuuuauguuuucaaauuccugucuaucucccaguguaucccuacuguuggacaauaaguuuuugggggguuuugcuguuuuaaauaaugcuaugcugaacauccuuguaacuuuucugauuaguuuuuuuaggauaaauugcuagagauguaauucauugcuggaccacagggccaaauauaaauccuaauacuuaaaaauaugugugugugugugucuguguauguguaaauguauagauauauacacacauauauacacauacacauauauacacauguguauauauguacacguguguguauauauguauauauuuuuuuucucgaaaagauguacaaacaguuaaaaaaaaauucagacaguacaaauacgggauguccagugaauaagucugccucccacaccuggcccuccuucugcaggcuucaccuuaagagaaaaaugcuguuacuagguuuuuguguauuugcccagaaauauccuauguuuauauaaacauguauguuucuauuauuuucacucucuuucucuuuuuuuuuuuuuuuuuuuuuuugagacaaggucuggcucugucgucguccaggcuggaguucaauggugugaucuuggcuuacugcaaccucugccucccaggcucaagugauccucccacaucagccucucuaguagcuaggacuacaggcgugcaccaucacacccugcuaauuuuuuguauuuuuuguagaguugggguuuugccguguggcccaggcuggucucgaacucuugagcucaagcaauccgccaaccuuggccucccaaaguguugggauuacaggagccaugaaccaccacacccagcccacccucuuuuuuuuuuaaacacaaaugggaacaucuuauaucuacacuuuaaaauagugcuucccauuucuuuguauggcugugugauauauaugcccaguccugagcugguaaugacacacuccagggcugcaaggucuuuauugagcaaccacagagugcaaggcacaggauuaaggcugccucugcgaaagcaacacgaugucuuaaacugggcuagucccccagaaugcuuugcagucucccggggaaaggggauuuguagcgcgccugggacccagugggccccuaguaucccaggcaggaaguagaagaggcugucagacccugggguugugguggggucaggaacucuucgccccacuaccccagcaagcacccaguaucuaccccaguacucccggagggagcuggucugcccgaagugagugugccauuguaugcaggggcgggggccacagacucaagaggccugggggaagcuggcuucacaggugaagggugagggguaggggcacgucugugcccggcacuggagcagaaugcuugcuuucuccuggauagccgacuagauugucuccuuuuuuucuuuccuuuuuccccagaggcucauccaaaauagaggaagcaugcgaaaucuacgccagagcagcaaacauguucaaaauggccaaaaacuggagugguaugucaucuccgcuagagcuccuccaaggugcucuccuccucccucagcuuccacucacacaggccugcccgagagguuggccuugagggcccuuucucuuuguaugcccucuccggcaucggaaagccacuggccugcucucuuguuuugugccugcuggguuacuuuauacucugggucauggggccuuggugaaaggacagagaggaugggaauaaauagauuauuagaccuagauaaacccauguggauugaugagcucuuagaguccuccuuaaauucagaacuucagguuuccugguaacuuccuuagugcuuccaucagugucuaaauucuaggcugggggaggauguucaggugauuccaauaacaacgugaaucauggcugcuguuuguugaguccuaagugcucaucauuuaauugcguuagcacagcagcccuaagggucagucuauaaauaucccuauuuuacagauuuggaaacugaggcuuggcuuagucucuugcccaggaugccagaacuaguaagugacagaaccaagauucagaaaccaaggcucugacugcagagccugaguguuuaaccugccccagugaggcaggauagcuucacagaggagagggguggggaggagccccuugggcucagggaggcuggagaucuguuuggagcucccugcaggcccaagaaguccaacaagccaguguguugagcccuuucgaggcucauuucaucauacaucuuucaugucaccaagauugaauuaaggaaauacggcaagagacccaguguuugaaugcagggaggaacuucugacuguggaggagagggaaccugguggugggaccauggaggcagggugcagaggugcacaauaaaauugauuaucaucguuuuugagaauguuguugguuuccccaaaauucaaagaguuauuccugaguuuucacaaaauacguugugaauaaagccaaauguuuuuuguauuuuuaugcucccaaacuuagaaaauuccucuagagaaaaaaagcuuauuuuuuaauuacauagguguugcuuuuccccuaaaauuuguuaccucugcccccaaacucuucaaagaaaagcccuaggccauuuccccccgguaauauccccuuuucuugaaauuuuuuuuuuuuuuuuuuuuuuuuuuuuuuugagacagucuugcucuguugccaggcuggagugcaguggcgcgaucuuggcucacugcaaccuccgccucccugguucaagugauucuccugccucagccucuugacuagcugggauuacaggcacgugccacuacgcccagcuuauuuuuguauuuuuaguagagacagaguuuuaccauguuguccaggauggucuccaucuccugaucucgugauccgcccaccucggccucccaaagugcugggauuacaggcaugagccaccgcgccuggccguaauuuuauacucaaauuuggaacucuugaaaauaaugaaaucauauagugaaaacccggaaggcuuugucuuuucugcugcucaaaacuuaagaggauagggccaggccuccugguccucuuccagcuuagaaacucugacucagauucagcuggaggagaaugaaggggagaagccucagagcugagcuggagguggucagcugcacgaggaggaggagagaugcugcugccucccaaacgucaguuaggagaugugugggcagaauggcuugggacccacagaagcugaccgugugcagaugagcacaggauggaugaggcuucaggcacggucucuucugcccuccgcccaugggcacuggucugcauguauucauucuugcuguccacauccuguuucccucucuggacaugcagcuccuggagggagccggcucuguguuguccgaccccaacuccaugagccucacaauucaugcaagugccuuguccauggggaucugcagugaagggaacagaaugugaacagaggcagaggaguugggagaaucaggaagagcuuuggggagcuguggaaaaagaaacaggacuuggaaaggggaguagaugggaagauguuaugugguuuaaucucaguugccccuugcuucccaaaauaccccuccgaagccaccccaugauuucagccuguacuuugccuucuaguggugguucugggcccugugcuucgaggcuccccuggggaggacugcccaggccgggaggugcaggaggccaccucacucuguuuuauauccuuuccaacucagcucuaucugccuucuccuuggaucuuuagaagugguggcccuggaaaugcuggcauagcugggauuagggacaugguguuuuaccugggcuuacccuggcucucuuuccauauaccuggggcucagggccuucccccgaggcagcuuccugccgcccucagagacugucaggugggccaccaggagccucagcgcaggagccagcagaccugagcgcaggagccaggagaccugaguucuaggccucggucugggcucgcucaggucacccucguccugucuuggggacucuuuccgcauucucgagagcccgacccaccucccagggcagugucucuguggcuucauaaaguguggagccccacugaggccaggacugcccuucucuucuguuccagcugcuggaaacgcguucugccaggcugcacagcugcaccugcagcuccagagcaagcacgacgcagccaccugcuuuguggacgcuggcaacgcauucaagaaagccgacccccaaggugagggccucugcgggccacacgggcuggcuguccggagcgccauccuagcacccugcauugauuccucagguuuccuggcggcucugguuuuuccaguggccgacaugugauaggcuggcaggggcgugccugaggcagagugagcguugacuuuagaacuggcucucuuccuuccaguuggcauucgcgcccugcucaagucuccgccccccuaucuaccgugucgguggugucggugcagcugaucaccccuucccaaucccggagcauuugggagugggaguuccauugcagacccaccgccugccggggagagaggaaaaucuguucuguugucagaauuaacaugcagaagggagcgguguggggggcggggaggauucugagaccagccagguaggaguugcugccgaaaaaggagcggaaauuagcccaaccuggcuucccuacauccuggggaggaauuagagagaacagagcccgagauguaguugccagagaacaaauuacuuaaaaugagagcgugcuagggacagaaacccaguuuggggcugacucauggugagaaaacaguuuugucccccugggugccucccgaagaggagguccagcccaguguuugcuugcauguggcgggaauuuuaauuuauuuuuuaaaauguuggugccagguacagguugcuaauuagaaagcacaggcaguuuuuaaaaaugaccaucuauugucacugucaucucaggggaauggaaaauauaugaaucuuuaaaaaauaaaaagcagcuauauaaucuuggaauaaaagccuguccuucccaagagaagacagguuugcagcagugcagggagcuuccuccauggaucagugagcacugguucacauggcguguuugagaacugcuggcauaccccuuugucgugaucugacguguuaguucccagaugaggaugaauuuguguugaccaguagcucuucucuguccuuagacugaccaguugcuccucagcagcugggcaucucaugcguuggccucaguggucacaugguggggcucaggccuggcaagaggccgaggagcagccuuguaacugggugggccauggggcuugccuggcugguagcacugggccacagcaggcugcgugguugaugcagugaugacccagggagacccuggguugguuuuaagcuugauucaccacauggagucuccaugccuuccauuaaacugccccgccaagccuuuccuucugcucccugggaaacugguuggccuagaggugcugucuuagcaucugugacguucagcugcugccccaucuggagugacuggaaggacacucuggggcaacacugagcgccaggcugccgaacagagagugccauuugcucuuucagcagaccccucacuuccugcagacaggcccugccuggcagugggauaugguggggucccuccccugcguuugaucugagcuuuucuagcucuccagcgagacucugcagggugugggccuggagucuggauguggccccucccuggccuuaggaagcucagaagguggcugaggacuccgaccgguaggaaaguauaaagaugauguuacauccagggcacagaggccaacuugcacagagcugaggcugggggcgugaauuuggcuaugggagaucuuucaaggaagaaagggggcaguucugaaaggagagccucaccuggguagagcugagagcaggugccguguccagagcccuggggacgugguguugagcagggaaggguguuagugcagcuuccagagcuacagccuaaagauacgcacgccagccaugacucccaguggggcaaggggcacauuggcaucaagggcaguggcugcuuugugucugaggcuagucaggccucacacaaggccaggugcaguggcucaugccuguaauuucagugcuuugggaggcugaggcaggaggaucgcucaagcccaggaguucaagaccagucuggacaacauagugagauccuguccccaaaaaaaagccucacagagaaugucauguagcaacuguguguggcucagcagcgcaggugguggguggucugggaggacccugccuccccugugauccugggcaagucagucuuuugggccucuguuuccucgucuguuaaagcagagacugcugugagaugaugcagucaugcccagcgcggcaccuggugugugauaaacuuccagucaggacacccuuggcuuucaucaguccaggggccccugccugcccugggcuccccacagccucugcccuuggccgggugccuugugagacagcgcuggaggcccgauuuggaaccuugccuggcuuccccaagcagguggccgguacccuggggccguccucaucacuggucuccucagcagccuagaaggccucugucuugggucagcacuucuagggcuuccuccaggacucccuccagaaggaccugcccccaaguggcagcuggagugugccugaggcccgacugggcucccgaauuccucucccucucgcagaggguggccugcugccaccuugguggcucuggguggggaagggugaugcucauauguguuauugguuccucaguuacccaaccauggcugcugcucagggcagacucgggccagcgaggccucuucccaggccugccugauaguugggggugggggcaguguguguaccuggggcagagaagcgaccuggccccugcuugucccccacuuccuccccagcugccauuuacuggguuucuacuguguaccagaugcuuggcaucuuuuaacccauuugauuucuuugugcauucugugauuugcccccauuuuacuaaggaggagaugaccaaguguaaccaggaagggcuucagagacgcagaagucagguugggcgucgcugguaggagugacugcggggaugggcgguggccugggccauagcuccccaacuugggcuguauugcucugagccccuuuccagcccucuguggguggguacaggaggggccaggccacagaacuggguguugcucugccuguccgagugcacaaggccuggugaccugagauaagaguagcagucaugagugugucagaagcucguccaggagccagcugucccaggugucugcugguggcccgccgcuuuccagacauggaggggacuuaaccccgugaguccauguugcugccugggggguaagcugucucccugcugcuacugcaaggacugugccaugcugacggcgggugcuccagagccagugccagcaggcccagguggcagcugcagaucucacugcucacugcggagcagcagccuuugccgccucagcccacagggugccagguugguguccuggguguuccggccaggagagugaaccagugagcagcccggggccuccauguggagacugcagccagguggggcggggcaaggcgggccucucaccucacuccagcugcugcucuccucugcagcguggcccggcuuagccguugcuucuggguccgccgauuacaggauguaugugucuucaaacugccggauuuagguuguguucucuccccuuccuccucaucugcccccuuuuugccaccguuuccacugucugcugccacagucucggucugucagcccuagaaccuggacugagugcuguaccuucucucagucccuuuuagauccccagaggucuuucugaauuggacaaaaccuacagaccccacuccccagaggagugcuuauggaccccacuguuuacaugucagaaggagggguuggacucccugaaagcccagccacagaccugagacaaagagccucuguccagaugccuccccacggagggaguuuggagucccauccagaccgugagccccuugagaggagcccagccccggcgcuucuugguagcacccucuucucaggcgaacauggccugggugaccauggagacccccacggugaccaggaacuuucagaugcccaggcugaagcucagagcccaugcccuguggccuguccaagcucccugccuuucccucuccccaacccaggccucccuccccacaacaccccuguccuccugagaugugcuaaaaugguguucuuaaaaaauacccccugagagcucauuucugucugcuagaaaaugccucccacucaugcuuuucucucuccuccaaauaacuugucaaaaaaaagccuuucccaaauuuaaaaucuugcaagagauaguacaacaaagguagcccaguucuuccucagugccauccugguguguucagguuuuuuggcaaaaccuuugaggagcugguggguggcaggacuagguuaaagggacugagcagagggcucccgacugcugagcuacgaggaagagggggcaguggagagcacacugagggcucaguguugaugacauccagccuccucgugccagagguccagguccuccuggugcaggagcagaagcugcucaggauccugcagagaugguggcagagcccagguagaaccuggcacccuguugccuccaagaccaccucagaugcugguuuggccgccucccaugccuccuuccccuuugccagcagcucaguccuucaagagcagggccuuggcaggucugucuuaaaacaccgugggagucuggccaucauccuggccuagcacugcugugcccugucccugggguugugggaagcugguagcauccuggcagcccgaggagagaagggcucccccagaagcaugugcccagcaagucacagucugcagagucagcccucucaccagauuuccuggggcucagggauuccguccccuucuucccagccccuugagaguguguggcagcgcuggcagcucugagcgccuauugaucucucugcuggcagccaggugcgccugcguccgccuccucuccucagcuucugcugaaacgacuucacuuucucaugucuccucccaccucccuuucucuccagaggccauuaacuguuugaugcgagcaaucgagaucuacacagacaugguaagggcugcuugcuuguccugacacccccgggucccacugcauugccccagccuugcguccccucuuucagcacccccagcacuguucuuauucugcggccaaaccacuuggggagggggaagugggagcuggggggauuaggucaccugagcuggccugggcuggcugggucuucacccagcuccccaccagccugacggcccccucacuccacaggcagucaugguuuucauucauagaacuuagguuauugagcugggcaggguggcucaugccuguaauccuggcauguugggaggcugaggugggaggaucuuuugggcacaggaguucgagaccagccugggcaacauagcaagaccuccucucuacaacaaauuagccugguguaguggcaugcaccugggguccuaguucuugggagguugaggcaggaaaaucgcuugaguccaggaaguugaggcugcagugagcugugaucacaccacugcacuccagcguaggcgacaaaacaagacccugucucaaaacaaaaaaagaaauuagguuacuggagaguguguguccggcacuuccccuugcccagccuucccgcaagugucacauuugauaagcaucuugcagcaggccacagggauaggcagagcccacaggaggcucagcaccugcccugcccccagggcgcguugccaacgacagaugcagaccagaugggcagcugccaacuggagccagagugaagggucccacccaggccggggcuccugucagugcuuucucucucucucuuuuuuuuuuuuuuuuuuuuuuugagacagaguuucucucucaucuaggcuggaguucaguggcgugaucuccacucacugcaaccucugccucccagguucaagcgauucucgugcccuagccucucgaguagcugggauuacaggcgugugcuaccaugccuggcuaauuuuuguauuuucaguagagaugugguuucaccauguuggccaggcuggucucagacuccugaccucaagugauccaccugccuuggccucccaaagugcugggauugcaggcaugagccaccgugccuggccagcuccuuuuugccucuccgcuugcccugucugucucagcccuccaaccccaggcagggacacgagcccuaccccuugcguucagggcagugcugcagggaugacugugauuagaacaauaauagcagcugccauuuauuaggccagacacugcagggugguuuaauccacagcccugugagguuggcauuauugucauccccguuccuuaguggaggagaggggcucagacaagugacaugauuugcccagggacauguggcuacaagcaggagucacugagacccgaaacaaggucuggcugagcccagggccuugcccuuuccuacugcccucagcaaggggguggcguuggaccagccccuggugcagagcaguuaggcaagcgccuggacacuggguggaggcggauggaaggugcgaggccccuuggaaccugaggccucccuggggagcucugggugugccugggggaggcugacagauagguguuggccugggggcagagcugguacucuugggcagaggucucaagcccucccucccauccugguuucuccagagcccuuugccaaguggcucuggacugguccuuccgccucucuggcuguuaucagaggcuuccuaagggccagggccuuggccaagugcucgugcucacauucucucuggugucacaccaucugugcccucguggaugggauggaauuaggcuaaggcccuggaguggcuuguccaacaucacccgcucagcccagcacgcauagccaggccucuagugcuggggcccucccuucucacuccuguguucccccaccucucgaucuucuucacaccucaggucuucuucauaccuccucacaggcguggcugaggggugggaacuugaagggucauaggucagcaggcaggcacgcaggaggucaugagucgcaggcagccccuuccuguguccccuccagggccgauucacgauugcggccaagcaccacaucuccauugcugagaucuaugagacagaguugguggacaucgagaaggugaguggcagcagggcccugcaugggcuggcagccaggaccagugcugcucucucuucuucccaccaggggaguccucuggugucugagugccgagaagggggcauggggcgccggcagagcuuggagaauggggucuggcugugucccaggcaggcagggcggaggguguggaagcuucacggaggccuccucucccuucccugcccuccccuggaacccaucccccgugucuccccaggccauugcccacuacgagcagucugcagacuacuacaaaggcgaggaguccaacagguagcccccuuccugccugccccagccccgcagggaccgccaccacuuccccucacuacuccuccccacacagcucagccaacaagugucugcugaagguggcugguuacgcugcgcugcuggagcaguaucagaaggccauugacaucuacgaacagguggggacagguggggauggcggcuuccacccugcccccucucagggccugugccuccuccuaagccccggcaccuuguucuggaaccaccccucccccggcucacccucugccucucccccgacaucccuugccaugucauccccccacccugucuucagccuggcugaauguucuccaccuacgacuccaugccgugccagcaccgucucucucccuggcugugccccucccacaccccucgcagagcuuccuggaggggcccagagugaggcuggcuaaagaacccagagggagggaaugggaagaagugccaagaggcccaggguggccgugggcaccccaccccauggcccgaugguccucauccacagugggagggagggagugucacaugggguccccccagcgugcacggagcccugggugauggccgagaaaaaggcaggcagcuggcccccugggagagaggggcgggcgccgccucucauguucccaccgccugccgccgcucugcccaccgccaugccagccucccguugguccugacagccaggcugccuccuucccacugucucaggcucucagaaggcccacgaacaccuggcuacagccuccacccccacccagccaccaucacacccugaucuuggucgcucacgcacuggccgcugaccucuccaagcuggucccuggcucccugcccuugggguccuggguuaacagggccucaccucgggacaugaaccagcucccagcuggccccccagugccuggcaguggcucuggcccucuggcugcuugcccugagcucaccagugccacuucuccauggcuacagguggggaccaaugccauggacagcccccuccucaaguacagcgccaaagacuacuucuucaaggcggcccucugccacuucugcaucgacaugcucaacgccaagguagcacaccccacgcccgcaggaccaccgcaccaggccaccaugugcuuaucuccaggccaggucccguugcccccgaagagggacgugcuccucccucacgucuggccccugccagccagccuuuggaugagaagugugguucucacagcuguguuucugugcuggcaucaccugcccacccagcccuggaggcuuuugcggguccagcuccugccucacuuagugcucuuuccuucaugggugcacuuuuugaauccucacugcaccccauuaaagucagcaccauugucaccgcgucuuaugggugaagauggugaggcugggacgagagucccuuguuugaggccacaugacuagggaccugcagccccaguguuccagaucuuugugacuccugcugucguggcuuuagcuguagcucacacaugcccaccuauuuucaggacacuuggcaaaagaggggccaaagagggcagugggagggggcguggccagcgggaaggagcuggaggguuggcgcuagauuuugcuuggccggaguuuuuuuaccauugccuggcagaagcacggaguccaggauuuccuggugucccuggcucacggccuggggugguggccccacacaccccacacacacacaccccacagagcccugcccugcugugggcaccgguggugggcaaaagcuugggcuuugucagaccagguucccauucccaccccaugucucaccgugcccugggcaggucacugccccucucuggaucuguuuccucacuuugaaaagggggcucaccgucauuugacccucucaggguccucaagaagcaccagccccaggccuggcauggaggaugugcucauuuguccccugccccagcugagccaggugggaggaggcagugggugccuaucuggggaaccuucccccuccacccaccucucccugcagccaucucugcagccaggcuggugcugagcucagcuacgggaagguacugacagacacagagccaggugacaccugaggcugggggaggggugcaagagcugacucaauaucacccgacauccccaaguccccucagcugcuaggccaguagcucugaggacccucuuguuacuaacucaucuucucccuucccugcugcccagcuggcuguccaaaaguaugaggagcuguucccagcuuucucugauucccgggaaugcaaguugaugaaaguaagugcugggugcuccggccucccccuucccgaaccucagacggggguggcuggggcuccaggugggacaaucgccaagacuuguccaguaguucucagagggugucuuuguuuuguuuuguuuuguuuuguuuuguuuggccauuugagucuccauuuuccagaugaagaaaguacaacucggggagugcuggagcucaggauggcuagguggacacacacacacacacuacacacaccacaccacaccacacacaccaaacauacacuacacacaccacaccacacacaucacaccacaccacacacaccaaacauacacuacacacaccacaccacacacaucacaccacaccacacacaucacaccacacgcuacacacacaccaccccacacaccccacacacacuacacacacaccacacacagcaaacacaucacacaccacacauaucgcacacacacuacacacacacgacacaccccucacacaaaacacauugcacaguacacacaccacacgacacacccccccacacacaaaacacacugcacacacaccacacaugacacaccccacacacacacauugcacacacacuacacacaccacacacaccccacacacacaccgaacacaccacacacgcaacucaacacacaccaaacaccacacgugccccuacacaccacaccccaacacacacaccacacacacacacaccuccaccacacaccacacccaacacacacaccccccauacccacacacacacacauucugugugauguucuauguugguaagguugcccugagagcaagccguuucugaugaauagggcagcaggaucgcaacacgcccguacccauccccaguuuaacccacacggauugacccucugagaguccucaggaagccccagccccaggccuggcauacagauagcguguccuuucaucuaauccaggccagaccucaggucagcauaggccccugaccccucucugccauuugcuugcagaaauugcuagaggcccacgaggagcagaauguggacagcuacaccgagucggugaguggccagcauggggggccaggccccuucacggggaugggucuccuaggaaagcugcccuucucagacacgcucuccaugacauucacccauuucaucuggcccccagcccacugugaaguucuuucuccagucaccccagaaaccuuacaaguagcgccaagaggcgcagggaguguucuccccauuuuauagaugguggcacugagguuggggaggucaggaggcucggccuuggccccucagggacagagcugguguucagagccacaucugucugccucugaagaccaggguuccuugagucccccaggugagugugugagacucacagugggcgccuugggcacccaggaggcacagacggggagggaaggggugagaaggagaguggagcugaggacaugggagaggugccagcuucccucugccugguggagccgcccacgcggcucucucucccuucccuuucucuguucccagcauucccgggcuuagugguguccggcucagguccugauucacuccucuaauggcacaugucaagcauuucucccuaggugccccuugggaauggaagccccuaacugaggacagugaaaaugccauccuguuccuccugccccagacaguggguggcaacucagccaggagcucagggaggggaugcccagcaggccguggcuucucucccccgugucccauggcacucaggaguggccuuuuccauaucuccaggccucaguuucccacccauucagugaggaugcuggacuuuuuuuuuuuuuuuugagacggagucucgcucugucgcccaggcuggagugcaguggcgugaucucggcucacugcaagccccgccucccggguucacgccauucuccugccucagccucccgaguagcugggacuacaggcgcccaccaccacgccuggcuaauuuuuuguauuuuuaguagagacgggguuucacuguuagccaggauggucucaaucuccugaccucgugauccgcccgccucagccucccaaagugcugguauuacaggcgugagcuacugcgcccagccauggaccuuuuuuuuuuuuuaaagcuacaauaucuuucucccccaagggaaaugaugugcccagcauagucaagacagacaagagggagcucccauggcugaguuggggccucaagcccucccucuacuccuccucagagaccaggggugacagagacagaucuugaaaaccuugggacaagugcccuugggcugcaggguugggaacggggggagcauggccagccuaucaccuggugugcccucaggugaaggaauacgacuccaucucccggcuggaccaguggcucaccaccaugcugcugcgcaucaagaagaccauccagggcgaugaggaggaccugcgcuaagccccacccagccccccagugcccgucuuccugucccaucugcucagagagagguggggccgagacuugcuggagagcuucccuccuuucccaucuggggagugccgcgggccacagugggcagguggcaccgggggucagcaugcaggggcgccagaggcccaggcugcuggccggacagucacccucuguucucgcuacaucccuugcccccuguccauuuauuuaagcccccauaggugcccuucacccccaaaaccagcuguacagaaucuuugauacagaccuauuugcuaggggugcugccggggauuuggggucagcaucuggcccccuaucuccugaccagcugagucaugaggccgguuucucucucucucccacuuuugucccccagccaagcucuaaagcacauguagccgcugagaccugcuguuucugcugggggcaggcuccucuucccccagccccgggagccucccccagcuuccugcagccccgaccucucagguuagacccugggcccuggagcuuaggggauucuccccaccccagccccacaccugcuccuucccuaaugcuuugagguuuucuugguuggaagcugcagcuggcccaagaaagaaaauaaaaaacaacacuuuugcaugagucucucuuccuccucaccucugcuacccacucugccccugggcc

SEQ ID NO: 15027 - RNA, 3509 nt, Homo sapiens
cccgcgggggcggagcuaggcugccugggcggggccggaauccugacaggcggaguuagagcggggggcggggucagcgcgcgcggguggggcucuggccaugggcauggggcggggccgucagcgggggcguggucggggugucgcgcgggaacccgcgcgggaggagagcggggauuccggaacuagagugugggagccagaggccguagcgggcagggcucgagcacuggaguagagcaguccgacagguagagaagugagacuggcugcggcacagggcggguuagggcuccaggcagggcuugagcgggacgagggggcgggcuccgaggcgggcuagaugccugggcuggaugaaguccgagucugggaagagaaccguguuguggcgggaggaggcggugauuggggugguggggcuaagcgcgggggcggggcuggagcgaggggggcgggguagcaccuccgccugucggugguggggcggaggcuggagggggugggccuaggaugcggaggcggcagcucgcgugggggcgugaccaugcuggcgggggcggggccggaggcgggcgguuuagagagcggggcggucugcggggugggggcggggccuggugggggcggggccugugcggucugcggcgcggagccgagugggcugcggggaugcgggggaccagcugcgugggcggcggcgccgagagccccggaggcgcggggcugagcgagggcccgcgggggcgcuggcugcgcuuggcuccgguaugcgccuacuuccucugcgucucgcuagcugccgugcugcucgccguguacuacggucucaucuggguacccacgcggucucccgcggcacccgccggcccacagcccagcgcgccguccccuccgugugcugcccgcccgggcgugccgccugucccggcgcccgccgcugccucccucuccugccuccugggaguccccggcgggccgcgaccccagcuccagcugccgcugagccgccgccgccgcuacagcgacccugaccgccguccgagccgccagacacccagagagacgccagaggccgcggaggggcgaagacccggguaacucucccuuccaccccaacccggaucgccagcccucgagagcucugugcuccacgccgaggaugcaccgucucuggauugguccggccuucuuccuaaugacaucgcucagcgucucuggagccgucaucccgcggaaugggggcccagggggugucagcucggggccuugccucuugcagcuacucuguggucaggccggguccuccaccaucaggaagaucccauccugagcucugucuccugccccuccugcugugggaugcugagcacagagcccacagcccaucugccucuucaccucccugaauccguguccaucugcaauaaacgacagccucggcugccucgugcugugucuguccuguugucugcagagaugccuccccucccaaguuugugugggaaagaccuuccugggguguggccuuugucuguuuugucccgggugggcuguuccccuuccuuaaggagcucuucuuuucuuggaguagggagaagcagcuuagcagcagcagggccuuugaaggucagacagugggaagggcuucccaguuuuuugugugcuuggagcaaaggacaaaugucucuggggagaagcagagugucugcccucguguuacagcacaggagacaagaggagggguggggugauauaggacaauagcugggguucugggaauugcuguugguguaauuaucaugucagggacagaggcugaaucacccagggaucucaguuggcugccgagagggaacgaugcuggcccacuuccuggggucagagagaugagaguggauggcggcggcggugguguugcuucucagccugucuggaaaucucagagccaaugaccaaagcgcugugcugccuuggaagacuggugcagccucuggccuggggcgcugcuaggaaaccaaggccgggaaacugaggucuagcuucugggcaaggaguccgagguggggaggccauguuccauccuggaagacugaggccuggcucuggacagggccugggaucugacaugcaggaagcugguuccuguccagccuccccgcuugagcuggaggccuucccaggagagugaggcugagcaucuucucccacgcuguggcuccuggagaucuguggaggugguuaggaaggucagcugcucugcucaccuccccuuuaccccaccaccacuccccagagggugguugugaaggggaaucuaggaagccagcacuucuuuguagucagcauaggugauaguuaggggcacugacuggggcgagacuacucggguucaaauuccagcuccucucauuacaaacugugugacuuugggcaggucacuugaccucuguguuucuuuuuuuuuuuuuuugagauggagucuugcacuguugcccaggcuggagugcaguggcaugaucuugcucacugcaaccuccgccuucugguucaggugagucuccugccucaaccuccugaguagcugggauuacaggugcccaccaccacacccagcuaauuuuuuuuuuguauuuuuauuuuuuauuauuuuuauuuugagagaagucucacucuugucccccacgcuugagugcaauggcucgaucucugcucacugcaaccuccaccucccagguucaaacaauucuccugucucugccucucaaguagcugggauuaaggccccugccaccacgccuggcuaauuuuuguauuuuuuaguagagacgcgguuucaccauguuggccaggcuggucucgaacuccugaccucgugauuugcccacuugggccucccaaaauucugggauuacaggcaugagccaccacacccggccucuguuucuuuuuuuuuuuuuucuuuugagacggagucuugcucugucgcucaggcuggagugcaguggugcaaugucggcucacugcaagcuccgccuccuggguucaugccauucuccugcuucagccuccugaguagcugggauuacaggcgcccgccaccacgccuggcuaauuuuuguauuuuuaguagagacgagguuucaucauguuggucaggcuggucucaaauuccugaccuaaggugauuugcccacuuuggccucccaaagugcugggauuacaggcgugagccacugcacccagccuuauaacuuauuuaaaauuuuuaagcauuuuuuguuuguuuguuuaauagaaaugggguuucacacuauguuagccaggcuggucuugaacuccugggcuuaagugauuuuccuaccuuggcuucccaaagcccuggaauuauaggcaugagccacugugccuggcccugccucugugguucuguagaaugaagaugcuaaugguacuucuucauagacuugcucugaggaauaaauaaacuggugaucucaagcccugag

SEQ ID NO: 15028 - RNA, 12026 nt, Homo sapiens
gucugacauccuuacucagccagccccacacuaggcacuggaaggugagucacucuggugaggcgauugcgauugggugagacccaguaaggauggaaaguguagaggagacaggaauccacggcuuuggaaaaaggaaggacaaaacucaccaaaccagagcagggcaggaaguaacaaugagaaacugaaaaagaaacggaauggaaagcuaugagacaggaugaaauuuggcauggggucugcccaggcauguccaugccaggugcccagggcugcuuccacgacguggguccccugccagauuuguggugaguguggccaggugugcaugcuccgacgugugugcagugggccaguuagcaagaagcugucacaggugugacuuugugacauguguggguggucaguuucuucuaugucugauuugguuugugucucugaaugucaguuucuuuccuuuauuuuuauuuuuaagacggaguuugcucuuguugcccaggcuagagugcaauggcacuaucucggcucacugcaaccuccgccucccggguucaagcaguucuccugccucagccucccaaguagcugggauuacaggcaugcgccacaacgcccggcuaauuuuguauuuuuaguagagaugggguuucaucauguuggucaggcuggucucgaauuccugaccucaggcaguccacgcaccuuggccucccaaagugcugggauuacaggcaugagccaccgugucgggcgaaugucacuuucugauaguuuuaauguguuagcugugaaauugugugagugcauuuguguaugucccugugggagugugauuuggauuuggccguguauccagguaucccuguaacaggugucuguguguauguguguguccccugugccuaucagcaaguuuguguuuccugauaagcacuccgccuaugucugugugguugcaccaccguguguguggugugggugccuguucgguaggguuguuugugaacacaguuugugggcccaggugugaucaucaguguggguguuucugcaacuguguguggcccugucauuguguccgucugcuuguccaggggacccuguuagugagucugugcauuuccgucuggguguguguaagugugagccccaucaguaugugagugugugugcucaugccccuguccaugguguggauuugcgagacuguggccuugugucugugaguacauccucugggcucugccugcacgugacuuuguggacccuggaacgcccgucggucggucuguguacgcaucgcuggggguguggaucugugggucccagucaguguguguguccgacugucccggugucugggcgaucuccccacaccccgccgcacagcgccuggguccuccuugccuugggcuaggcccugccccgucccccgcugcagggaaacccccggcgcggagguaggggggggcgcggcgcgcgccugcaaguccugacuuguccgcggcgggcgggcggggccguagcgucacgcgggggcggggcgugggacccgccgggcgggggcggggcggggcggggcggggcggcuuuggagcgggcccgggauccgccgggcggccugagacgcggcgcgagccacaugcgagcgggcgccuggcggcggcggcggcggcaccagcgaucccagcagcggccacgacgcggacgcgccugcggcccggggagcagcagcagccacagccacagcagccgccacugcaguuagagcggcagcagcagcgacagccacagcagcagccgccgcggagagcggcgcucggcgggcgcgcccuccugaaggaagccgcccgccccccaccgccgcccccuccggcguguucaugcccccggggugagugugcgcgccccgaauccucuccggcggcgaucggccaggccggguggacucccuggaggaggugacaggagugcaggcggagagcagugugggcgcccugccuccccacaccgcgccucuccaaaccccgcgagggacccugggccagggucgccgggugagaggcggcucggcguuggggcgccggucugggcgcacaggugccucggcggucuggcggguuuguuuacaaacaauggggugcgggcucggcagcgcccccuggcggccagugcggccccggggaagagggucgaccccaggggugccccagcccccaaaguccgggaggggcgggggggcggcacggaggggcggccacacccagggcgcgcgcccgcugggggcggcgacggggggcggcucgcgggccguggagucugcggcuccugcgggcgggggcugcgccccagcaacagccgguuauuggccccgcgcucgccuggcgggcggggcgggcgcacguggcggcgguggggggggcugugacagcggaggggggugucugggaccgccgugggagcgcgcgugugcgggguuguggaucugcaggugucucgccugggugugugcgcgugucuggcuccgaguuugugcuggguucugcagggagugguggugucgauccagaggaauguugggguuucugacccgucggggugucugcgugaguccccgcgccuguuugugugggguucugucugugggugcccugcuugugggguggguggaccugcguguguugucggugagaguugucugugugugcuguuccgggaugauacugggggucuguggugccugcgugugcugggguguggagguuguaguguguguguguugcuggagugagcuguuuguguguuuaugugugugucuugcccgagcgugcgauaugugugcuugugucuugccuguguguuucugucuuggcugaggccgucucuguaucuccggggcaugugucuuuugcccagcguuugugaugcugcgccugcuaaaugcaaaugucuguuuucuguccaggugucugugugaguugucaggugugaguguguguguguauguauguguguggugggggguuguuucagucuggguuuggcuugugugucuggcaucagcgucugggauuugaggacccaggaucuguggggucuaugcaguguagacgguggguguugcuggcagccucuggaugggguugugucugagccuguguguguguguguguguugggucugaggggcuugucacugugaucggcuggcucaugugugucaugugggcugcguguguguaguguuuaugucagucacgugagaccaguguuuucugugggugcgcuaggugugugugcugcugggcugugugggauuagaguuagcuguaggguguguguguguguguguugcugacaguuggugaugauguuugaggguugcgugaggaggguggguuggugucuggugguguguugaggucugauggcaugugucugugugugccugaucuacguguguccugagaguuggugacauguggguguguuuuggggguguugauguauguguguccgugggugucuguuuuguguugauaugugaguccagaggugugcaggucuuaucucuggagugaguguguguguguggagaggggcauguuugggaacugaggcagugccuagcuuguguguguguguuuguguuugcaaaggcugcauuguguuugcaugugccccugggcauaucaacagugggucagugugugagacuuugacaguuuggauguguggggauggauugugccagccagugugcgcaguauguagagugcuugugauggucugucuggaugcuccugcuuuggucggggguguguguguauuguguguacugaguagugauguccgagacuggggccaucucaguguuugugugcaagugggagguggggugggcggucaggcuggccagucccgugugaguccuugugugugugcugugggggccucgcugugccucacugcccucccugugugcccgucgcuguguugggaaaguuguccccaccagcccaugcugugagucccaaguggagugaguuuguguugugggacugucacagcccucauacacacaccugcuagaccccuccauccguccugugugagcccuguccuugcugugagagccguccugugcccccugucccuccugugugcccaucaccguaugcacgggaggcucuccaggccagccaggacccgguggugucaucccccggcugggcgugucucuguggggccgucacccccuccgcaugcacacacaccuccacucuucuccaucuggguccuaaccccggguaggcuggagguacagugggcccugguacuucccugcugaccugcuccuccucccgugucccgcaggccccagggagcgccauggcccgcgcacgccaggagggcagcuccccggagcccguagagggccuggcccgcgacggcccgcgccccuucccgcucggccgccuggugcccucggcaguguccugcggccucugcgagcccggccuggcugccgcccccgccgcccccacccugcugcccgcugccuaccucugcgcccccaccgccccacccgccgucaccgccgcccugggggguucccgcuggccuggggguccccgcagccggccccgaggcccgcgcccggacggugagugcccgccccgcccccggggugauaggagccgggaagagagagggcuggagacucggaggaacuggagaagugggagaggacggggggagguggcgggcccagccgggccacugggaggguguggccaauguggucuuuguguugcaagaagcaggaagacggaggcuggggguggagggggaggucaagugggaagucccuccuggaaucugacugcaguccccgaauugcagcccacugucucuuccgggccuggggcaacagcugcaucccagcuccccucccccagucuggguccucuagacccccuggaggauuccuguugcagggagagugggccgagcgggaggacugucaacucuggccucuggggaggggucgagaggccuuuugcuuuuauuugcaucucuuuggccaggggcuguccucagcagucccggcggaggaaggagagggggaggggccauuguguugggaaguccccucggggaggugggggagucuuggggagggaaggguuaaagguccccugccugaugggcuguuaacccuguggugcccguggagccccaucccugccggcaggcgcucuagggaaaguguguccugguuucccaucccccaucuugucccggcagcccaaggggagcgaggaaagagaaaacuucccuaacucaguuccuggaagcccuggaaggggacaccgauuucaaggccaaggucacagauguggaaacugaggcccuggcuguaggccuuagggaacccucaggccaggaccuggugggacgggagggcaggagccuccuagggcgcucagaaguggggggggggggggggcaggaaggcaucucccgcgucccagccccccaggcccgcgcucugaagcugccacagucucuggccuucuggucucuaggccucugccacauccggagguguggcuucccugugguuggacacgagagggcaggagaccugaggcuugugaucuggguggggucagucacuguaucccugugugaccuugggauacucccuaagggcgggccucaguuucccugccugucacauggaaaaggcaaaauguggccccuuuggaaaauagaggucguuaagccugaccacccccggggucaccucucuggccgucuaccuuccacacugacaagggccguggggacguagcuggccagacaggugaccccagagcggcguccccagguacuucuugcuuucuggugccuguggaggagaagcugagaaauugacucacuagcgaugggaucacuagaaaugaggcggggagcaguggcugggaaagaggggagcaggccgagacaccucgaggccuggagggguggugggugcugaccgcgccccucugccucuccaagguccucagcccucgcucucgcuggcggagcagcaccuggagucgcccgugcccagcgccccgggggcucuggcgggcggucccacccaggcggccccgggaguccgcggggaggaggaacagugggcccgggagaucggggcccagcugcggcggauggcggacgaccucaacgcacaguacgagcggcgggugagugcugggggugggguagacggcaggugggacuuccgccggaggagggggcggcaggcggcccccgccagaugugcggcagcugcugcccugcgcggcugggucgcuccgcggacaggcaggugggggguaagugggugggggggaaucgcgcgcccgcagagccgcccaaggacuccgcgccgcggcuggcauagccggagcccgagccagggccagggccagggccagggacuaggccgccgaggaguggagcugcgcgcccguggcccgcggccgcggggacugagggcggcgcugggcggcgcggcucauauaucccgggcuauuuauagccggugagucagcagccgcgccgcgcccgcccccugccgucccucucgcgcggcccgcagcgccacacaguuucccgggcgccggggcgggccggggaccgcaggggugggcucgcagccccgccccgcgggaggccccgccccccagccccuggcacggccucgauuuuuuaaaacaaauauucgaagcccacagcagagaaugggaaaucacaaacaucaugcgcccaccaggcagcucuguucaguuugaacauuacacccgcauugcuugcuuauuaagaaaccaaacaaaaccgcagaaacgcauguggugaagcuccuuacucuccccaucccuucccccuccuugcauccaaaggaaaucucucgaguuggccucucucaaccccugcagguguugcuuuuacuccguauuuaccaggccagaaccagggcuuagaaucauggagcauucuuagcuuagcguauaugacauaguuuuuguuucuccccagaauuccuuuuucccucaauauuaggcuucagauucaccauaugggcaaaagagcuuccauucaucuauguucagccaggcacgguggcucacuccuguaaucccagcacuuugggaggcggagauagaaggacgcuugagcccaggaguuccagaccagccugggccacauaaugagauccccguugcuacaaaaaauacaaaaauuagccgggugugguggcgcgggccuguagucucagcuacuugggaggcugaggugaaagggucccuugagccaaggaagucgaggcugcacugagccaugaagggucacugaacuccagccugggggacagagcaagaccaucucaaaaaagaaacaacaaauacagccauuuucggccuggugcaguggcccacgccuguaaucccagcccuuugggaggcggaggcaaguggcucacuugagguugggaguuugagaccagucuggccaacauggugaaaccucgucucuacuaaaaauacaaaaauuaaggccgggcgugguggcucaugccuguaaucccagcacuuugggaggcugaggagggcggaucaccugaggucgggaguucgagacaagccugaccaacaugaacaaaccccgucucuacuaaaaauacaaaauuagccaggcgugguggcacaugccuguaaucucagcuacucgggaggcugaggcaggauaauugcuugaaaccgggaggcagagguugcggugagccgagaucgugccauugcacuccagccugggcaacaacagcgaaaaucugucucaaaaaaaaaaaaagaaacaaaaaguagcugagcaugguggcacacgccaguaaucccagcuacuugggagacugaggcaggagaaucucuugaacccaggagguggagguugcagugagccgagaucaggagaucaugccacugcacuccagccuggaggacagaaugaaacucugucucaaaaaaaaaaaaaaaaaaagucauuuucacugcuacauaguauucuguuggauaaacauaguauccuuauucauuuucucauugauggauauuuaggauagauauguauuuuuauuuuauguuuagagacagggucucacugucucccaggcuggagugccgugguucaaucacagcucccugcagccuccaacuccuggguuuaagggauccucccgccucagccucccaaguagcugggaccacaggcagauccaccaugccuggcuaauuuuuauuuuauuuuuuuguagagaucaggucuuucuguguuacccaggcuggucucaaacuccuggccucaagugauccuccugccuuggccucccaaauugcuggaauuaugggucugagcuaccucacccagacuauuuuuaaauguauuucagauuuuauuuuauuuauuuauuuuuugagacagaguuucgcucuuguugcccagguuggagugcaauggugcaaucucggcccauugcaaccuucaccucccggguucaagugauucuccugccucagccucccaaguagcugagauuacagaugccugccaccaugcccagcuaauuuuuguauuuuuaguagagacgggguuucacuauguugaccaggcugaucuugaauucccgaccucaggugauccacccaccucggccucccaaagugcugggauuacagguguaagccacugcgcccggccauuauuuauugccuuuuuuccucucccaaucaugcauauuuccgggugcgcucuuguguuucuagaguagguaccuggguggucugcccaccauccaccuuacuaggugauugcuagcuuucucaccagguggcacccacagcagugugacagugguggguuuuguaacuuacaccaauccgaugugcccccuuugccaccaucuccuggccccaagaguugcuagggaguguugaggaggcugggcugguaccaggcgacucacuaccagguagcaugaggacgaugaggaucauuuaaccuucuguaaagugaguuucuccuuccccugcaccugaagggaaggagguuaggugguccccacuuagcacagagccugccuguggagcuacagggaguggcagaggauugcagcucucuguacacuuaaaaaaaauuuuuuuuuugacacggagucuugcucuguugcccaggcuggagugcaguggugcaaucucggcucacugcaaccuccgccucccggguucaagcgauucuccugccuuggccucccuaguagcugggaauacaggugugugccaccaggcccagcuaauuuuuguuguuuuaguagagacgggguuuccccaugguggccaggcuggucuugaacuccugaccucaggugauccaccugccuuggccucccaaagugcugggauuacaggcgugagccaccuugcccagccauuuuuuuuuuuuugagauggagucucgcucugucacccaggcuggagugcaguggcgccaucucggcucacugcaagcuccaccuaccggguucacgccauucuccugccucagccuccggaguagcugggacuacaggcgcccgccaccacacccggcuaauuuuuuuguauuuuuaguagagaugggguuucacuguguuagccaggaugaucucgaucuccugaccucauaauccgcccgccucggccucccaaggugcugggauuacaggcgugagccaccgcacccggccuguauuuuuuuuuuuuuuuuuuuuugagacagaguuuugcucuugcccaggcuggagugcaauggcacgaucucggcucaccgcaaccuccacuucccagguucaagcgauucuccugccucagccuucccaaguagcugggauuacagacaugugccaccaaguccggcuaauuuuguauuuuuaguagagaugggguuucuccauguaggucaggcuggucucaaacucccgaccucaggugauccgccuaccucggccucccaaagugcugagauuacaggcgugagccaccgcgcccggccuguauuuuuaauagagacgggguucuaccauguuggccacacuggucucaaacuccugaccucaggugauccucccgccuuggccucucaaagugcugggauuacagcuauaagucacugcgccgggccucuguacucuuuuuaguauugccuuuaauuuuuaccagucgggagccuuuccuaggaccuagccuccugccugcccacuuccuaggauguuggagcugagaggguccuagagaccaccuuguuuucauccugccacuggagagggggcagggguuucacucggcguugccuagaggugcuucuguugaagccucugcaauggggggggcucuucccaguucuccuccuuccacagauuguucuagaacugccaagacugugggcacccugcuccuuucuccucaucuugccagcccuguagggaggggcaggauagguugcaguccauccuucagccccuugggggaugucuuucucaaauguacaacagagacggggcagucacagcuaaugugccacgcacucgcuuggugcccagcucucugcugaaggcauuccguguuuguccucugccuccaggucucauguccuggaugaggaugugaccuccgagacauggacauuagcccaggcggggggaggagcuggaauagggugggcgagacugucgccucgcugccccuggagcugaccauccccacucccaucaccauacucaguccccugcuaacugccccuucucucucuuuuccccagagacaagaggagcagcagcggcaccgccccucacccuggaggguccuguacaaucucaucaugggacuccugcccuuacccaggggccacagagcccccgagauggagcccaauuaggugccugcacccgcccgguggacgucagggacucggggggcaggccccucccaccuccugacacccuggccagcgcgggggacuuucucugcaccauguagcauacuggacucccagcccugccugucccgggggcgggccggggcagccacuccagccccagcccagccuggggugcacugacggagaugcggacuccugggucccuggccaagaagccaggagagggacggcugauggacucagcaucggaagguggcggugaccgaggggguggggacugagccgcccgccucugccgcccaccaccaucucaggaaaggcuguugugcuggugcccguuccagcugcaggggugacacugggaggggggggcucuccucucggugcuccuucacucugggccuggccucaggccccuggugcuucccccccuccuccugggagggggcccgugaagagcaaaugagccaaacgugaccacuagccuccuggagccagagaguggggcucguuugccgguugcuccagcccggcgcccagccaucuucccugagccagccggcggguggugggcaugccugccucaccuucaucaggggguggccaggaggggcccagacugugaauccugugcucugcccgugaccgccccccgccccaucaaucccauugcauagguuuagagagagcacgugugaccacuggcauucauuuggggggugggagauuuuggcugaagccgccccagccuuaguccccagggccaagcgcuggggggaagacggggagucagggagggggggaaaucucggaagagggaggagucugggaguggggagggauggcccagccuguaagauacuguauaugcgcugcuguagauaccggaaugaauuuucuguacauguuugguuaauuuuuuuuguacaugauuuuuguauguuuccuuuucaauaaaaucagauuggaacaguggauacucuuucugcuugccuuccc

SEQ ID NO: 15029 - RNA, 12026 nt, Homo sapiens
gggaaggcaagcagaaagaguauccacuguuccaaucugauuuuauugaaaaggaaacauacaaaaaucauguacaaaaaaaauuaaccaaacauguacagaaaauucauuccgguaucuacagcagcgcauauacaguaucuuacaggcugggccaucccuccccacucccagacuccucccucuuccgagauuucccccccucccugacuccccgucuuccccccagcgcuuggcccuggggacuaaggcuggggcggcuucagccaaaaucucccaccccccaaaugaaugccaguggucacacgugcucucucuaaaccuaugcaaugggauugauggggcggggggcggucacgggcagagcacaggauucacagucugggccccuccuggccacccccugaugaaggugaggcaggcaugcccaccacccgccggcuggcucagggaagauggcugggcgccgggcuggagcaaccggcaaacgagccccacucucuggcuccaggaggcuaguggucacguuuggcucauuugcucuucacgggcccccucccaggaggagggggggaagcaccaggggccugaggccaggcccagagugaaggagcaccgagaggagagccccccccucccagugucaccccugcagcuggaacgggcaccagcacaacagccuuuccugagaugguggugggcggcagaggcgggcggcucaguccccacccccucggucaccgccaccuuccgaugcugaguccaucagccgucccucuccuggcuucuuggccagggacccaggaguccgcaucuccgucagugcaccccaggcugggcuggggcuggaguggcugccccggcccgcccccgggacaggcagggcugggaguccaguaugcuacauggugcagagaaagucccccgcgcuggccagggugucaggaggugggaggggccugccccccgagucccugacguccaccgggcgggugcaggcaccuaauugggcuccaucucgggggcucuguggccccuggguaagggcaggagucccaugaugagauuguacaggacccuccagggugaggggcggugccgcugcugcuccucuugucucuggggaaaagagagagaaggggcaguuagcaggggacugaguauggugaugggaguggggauggucagcuccaggggcagcgaggcgacagucucgcccacccuauuccagcuccuccccccgccugggcuaauguccaugucucggaggucacauccucauccaggacaugagaccuggaggcagaggacaaacacggaaugccuucagcagagagcugggcaccaagcgagugcguggcacauuagcugugacugccccgucucuguuguacauuugagaaagacaucccccaaggggcugaaggauggacugcaaccuauccugccccucccuacagggcuggcaagaugaggagaaaggagcagggugcccacagucuuggcaguucuagaacaaucuguggaaggaggagaacugggaagagccccccccauugcagaggcuucaacagaagcaccucuaggcaacgccgagugaaaccccugcccccucuccaguggcaggaugaaaacaagguggucucuaggacccucucagcuccaacauccuaggaagugggcaggcaggaggcuagguccuaggaaaggcucccgacugguaaaaauuaaaggcaauacuaaaaagaguacagaggcccggcgcagugacuuauagcuguaaucccagcacuuugagaggccaaggcgggaggaucaccugaggucaggaguuugagaccaguguggccaacaugguagaaccccgucucuauuaaaaauacaggccgggcgcgguggcucacgccuguaaucucagcacuuugggaggccgagguaggcggaucaccugaggucgggaguuugagaccagccugaccuacauggagaaaccccaucucuacuaaaaauacaaaauuagccggacuugguggcacaugucuguaaucccagcuacuugggaaggcugaggcaggagaaucgcuugaaccugggaaguggagguugcggugagccgagaucgugccauugcacuccagccugggcaagagcaaaacucugucucaaaaaaaaaaaaaaaaaaaaauacaggccgggugcgguggcucacgccuguaaucccagcaccuugggaggccgaggcgggcggauuaugaggucaggagaucgagaucauccuggcuaacacagugaaaccccaucucuacuaaaaauacaaaaaaauuagccgggugugguggcgggcgccuguagucccagcuacuccggaggcugaggcaggagaauggcgugaacccgguagguggagcuugcagugagccgagauggcgccacugcacuccagccugggugacagagcgagacuccaucucaaaaaaaaaaaaauggcugggcaagguggcucacgccuguaaucccagcacuuugggaggccaaggcagguggaucaccugaggucaggaguucaagaccagccuggccaccauggggaaaccccgucucuacuaaaacaacaaaaauuagcugggccugguggcacacaccuguauucccagcuacuagggaggccaaggcaggagaaucgcuugaacccgggaggcggagguugcagugagccgagauugcaccacugcacuccagccugggcaacagagcaagacuccgugucaaaaaaaaaauuuuuuuuaaguguacagagagcugcaauccucugccacucccuguagcuccacaggcaggcucugugcuaaguggggaccaccuaaccuccuucccuucaggugcaggggaaggagaaacucacuuuacagaagguuaaaugauccucaucguccucaugcuaccugguagugagucgccugguaccagcccagccuccucaacacucccuagcaacucuuggggccaggagaugguggcaaagggggcacaucggauugguguaaguuacaaaacccaccacugucacacugcugugggugccaccuggugagaaagcuagcaaucaccuaguaagguggauggugggcagaccacccagguaccuacucuagaaacacaagagcgcacccggaaauaugcaugauugggagaggaaaaaaggcaauaaauaauggccgggcgcaguggcuuacaccuguaaucccagcacuuugggaggccgagguggguggaucaccugaggucgggaauucaagaucagccuggucaacauagugaaaccccgucucuacuaaaaauacaaaaauuagcugggcaugguggcaggcaucuguaaucucagcuacuugggaggcugaggcaggagaaucacuugaacccgggaggugaagguugcaaugggccgagauugcaccauugcacuccaaccugggcaacaagagcgaaacucugucucaaaaaauaaauaaauaaaauaaaaucugaaauacauuuaaaaauagucugggugagguagcucagacccauaauuccagcaauuugggaggccaaggcaggaggaucacuugaggccaggaguuugagaccagccuggguaacacagaaagaccugaucucuacaaaaaaauaaaauaaaaauuagccaggcaugguggaucugccuguggucccagcuacuugggaggcugaggcgggaggaucccuuaaacccaggaguuggaggcugcagggagcugugauugaaccacggcacuccagccugggagacagugagacccugucucuaaacauaaaauaaaaauacauaucuauccuaaauauccaucaaugagaaaaugaauaaggauacuauguuuauccaacagaauacuauguagcagugaaaaugacuuuuuuuuuuuuuuuuuuugagacagaguuucauucuguccuccaggcuggagugcaguggcaugaucuccugaucucggcucacugcaaccuccaccuccuggguucaagagauucuccugccucagucucccaaguagcugggauuacuggcgugugccaccaugcucagcuacuuuuuguuucuuuuuuuuuuuuugagacagauuuucgcuguuguugcccaggcuggagugcaauggcacgaucucggcucaccgcaaccucugccucccgguuucaagcaauuauccugccucagccucccgaguagcugagauuacaggcaugugccaccacgccuggcuaauuuuguauuuuuaguagagacgggguuuguucauguuggucaggcuugucucgaacucccgaccucaggugauccgcccuccucagccucccaaagugcugggauuacaggcaugagccaccacgcccggccuuaauuuuuguauuuuuaguagagacgagguuucaccauguuggccagacuggucucaaacucccaaccucaagugagccacuugccuccgccucccaaagggcugggauuacaggcgugggccacugcaccaggccgaaaauggcuguauuuguuguuucuuuuuugagauggucuugcucugucccccaggcuggaguucagugacccuucauggcucagugcagccucgacuuccuuggcucaagggacccuuucaccucagccucccaaguagcugagacuacaggcccgcgccaccacacccggcuaauuuuuguauuuuuuguagcaacggggaucucauuauguggcccaggcuggucuggaacuccugggcucaagcguccuucuaucuccgccucccaaagugcugggauuacaggagugagccaccgugccuggcugaacauagaugaauggaagcucuuuugcccauauggugaaucugaagccuaauauugagggaaaaaggaauucuggggagaaacaaaaacuaugucauauacgcuaagcuaagaaugcuccaugauucuaagcccugguucuggccugguaaauacggaguaaaagcaacaccugcagggguugagagaggccaacucgagagauuuccuuuggaugcaaggagggggaagggauggggagaguaaggagcuucaccacaugcguuucugcgguuuuguuugguuucuuaauaagcaagcaaugcggguguaauguucaaacugaacagagcugccuggugggcgcaugauguuugugauuucccauucucugcugugggcuucgaauauuuguuuuaaaaaaucgaggccgugccaggggcuggggggcggggccucccgcggggcggggcugcgagcccaccccugcgguccccggcccgccccggcgcccgggaaacuguguggcgcugcgggccgcgcgagagggacggcagggggcgggcgcggcgcggcugcugacucaccggcuauaaauagcccgggauauaugagccgcgccgcccagcgccgcccucaguccccgcggccgcgggccacgggcgcgcagcuccacuccucggcggccuagucccuggcccuggcccuggcccuggcucgggcuccggcuaugccagccgcggcgcggaguccuugggcggcucugcgggcgcgcgauucccccccacccacuuaccccccaccugccuguccgcggagcgacccagccgcgcagggcagcagcugccgcacaucuggcgggggccgccugccgcccccuccuccggcggaagucccaccugccgucuaccccacccccagcacucacccgccgcucguacugugcguugaggucguccgccauccgccgcagcugggccccgaucucccgggcccacuguuccuccuccccgcggacucccggggccgccugggugggaccgcccgccagagcccccggggcgcugggcacgggcgacuccaggugcugcuccgccagcgagagcgagggcugaggaccuuggagaggcagaggggcgcggucagcacccaccaccccuccaggccucgaggugucucggccugcuccccucuuucccagccacugcuccccgccucauuucuagugaucccaucgcuagugagucaauuucucagcuucuccuccacaggcaccagaaagcaagaaguaccuggggacgccgcucuggggucaccugucuggccagcuacguccccacggcccuugucaguguggaagguagacggccagagaggugaccccggggguggucaggcuuaacgaccucuauuuuccaaaggggccacauuuugccuuuuccaugugacaggcagggaaacugaggcccgcccuuagggaguaucccaaggucacacagggauacagugacugaccccacccagaucacaagccucaggucuccugcccucucguguccaaccacagggaagccacaccuccggauguggcagaggccuagagaccagaaggccagagacuguggcagcuucagagcgcgggccuggggggcugggacgcgggagaugccuuccugccccccccccccccccacuucugagcgcccuaggaggcuccugcccucccgucccaccagguccuggccugaggguucccuaaggccuacagccagggccucaguuuccacaucugugaccuuggccuugaaaucgguguccccuuccagggcuuccaggaacugaguuagggaaguuuucucuuuccucgcuccccuugggcugccgggacaagaugggggaugggaaaccaggacacacuuucccuagagcgccugccggcagggauggggcuccacgggcaccacaggguuaacagcccaucaggcaggggaccuuuaacccuucccuccccaagacucccccaccuccccgaggggacuucccaacacaauggccccucccccucuccuuccuccgccgggacugcugaggacagccccuggccaaagagaugcaaauaaaagcaaaaggccucucgaccccuccccagaggccagaguugacaguccucccgcucggcccacucucccugcaacaggaauccuccagggggucuagaggacccagacugggggaggggagcugggaugcagcuguugccccaggcccggaagagacagugggcugcaauucggggacugcagucagauuccaggagggacuucccacuugaccucccccuccacccccagccuccgucuuccugcuucuugcaacacaaagaccacauuggccacacccucccaguggcccggcugggcccgccaccuccccccguccucucccacuucuccaguuccuccgagucuccagcccucucucuucccggcuccuaucaccccgggggcggggcgggcacucaccguccgggcgcgggccucggggccggcugcggggacccccaggccagcgggaaccccccagggcggcggugacggcggguggggcggugggggcgcagagguaggcagcgggcagcagggugggggcggcgggggcggcagccaggccgggcucgcagaggccgcaggacacugccgagggcaccaggcggccgagcgggaaggggcgcgggccgucgcgggccaggcccucuacgggcuccggggagcugcccuccuggcgugcgcgggccauggcgcucccuggggccugcgggacacgggaggaggagcaggucagcagggaaguaccagggcccacuguaccuccagccuacccgggguuaggacccagauggagaagaguggaggugugugugcaugcggagggggugacggccccacagagacacgcccagccgggggaugacaccaccggguccuggcuggccuggagagccucccgugcauacggugaugggcacacaggagggacagggggcacaggacggcucucacagcaaggacagggcucacacaggacggauggaggggucuagcagguguguguaugagggcugugacagucccacaacacaaacucacuccacuugggacucacagcaugggcugguggggacaacuuucccaacacagcgacgggcacacagggagggcagugaggcacagcgaggcccccacagcacacacacaaggacucacacgggacuggccagccugaccgcccaccccaccucccacuugcacacaaacacugagauggccccagucucggacaucacuacucaguacacacaauacacacacacccccgaccaaagcaggagcauccagacagaccaucacaagcacucuacauacugcgcacacuggcuggcacaauccauccccacacauccaaacugucaaagucucacacacugacccacuguugauaugcccaggggcacaugcaaacacaaugcagccuuugcaaacacaaacacacacacacaagcuaggcacugccucaguucccaaacaugccccucuccacacacacacacucacuccagagauaagaccugcacaccucuggacucacauaucaacacaaaacagacacccacggacacacauacaucaacacccccaaaacacacccacaugucaccaacucucaggacacacguagaucaggcacacacagacacaugccaucagaccucaacacaccaccagacaccaacccacccuccucacgcaacccucaaacaucaucaccaacugucagcaacacacacacacacacacccuacagcuaacucuaaucccacacagcccagcagcacacacaccuagcgcacccacagaaaacacuggucucacgugacugacauaaacacuacacacacgcagcccacaugacacacaugagccagccgaucacagugacaagccccucagacccaacacacacacacacacacaggcucagacacaaccccauccagaggcugccagcaacacccaccgucuacacugcauagaccccacagauccuggguccucaaaucccagacgcugaugccagacacacaagccaaacccagacugaaacaaccccccaccacacacauacauacacacacacacucacaccugacaacucacacagacaccuggacagaaaacagacauuugcauuuagcaggcgcagcaucacaaacgcugggcaaaagacacaugccccggagauacagagacggccucagccaagacagaaacacacaggcaagacacaagcacacauaucgcacgcucgggcaagacacacacauaaacacacaaacagcucacuccagcaacacacacacacuacaaccuccacaccccagcacacgcaggcaccacagacccccaguaucaucccggaacagcacacacagacaacucucaccgacaacacacgcagguccacccaccccacaagcagggcacccacagacagaaccccacacaaacaggcgcggggacucacgcagacaccccgacgggucagaaaccccaacauuccucuggaucgacaccaccacucccugcagaacccagcacaaacucggagccagacacgcgcacacacccaggcgagacaccugcagauccacaaccccgcacacgcgcgcucccacggcggucccagacaccccccuccgcugucacagccccccccaccgccgccacgugcgcccgccccgcccgccaggcgagcgcggggccaauaaccggcuguugcuggggcgcagcccccgcccgcaggagccgcagacuccacggcccgcgagccgccccccgucgccgcccccagcgggcgcgcgcccuggguguggccgccccuccgugccgcccccccgccccucccggacuuugggggcuggggcaccccuggggucgacccucuuccccggggccgcacuggccgccagggggcgcugccgagcccgcaccccauuguuuguaaacaaacccgccagaccgccgaggcaccugugcgcccagaccggcgccccaacgccgagccgccucucacccggcgacccuggcccagggucccucgcgggguuuggagaggcgcgguguggggaggcagggcgcccacacugcucuccgccugcacuccugucaccuccuccagggaguccacccggccuggccgaucgccgccggagaggauucggggcgcgcacacucaccccgggggcaugaacacgccggagggggcggcgguggggggcgggcggcuuccuucaggagggcgcgcccgccgagcgccgcucuccgcggcggcugcugcuguggcugucgcugcugcugccgcucuaacugcaguggcggcugcuguggcuguggcugcugcugcuccccgggccgcaggcgcguccgcgucguggccgcugcugggaucgcuggugccgccgccgccgccgccaggcgcccgcucgcauguggcucgcgccgcgucucaggccgcccggcggaucccgggcccgcuccaaagccgccccgccccgccccgccccgcccccgcccggcgggucccacgccccgcccccgcgugacgcuacggccccgcccgcccgccgcggacaagucaggacuugcaggcgcgcgccgcgccccccccuaccuccgcgccggggguuucccugcagcgggggacggggcagggccuagcccaaggcaaggaggacccaggcgcugugcggcgggguguggggagaucgcccagacaccgggacagucggacacacacacugacugggacccacagauccacacccccagcgaugcguacacagaccgaccgacgggcguuccaggguccacaaagucacgugcaggcagagcccagaggauguacucacagacacaaggccacagucucgcaaauccacaccauggacaggggcaugagcacacacacucacauacugauggggcucacacuuacacacacccagacggaaaugcacagacucacuaacaggguccccuggacaagcagacggacacaaugacagggccacacacaguugcagaaacacccacacugaugaucacaccugggcccacaaacuguguucacaaacaacccuaccgaacaggcacccacaccacacacacgguggugcaaccacacagacauaggcggagugcuuaucaggaaacacaaacuugcugauaggcacaggggacacacacauacacacagacaccuguuacagggauaccuggauacacggccaaauccaaaucacacucccacagggacauacacaaaugcacucacacaauuucacagcuaacacauuaaaacuaucagaaagugacauucgcccgacacgguggcucaugccuguaaucccagcacuuugggaggccaaggugcguggacugccugaggucaggaauucgagaccagccugaccaacaugaugaaaccccaucucuacuaaaaauacaaaauuagccgggcguuguggcgcaugccuguaaucccagcuacuugggaggcugaggcaggagaacugcuugaacccgggaggcggagguugcagugagccgagauagugccauugcacucuagccugggcaacaagagcaaacuccgucuuaaaaauaaaaauaaaggaaagaaacugacauucagagacacaaaccaaaucagacauagaagaaacugaccacccacacaugucacaaagucacaccugugacagcuucuugcuaacuggcccacugcacacacgucggagcaugcacaccuggccacacucaccacaaaucuggcaggggacccacgucguggaagcagcccugggcaccuggcauggacaugccugggcagaccccaugccaaauuucauccugucucauagcuuuccauuccguuucuuuuucaguuucucauuguuacuuccugcccugcucugguuuggugaguuuuguccuuccuuuuuccaaagccguggauuccugucuccucuacacuuuccauccuuacugggucucacccaaucgcaaucgccucaccagagugacucaccuuccagugccuaguguggggcuggcugaguaaggaugucagac

SEQ ID NO: 15030 - RNA, 3038 nt, Homo sapiens
ggacgggcacuaccggccuagaugacagaggagggaaucacugccauuccgaccaauggacaguucacgccggaccugaguggcgagcgcauagccaauggguaagccauucauccugagugacauggguugcaaccuaccggaggccgguggggcgguacggcgcgcggcggccguagugcgaaucaugggaggcggcugguggugggcucgggccgcucgccuugcccgucuucgcuuccggaggucgcuacugccgccucagcggccccggagcgggggcgcccggggguccuucgcccccggccacgguccccgcgccggggcuucgccgcccccaguguccgagcuggaucgugcggacgccuggcuccuccgaaaagcgcacgagacaggucgguggcuaggggugggggcggugcggaugggacgggggucccgggcucgcgugggaccuugauggggcgggggcuucugcaggaaacggggcccgggcucggcuccgagaagggcuucagugugagcgcacggaagcgcagacugcaagagcgcaggugcccgcagaggggaugggcuugcggggaggacgaggaccccggguaacggggcgccguagggauuggagggggugguaggguugcgcgaggcagccucguagaaucgcgccugccguggggagaggggcuucagggagagcuuagggucuguggaguuggguacaagauggguccaucccgauugcagaggccaccacugugcagagagcgggaguguggauccccgcagaagagggggaaguucaggauuggagaaggggacaaccaaucgggagaaagcucucugcugauuggagggggaggugaucuaggcugcagagggcggggcuugugacggaggcgagguccagaauggagcggacuggccauguuuguuuuuuuuuuaauuuuauuuuuuuaaugacggugucuugcucugucaccgaggcuggaccgcaguggcgcaaucguagcccacugcagccuugaacuccugggcucaagcuauccucuugccucagccuccugcuuagcuggagcuacaggcauacaccaccgcacccaacuauuuuaauuuauguagagacggggucuugcuuuguugcccaggcuggucugaacucuugggcucagagaauccuccugccuuggcuucccaaagugcugggauuauaggugugagucaccucacuaggccaggaccgggcaucuagauauaggguguggugggcuguuuguaaaggacgugaauggggacggacgugggugggauuggcccaggccauacucgguaggacauggaugggauuggcccaggccauacucgguaggagauggcggcauuugaaggaaaagaagggcgaggcugaagagcggccuggauuaggaaacaguuugucccagaguucugagaaagaagugagugggcaggccguggggguacacguagagggagggguuuggccaagaugacuccucagauggagguucugcaacuuugccccuagauuguccuccacauucugcagggacuaucuugaauccuuuauuuuuuuugagacggagucucacucugucgcccaggcuggagugcaguggcaugaucuuggcucgcugcaaccucuaccuccuggauucaagugauucuccucccucagcuuccugaguagcugggacuacaagcacgugcuaccacacccugcuaauuuuaacauuuuuaguagagacaggguuugacuauguuggccaggcuggucucaaacuccugaccucaugauccgccugccuuggccucccaaagugcugggauuacaggggugagccaccacacccggcccuugaauccuuaguguuacagaguuugggggagaggggcacugagguggaggccagagaggauguggggggauaugguuaggugagcggcuuccuggaagaggugaggauuugggaugggcuugccuugcggcuggaugggauggggugagcugaagggaggccccucaguuugacuggguaagggggauugaggagguaggguugggggugauguuaauccccccaugucccccucccuccagccuuccucuccugguuccgcaauggccuccuggcaucgggcaucggggucaucuccuucaugcagagugacaugggucgggaagcagcauauggugagugcagacccccccucucgccccacggaaccagggaaugcagagccccuaucaccugcccuggugagaguagacucuccuaccccaucccacucccaguaguaaguauagaacccccauucuucccccaccagaagacaccccucccauaggcacuagguccaucugaauggguggcccaggacaugguuaugguccccuccccuccgaucugauucucaaagaugcaggcuagccccuggcacggcccugccucuguuccugucuccucaacccuggcuuugcucccagaccaucccccgaccuuggcccuguugcuacccugccucucccgcaggcuucuuccugcugggcggccugugcgugguguggggcagcgccucguacgccgugggccuggcggcgcugcgaggacccaugcagcugacgcuggggggcgcggccgugggcgcgggcgccgugcuggccgccagccugcucugggcgugcgccgugggccucuacauggggcagcuggagcuggacguggagcuggugcccgaggacgacgggacggccuccgcggaaggcccugaugaggcgggucggccgccacccgagugagcgacacggccguggggccuggcaggcgcuggacagcgcccgaggacugggacauuaaaccugaccuccccuccuccagaugcagaguauugguucguguuccuugggaagggcggcgaggagcggacuaacuggagaggcaggagggcggguggagggagaggggggugaggacccgggggagacagaaauggacagaggagcucacagcccggagcccaaa

SEQ ID NO: 15031 - RNA, 12487 nt, Homo sapiens
cggccgucccggcggccauugcuccaagauggcggcggcggcggcagcgggugaggccgggccgggccgggccggguugggggucgggggucccgggacagcgcucaccuguaacucggcgcgcucggccucccagcgggcuuucucggcuucgaagcgcgcccacucgugcuggauaaagugcaggauccccggcaggcucaggggcuccgggcccgccgugggcccggggcugccuccgccgccgccucccuuaccugccgggcccggcccgggggcaggggcggagaccggggccgccccaguggggccagggcccgcgccugagccgagcggacggcaggaggaggcggcggcggcgaccgcggcggccgcucgcuccuccaucauggaggccccggggccggccugcgcgcccgcugugccucgcgcgccugcgcggccgcgccaacaccccccccccucccccgccgcaaccaccgcgcgcgcgcccggcgggggacaguaggaaggggggccggcggcgagcgcgagccucgcccacccgggucuacaccgaaggguagcgugcccgcgcgggggccggcgggugggagaucgcgccccgaggagggcgagggagacccaggccccgcgcgacggucccccucgcuggagugagacugaggaaggggccgcuuucugccccccuccucccacuucgccccagagaaagagccuuaccccuuccacacccaaacaccacucuccuggacaauuacuuuuacucugagagaaagggcgaccagcaguggccccauccucucugauugccggccagguugguugucaugguaacccuuccccagcggugggggcgaggugguggggagcagccuuccccucgcuuccaccuuugugguuauggagccccaaaccucuuaggacucugcaccaggagaagguugcuaagguaaccuaaguguccguggugguccuucugcuccuauccucauugauuacuauggcaaccucccccccaccuagcauucagguagaaaggaccccagccccaaggacacugaucucuaagagaagcaccucuuccccagccccucccccauagccaccuaguuggcauuaccaugguaaccgucuuccccuucccaucgugggaggcccaugcaccaaacuaaccagguguuuuuauuuagaggagaugcucugcugaggggcaguugcuaugguuacagggccuggaccuuccuccggaaggugagaaacaggcaaguucaaggccugguuacuaugauaauagagcagcccccuucgagugacccuaggaaccaagcccaacaaaggaggggauuuuuuuuuuuuuuuuuuuuuuugagacagaguguaacucuuguugcccaggcugggaugcaauggcccaaucucggcucaccacaaccuccgccuccccgguucaagccguucuccugccucacccucccaaguagcugggauuacaggcaugcgccaccacgcccggcuaauuuuuuuuuuauuuuuaguaaagacgggguuucuccauguuggucacgcuggucuugaacucccgaccucaggugaucugccucaggcccgccucggccucccaaagugcugggauuacaggugugagccaucacgcccggccaggggauguuuuaagaaugucucucagagguagagugugucuauggaagggguugucaugguaacagcuucuguuggcuucuagcccuaccuuuucuggacacauucaugcuagagggaugguuauagguugcuauaauaacugacaucccucccauucaccccaccccacuccugagacaccccagguggugcccgagauuauaggacuucaagagaaaggauucccugaccuuucucuugccacuuuuguggauaagaugaaauugugcucuauuguacggaaauggcugauuugggauuuucugguucuccuccucucaggagcgcagcucagcugggcuggaacugcccuccuggaacucccccagccuacaaccuaggagguaagaagucccucagugucaccuacacucucauggaaacugcccuuccucauuccuuaaggcuuucccaugucucucauuuuuuucuuuuucuuucuuucuuuuuugagacggagugucgcucuguugcccgggcugaaaugcaguggcgcggucauggcucacugcaaccuccaccucccugguucaagcgauucuccugccucagccucccgaguagcugggauuacaggcaccugccaccacgcccggcuaauuuuuuguauuuuuaauagagaugggguuucaccuuguuggcaggcuggucucgaacuucugaccucgugauccgcccgccucggccucccagaaugcuagaauuacaggcgugagccaccgcgcccagcccucucauuuuuuucuaaccgucacauucccauuccacaggugcagggacugaggcucaggccaaaucgcaacucagacccagugaacccaaggccugaagagaauuuggauucauuuaccuuguuuuguggggacuggagagacaaguaaacucucagaguaacuguccccucugacuaccauuucuaaggcaagcccccuguuucuacucuugcgcccccugcugguuuccugcccugucuguaaguugcauggcuuuuguccgucuuuuuuuuguuuguuuguuuguuuugagacagggucucacccaggcuagagugaaguggagcaaucucggcucacugcaaccuccgccuccugaguucaagugauucucacaccucagccuccccaauagcugggauuacaggugcgcaccaccaugcccagcuaaucuuuguauuuuuugguagagaggggguuucaccauauugcccacgcuggucucuaacuccugaccucaggugaucugaccgccugggccucccaaaguacugagauuacaggugugagccaccacacguggcccugucagucuucuuucugucuucuggagggcugaccuaaugaguaccucguucauucuguauccucaaaacaugggguccaccacaaagaauacuugaguuuguugaguuacugaguugaauuaauuuauuaaugugccauagccaagcuuugaaagccccugucagguuagggcuggggaaggcucacuaaagaugggcugagaguuggggcuucagaaagaacccaagagagaagguaaaguuuacugguuuaaaguacgacucuguagccagcuucuuggaucaacucuuggguccacuacuucacauugugugaccuugaauaagagacuuuaacucuuuaacucucugugccuuuguuuccuuuuuuuuuuuuuuuuuuuuugagauaaggucucgaggccaggcgcgguggcucacgccuguaaucccagcacuuugggaggcugaggcgggcggaucacgaggucaggagauugagaccauccuggccaacauagugaaaccccaucucuacuaaaaauacaaaaauuagccgggcaugguggcgcaugccuguaaucccagcuacucaggaggcggaggcaggggaaucccuugaaccagggaguuggagguugcagcgagccgagauugugccacagcacucuagccuggugacaaagcgagacuccgucucaaaaaaaaaaaaaaaaaagagucuggcucugucacccaggcuggagugcaguggcacaaucucaacucacugcaaccucugccuccuagacucaaguaauccuaccacuucagccaccagaguagcugggacuacaggugcacaccaccaugcccggcuaauuuuuuaaauuuuuuuguagagacggggucuuaccaguccaugcuggucucaaacucccaggcucaagcaaucucccccagccucauccucccaaagugcugggauuacaggcaugagccaccacaucggcugguuuccauuuuuaaaugugaucauaacacgaggauuaaacaagugaauaugccuaaagugcuuagaacagggccuggcacauggugagcugcuagaauuguuauuauuauccucccgauucagaaaaauguagaacauucagaccuucaaaaucaucauuguauccacuuugccccaacgaagggguuuguugcccuuagaggcggugaagucugcauggcuuuaucaggguacuagaugauuccuuuccccgccucagguucccucacacccucaccagcagguggcaccucuucaucuggccaucaaaucugcuggugucuggucugcgagggccaagaguugugcugggccugaggguagccaggaccuggcugcuguccucugcccugcugggcaccuccuuccuggcccagagucagucagacaguguggcaagagccagggccucagaagcggagaccucgguucucgacccugcauccuucuuaucucucugagccagagguuccuaucuuucguuuuugagacugggucucgcucugucgcccaggcuggagugcaguggcugaaucacagcucacugcagccuccaccuccugggcucaagggacccuccugccucagccucccuccuaaguagcugagaccacagguaggcaccaccacgccuggcugauuuuuguauuuuuuuagagacgggguuuugcuauauugcccaggcugguguugaacuccugagcucaagcgauccuccugccucagcuucccauagugcuaggauuacaggagugagcccccauacccagcccacguuccuuaucuuaauaauucaagucacucauucauucaacacguauuuauugagcaccugcuaugcaccaagcacugagcugugcucuggggauacaguagggaagaaaacagauucccugccuuccauggagauucugacaacaaacaagcuaaguaaaauccacgugauaacuacuaggggagcaaaauaaagcaggaaugggggauaggaaguacaugggagaugcuuuuuuuuuuuuuuuaaagacagacaaggucucgcucuauugcccaggcuggagugcaguggcgccaucacagcucacugcacccuugacuuccccagcucaagugauccuccuaccucagccuccuaaguaacugggacuacaggugcaagccaucacauccaguuaguuuuguuuauuuuuuguagagauggcaucuuacuauguuguccaggcugaucugaaacuccuggucucaagcgaucugccuaccucaaucucccaaagugcuggaauuacaggugugagccacugcaccuggccaagaugcauuuuuuuguuuauuuacuuauuuugagacagaguuuuguuguuguugcccaggcuggaguacaauggcauggucucagcucacugcagccucugccuccuggguucaagcaauucuccugccucagccucccaaguagcugggauuacaggcgccugucaccaugcccagcuaacuuuuuuguauuuuuuuuuuuuuuuuuuuuugagacggagucuugcucugucgcccaggccggacugcggacugcaguggcacaaucucggcucacugcaagcuccgcuucccggguucacgccauucuccugccucagccucccgaguagcugggacuacaggcgcccgccaccgcgccuggcuaauuuuuuguauuuuuaguagagaugggguuucaccauguuggccaggcuggucuugaacuccugaccucaggcgaucugcccaccucgcccucccaaagugcugggauuacaggcaugagccaccaugcccagcccaccaagaugcauuuuuaaauaggauggccaaaggaagagguuaugggaaggugacauuggagugaugggggugggggccggcgcagugggguggaucgccuguggcuaucugggauaagaacacucagacagaggcaacaggcaguucugcagcuggagugucccagguguguuugaaagaugguguugguggccaauguuccuagagcugagugagugaguaggaaaggauggaagaucacgcggggccuuaugggccacauugaguaccuuggcuuuuccugcgaggugccagccacagaagggccugagcagagccaggacaggaugaaaugugaguugugacaggaucucucgaggugcugaaugaggaacagaccacaggaacagaagcgggaagacagucucuugcugugaccuucaaggauaugcagacuaaccaucucauguguguucggagcuccuauguaccuaaacucuaagauuuugaagggcuugagguucugugguugcaaagguuccugccccugcacuaaugggagcuccacaagggcaggaauguugucugucucugagcaucuguugcucucucuccagugccuagaacagugccuggcauguuguaggaguucaacaaauagauguugaaggauugaaggaaggaagaaucaaucuaagguccagaaggcaauuccaggauucuaaagauuagaaaggacauggugacucacgccuguaauccuggcacuuugggaggccgagacggaaggaucacuugaggucaggaguucgagaccagccuggacaauauagugggagccagucuccacaaaaauguguuugaaaaauuagccaggcacaguauugcaugccuguagucccagcuacucgggagacugaggcaggaggauggcuugaacacaggaauucgaggcugcagugagccgugauugcaccacugcacucaagcuugggcagcagagcaagacgcuguccguuuaaaaaauauauauauuuuggcugggugugguggcucacuccuguaaucccaacauuucuggaggccaaggcaggcagaucaugaggucaagggauugagaccauccugcccaacauggugaaaacccgucucuacuaaaaauacaaaaauuagccgggcaugguggcacgcgccuguagucccagcuacucaggaggcugaggcaagagaaucgcuugaacccuggaggcggugguugcagugagccagucgcaccaccgcacuccagccuggcaacagagugagacuccgucucaaaaaaaaaaaaauuguuuuuggcugggcgcgguggcucacgccuguaaucccagcacuuugggaggccacggcggguggaucaccugaggucaggaguucgagaccagccugaccaacaucccgucucuacuaaaaauacaaaauuagccgggugugguggcgcaugccuguaaucccagcuacucaggaggcugaggcaggagaaucgcuugaacgcgggaggcagagguugcagugagaugagauagcugccacugcacuccagccugggcaacagagggagacuccaucucaaaaaaaaaaaagaaaagaaaagaaauaagagcaguuugagaaaauguucagggugacuuaaacauacagguuggggaaagcauggcaagagaugaggguggaauggggggcagacaaggggaaugucagaagcagcuuccacuuucuccccugggcacugggagccauggcaaguucagagcaggggaaggagagguccaacuugugcuuuaggaagacuccucuggcuaucacggggagaggaauugccaggagaccagggggagguuggaugggaauguggguggaccugguugaggagggagcuguggaaauggggaggaggggacagaggauuuaggacauagggagguuaguuggaugcccccucucucuaggaagggcagaaaccuacaaaaagccuucauggggaaauuauuugaucaucugcuuggaacccagagcuauaccaccugugcuggagaccggccagccaaaucuucagucucgguggggacaaggagacagcgccaucuggugcuugaggguguggccaaugaauguggaggggaguguccuaagguuggcagccucuuuugaugcaagcuaccccaguuuuuuguuguuguuggguauuuugagacagggucucacucuuguccaggcugagugcaguggcaugaucauggcucacuggcucaagccauccccccaccucagcauccugaguggcugggaccauaggugaguagcaccacacccagcuaauuuuuuauuuuuuguagagaugaagucuccuuauguuacucagguuggucucgaacuccuggacucaagugauccuccugccuuggccucccaaauugcugggaucacaggugugagucacuguaccuggcccaccccacuuuuguuuuuucuuuuuuuuuuuuaauuuuuauuuauuuauuuauuuauuuauuuauuuauuuuuugagacagucucacucuguugcccaggcuggagugcaacggugccaucucggcucacuguaaccuccaccucccagguucaagugauccucuugccuuggccucccaaauugcugagaucacaggcgugagucaccauaccuggcccaccccacuuuuguuuuguuuuucuuguuuuaaauugguuuguuuauuuauuuauuuauuuauuuuucgagacggagucucgcuguguugcccaggcuggagugcaauggugccaucuccgcucacugcaaccuccaucucucagguucaagcgauuuccugccucagccuccugaguagcugggcuuacaggcacccgcccucacacccagcuaacuuuuguauuuuuaguagagaugggguuucaccguguuggccaggcuggucucaaacuccugaccucagguaauccaccugccuuguccucucaaagugaugggauuacaggcauaagccaccgcgcccagccuaaccuuuuuuuuucauuuauauuuuucagcaccccacuuaaaauuuuuuuuaaauucugauuaaguauauauaacauuaaauguaccaucuuaaccauuuuucagcacacaguucaguaguguuaaaugcauucauacuguugugccaacaaaccucugggaccuuuucaucuucccaaacugaaacucuguacuuaucaaacaacuccccauuccccccugccugcaaccccuggcacccgucauucuacuuuauguuucuauuaguuugacucacucuguuuaaaaaaaaaaaaaaaaauucugaggacacccagaguuggugcauggcccagacugggaggucagggagugcuuccuggagaaggggaagucaaagcugaaaccaaauagggaaaagaaagggaauugagaaagagcuguagaaaggggcaaggcugaggguggcagaagggggugguucugacaaucagcugcugccuucccuuucgucccccucccccaggaugccccggaggcccagcuagccccagacuucggccccaugcggcucacccgcugccaggcugcccuggcggccgccaucacccucaaccuucugguccucuucuaugucucguggcugcagcaccagccuaggaauucccgggcccgggggccccgucgugccucugcugccggcccccgugucaccguccuggugcgggaguucgaggcauuugacaacgcggugcccgagcugguagacuccuuccugcagcaagacccagcccagcccguggugguggcagccgacacgcuccccuacccgccccuggcccugccccgcauccccaacgugcgucuggcgcugcuccagcccgcccuggaccggccagccgcagccucgcgcccggagaccuacguggccaccgaguuuguggcccuaguaccugauggggcgcgggcugaggcaccuggccugcuggagcgcaugguggaggcgcuccgcgcaggaagcgcacgucugguggccgccccgguugccacggccaacccugccaggugccuggcccugaacgucagccugcgagaguggaccgcccgcuauggcgcagcccccgccgcgccccgcugcgacgcccuggacggagaugcuguggugcuccugcgcgcccgcgaccucuucaaccucucggcgccccuggcccggccggugggcaccagccucuuucugcagaccgcccuucgcggcugggcggugcagcugcuggacuugaccuucgccgcggcgcgccagcccccgcuggccacggcccacgcgcgcuggaaggcugagcgcgagggacgcgcucggcgggcggcgcugcuccgcgcgcugggcauccgccuagugagcugggaaggcgggcggcuggagugguucggcugcaacaaggagaccacgcgcugcuucggaaccguggugggcgacacgcccgccuaccucuacgaggagcgcuggacgccccccugcugccugcgcgcgcugcgcgagaccgcccgcuauguggugggcgugcuggaggcugcgggcgugcgcuacuggcucgagggcggcucacugcugggggccgcccgccacggggacaucaucccaugggacuacgacguggaccugggcaucuacuuggaggacgugggcaacugcgagcagcugcggggggcagaggccggcucggugguggaugagcgcggcuucguaugggagaaggcggucgagggcgacuuuuuccgcgugcaguacagcgaaagcaaccacuugcacguggaccuguggcccuucuacccccgcaauggcgucaugaccaaggacacguggcuggaccaccggcaggauguggaguuucccgagcacuuccugcagccgcuggugccccugcccuuugccggcuucguggcgcaggcgccuaacaacuaccgccgcuuccuggagcucaaguucgggcccggggucaucgagaacccccaguaccccaacccggcacugcugagucugacgggaagcggcugaagcccugauaaccucgccuuuguuuuucgggggucugucuggauguggagaagcucugugugagcggugagggguggagggaugucgcggagaggggaagggggaaacugaccaagaaagaaauucuaaggagagcaugagagaaggcuggcauuggcaggaggagagcaccaggacgaggaugggaagcgaccuccagauuuaucaaauggucaugcccacugggagccguggauaugcguggggacauccugggucaucucagucauggagggagacggggaugucacgccgucccgcagggcccagcacagccccagacccgaaaaaaguguucugcccaagauuccgagagcccugcgcucuagggcaggggcagaguuuuggaaacagugcaggcucuggagccagacuggcgagauucaaauccuggcucuaucgcuucggagccaggugggccugggggggcgucgcagucucucugugccucaguugcuuccaggaugcgggacccuuggcugcagggguugcuuccgccacuagagggcgcgccggucccgcuccugguggcccacuguggcugcccgggcgacaguacgcccagggccuguguuccauagccaucuacucucuugagccuuuggacuucucuccaagccccugugggaggcggacagcagugaccaccuccccuucuuuuggacugcgaccuccuucccuccugggagagcccugugaccugcaugcuacucuuaacuguucuauucaagacugaauagaaguauuucagucuugcagaggaggaaaugcucagagcuccgaggugcggcuguggucgagaaccgggugcugggccgggcgcgggggcucacgccuguaaucccagcacuuugggaggccgaggugggaggaucgcuugagcccaggagucugagaccagccucggcaacaugccaagaccccgucucuauuuuuaaaaaagaaaaagaaccgacuucugaaucgcagcuccacucaugacuaauaccucauuauuucagcugucugcaccuaauuccccacuugcacggcaguguagacaauaaccauagcucacacucacugagcaccuacuggguaccaggcaccauucucaguguuucaccuggaucaacuaaugcgucccucaccucagcccucugaagugacagcugcuauuauuuucauuacacagaugaaaaagcugaggccagaaucgugaagucacuugcucaaggucaggcagcuuaggaaggggcagaucgggggcuugaacccagguggucaggcucuggagcccacaauugucuuacccacuaugccccucucuagucaugguccccaagaggggcuuggagacccacuuagcaggugaaagcaauggcagccuuccuuauuugauuaugcaccuaagaauaaaugguauuugggcauguauucccaauauguguauauuuauuuauaaauauauacagauacuauuaucuguauguuaguaauaaagcuuaaauuauuccauuuuaaaauuaugaauaugaauaggguuuuuuuuauguuucuugccucauccc

SEQ ID NO: 15032 - RNA, 13979 nt, Homo sapiens
cauugugacgcgugggggggcguggccagggccccgaggcaguugcacggagggggcguggcgagcggagugaguaggcaguugcgagcaugcgucguguugggcggugcgguugcacgcccgagagucuucgucaggaagcuuauucgccaauaggcggcuguugcucggucgccgggggcguggccaugcagauaaggcgcgggugggcggcccaaugggcgggcgccuaugcagaugagacggugacagcccggccagcgggcgggcgggcaggcugcuggggcggggaggugggaccgggagagggguggccgcggggcccggccgggcuggggcggggggccgcagccaugauccgggccuucucguucccggugagcccugagcggggccggcugcggggcuggcuggaggguagccuggccgggcucugcgaguuacauuggcuccgggagaggcaggaguaccgcgugcagcaggcgcugcggcuggcccagcccggaauggggggcgccgaggccgaggacgaggaggacgccgaugaggaugaagaugcggcggcggcgcgccgggccgcagcggcccuggaggagcagcugguaaggggcugccuguccguccgucccuccacccccgucugugucugucugucucgguuggaugcucagacaccgggcggggguuggggacccggguaggcagggagugagaaaggacaggggguggggcuggcgaccccggaguuccggcggcgggccggaccuggccuccccgcccccaaaucgggggagggggaacugcaucgcccccacuggggccucgugagaaacacaggcccugucucuuacaccccuuccccaaagaaaauccuugugggcgccaaguaugugucaaacccgagaccggguacuuugcaggcguugucuucuugcggcuugggaaacggggugauaguccccauuuaacagagaaacaaauugaggcucagagagagcaagcgacucacccaaggugacacagccaggcuccaaacaugcccuucucugggccccgccaccagggcuccaucuucccuaaguccuggugugcuuggagaucucuggagggggcggggugggaggaggggaaucucagggccuccagagggagggaccacugcugagaggaagcucacagucccugaggaccccccacugggaucuugacccuuuggugacacuuccccugcuuccuaccuggccccagcucuccuugacccaaggggaggcaggucgaggcagcgccugggggagacuucuggacucuggguguucucaugguggaagaugggcagaggucuccggaaugacuugaggacgccccaugccucuccccuuucuaugucauuccuugagucucccgaucucguccuggguucugucacucucuccguccugccacaucccugugacuuucugugucugcuucucuuucuucauccugucucucugucucugugaucucugugucccucugcaucugucuccuuggccuucccuuccugccugucugcaccucgcucucuucuucuugcccgacgucccaggcucagucugucuuccccuccccccagcccgcacacccuggcuccacggcagauccccauccccaagccuguguguggccagagcuucccguuucgggaaaccugagccgagguggcaguggagggggcucuccccgccgcugaccucgaccgcccccuccccagauggggaguggggaggaagacugaagccaggcucccggggcugcacgcccggccccucccccucucaggagugggaccccccugcacauucuuuucuggaaacagaaacagcugugggaggccccacccccucccaaaguuagagacggauugugggggccuucgcuagcuccccccaccccaagcuggcucggcuuggaaggcgccuuccauccugacaaggagaaugcgaggcaugagguugggguagcuguggguagcuguguccucucccccucugcccucggucucuccccuuuucacccuucaccuuccccaucucugcccuucagucucccucuccucggucccucuguccccuccucccccucagcccucuguccucccggcacgagcugauaguggagaggccuguccccccaccccccagucucuaggcaaagcuugucccagcaucagggaggaggcgguggcaggcggggggaggaggaggagcagagaagcgcuaaauauaaacuucucuagugcuggggguuccugggucccucugaagaguggauuagggcuucuucugaucccccaacccuugucuuaugacuuauccccccacccccagccccugccaggaauacacuuccuucaaggcaagaaagacugaagccagacuugauuacuuucuaauaggaaugauggggauaccagguaaagaucagggguguggcagagaagagaggcaggaauccugggugagggcaggggcucccuggguccugcuugcucucaagaaggaaaaagguuccuuucaucaagaauaacuuaaguuagacuugcagaaugacuuccuaauagagauaaaugggcacuggauaccaacgaggggcacgugaggggagaaacaagguaagggaaguuugggcaaaggggucuccagggguccuaaccacacucuuauuaagccugcagaggaaggaugaggggcaccgugaggaggcagagagccagacucaggccaaggacuuucuaaucuuuuaaagauucauccuuuugcaacuggaaggaaugaggccagacuugcaaauagagggguguagacuuggaauauuuuuggggggcgucuaggugcuggagaggaggaggcaucuccugucugucucccuaauuucugcucuuccuuguaauggaagaaccggaauuagacuuggcagaacuuaccaaaaagucuauccuuucacguuuauuuauguauuuuuaaaugauauauuuauuuauucauuuauuuuuggagacaaagucucucaggcugaagugcaguggcacgaucauagcucacugcagccucuaacuuggccucaagcaauccuccugccucagccucccaagaagcuaggacuacaggugcacaccgccacauuuggcuaauuuuuuuuuuuuuuuuaaagauaugaggucuugcuauguuguucaggcuggucuccaacuccugggcucaagcaauccuucugucucagccucucaaagcacuaggauugcaggugugagcuacuguaccuggccuuuauuuauuuauucauugagacagaaucuugcucugucacccaggccagagugcaauggcacaaucucugcucacugcaaccuccaccuccuagguucaagugauucucggcucacugcaaccuccaccuccuggauucaagcaauucuccugccucagccucccgaguagcuggaauuacaggcaugcaccaucaccccuggcuaauuuuuguauuuuuaguagagaugggcuuucaccauguuggccaggcuggucuugaauuccuggccucaagugauccucccgccucggucucccaaaguuguugggauuacaggcgugagccacugcgcccgacaccuacauuuauuuuuaauuaaacaauggaaacauuuucuauuuuccuuauaagaaauucauagcuuuccuguaaucauacaaacuggcauuuauuaugugucaaaagaaacucauuggccgggcgcgguggcucacgccuguaauuccagcacuuugggaggccgaggcaggcagaucacaaggucaggagauugagaccaucuuggcuaacgugguggaaccccgucucuacuaaaaauacaaaaaauuagcugggcgugguggcgggcaccuguagucccagcuacucgggaggcugaggcaggagaauggcgugaacccgggaggcggagcuugcagugagccgagauugugccacugcacuccagccugggcgacagagcaagacuccgucucaaaaaaaaaaaaaaaaaaaaaaaaagaaacucauuuaauccucacaauaaccuccaggagaugguguccuaugaugcccaguuauagauaaggaaacugaagcccagagagguaaagucacccacccaaggucacacagcuggggagcagcagagcuuaaugugaugccaagucacgccuccuuaaacacuuccuuccaccauccaguccccucauuccucccuggauccccuaaauccaaccuauccccugaggucaccaucauugucaccuuagugucaccucccagaccucuuccaacauaucuccuaacagaaacuguuuacauaccaaaaaacguagagcuuuugucaaagcuuugcuuuuuacaaauucuaguuucuugggugaggucccagagacuaugccagucaaaguguggccuccuagccagcagcaccacaugacauggaacuuguuagccauacaacuacuugggcgugacugcaggcuguaaucaaaagcucugggaaugggacucagucauuugggcuuucacaagcccuccagguaauucugagucacucauacuauauauauucugcccuuuucuguuucugcucaaugcuauaucuugguaaugauucuauauagaaauuugacucauuccguuuuaacagcuguauaguauuccauuguauacauucauucuuucaucuaauauuucuuuuuaaaaaauagacagcugggugcaauggcucaugccugcaaucccagcacuuuaagagaccgaggcgggaggacugcucaagcccaggaguucgagacaagccuaugcaacacagggagacccugucucuacaaaaaaauacaaagauuagcgggggugugguggcaugugccuguagucccagcuacuugggaggcugaggugguaggaucaccugagcccaggaggugaaggcugcagugagccgugaucgugccacugcaguccagccuggugagacagugagaccuugucucaaaaauaaaauaaaaaagaccaggcacaguggcucacgcaugcaaucccagcacuuugggaggcugaggugggcggaugacuuguagucaggaguucgagaccaaccuggccaacaugaugaaacccugucucuacuaaaaacacaaaaauuagccaaguguggugggacaugcuugucaucccaccugcuugggaggcugaggcaaaaaaaaaaaaucacuugaaccugggagguggaggcugcaccacugcacuccagccugagcgguagagcuagauuccaucucaaaaauaaauaaauaaauaaauaaauaaauaaauaaauuucauauauauacauauauguguauauacauguguguauauauaguguauauauguguauauauauguguguauauauauauguguguuuguguauauauauauauauauauauagagagagagagagagagagagagacugggucucacuaugucgccuaggcuggucuugaacucucggccuccagcgauccucccgccuuggcacuuccagagugcugggaugauaggcauaagccaccacacccagcccauuaaauauuuccugagcacccacuuugugccaggcacuguucuaggcacugggugggggugcaccugugagcuaaacagacaaaucuccgcguuccuagggcugacauucuagugagagauucaacaaacaaaugauaccuugauguauacuuuuauuuuauuuuaguuguuuuuggagaugaaaucuuacugucgcccaggcuggagugcaguggcgugaucucggcucacugcaaccuccgccucccugguucaagcaauucuccugcuucagccucuuggguagcugggauuacaggcacacaccaccacaccuggcuauuuuuuguauuucuaguagagacgggguuucaccauguuggccaggcugaucuugaacuccugaccucaagugauccucccugccuuggccucccaaggugcugggauuacaggcgugagccaccgagccuggccugauguauaauuuuaaaucaagaggucauuacugauauguagaaaaaacccgaaaagcagggcaacgggguacacaaugacaggggagcuauuuuggaaaggugucagagaagagaucaccaaagaucugaaugaagcaaggaagguaugugggggaaacauucucccgagguaggcgcauacaugguauguucgagggacgguggcaaggccaggcguggcuagaggggagugagcaugccagugauuugugacggacgugacaugggguacaugguagguccgagagauuuuuuuuuaguuacuuccugaugcugcacaauucagcugcuuuuuugaguuccgcucaaagaugacuucacugugagcaucucaauauacccagggcaggagcccagaguggaaggauuuguugaccuuccucaaauaaacaggcccggaugggggcuucuguucuagggggaugggagaggcugggcccuggagagacugggauggggcggggggguuguggcugccggggagccggccagucuuucugcccuaaauaggcaggguugggugccugcccucccaaacccuccuccccacuucccucccuccugcgguccagacaagccgcuuuugucugagggucaaccgucagcccgaggcugccugcugcuacccggccucacucagacccaugugagacuuuuucuggcucugacccucucuuuucuaaaaugagauuaaguccuaaugucuuggagaccccauccgugagaagugcucuuuuccugcagcaagaaggauccaggguagacucauggaaauuucuuuuucuuuuuuccuuuuuuuuuuuuuuugucagucuugcuguguugcuuaggcuggagugcaauggugugaucucggcucacugcaaccucugccuccugggcucaagcaauccucccgccucagccucucuaguagcugggacuacaggcgcaaaccaccacgccccgcuaguuuuuguauuuuuaagggagacaagguuucaccauauuggccaggcugguuccaacuccugaccucaugugauccgcccgccucggccucccaaaaugcugggauuacaggcgugagccacugcgcccggccugacuccccgaaauuucucauggcgaugaggaaagguagacucacuggagcuuccuggugggaguggaccaaaggcagaaggaggauguggucucuagggcaaaggaacgugcugggauggcugcugcaguaccaguaaggcuagacucacaggacugucuaggaggcuugggagguucuuucugaagggagagcaaagacguuuaugagucguggucagccuauuuuacccauaugggggaaagaggcaaucugcagcaggaaggacuuaaggaagacucacaaaaggaccuucucuuggugauaaggggcaaugggcguaucugagaaagaaggucaaagacggggagaggcugggcgcaguggcucaugccuguaaucccggcacuuugggaggcugaggcagguggaucaccugaggucaggaguucaagaucagccugggcaacauggugaaacccugccucuacugaaaacacaaaaauuaucugggcgugguggcgggcgccuguaaucccagcuacucaggaggcugaggugggugaauugccugaucccgggagguagaggcugcagugagcugggaucacgccacugcccuccagccuaggcgacagagugagacccuaucucaaaauaaauaaauaaauaaauaaauaaauaaaaauaaaaaaagaaaaacuuggagaagaaggcagaccuaugacuaagggaucuggggguccuggacaccaccuuuuagcaguaaacuguccuuacagcaauccugaaguuagacucaaagagggacauucuaaucaggguugaggggcucugagcacagauuggggguagcaacugauaaagacagggcaagagauggggguuuucugaggccucaucacaccuaagagggaaugagauggggcugcagcaugaaggacuggaguuggaacgucagaaggacuuucuaauggggaugaagggacacagaucuugaggggguccugggacugagguacugcuuuuauccuuugaagcgagagccucauugucaaagugaaacucugcccaugagcucguggaauaggggaccagucggcagaggacugggggccuucugaccauccuucucucccuaugccuucaggaggcccugccuggucucgucugggaccugggacagcagcugggagaccugagccuggagucugggggccuggaacaggagagcgggcguagcucgggugagcauggauggagggguaggguuugccugggacgccuccauguuccccguaucccuauuucugaggcccccugugucucuccccacgccaucuccuccuuuccccagcucugguuuucccacccaaacccccugaagucucucugcuucuccuggaaauuuaggcuucuaugaagaucccagcucuacaggagguccagauucaccacccucaaccuucuguggggacaguggcuucucuggauccagcuccuauggucgccugggucccucugagccccggggcaucuaugccagugagaggcccaagucccuagguaaggugggugaggguggggcccuggggccagggaaaggacaguaggaggaugguugugggcacagacuuccgaaucgggccuggauuccaauuccagcugugacauuuccuuuucacaugguuaugagcaggucucuuauuucugggucucuguuuuuccaucuguuaaaaugaaauauggcugggugcgguggcucacgccuguaaucccagcacuuugggaggugggcggaucacuugaggccaggagauugagaccagccuggccaacauagugaaaccccgucuauacaaaaauuaguugggcgugguagcgaacaccuguaauuccagcuacucgggaggcugaggugggaggaucgcuugaaccugggagguggagguugcagugagccaagauugugccacugcccuccagucugggugacagagcaagacucugucucaaaauaaauaaauaaauaggcugggcacaguggcucaugccuguaaucccaacacuuugggaggccaaagcagguggaucaccugagaucaggaguucgagaccaaccugaccaauaugguaaaauccugucucuacuaaaaauacaaaacuuagcuaggcguggugaugugugccuguagucccaucuacucugaagacugaaacaggagaauugcuugagcccuggagguggagguugcagugagccaagauggagccacugcacucuagccagggugacagagugagacuccaucucaaaaaauaaauaaauaaauauaaaaugguauaauaacagugccucaauagccaggcauuguggugcaugccuguaucccagcuacuugggaggcugagccaggaggauugcuugaaccugggaggcagagguugcagugagcugagauggugucacugcgcuccagccugggugacagagcaagacucugccucaaaaagauaaaaauaaaacaccaaccacacacacacacacacacacacacacacacacacacacacacacacaaacagugccugcccuaaggggauauuuuugaauauucagugagccucugcucuaaggcauuggacuuggugcauggcagucacugguaaacaggaacugcugucauucauucauacaaguaaguuuuugagcccccacuaugugcuaccuagcaguaucccaggagcaaugaacaaaaugaacaguaaugaacaaaacaggcaaaucccugcccucaggaaacugccagccuaguuggaggaauagauaaaauacaggauaaauggccaggcgcgguggcucaugccuguaaucccagcacuuugggaggccgagacgggcagaucacgaggucuggaguuccagaccagccugaccaacauggugaaaccccgucucuacaaaaaauacaaaaauuagcugggcgugguggcgcgugccuguaaucccagcuacucaggaggcugaggcaggagaaucgcuugaaccuggguggcagagauugcagugagcugagaucaugccacugcacuccagccugggugacagagcgagacuucgucuaaaaaauaaauaaauaaauaaauaaauaaauaaauagauaaauaaauaaaccaggauaaauaaguaaaauaucuaggguacgaaauaaugccaugugcuaugacaagaaauaagccggggaaagggacucagaagugucccuuugaguuuggggagggaagugcaauuuuagaaaauauggcuggggagggcuucacugagacuguaacauuugaguugugcccugaacuaagugggggaguggaccuagcagauauccagaaggaagagcauuccgggcaucuggaaucuggaaugggaagcagaaaggcucugaggccagaaugugacuggcgccugcuuucaggaggccaguguggcuggaguccuauaaguagaggagaagggucagcucagugguucaugccuguaaucccagcacuuuaggaggcugaggcgggaggauuauuugagccugggagcuggagacuagacugggcaacacagugagaccccaucccuacaaaaaauaaaaaaaucagcagggcauggugaugcguuccuguagucccagccguucaggaagauaaggcgagaggaucccuugagcccaggagcuggaaacugcagugagcuaugauugcgccacugcacuccagccugggugacagagcaagcaagaaccugucuuaaaaaaaaaaggccaggcgcaguggcucacaccuguaaucccagcacuuugggaggccgaggcgggaggaucacgaggucaggagaucgagaccauccuggcgaacacggugaaaccccgucucuacuaaaaauacaaaaaaauuagccgggcgugguggcgggcgccuguagucccagccacucaggaggagaauggcaugaacccgggaggcggagcuugcagugagccgagaucgggcuacugcacuccagccugggcgacagaacgagacuccgucucaaaaaaaaaaaaaaaaaaaaaauaggggguaagauguugugagaguuggagaggcagaggcagaggcaggacaagucacgcagggucuuguaggacccuguaaagauuuuauuaugaauuuuacaagaaggaaggugugagagcaggguuuuugcugcgaugaggauggaagggagggaggcaacccgccccuuccgggcuggaugagaaaugggaaaggacuuugagagccccuccacucucucuuuuuuuuuuuuuuuuggccuuccuucccuaggagacgccagucccagcgcuccggagguggugggcgcgcgggcagcggugccgcgguccuucucagcgcccuacccgacggcagggggguccgccggcccggaggccugcuccucggcggagcggcgggcccgcgccgggcccuuucugacgcccagcccccugcacgccguggcgaugcgcagcccgcggcccugcggccgcccucccaccgacucgcccgacgcggggggcgcagggcggccccuggacggcuacaucucggcgcuccugcgcaggcgccgccgccggggggcgggccagccccggaccagucccgggggcgcggacggcggcccgcggcgccagaacagcgugcgccagcggccgcccgacgcgucuccgucccccggcagcgcgcgacccgcgcgggagcccucguuggagcgcgucgggggccaccccaccagcccugccgccuugagccgcgccugggcgucgucgugggagucggaggcggcacccgagcccgcugcgccgcccgccgcccccucaccccccgacagcccggcugagggccgcuuggugaaggcgcaguacaucccgggcgcgcaggcggccacccgaggccucccuggccgcgccgcccgccgcaaaccgccgccacugacccgcggccgcagcguggagcagucaccaccccgggagcguccccgggccgccggccgccguggacgcauggccgaggcuucgggccgccgcggcucgcccagggcccgcaaggccucgcgcucccagucugagaccagccugcugggccgcgccuccgcggucccuucggggcccccuaaguaccccacggcggagcgggaagagccucggccuccacggccacgccgcggcccagcgcccacgcuggcggcccaggccgcaggguccugccgucgcuggcgcuccacugcggagaucgacgcugccgaugggcgccgcgugcggccccgagccccugcggcgcguguucccggccccggcccguccccgucagcuccccagcgucgucugcuuuacggcugcgcgggcagcgacuccgagugcucggcugggcgccuggggccccugggacgccgggggccugcgggaggcgucggcggggguuacggggagagcgaaucgagcgccagcgagggagaaucgccugccuucagcucugccuccagcgacucagacggcagcgguggccucguguggccgcagcagcugguggcggccaccgcggccucuggggguggagcaggugcaggggcgcccgcaggccccgccaaagucuucgugaaaaucaaagcuucccacgcgcucaagaaaaagauacugcguuuccguucggguucucucaaggucaugacuacagugugaguuuggggauuugcuugggcucccccuucauggccucugcaccuccacacucccaaccacugacccuuccacaucuaccuuccaaagaccaucguuuucucugcuuccaaagaccccccucacucuccccacuccuaacagucuugguugaaaaggcucccccaccaccaccgagaggaauggggaggagcccuguuugacccaguucagcuucuagcuuggaagcccuugggcaagacaguuccccuucucugggcgucacuuuccucaucuguacaguaaguguccauguaugcaaaagggguaauucgguuugaauuuccccguuuuaguuuagaagccuagucuguuuguuccccuccaccgcucucccucucauuccugaugagcccucucauuccuccuuuccuugcccagcuauggcccccucucauucacaaagugcccccuccaugucccuggacccuuaagauauccccuuggcacccuggucagagacucugugucugacucagguggucccugcagagugcccugggaagggaaggagcacugauuuggggguuuugagggucaaguagggguugguaacaccuggaaagaaggacucuuucacuucgaucccuggacaauuauggaggauucggagguagaagaggggaaggaagaugguuucuaucucaugacccccacucccugugagagggaaugggggaagccugaugacccucagcuguuccaaucuaguauuuuuuuucuuuuuuaaaauuacuguauuuauuaugacgauggugacuccccagugcaaaggggggccagauucuguguguuucucuaaccucuuuguaaauaaaugcacaguguaacauaugugguggacucucacugaaugauuaaaugggagaaaugcucuuuuuccuuuggacuaacauuuauugagcaacuucuguuugcuguggauauggcaguuuccagggaggucccagggugaaucucaacaucaucuuccuaccauuggcuauuuuacaucaaggaaucuaacc

SEQ ID NO: 15033 - RNA, 13979 nt, Homo sapiens
gguuagauuccuugauguaaaauagccaaugguaggaagaugauguugagauucacccugggaccucccuggaaacugccauauccacagcaaacagaaguugcucaauaaauguuaguccaaaggaaaaagagcauuucucccauuuaaucauucagugagaguccaccacauauguuacacugugcauuuauuuacaaagagguuagagaaacacacagaaucuggccccccuuugcacuggggagucaccaucgucauaauaaauacaguaauuuuaaaaaagaaaaaaaauacuagauuggaacagcugagggucaucaggcuucccccauucccucucacagggagugggggucaugagauagaaaccaucuuccuuccccucuucuaccuccgaauccuccauaauuguccagggaucgaagugaaagaguccuucuuuccagguguuaccaaccccuacuugacccucaaaacccccaaaucagugcuccuucccuucccagggcacucugcagggaccaccugagucagacacagagucucugaccagggugccaaggggauaucuuaaggguccagggacauggagggggcacuuugugaaugagagggggccauagcugggcaaggaaaggaggaaugagagggcucaucaggaaugagagggagagcgguggaggggaacaaacagacuaggcuucuaaacuaaaacggggaaauucaaaccgaauuaccccuuuugcauacauggacacuuacuguacagaugaggaaagugacgcccagagaaggggaacugucuugcccaagggcuuccaagcuagaagcugaacugggucaaacagggcuccuccccauuccucucggugguggugggggagccuuuucaaccaagacuguuaggaguggggagagugaggggggucuuuggaagcagagaaaacgauggucuuuggaagguagauguggaagggucagugguugggaguguggaggugcagaggccaugaagggggagcccaagcaaauccccaaacucacacuguagucaugaccuugagagaacccgaacggaaacgcaguaucuuuuucuugagcgcgugggaagcuuugauuuucacgaagacuuuggcggggccugcgggcgccccugcaccugcuccacccccagaggccgcgguggccgccaccagcugcugcggccacacgaggccaccgcugccgucugagucgcuggaggcagagcugaaggcaggcgauucucccucgcuggcgcucgauucgcucuccccguaacccccgccgacgccucccgcaggcccccggcgucccaggggccccaggcgcccagccgagcacucggagucgcugcccgcgcagccguaaagcagacgacgcuggggagcugacggggacgggccggggccgggaacacgcgccgcaggggcucggggccgcacgcggcgcccaucggcagcgucgaucuccgcaguggagcgccagcgacggcaggacccugcggccugggccgccagcgugggcgcugggccgcggcguggccguggaggccgaggcucuucccgcuccgccgugggguacuuagggggccccgaagggaccgcggaggcgcggcccagcaggcuggucucagacugggagcgcgaggccuugcgggcccugggcgagccgcggcggcccgaagccucggccaugcguccacggcggccggcggcccggggacgcucccgggguggugacugcuccacgcugcggccgcgggucaguggcggcgguuugcggcgggcggcgcggccagggaggccucggguggccgccugcgcgcccgggauguacugcgccuucaccaagcggcccucagccgggcugucggggggugagggggcggcgggcggcgcagcgggcucgggugccgccuccgacucccacgacgacgcccaggcgcggcucaaggcggcagggcuggugggguggcccccgacgcgcuccaacgagggcucccgcgcgggucgcgcgcugccgggggacggagacgcgucgggcggccgcuggcgcacgcuguucuggcgccgcgggccgccguccgcgcccccgggacugguccggggcuggcccgccccccggcggcggcgccugcgcaggagcgccgagauguagccguccaggggccgcccugcgccccccgcgucgggcgagucggugggagggcggccgcagggccgcgggcugcgcaucgccacggcgugcagggggcugggcgucagaaagggcccggcgcgggcccgccgcuccgccgaggagcaggccuccgggccggcggaccccccugccgucggguagggcgcugagaaggaccgcggcaccgcugcccgcgcgcccaccaccuccggagcgcugggacuggcgucuccuagggaaggaaggccaaaaaaaaaaaaaaaagagagaguggaggggcucucaaaguccuuucccauuucucauccagcccggaaggggcggguugccucccucccuuccauccucaucgcagcaaaaacccugcucucacaccuuccuucuuguaaaauucauaauaaaaucuuuacaggguccuacaagacccugcgugacuuguccugccucugccucugccucuccaacucucacaacaucuuacccccuauuuuuuuuuuuuuuuuuuuuuugagacggagucucguucugucgcccaggcuggagugcaguagcccgaucucggcucacugcaagcuccgccucccggguucaugccauucuccuccugaguggcugggacuacaggcgcccgccaccacgcccggcuaauuuuuuuguauuuuuaguagagacgggguuucaccguguucgccaggauggucucgaucuccugaccucgugauccucccgccucggccucccaaagugcugggauuacaggugugagccacugcgccuggccuuuuuuuuuuaagacagguucuugcuugcucugucacccaggcuggagugcaguggcgcaaucauagcucacugcaguuuccagcuccugggcucaagggauccucucgccuuaucuuccugaacggcugggacuacaggaacgcaucaccaugcccugcugauuuuuuuauuuuuuguagggauggggucucacuguguugcccagucuagucuccagcucccaggcucaaauaauccucccgccucagccuccuaaagugcugggauuacaggcaugaaccacugagcugacccuucuccucuacuuauaggacuccagccacacuggccuccugaaagcaggcgccagucacauucuggccucagagccuuucugcuucccauuccagauuccagaugcccggaaugcucuuccuucuggauaucugcuagguccacucccccacuuaguucagggcacaacucaaauguuacagucucagugaagcccuccccagccauauuuucuaaaauugcacuucccuccccaaacucaaagggacacuucugagucccuuuccccggcuuauuucuugucauagcacauggcauuauuucguacccuagauauuuuacuuauuuauccugguuuauuuauuuaucuauuuauuuauuuauuuauuuauuuauuuauuuuuuagacgaagucucgcucugucacccaggcuggagugcaguggcaugaucucagcucacugcaaucucugccacccagguucaagcgauucuccugccucagccuccugaguagcugggauuacaggcacgcgccaccacgcccagcuaauuuuuguauuuuuuguagagacgggguuucaccauguuggucaggcuggucuggaacuccagaccucgugaucugcccgucucggccucccaaagugcugggauuacaggcaugagccaccgcgccuggccauuuauccuguauuuuaucuauuccuccaacuaggcuggcaguuuccugagggcagggauuugccuguuuuguucauuacuguucauuuuguucauugcuccugggauacugcuagguagcacauagugggggcucaaaaacuuacuuguaugaaugaaugacagcaguuccuguuuaccagugacugccaugcaccaaguccaaugccuuagagcagaggcucacugaauauucaaaaauauccccuuagggcaggcacuguuugugugugugugugugugugugugugugugugugugugugugugugugguugguguuuuauuuuuaucuuuuugaggcagagucuugcucugucacccaggcuggagcgcagugacaccaucucagcucacugcaaccucugccucccagguucaagcaauccuccuggcucagccucccaaguagcugggauacaggcaugcaccacaaugccuggcuauugaggcacuguuauuauaccauuuuauauuuauuuauuuauuuuuugagauggagucucacucugucacccuggcuagagugcaguggcuccaucuuggcucacugcaaccuccaccuccagggcucaagcaauucuccuguuucagucuucagaguagaugggacuacaggcacacaucaccacgccuagcuaaguuuuguauuuuuaguagagacaggauuuuaccauauuggucagguuggucucgaacuccugaucucaggugauccaccugcuuuggccucccaaaguguugggauuacaggcaugagccacugugcccagccuauuuauuuauuuauuuugagacagagucuugcucugucacccagacuggagggcaguggcacaaucuuggcucacugcaaccuccaccucccagguucaagcgauccucccaccucagccucccgaguagcuggaauuacagguguucgcuaccacgcccaacuaauuuuuguauagacgggguuucacuauguuggccaggcuggucucaaucuccuggccucaagugauccgcccaccucccaaagugcugggauuacaggcgugagccaccgcacccagccauauuucauuuuaacagauggaaaaacagagacccagaaauaagagaccugcucauaaccaugugaaaaggaaaugucacagcuggaauuggaauccaggcccgauucggaagucugugcccacaaccauccuccuacuguccuuucccuggccccagggccccacccucacccaccuuaccuagggacuugggccucucacuggcauagaugccccggggcucagagggacccaggcgaccauaggagcuggauccagagaagccacuguccccacagaagguugaggguggugaaucuggaccuccuguagagcugggaucuucauagaagccuaaauuuccaggagaagcagagagacuucaggggguuugggugggaaaaccagagcuggggaaaggaggagauggcguggggagagacacagggggccucagaaauagggauacggggaacauggaggcgucccaggcaaacccuaccccuccauccaugcucacccgagcuacgcccgcucuccuguuccaggcccccagacuccaggcucaggucucccagcugcugucccaggucccagacgagaccaggcagggccuccugaaggcauagggagagaaggauggucagaaggcccccaguccucugccgacugguccccuauuccacgagcucaugggcagaguuucacuuugacaaugaggcucucgcuucaaaggauaaaagcaguaccucagucccaggacccccucaagaucugugucccuucauccccauuagaaaguccuucugacguuccaacuccaguccuucaugcugcagccccaucucauucccucuuaggugugaugaggccucagaaaacccccaucucuugcccugucuuuaucaguugcuacccccaaucugugcucagagccccucaacccugauuagaaugucccucuuugagucuaacuucaggauugcuguaaggacaguuuacugcuaaaaggugguguccaggacccccagaucccuuagucauaggucugccuucuucuccaaguuuuucuuuuuuuauuuuuauuuauuuauuuauuuauuuauuuauuuugagauagggucucacucugucgccuaggcuggagggcaguggcgugaucccagcucacugcagccucuaccucccgggaucaggcaauucacccaccucagccuccugaguagcugggauuacaggcgcccgccaccacgcccagauaauuuuuguguuuucaguagaggcaggguuucaccauguugcccaggcugaucuugaacuccugaccucaggugauccaccugccucagccucccaaagugccgggauuacaggcaugagccacugcgcccagccucuccccgucuuugaccuucuuucucagauacgcccauugccccuuaucaccaagagaagguccuuuugugagucuuccuuaaguccuuccugcugcagauugccucuuucccccauauggguaaaauaggcugaccacgacucauaaacgucuuugcucucccuucagaaagaaccucccaagccuccuagacaguccugugagucuagccuuacugguacugcagcagccaucccagcacguuccuuugcccuagagaccacauccuccuucugccuuugguccacucccaccaggaagcuccagugagucuaccuuuccucaucgccaugagaaauuucggggagucaggccgggcgcaguggcucacgccuguaaucccagcauuuugggaggccgaggcgggcggaucacaugaggucaggaguuggaaccagccuggccaauauggugaaaccuugucucccuuaaaaauacaaaaacuagcggggcguggugguuugcgccuguagucccagcuacuagagaggcugaggcgggaggauugcuugagcccaggaggcagagguugcagugagccgagaucacaccauugcacuccagccuaagcaacacagcaagacugacaaaaaaaaaaaaaaaggaaaaaagaaaaagaaauuuccaugagucuacccuggauccuucuugcugcaggaaaagagcacuucucacggauggggucuccaagacauuaggacuuaaucucauuuuagaaaagagagggucagagccagaaaaagucucacaugggucugagugaggccggguagcagcaggcagccucgggcugacgguugacccucagacaaaagcggcuugucuggaccgcaggagggagggaaguggggaggaggguuugggagggcaggcacccaacccugccuauuuagggcagaaagacuggccggcuccccggcagccacaacccccccgccccaucccagucucuccagggcccagccucucccaucccccuagaacagaagcccccauccgggccuguuuauuugaggaaggucaacaaauccuuccacucugggcuccugcccuggguauauugagaugcucacagugaagucaucuuugagcggaacucaaaaaagcagcugaauugugcagcaucaggaaguaacuaaaaaaaaaucucucggaccuaccauguaccccaugucacguccgucacaaaucacuggcaugcucacuccccucuagccacgccuggccuugccaccgucccucgaacauaccauguaugcgccuaccucgggagaauguuucccccacauaccuuccuugcuucauucagaucuuuggugaucucuucucugacaccuuuccaaaauagcuccccugucauuguguaccccguugcccugcuuuucggguuuuuucuacauaucaguaaugaccucuugauuuaaaauuauacaucaggccaggcucgguggcucacgccuguaaucccagcaccuugggaggccaaggcagggaggaucacuugaggucaggaguucaagaucagccuggccaacauggugaaaccccgucucuacuagaaauacaaaaaauagccaggugugguggugugugccuguaaucccagcuacccaagaggcugaagcaggagaauugcuugaaccagggaggcggagguugcagugagccgagaucacgccacugcacuccagccugggcgacaguaagauuucaucuccaaaaacaacuaaaauaaaauaaaaguauacaucaagguaucauuuguuuguugaaucucucacuagaaugucagcccuaggaacgcggagauuugucuguuuagcucacaggugcacccccacccagugccuagaacagugccuggcacaaagugggugcucaggaaauauuuaaugggcugggugugguggcuuaugccuaucaucccagcacucuggaagugccaaggcgggaggaucgcuggaggccgagaguucaagaccagccuaggcgacauagugagacccagucucucucucucucucucucucucuauauauauauauauauauauacacaaacacacauauauauauacacacauauauauacacauauauacacuauauauacacacauguauauacacauauauguauauauaugaaauuuauuuauuuauuuauuuauuuauuuauuuauuuuugagauggaaucuagcucuaccgcucaggcuggagugcaguggugcagccuccaccucccagguucaagugauuuuuuuuuuuugccucagccucccaagcaggugggaugacaagcaugucccaccacacuuggcuaauuuuuguguuuuuaguagagacaggguuucaucauguuggccagguuggucucgaacuccugacuacaagucauccgcccaccucagccucccaaagugcugggauugcaugcgugagccacugugccuggucuuuuuuauuuuauuuuugagacaaggucucacugucucaccaggcuggacugcaguggcacgaucacggcucacugcagccuucaccuccugggcucaggugauccuaccaccucagccucccaaguagcugggacuacaggcacaugccaccacacccccgcuaaucuuuguauuuuuuuguagagacagggucucccuguguugcauaggcuugucucgaacuccugggcuugagcaguccucccgccucggucucuuaaagugcugggauugcaggcaugagccauugcacccagcugucuauuuuuuaaaaagaaauauuagaugaaagaaugaauguauacaauggaauacuauacagcuguuaaaacggaaugagucaaauuucuauauagaaucauuaccaagauauagcauugagcagaaacagaaaagggcagaauauauauaguaugagugacucagaauuaccuggagggcuugugaaagcccaaaugacugagucccauucccagagcuuuugauuacagccugcagucacgcccaaguaguuguauggcuaacaaguuccaugucauguggugcugcuggcuaggaggccacacuuugacuggcauagucucugggaccucacccaagaaacuagaauuuguaaaaagcaaagcuuugacaaaagcucuacguuuuuugguauguaaacaguuucuguuaggagauauguuggaagaggucugggaggugacacuaaggugacaaugauggugaccucaggggauagguuggauuuaggggauccagggaggaaugaggggacuggaugguggaaggaaguguuuaaggaggcgugacuuggcaucacauuaagcucugcugcuccccagcugugugaccuugggugggugacuuuaccucucugggcuucaguuuccuuaucuauaacugggcaucauaggacaccaucuccuggagguuauugugaggauuaaaugaguuucuuuuuuuuuuuuuuuuuuuuuuuuugagacggagucuugcucugucgcccaggcuggagugcaguggcacaaucucggcucacugcaagcuccgccucccggguucacgccauucuccugccucagccucccgaguagcugggacuacaggugcccgccaccacgcccagcuaauuuuuuguauuuuuaguagagacgggguuccaccacguuagccaagauggucucaaucuccugaccuugugaucugccugccucggccucccaaagugcuggaauuacaggcgugagccaccgcgcccggccaaugaguuucuuuugacacauaauaaaugccaguuuguaugauuacaggaaagcuaugaauuucuuauaaggaaaauagaaaauguuuccauuguuuaauuaaaaauaaauguaggugucgggcgcaguggcucacgccuguaaucccaacaacuuugggagaccgaggcgggaggaucacuugaggccaggaauucaagaccagccuggccaacauggugaaagcccaucucuacuaaaaauacaaaaauuagccaggggugauggugcaugccuguaauuccagcuacucgggaggcugaggcaggagaauugcuugaauccaggagguggagguugcagugagccgagaaucacuugaaccuaggagguggagguugcagugagcagagauugugccauugcacucuggccugggugacagagcaagauucugucucaaugaauaaauaaauaaaggccagguacaguagcucacaccugcaauccuagugcuuugagaggcugagacagaaggauugcuugagcccaggaguuggagaccagccugaacaacauagcaagaccucauaucuuuaaaaaaaaaaaaaaaauuagccaaauguggcggugugcaccuguaguccuagcuucuugggaggcugaggcaggaggauugcuugaggccaaguuagaggcugcagugagcuaugaucgugccacugcacuucagccugagagacuuugucuccaaaaauaaaugaauaaauaaauauaucauuuaaaaauacauaaauaaacgugaaaggauagacuuuuugguaaguucugccaagucuaauuccgguucuuccauuacaaggaagagcagaaauuagggagacagacaggagaugccuccuccucuccagcaccuagacgccccccaaaaauauuccaagucuacaccccucuauuugcaagucuggccucauuccuuccaguugcaaaaggaugaaucuuuaaaagauuagaaaguccuuggccugagucuggcucucugccuccucacggugccccucauccuuccucugcaggcuuaauaagagugugguuaggaccccuggagaccccuuugcccaaacuucccuuaccuuguuucuccccucacgugccccucguugguauccagugcccauuuaucucuauuaggaagucauucugcaagucuaacuuaaguuauucuugaugaaaggaaccuuuuuccuucuugagagcaagcaggacccagggagccccugcccucacccaggauuccugccucucuucucugccacaccccugaucuuuaccugguauccccaucauuccuauuagaaaguaaucaagucuggcuucagucuuucuugccuugaaggaaguguauuccuggcaggggcuggggguggggggauaagucauaagacaaggguugggggaucagaagaagcccuaauccacucuucagagggacccaggaacccccagcacuagagaaguuuauauuuagcgcuucucugcuccuccuccuccccccgccugccaccgccuccucccugaugcugggacaagcuuugccuagagacugggggguggggggacaggccucuccacuaucagcucgugccgggaggacagagggcugagggggaggaggggacagagggaccgaggagagggagacugaagggcagagauggggaaggugaagggugaaaaggggagagaccgagggcagagggggagaggacacagcuacccacagcuaccccaaccucaugccucgcauucuccuugucaggauggaaggcgccuuccaagccgagccagcuugggguggggggagcuagcgaaggcccccacaauccgucucuaacuuugggaggggguggggccucccacagcuguuucuguuuccagaaaagaaugugcaggggggucccacuccugagagggggaggggccgggcgugcagccccgggagccuggcuucagucuuccuccccacuccccaucuggggagggggcggucgaggucagcggcggggagagcccccuccacugccaccucggcucagguuucccgaaacgggaagcucuggccacacacaggcuuggggauggggaucugccguggagccagggugugcgggcuggggggaggggaagacagacugagccugggacgucgggcaagaagaagagagcgaggugcagacaggcaggaagggaaggccaaggagacagaugcagagggacacagagaucacagagacagagagacaggaugaagaaagagaagcagacacagaaagucacagggauguggcaggacggagagagugacagaacccaggacgagaucgggagacucaaggaaugacauagaaaggggagaggcauggggcguccucaagucauuccggagaccucugcccaucuuccaccaugagaacacccagaguccagaagucucccccaggcgcugccucgaccugccuccccuugggucaaggagagcuggggccagguaggaagcaggggaagugucaccaaagggucaagaucccagugggggguccucagggacugugagcuuccucucagcaguggucccucccucuggaggcccugagauuccccuccucccaccccgcccccuccagagaucuccaagcacaccaggacuuagggaagauggagcccugguggcggggcccagagaagggcauguuuggagccuggcugugucaccuugggugagucgcuugcucucucugagccucaauuuguuucucuguuaaauggggacuaucaccccguuucccaagccgcaagaagacaacgccugcaaaguacccggucucggguuugacacauacuuggcgcccacaaggauuuucuuuggggaagggguguaagagacagggccuguguuucucacgaggccccagugggggcgaugcaguucccccucccccgauuugggggcggggaggccagguccggcccgccgccggaacuccggggucgccagccccacccccuguccuuucucacucccugccuacccggguccccaacccccgcccggugucugagcauccaaccgagacagacagacacagacggggguggagggacggacggacaggcagccccuuaccagcugcuccuccagggccgcugcggcccggcgcgccgccgccgcaucuucauccucaucggcguccuccucguccucggccucggcgccccccauuccgggcugggccagccgcagcgccugcugcacgcgguacuccugccucucccggagccaauguaacucgcagagcccggccaggcuacccuccagccagccccgcagccggccccgcucagggcucaccgggaacgagaaggcccggaucauggcugcggccccccgccccagcccggccgggccccgcggccaccccucucccggucccaccuccccgccccagcagccugcccgcccgcccgcuggccgggcugucaccgucucaucugcauaggcgcccgcccauugggccgcccacccgcgccuuaucugcauggccacgcccccggcgaccgagcaacagccgccuauuggcgaauaagcuuccugacgaagacucucgggcgugcaaccgcaccgcccaacacgacgcaugcucgcaacugccuacucacuccgcucgccacgcccccuccgugcaacugccucggggcccuggccacgcccccccacgcgucacaaug

SEQ ID NO: 15034 - RNA, 5670 nt, Homo sapiens
aagugggccugcgguagaggggaaccaggugugaaaacaggagucguuaagggggugagaagugugggauggggacuggggacccuaagaauguccaagccaguggggaggagaggagagaggauggcggagggguucagggagcacuggaguacccccgucagcgcucuguuaccgccuagcuuugugacucugaauaaaggacuuccuuuggcucaguuuccucuuggguaucauacaaguaguuagcugucuucuggggcugucgggaccauuaaguucaggaucgaccguggaggagagagcaccgaauacucaucuccuccgaagcuuugguggagucguacucccuccacguccaccccuacccccaacacacacacucagaaggaaugagaacggacacagcuuccccuacgguggccccaagcucugugcgugccucagucucccugaaagcacaggcaccaccacaguuaccaaguuuauuggauccauacuuuggcaggggaggguaagcuguccggagggcucagagcagaacacaaaagaggcgcuugucgcggaagggguucuccgcggcggguacuggcgucaccagcgggucaucuuuggcaugcgucucgcagaaagccaggaguuccgcugcugccugcgacaccugcgagcacccggguggagaugucaccgcccugcccggcuccuuggagccgcccacuuaggccccgccucuugcccuguccccuccucccaccuugccccgccccauacaggccuuuccccuugucuuacuccgcccccucguccuggccccuccccuguccuaccccgccccucguccuggccccuccccugccccaucccuccccucguccuggccccuccccuguucugccccuccccucguccuggccccuccuccugcccugccccgccccuugcccagcccuguucccaggggcauccuugcacuauggcuccgagccgggccgacacagccccggacagaccgcaggcccagaacccccgcccuauuccccaccccgacccagcaccuucaugcggucgauguucaccuccagcuucagcuguuccaccgucuugcgggccucggcaaucuuggccauguuguuggacaugguugcggcggggaagggguuaaaagacgcgcgggagugggggcuguggggguagguuaggauacgucugggucccgaggugggggcgagagggcgggccccgguaacaggugcgaggguggaagggcgcgugaaugggguggccaggggcugguggagggagggacagaugaaggggacaggaacaagaggagcgauggaggggugcacggauggagguagcuaaggcagguggggagagagcagggaggggcgagggagggaaggaggggcgcacagaugggaggcugagacagaaggacagggccacaggugcuggaucagaauccagguguccucacccccgggggcagagcgagagccaggaggggggccccucccccaggccaauuagcaguggcuccagggagaacugggaauuaagaucgcggcgggaggggcacagagggggccucauuagggccuuggcagcagcugcccucuccgccacccucagggagcccccccacccuagcccuggucaccucaaagccuccucugcucauuagcagccagggcagagggcugggggagcccaacucgggcaccugaggagaggccuaucggauggacagagggacaacgggacgcgcagaggcagagacagaguaauggagggagagacugaggcacgggagaaaugaagagacggggaggaauagagagagggagagacugggggaggaaugaagugauggaggagaaaauagagggacaaaugaaggggggagcaaggaacagggugauacaaggcgacaggcaccgaggggacaaagggacagaggggacagagcaggggagauggagggaggggguguggggugggagaggauggggagauggagggaggggguguggggugggagaggauggaggagauggacggauggggugggagaggauggggagauggagggaggggguguggggugggagaggauggggagauggagggaggggguguggggugggagaggauggggagauggagggaggggguguggggugggagaggauggaggagauggagggaggggguguggggugggagaggauggaggagauggacggauggggugggagaggauggggugauggagggagggacgaaggagagagaaggggaaauggaggaaggggggagggaggaaggagcagagacaccaaggagauaaaggaacagagacggggagauagagggacagaggaaagaagggaaggacaaagagggagauggagggguuggggagagauggaaacagaaagugggagagaggaacaaggcgagagacaggcugauggagacgcagaagaauucauucacucacucauucacucauucacucauucauucccaggcggagagacgguggccacggagcaggcaaagggaccagcuguggggccgggaccggagcuuccuaccuguugcugcucugggccgggcucgcggcggugacagaggcugggaggcagcgucugggucccuccggcccgccccgcccccuccccuggggcgcagccccuacggacccgccuccucccggagccaccguccccgccgccccgccaccuuggggcucccucucugggcccucucucuugucugucaguccuaucuuugucccucucccugugucucugccgcugcuguccuauugugugacucucucugugccucucucacacucacuagaaaacacagucucucuaggugggccccgggccucgcuacauuuaauccacagucacaacaaaccucuccagugugucccacagagccgcucacucagccacacucgccaccucggugucaccaccccccuccagccucaugcucacugucccucacacagacaaaaacuaucuugcccugucacacgguagcaccacacaaccucacgaaugaccuugcucaacacaaccucacacgguugccccaaaugccacacacagccgccaccaauggcagcuccaagcgcuacacagucagauaaauuaucucagagcaccaaauguaccacagugucacacauaaugucuccaaaugucacacacauuugcaugccuuuuuuuuuuuuuuuuuuugagaugaagucucgcuguguugcccaggcuggagugcaguggcccaaucucagcucacugcaaccuccgccuccuggguucaagccauucuccugccucagccuccugaguagcugggauuacaggugccugacaccacgcccgucugauuuuuguauuuuucguagagacagggucucacaauguuggccaggcuggucuugaacuccugaccucaggucauccacccgccucggccucccaaagugcugggauuacaggcgugagccaccgcgccuggccuugcaugccauuuaaacucucucaaucucacacccugucccagucucacacuuucugugucucacgguggcaugcaauuacccaauacaaccugucaaguacacacuguuuuauaguauuucauaguaacacccagucgccuguccagugacaaccauggaaggucacauacauucucucacagucuccuggugucacacgcaucugacacauucccuccauacacagucugucccugucacacacacgcacgcaacccaucuccuggugucauaccuagcuacccacgauggcucagugucucacagagucccacacaagcucgcagcguuucacacacucacucccaccucuccaucaucucuugccuucuacacacaaggccucccucacgcucucgcuuccgagugcccugcacagccgcaaacucucgcaugcacugucacaacgcugccaucucucaccagcucagugucacacauagucacgcaguuuuguuuuguuuuuugagacaaggucucucucucugucacccaggcuggagugcaguggcgcgaucuuagcucacugcagccuccacuucccaggcucaagcgauccuccaaccucagccucccaguagcugggaccacagagguacauaaccgcaccugguuaauuucuuuuauuuuuauuuugguagagacggcggggguggggggaggggucucccuauguugcccaggcugaucucaaacuccuggccucaagggauccucccgccucagccacccaaagugcugggauuacagcaaugugcccggaucacgcacuuuuucacaagccauacacagaguggccaacacagacugacacucacugugucugucccacccaggcccccuaugugccucucaugacaccugcccacaccaccucucaguguacaucagucaucagucucacucucucucacacagaaucuacuugugugacacacacagcaccguaugcucaccauguugcacacagccacacacacugcccccucacacgcaccgucacacacggucucucacucccacauacggucucucaaugucccauacagagccccaaagagugucucucccacacccgaucacacauaaccuuucaucagcacacacagucacccacaaucucucagcaucaccaguaaucucagugucacacacagucagcgacaugucaucucugacauaugcagucccacucagucucuccuugucgcacauaaucucauaucaaucagucacacacagacucccagcaccacacaccaucucaccaguacaccaucauggcaguacacacucaugguguccugguccuggcacugcacaccaucucacggcagucgacacucacacaguuuccuggcgucguacaccaucucacagcaguacacacucacagaucuccuggagucacacaccaucacggcaguacacacucacacacucuccagaugucucacgccgucucccggcaguacacacucacacagccuccaggugucacacgccauuucccagugucaccgcgaacaccagcgucccccgcuccccagcacuccccuuuuggcgcucacacgcagcgucugccggccacaugagggcgcgcgcagcacgcccaggcgcccacccugccccgagaggccgcagggaggagguggccacagggaggagggccaggcgggagaugaaggggagacucgggaccagaggaagcacggcagggagccagggaccggagggagaggacagaagauggacacagagaaauucacagacaggggagggagaugcagggagagucagagagacgcagggggcuauagggacacagauuuagagaaggagcgagcuagggacucagagagacagagacggggagggcgcugcggagagagggacaggagaggcagagacagacaggacacagagagaccgggguaggagagagacacccaagccgaaacucagagacagggacgaagacgcagacacacagagauggaggcagaggcggccagagagacaaagagaugcacagagggcgccuuccaguggggacccgacgacggaggcggggccugcag

SEQ ID NO: 15035 - RNA, 6507 nt, Homo sapiens
gggaggagggaaggagaagcugacacacagaccgacacaggcagcgagagacacgaggagcaaagcaagugaaggcacagacgcacgggacaggagagccugggcaagacuggagaggugcggugaggggcuggggaugcagcaacacagagcaggagcagguagagggugugggguuagagggagaaagguacggggaggacaaggacaagggaggggacagagacagggagauaucagcaagagaccgagagacagggagggaaagaacuggcaaugcccggauguucucugucucuuuaauggcagaaacagagcuagagaaggaaagaaacaggaggugguggggggguggugggugucaggcaugguggcucacaccuguaaucucagcacuuugggaagccaagguggauggaucaccugaggucaggaguucgagaccagccugaccaacaugguggaaccccgucucuacugaaaauacaaaaauuagcugggcgugguaguggacgccuguaaucucaucuacuccagaggcuggggcaggagaaucgcuugaacccaggagguggagguugcagugagccgagaucaugccauugcucuccauccuggacaacagagugagacucugucucaaaagaaacgaaagaaaagaaagagagaaagagaaacaggaagguggggagagacagagagagauacuggagaagccagaggggagaggacugcauacccgcacacacaggagaacuggggguuggcugggaggccccagcugccaaaaggacuggccagcagggacaucugagugggcugggugguggggguagcccuggcucccucugaccccccaccuugggaacccuccagcccagaccugggauggcggauucgugcaggaaccucaccuacgugcggggcucgguggggccggccaccagcacccugauguucguggccgguguggugggcaacgggcuggcccugggcauccugagcgcacggcgaccggcgcgccccucggccuucgcggugcuggugaccggacuggcggccaccgaccugcugggcaccagcuuccugagcccggccguguucguggccuaugcgcgcaacagcucccugcugggccuggcccgaggcggccccgcccugugcgaugccuucgccuucgccaugaccuucuucggccuggcguccaugcucauccucuuugccauggccguggagcgcugccuggcgcugagccaccccuaccucuacgcgcagcuggacgggccccgcugcgcccgccuggcgcugccagccaucuacgccuucugcguccucuucugcgcgcugccccugcugggccugggccaacaccagcaguacugccccggcagcuggugcuuccuccgcaugcgcugggcccagccgggcggcgccgccuucucgcuggccuacgccggccugguggcccugcugguggcugccaucuuccucugcaacggcucggucacccucagccucugccgcauguaccgccagcagaagcgccaccagggcucucuggguccacggccgcgcaccggagaggacgagguggaccaccugauccugcuggcccucaugacaguggucauggccgugugcucccugccucucacggugaguccccuccggagcugggaggaguggggagaggaggagggcagcucuguggguugugcccaugucacagauggggagacugaggcucaaaagaggugagacaucgugggcaugguggcucacgccuguaaucccagcauguagaaaggccgaggcaggaccggaugcgguggcucacaccuguaaucccagcacuuugggaggccgaggccggcggaucauuugaggucaggaguucgagaccagucuggccaacaugaugaaacccugucucuacuaaaaauacaacaaauaaauaaauaaaaaguagccggacguaguggcacaugccugaagucccagcuacuugggaggcugagccaggagaaucgcuugaaccccggaggcggagguugcagugagcugagaucgugccacugcacuauagccugggugacagagugagaccccgucccaaaaaaaaaaaaaaaaaaauaagaaaaaaaagaaaaagaaaggcgaggcaggacgaucacuugagcccagagguuugagaccagccugggcaacauggugaaaccccaucucuaugaaacauuuaaaaauuagccuggcaugauggccugugccuguggucucagcuacuugugaggcugaggugggaggauugcuccggccugggagguugaggcugcagugagcugugauuauaccacugcaucccagccuagcugacagagcaagaccuugucucaaaacaaaaacaaagaaaacaaaaacaaaucagacagaggcuugguccucagucagacagcuccuggcuuucuggaggggucuuucugcaucugacuucuucugauaccuugucucccagcuuaggcauccugagccccccaugaugaaaugcaucccccauccuuccccaccccuguaaugacaagaccaccacucauugagcacuucucuaugcccgccccgugcuuaguggcuuacagauacuuccuaagauaauuuucaaaaugaucauagccacccauuccacaguauuuggcaggaaaccaagagaacguucucucccauccccguuuuuacagaugaggggcagugucuuucgcccagucacacagagccagguccugguccuggguccuuccauuguagagccugaucucccaccuaccuggcuccccucugccucagagcaggccccacccuugccucugcaccucgguuuccugcggggaccccguccugccccuccccaaugggaguggcacagacccugguacccacucagugucugugacaccuggucgugccaccuuucuucugagcuucaguuucuguuucuguaaaaugcaagaggccaggccggauugggggguccuuaaaucuuuuuuggggguuacucugacucagagacucagaugccguggacagauacacacaggcaccaccgcagcucugcggcaguuucagggggcccagccggguggcgccaccuucuugcagggacguuauacucaaaaaucuguggagcccgaggguccucccagcuuccaaggguggggggacccacauaccuggcccccaucccucuccccuuaggcaucucuggcaauuuccuggggcuuucucucccuguguuccccagauacauuuguuacuuagucuuuaucuuaucuccuuccccucugacaugucaccccuaccucaucccugguaagcaagugggaggagggagccaggguggggaggcugaggacuccugggugcuccuugacgcccucacccugcccucagauccgcugcuucacccaggcugucgccccugacagcagcagugagaugggggaccuccuugccuuccgcuucuacgccuucaaccccauccuggaccccugggucuucauccuuuuccgcaaggcugucuuccagcgacucaagcucugggucugcugccugugccucgggccugcccacggagacucgcagacaccccuuucccagcucgccucagggaggagggacccaagggcccccucugcuccugugggaaaggaggggagcugcgugccuuugucggcuuggggcgaggggcagguggagcccuugccucccacacagcaguccagcggcagcgccgugggaacgucguccaaagcagaagccagcgucgccugcucccucugcugacauuucaagcugacccugugaucucugcccugucuucgggcgacaggagccagaaaaucagggacauggcugauggcugcggaugcuggaaccuuggcccccaaacucuggggccgaucagcugcuguuucuccugcggcagggcagucgcugcuggcucugggaagagagugagggacagaggaaacguuuauccuggagugcagaaagaaugguucucucaaaauaaccaguggccuggccgaccugcucuggcccuggauuccccauccaucucauugucuaaauauuuagaaggcggagaaguucccagaggcuucuguacagucaggucugcucuggucugggugcuggcuccaaucugcguccacuuaggaggcccaacugcccaccccaaguccccaggggauggcccucccccucuaccaagccacuccaagagccagccccuuucugcuccacaaaaaccacaguuauuggaaaagcucccugccuucccuugccgcuggucccccaccaggcuugggagcccuggcaucccaaaggggcaacgggaggaaggggaggcugcugcauugugggugaugacguaggacaugugcuugguacaaaaagggccugagacauuccaccuagcuugacuggcugcaagaugagaacugggggggugcaggugguggggagacagauggagaagcuggcagaugaagggugggggcugcggaucccagggacugccccagaacacaaaccuaaguccugugccuguccccaggguccugaauaaauaaaagccuccuugcagagccugaccucauguuauguguccuuagagcccucaccaagauuucauucauucauucauucaacagauacuuggcugggcaccauagcacaugccuguaaucccagcacuuugggagguucaggugggaggaucccuugagcccaggaguuugagaccagcucgggcaauauaucgagaacuugucucuacaaaaaaauuuuaaaaauuagcugggcgugguggugcacaccuguagucccagcuccuaggaaggcugagacaagaggaucaccugaacgugggagguugaggcugcagugagcugagaucgugccacugggugacggagugacacugucucaaaaacaaaacccaaaaaaacccucaaccuuccacugaaauucagcagugcugauugccugguguuaaggacacagacaagccccugcuccacccugggcccugccggggugauuuccagccugccauccacacaggcuucucaugaccacucccugcccucagagaggcccaggauggagggugcucaggagugagcugaugagcauggaaggaagugaguaggcguuuagggugggggagggugagugggaacuccccccacccagccccacugcacugccagucccaguuccccuuuccuacucucccccucuguuaaaacaaaaaauccacacuuggggagaggcgcgguacgugaggccugagccucccaugaggacaacagcagccaacucuucgagggguaggcagcgcuuccucccacuccauccacagggcaaccuauuauaaauccucuuucuuucuuucuuucuuuucuuucuuucuuucuuucuuucuuucuuucuuucuuucuuucuuucuuuccuuucuuucuuuucuuucuuucucucucucucucucucucucucucucucucucucuuucuuucuuucuuucuuucuuucuuucuuucuuucuuucuuucuuucuuuuuugagacagaauaucacucugucacccaggcuggagugcaauggcaccaucuuggcucacugcaaacuccgccucccggguucaagugauuccccugccucagccucccgaguagcugggauuacaggcgugcaccaccaccucuggcuaauuuuuuuguauuuguaguagagacgggguuucgucacguuggccaggcuggucucgaacuccugaccucaagugauccucccaccucagccucccaaaaugcuuggauuacaggugggagccucugagcccagcaauaaguccuuucuacagaagacggaguccagguccagagaugauaauccaccugucccgacucacacagcgagugggcgugggcuuggagcaggcccgucuauccacuccgggacaccuugguuuccuuuugaucauaaucuagcacuuagcuugcauggcggcuuuggggauuaagcaauucccucugaaaagcaaauuagcucagggcuuggaauaaagcccauaagaaaugucacuaugauugccauugcugcagcuguugcuauuguuauuuggacagauacaauuuaaaaggaaaccaccuccuggcucugguucggguguuuugacuucccccacccugcccagguaaccacguuucaaaucacaauaaagcagaacaaggggugucugggagaguuaaaaacaggucaaggucacccaugaaugagcuugggguuccccuuuggggugaugaaaauguucuggaauuggauaguagugaggguugcucaacagugugaaugcacugaaugccacugaauuguaacuuugaaugguuaaaauagcaacuuuuauguuauguguaucuuacugcgauuaaaaaaaaauuuaaaaaauaa

SEQ ID NO: 15036 - RNA, 5117 nt, Homo sapiens
uggagacgucggcaccugcgcagcccaagacccccgagcggcggugcgggagccagugcgcaggcgcgcgcugcgacgccaaccucggcuucucgccgcuaacggcaucgagucuggacgccccgugacccgccugggccggagcgggggcggacggcgccuucuuggcccuuucugccucuagcagcggcgccgggguagccggagccagcgacugggaaacggcugcauuccacugcgucuccuuggccuggcugggcggucggaggcugaucugccaaguaagucccggcugggcaggcggagcgucaggcccgggggaggguccuagggccuuuugcugcagauucagggacacgugugagcaccggggccuggguuggggaggaggguguugggaaagcgccaggccuccugcaggccagccgcggagggggcagcuaggaucugugagcuuggucaucuuccugggaacgugaccucgcucccuugucaccuugcaggauuacuguuuggagaccgcugcagcccacguccaccugauagacuauuuacuacacauaguagguucagagccgcuaaauguccaagaccauggcgaugaaccuucuggaggauuggugcaggggaauggaaguggacauccacagguccuuguuggucacaggcaucccagaggacugugggcaggcagaaauugaggagaccuugaaugggguccucuccccacugggcccguaccgcgugcucaacaagauuuuugugagggaagagaauguuaaagcugcccucauugagguuggugaaggugugaaucugagcaccaucccccgugaauucccaggaagggguggugucuggagaguggucuguagagacccuacccaggaugccgaguuuuuaaaaaaucugaaugaauuccuggaugccgaggggcgcaccugggaggaugugguccgccugcuccagcucaaccaccccacccugucccagaaccagcaucagcccccagagaacugggcagaagcucugggggugcuucugggagcaguggugcagaucaucuucugcauggaugccgagauccgcagccgggaggaagccagggcccaggaggccgcugaauucgaggagauggcagccugggcuuuagcagcagggaggaaggugaagaaagaaccggggcuugcagcagagguggguucugccuuaaaggcagagacccccaacaacuggaaugccacggaagaccagcaugagccuaccaaaccuuugguucgcagggcuggagcuaagucucgcuccaggagaaagaagcagaagaagaacuccaggcaggaagcagugcccuggaaaaaacccaaaggcaucaauuccaacagcacagcuaacuuggaggauccugaggugggugaugcugaaagcauggcgaucucagagccgaucaagggcagcagaaagcccugugugaauaaggaggaguuggcuuugaagaagcccauggcgaaaugugccuggaagggucccagagagccaccucaggaugcccgggcagaagccgagagcccaggaggcgccucugagucagaccaagaugguggccaugaaagcccaccaaagaagaaggccguggccugggugucugccaagaaccccgcucccaugaggaagaagaagaaggugagcuugggcccugucuccuacgucuugguugacucagaagauggcaggaagaagccggugaugccaaagaaagggccaggcucaagaagggaggcaucagaucagaaggccccucggggccagcagccugccgaggcaacagccucaaccucuagggguccgaaggccaagccagaaggcucuccucggcgugccaccaauggugagaaugauagcagaagugacugggcucgugccagcaaguggaugaggcaggaggagcaggaguggcagguggggcagaggagcccgaggagguggugggucaagcgggugaugaggaggacccuggugcauggcaggagguggaugacacaccaguugaggaggguaagagcccagaccgcccuuccaggagccccugaaggccgaugcuggagacaucuggugggcaggagguggcagaggaaacccacaaugagugucacuguggucauuugccacuccaucugacccaucuuccuugaugagaauuuaaugguuugggcccaggcuugguggcucaugccuguaaucccagcacuuugggaagccaaggugggcagaucgccugaggucaggaguucaagaccagccuggccaacauggugaaaccccgucucuacuaaaaauacaaaaaauuagccggguguggugccacauaccuguaaucccagcuacucgggaggcugaggcaggagaaucucuugaacccgggagguggagguugcagugagccuagauugugccacugcccuccagccugggugacgagagugagacucuugucuccaaaaaaaaaaaaaagaauuuaaugauuugggaggccaaggcagacagaucaccugaggucaggaguucgagaccagccuggccaacauggugaaaccccaucucuacuaaaaauacaaaaauuagcugggcauggugguuugugccuguaaucccagcuacuggggaggccaaggccugggauuggccuccagacaucugcccaccagaugucuccagcaucggccuucaggggcuccuggaagggcggucugggcucuuacccucccugaaccugggagguggagguugcagggagccaagaucacacugcugcacuccagccugggcgauagagugaaacccuguuccccccuccccccaaaaaaaauauuaauacuuuggaguuaugguguuugcaggguauguggcuuuaagggugaaguuuucuagagaccuggcuggggaauagaaauguucagggacccagaaauuucuuggaaguaaugcauuuccuaaugacaccucucugcuucccuucuugaucuguucucucauuuauuugcagaauccagaaagguuugaucugggggaccacccauacugaggaguugaaagaacaaggaagaaguaccaagucaaccaaguucucucuugucacugaauaagacuuuggacucucuuagggccccuguugauagagaucuggcccugagguaaacgauaggugaggucuugggugggagggaguuggggaagggagguggaucucuaugcccuuuucucuaccaggccugccguuucaccgccuucucuacucaccuucucuucggaggcaggagaguugguaagaggauugggaaaauucuagaacauucauuccccuuuaugcaugagcagggucacuguuacacucauccauguucagcuuuucucccccacgccuugcucccuccucggaauggucagcgaccucugcaggcccuggcauuuggaagagcuggguggcccugccauauucuuccucccgccuuccucucguguaaccagcgggguaaguuaagccaggaccuucgcugcaaaccugguuuuauugcuccuucagucuccagcuuccauccuccaguuaucuagccaggaggucccaagaguuaguuuuagggaaaaagaaugucugccuagaccucaaagucuuugaguuuuagagucuguuaguaaaaauggcacuuugauucccauuugggaugagcccucucaggaauccuguggggaaggggggugauuauagggaaggacgcaggcauuccuagguccccagcucuaauuccauccaucuacccaacugucaccaucuuugcaccaaacugucaccaucuuugcagcagaaggucacuacucacauuauaguaagaggggaaaaaaaucuuuuaaaacuuggcuguuggccgggcacgguggcucacgccuguaaucccagcacuuugggaggcugaggcaggucgaucacgaggucaggcguuuaagaccagcuugaccaacauggugaaaccccaucucuacaaaaauuagcugggcgugguggcgcgcgccuguaaucccagcuacucaggaggcugaggcagaugaauugcuugaauccaggaggcagagguugcaaugagccgagauugugccacggcacuccagccugggcagcagagugagacucucucucaaaaaaacaaaacuuggcuguuaaugucugcccucugaauucagacacacuauauuagaccagaccaccaugugucauuguguguguguguguguguguuugcgugcgcauguguagaggagagagcagggucccugagauaaugguuuccaaacuguaucguagccguccacaaagauguaauccaaaucuauuuuucucacguguuuaaaaaacugaaaagugacuacucagauauguuggaagucacaucgaagacuaucagaauauuaccuuguguucauagguuaacuuguuuuuguacacgucuuaguuauuucaggcaucucuuugcuuaaaauugaguuucuuguaaaugugacugaugagcgagguuagaaguggaagaaauuccugugcauguucuauaaucugacacccugaaagcaaguuuccuuucgucauucacaugcucuuguucugccgugacuguucagguguaugguaguaaguaaauguauuaacauggugaacaguaguaauauucuaucauagaguauuagcccuugcaaguuuucagggcgucuuuuccgacuucaguuuuugugauaaagaaugugaacaguuguuagauguucucagugauucaacuuuaaaacaaauuucucgugaugauucauuucaaaauccugagugagucugacugaaaaauacgagagaaaagagagugguuuccguuugcagcuacacagcugugugcaucgacguucuccuggggugugugccaagcgaaacccaggggugaauuggauucuugaagagaccaaagccuguaacuguccagcuucuaauuucaaaacggguccauuagggcuucguuguguuaacaaguugacaccaugacuaguaaauguaaacguguauguauaaaauaaaguuuagcaaauuaagu

SEQ ID NO: 15037 - RNA, 1185 nt, Homo sapiens
cgcgggagcaagugcagcggccacauccucguccuaguccggcgacagggcacugagugcaaccucugggccagcggugagggacgcgccucccugccugccagggccgcgccuacgacacucuguuggcaguugucccagggagaucagcagucccagauccggagagaccguuggggccugugagaccuucggaggccacgccaagaaaggggaagcaucaucuuuagacccuccuuggugcagccuugcccaggacccgggagccacgagucagguggcaaacaccgccuucugcuucuccagcacgcguaagucccugggaaucuucgagcccacucagagggagccacagaagccccgacguugcacagcccugcaggcaggggcugggggcauccuucacugagcuggacgaagggguccugggagcggccuccggccccugaggccucacucucucguagccuuugggaaggaaucgcggcauccuggauaauuucguggauucccgaggcagcucagguguccaccagcgggcauacugcugccucaaagaguugggcaagaugcuguucggggugaaggacauugcacuguuggagcacgggugcaaggcccuggagguggacaguuacaagucccugaugauccuggggaucccggaggacugcaaccacgaggaauucgaagagauuauucggcugccccucaaaccucuaggcaaguucgaaguggcugggaaggccuaucuggaagaagauaaauccaaggcggccaucauucagcugacggaggacaucaauuacgccgugguccccagggagaucaagggcaagggcgguguguggagaguggucuacaugccccggaagcaggacauugaauuccugaccaagcugaaccucuuucugcagagcgagggcaggacgguggaggauauggcccggguccugaggcaggaacugugucccccagccacgggccccagagagcugccugcaagaaagugcucugugccugggcugggggagaaaccggaggcuggggccaccguccagauggacguggugccaccucuggacuccuccgagaaggagagcaaggcuggaguuggcaagaggggcaaaaggaagaacaagaaaaaccgccggcggcaucacgccucagacaagaagcugugag

SEQ ID NO: 15038 - RNA, 10801 nt, Homo sapiens
cccuagcuauaaaauggggcgaaggacagcauccaccucacagggcugcagcaaggcuuugaugagacauguaaaaggcuugcaacagcgcaggcacacagccuacucugaagacacucaccugcacgucgguccucccggcggucuuccgacaacacguagcgcugagggcaggcgcuugggggcggcggcugugaagagggggccgcagggggcuccuccgccccagcaccugcccccggcgccgccacaccuggccccaggauggcaaaaauggucuccucuuccgcggagaaagcguccuccgcggcgggcccggcgcccugcguggagugcggcacgcgagcgagcuucuccuuggugcggcgcuugaagucguuccagcgcuucugcaccuccuggcccgugcgcuuccagcuggugauaccguugaucuuggcggcgaugccgucccacacgcgccgccgcucugccacgcucacccgacggcucugcgcgccguagagcugcggguagugggcgcgcaccucgcggaucaggaucugguucucuucgaaugagaagcgcggcuugcgcaaccgggugguuuccuccgcuucgcccgccgccgccgaggccauggcgccccccgacgccgccguccugccgucuggcgcauggggggcgccggcgcugcgggcaaagggcgcacggggcuggcugggguucgggguccccccgccgccgccucucccagaccgccgggccgagagcuccuuaguccccgggggcaggagugggggcggggggcgggcgggggcgacgggcacccggguaagucggaagcgccuaagaguagcugacaccggcugagcgcuuggcucggacuucgcgcggcgcgaagugccacgcugaagaguugauagaaauugggggagggucuggagggauggaaggaaaggaggaaaagugcgaggagaggaggugucugcaggaguuagagaaugggggcacgggaggauaggaaauggagggaggaugggggugccucgggggggucuuagaugcaugaagauaaggagaugcggaaggggggaugcagcaagaaggggggaaucuggagcagaggaggcgcucuaggggcucuagggggcaacggggcgucuguaagaccgauaugagaagggcccuuagagggauguccaggaauaauggugaggugggagcuccuguaucacuggaagagcuggaacgaucaaauauuagggaucagggucugcgaggauugugggggcucuggggauugccagaaauuaaggggagcucuggaaauaacgggggucccguaucacaaggagacaacggaggcuacgggggacggcagggagagcgaaggucgcggaggguggggaccgagucgggccacgggucacucaccggcuccgccgcagccgccggugggucagggcucgggcuucugcggccuguucccaccccccgccucccucccuccccucuuucggccccgccuccggccgccccgcaugccaaggcgcaggcgcgcccagggccagucggccccaaugcccuuaccgccaggguuucauucccaccuaccccagcacagcgcaggcgcagaacugcgcuccgccgagccccaccagcaggccgcaacugcgcagccgcaacguuagcgccgcgcggguaccccagcuuccuggggccacaacggcgcacgcgcaaaaacuccaucgcgcgcaugcgcgugccucggguuguacccgguaccgggucucggcgcaggcguugcgagcuuggaugggagagaugcugggagcgcgccaguacccaaccuuucggacagucuuccagcccacccugcccucuaaccaaaggggagggagacagcgcugaagggaagcgcuuugucuccuugacaacugugugggugggguggaggcgugaggaaaccgcuuugccuccuggcuugcccgccccugcgcugggccgcuccagagcuucccaccucgcaccccuagaggcugggcguccuggggaugucccgccccgggcggaugcaguaaccauagcgacccacaagccuuccagucacgccuugggggccccucugugcgcaccuuuaccucgaggagcggggaaaauaagagggaagagcuuccuggcugguaggaagggagauccugacgccggcacgacuuuaagcaagugcauggagacaggaaugaagccagaacgcagguggggugagccgcauggcaggaugauggagcucaguccggcugagaaguguguucguuagcauccugcaggaguccucaaggucauucgacaauuggugcuucauucaucgacucaauaaauauacaugagcacuuacacaguuccugguacaaugaacauaaaagcuaaaauccguagccugggccgggcgcgguggagcucacgccuguaaucccagcacuuugggaagccaaggcgggcggauuaccugaggucagggguucgagacaagccuggccaacacagugaaaccccaucucuacugaaaauacaaaaacuagcugggcaugguggugcaugccuguaaucccagcuacucgggaggcugaggcacgagaaucgcuuaaccccgggaggcagagguugcagugagcugagauugcaccacugcacuccaccuggacgacagagugagacuccgucucaaaaaaaaaaaaaaaaaaaauacaugccuguagucccagcuacuugggaggcugaggcgggaggaucgcuugagcccaggaguugcaggcugcagugagcuaugaucaggccacugcucuccagcuugggcaacagaguaagacccugucucaaaagaagagagagagaaaaaaaaggccccucugccugcuguguggagggugggugggagggagcaagacuacuggguagagucaaaaaaagucaugagcagggguaagaaaaggauuaggaaagcgaggggagacuaaacuaagacagggacagugucaagggggacacggagagacauuugagagaauauauggaaagcauggugagugucgcgcuagcgagggaaaggaagaugucuaggugaaacccaagucucuggcccagguucucacuuggggguguggggucagguaagauguggugaauguaaggcugggugcaguggcucacgccuguaaucccaacacuuugggaggcugagacagguggaucaucugaggucaggaguucgagaccagccuggccaacaugguggaacccugucucuauuaaaaauucaaaaaaaaaaaaaauagcuggguguugugccaugugccuguaauccuagcuacucgggaggcugaggcaggagaaucucuugagccuaggaggcacagauugcagggaaccgagaucucaccacugcacuccagccugggcgacagagugagacucugucucaaaaaaauuaaaaaaaaggccgggcgcaguggcucauuccuguaaucccagcacuuugggaggccgaggcagguggaucacgaggucaggagauugagaccauccugacuaacauggugaaaccccgucucuacuaaaaauacaaaaaauuagccgggagugguggcaggcgccugaagucccagcuacucgggaggcugaggcaggagaauggcaugaacccgggaggcugagcuugcagugagcugagacugcgccacugcauuccagccugggggacagcgugagacucugccucaaaaaaaaauuaaauuaaaaaaauaagaacaacaacaaaaaaaacacaaucaaaaaaagauacgugaguguaaagugaccaacagguugaacuguuucccccaaaaagagaggcugaaguccugaucccccagugcuucagaaugugaccuuauuuggaaauaggguccuuggagagggaauucguugagagguagccauaccaguguaggguggacccgucauuccucauucccggugucuuuauaagaagaggagacacacagggaagacaauucuauggugacagaaguggagacgggggugacgcagccacaagcccaggaaggcccugugcuaucagaagcuggaagaagccaggaaagaucacccgcuggagccuuguccggagugaggccacgcccaugccuugauuucggauuuucagccuggugaaucugggagacaauacguuucucucucucuguuuuuuuuuuuuuuuugaaauggagucuugcucuguugcccaggcuggaguacaguggcacgaucucggcucgcugcagccucugccucccggauuccagugauucuccugccucagucucccggguaacugggauuacaggcgcaugccaccaugcccagcuaauuuuuguauuuuuaguagagacgggguuucacaguguuggccaggcuggucuugaacuccuuaccucaggugauccgccugucucggccucccaaagugcuaggauuacaggugugagccaccgugccuagccacguuucucguuuuaaaccacccaguuugcgguaccuugucauggcagccacaggaaacaaaugcacuggggaccccgggaaggcauucggggagcugcauucagggagcugcugccuccauggcaguccaggcagagaguugagucuaaaccuggcucuggguucacgaggcggugggagguggagagccacagcagugggguauggagcuccacagauguggguagcuggaagcuggaugcaggaagucagagggcaagacuccuggggugagggugggucagggaaggcuuucuagggccacauuuucuuucuugucuugccucuuuucuuuucuugauggaguuuugcucuugucgcccaggcuggagagcaauggugcgaucucggcucacagcaaccucugccucccugguucaagcgauucuccugucucagccuccugaguaccugggacuacaggggcacgccaccacacuuggcuaauuuuuguuuuuuuuuuaguagagaugggauuucacccguguuggccaggcuggucucaaacaccugaccucagaugauccaccugccuuguccucccaaagugcuaggauuauaggcaugagccacugugccuggcgaagggccacauuuucaaaacugugaguugugaguccuuuuuuuuuuuuuuuuuugagacagagacuugcucuaugacccagacuggagugcagugguacaaucaugcaaucaugacucaaacuuccaggcucacccucccaccucagccucuagaguagcuggaacuacaggcacacaccaucaugcccggcuaaguuuuaaaauuuuuuguagagacaagaucccacuguguugccuaggcuggucccaaauuccugggcuugagcaauccucugugaggccucagccuccaagaguguugggauuacaggcgugagccacugaguccagccaaaacugugaaucuugacccauuagugaguccaggaaaauacuuaggaaguugcaaggagagauauuuaggaggaagaauggacaggacuuggaaccugaugggcugugaggggugagggaaaaagccuagaucucuggcccuggagacaggguacauuacaugguagggccggccaagauggggacuugagggguagcagauguggggguaagaugcugaagugguuugggaugugguggguaugaaaggccuggggagguuuggggaaugaggaagagcauccaggaacccaucagguauguggaagagggcuggaggcagaggcggaguggaagcuaaauuuuuguuuuguuuuguguuguuuuaaugcuaaaagaaauggaugcaacaagcauaucaagugcugcccuagggcugggccugguugcucaugccuguaaucccagcacuuugggaggcugagguaggaggauugcuugaggccaggaguucaggcugcagcgagcuauuaucuugccacugcacuccagccuggacgacagagcgagacucugucuuuucuuuucuucuuuuuuuuuuuuuaauuuaaaagauagagaugagguccugcuacaucacccaggcugguuuugaacuccugggcucaagugauccuacugccucagccucccaaaaugcugggauuacaggugcgagccacugcacuggcugauacccugucuuaaaaaaaaagaaggggccagguaugguggcucaugccuguaaucccagcacuuuggaaggcugaggcggguggaugaugaggucaggaguucgagaccagccuggccaacauggugaacccccgucucuacgaaaaauacacaauuagccgggugugguggugcacgccuauaaucccagcuacuugggagguggaggcaggagaaucgcuugaaccagagcggagguugcagugagcugagauggugccacugcacucuagcccggcaacaagagcgaaacucugucucaaaaaaaaagaaaaaaaaaagugcuggccguaggcaccugggauacagcagugaauaaaauacugaacuccacucucagagcuuccuuucuagcuggggaugguggauggacaggaaguagcucacuucaaucagggauaacacggaggaacagagccaguaggggguauguaugaagugaucuguugcaaggaauuggcuuacaggauuguagggccggcuaagcaacuucaaaauccauacacagggcaccaucggaaagugcaggcuggagcuuugggcgugaacugaagccacugucuacaggcggaauuuccucagggaagcuucggcucugcucugaaaaccuuuugacugauugcagcaggcccacuuagauuauuauuauuauuuauagagacggagucuugcucugucgcccagguuggaguucaguggcacgauuucagcucacugccaaccuccgcugccccaguucaagcaauucuccugccucagccucccgaguagcugggacuacaggcgcccaccaccaugcccagcuaauuuuuuuguauuuuuaguagagacgggguuucaccauguuggucaggcuggucucgaacuccugaccucagaugauccgccugccucggccucccaaaguguugggauuacaggcgugagccacugcacuggccuauuauuauuauuauuacucgagacagagucucacucugucacccaggcuggagugcaguggugcgaucuuggcucacugcaaccuccaccucccggguucaggugacucuccugccucagccuuccgaguagcugggacuauaggugcaugcuaccaugccuggcugauuuuuguauuuuuaguagagacaggguuucacuauguuggccagucuggucuugaacuccugacuucaggggauccaccugccuuagccuccgaaagugcugggauuacagguaugagccaccgcccccucagauuaucuaggauaaauuuccuuccuuaagguaaacuaauuauagucuuuaaucacaucuaugagauaucuucacagcagcagcuggauucauauuugacugaaugacuggggacagcggucuagacaagcugacaugugaaacugaccauugcaaccagagacauaauaaacaacucagccauguggcauguuagauggugguaagugcuaaggagguaagaaaaguagagauggguuggagggaucaggaauaugugggugggaaggccucggggagguggcggccuuugagcaaaggcuugcaagaaguggcagaguaggccaugugaguaucugguccaagagcuguccaaggagccggaagggugagugcaaaggccucgaggccagaauguuccagaaguguucggggaacagcuuagaggccaaaguggcuggagaagacugagcaaacgggagagggugggaaaagagccagacuugggugagaggcagauuguguggggccuugugggcugagaugaggauuuuggcuuuuagucagagugagacagugaccacaggagggcucugagcagaggagggagaugagcuggcuuguguuuuaaugggaucacuuuuguuggguuuugaaaauauacucuuggcugggcacaguggcucacaccuguaaucccaacacuuugggaggccgaggcagguggaucacuugaggucaggaguuugagaccagccuggucaacauggcaaaaccccaucucuacuaaaaauacaaaaauuagccaggcgugauagcggucacccggaaucccaguuacucgggagccugaggcaggagacuugcuugaaccugggagauggagguugcagugggccgagaucaugcuacugcauuccagccugggagacugagugagacuccaucucaaaaaaaaaaaaagagagaaagaaaauaaaauauacuuuuuuuuuuuuugagacagucucccucuguugcucaggauggagugcaguggcgccuucuuggcucacugcaaccugcgccucccaggcucaaagauucuugugccucagccucccagguagcugggauuacaggugugcaccaucaugccuggcuaauuuuugauuuuuagcagagacgggguuucgccauguugaccaggcuggucuugaacuccuggccucaacugauccaccugccucggccucccaaagugcugggauuauaggaaugagacacugugcccagccugaaaauauacccuuagggguugagaguagaagcaggaagaucauugaggaggugacugcaguacucugggugagaggugguggggcauuggaagguagugugcuggagaagagauggucagauuugggauggauguugaagcuagagccaagaggauuuccuaaugaaugugagauuucuguuuuggacuggauaaggaggagggaaggaaagaagggaaggaaggaaggaauguggggagggagaaaggagaaagaaaggagggcggaagaagaaggcaaaaacgacagauggagagacacguuaagagagaaucuggaucgggcacaguggcucauguguguaaucccagcacuuugugaggccuaggagggaagauuguuugaggccaggaguucgaggcugcugugagcuaugaccacuccacugcauuccagccugggugacagagcaagacuuuuugcgggagggcagagagaaggagaaacugaaugauaaaccuaaaagugaucucucaacauucuuaguacaaauuaaaaauaaagacuuuuguuaauagugcgaucuuggcugggugcaguggcucacuccuguaaucccagcauuuugggaggccuaggcagguagaucauuugaggucaggaguucgagaccagccugggcaacaugaugaaaccccaucucuacuaaaaauacaaaaauuagcugggcgugguggcgcaugccuguagucccaguuacuugguaagcugggcaggcaggagaauugcuugaacucgggagguggauguugcagugagccgagaucaugccacugcacuccagccugggugacagacugagacucugucccaaaaaaaaaaaaaaaaaaaaaagugcaaucuuuucccuuccuuuguauaaaauucucuagaaugggccagauacugguuagcauuggaaauaggcucuaaucuauggucaccacucaccagaaccccuggaaccccacgugugcacaaauccaguuucagagaccaacacagugguaggcacucuuggccacugugggagugugaggugcagagacaaagccuuggccuuauauacuucagagcacacuggggacucugugaggcucuaggucuauccuuaguggaucuaauuuuccugcccugguucuuuguggguguagaacuauuccccuacucucucuccuaagcccaaaguggugcuggagggaagaggccguucugaagcauuugcuucucugcauggagucucccugcugucuucucugauuuccucaggggugggcgagauggugucugaugcacacgggcgccacgcacaagucuccaguggccccugcaugcccacucugccucuuuguaucuucucugagcccaggaggcugcccugugugcucuccaucugccugccugccuggucucagguucaugggagguaacugcaggaauggggcagaugcaggagaaugaccagcuguccugcaccuggccucgaccuguccacagcagcaaagcucucuguaccucuucccauaacucucugcaugcagccuucucacaggcuccaggccggacuuugacacgcaccuacuucaguccagacucccuggaugccuccccagagccccagugcauuccuuuccuguagcugucaugacaagguacugcaaacugagugguuuaaaacaagggaaacgggccgggcgcaguggcucacaccuguaaucccaacaggcaugggaggaucgcuugaagccaaguguucgagaccagcuugggcaacaaagcaagacuccagcaugccugacuauuguuuuguauuuuuuguagaaacggguucucacuauauugaccagauuagucucaaauucacggucucaagugauucucccaccuccgccucuccgaguguugggauuacaggcguuagccacugcacagggcagggaccacaauuuucaacaccucgccaauggggucugggagcucaaaguuuaagaauuaccaaaaagccgguccuggaagaucccggggguucacagggccagagaaacccauag

SEQ ID NO: 15039 - RNA, 9103 nt, Homo sapiens
ccgcugagaaaacagggaacuuuaguauaaauaagagguccugcgggacagggaggaaccugaggggcuuccauaauuuaacacucuucaaaagcacagacaauagcaagggcagcuggggugggggccgggcgagggcuggaccacccccggcccugcccacucaacugaggggcacacugcagaccuggggcucuuguggcaggggcggggagucucuccccaggagugaccagucacaugcuggggacagggaugaggguaacacugauguuucagaggaagaggucauuguacuuggcagugggugggggacaaggcugaggccacaagggcuauuacaucgcccguguccgggccagucuggggggcccccaaauuuugugcagguggggggacuggagcaguccauccaucaugguuagucuuguuaauacguugaucugugaggucagcagggaggguuauggcuaggaggcugggggcaugggguugggggggcccgauauccauggcuucacaccacugugccacucggggaguugccugguugggaggagaugcccuggggaagaugagagggagagaugggagggguuagagaccaccugggcuucagccagugucaaggggagggagccagcccagaguccccaaagcugcugccacccuggccuugcccuuggguccgcccuagaccccccagaggccacugcucuaggcugggaacuugcaucuuagcuagcuuccuguccuggcagucagcacuuucacgcaauaaucaaaguccuuggcggauccugagugagaccaugggguaaggguaagggugggaggggagggggaaacuggagcucccuucuaacuugggagggacccugaggugcuggggaaagaacucagggacaguccuaccucuaccacugacuugcugggugaccugggccaacuuccuuccccugucugggccucggucuccucgucugugaacuacggagacagaggggucucuuuuaggacucaaccagacuccccaaaucccaccacucuugccucugagucacucagacugugcucucaaguucuagggacucaggacucuacgauuccaaaacugaggaucugaggaaccaagccacggccuccaggacccugggcaacugaguccaagcccuaagaagcugagacacccaagacgagcuccgaacuuacaagaugccaggccugauucgccuacuaugaccuucccaacgccacagcccacccaggaggcaagcacauccacccacugcccauccuacaggcucuguucuaagaggugaugaguuggaggucagagggggcagugacuuguccagggucacagagggagugggacuggaacccaggccugggauucccagccugugccuucagcaggaggcucagauccugagucccagacccaggcuggcagccaugcccacaggcuugagcucgccccuaguuuuggccugaaguacucaaaaaaguuucacgauuuaaaaaacagauguucaacagaaauagauucugguucgagugacaggcaguaagaccuggccauguggggcccaucugcugcccuucagacggccagccuuggaugccccaauuccuagcuggcucucacacccaccccucuuucugcugccugcugccuagggcuagacccccucacucuaaggaucugagaggucuuguacugagacacuaagauuucccuggcuuccccucaccccacggagccagaggcugugacagcaacaaagcccucucucugccaaugccugccucuucccacgaaagguccugccagguccccggcaggcugguguggggccacucaccgccuugcccggccgggcccaggugcagaugaggcccuccuggcaggcagugaugaugcaguccuccaggaacaggaggacugugagccgcuccugggcgaucuucuugcacacaaggggcuccagcaggggcaccucguggaugcgcgggcacagcgcagugcccagcaccuuggcgggguccaggcggcugcggggaacagggccgcugggcuucuccccaccacugccacugccgccacugccaccccggcugauguugcccaggcugugguagcgcuugugcuccuucucugccccccggucccgccgcuccugcagugugagcguggcgaagcggccaaugcugaauggugugccaggcucugccgccacacccgggccgcccgccuugcccccgccagcugggugcgggagacuguuggagcgggacagcgagcgaggcagggggccugggccaggcucgccaccccucgagcugcuggcggccgguggcguggugccaggugugccagggagggugcgggugcgggccaggggggggugcggguagagcacgucuucagugaggucccacaggcagaacugcguguccuggcccgccgagccaaagcgguaaguaauggagccagccuugggcaguggagagagcggggcgcccccggccgagccugugcccgcagccucgggcuccuccuccuccucuucgccgcuccgcuccccaucagcaccggcugcugucgccgccuccucugcccuugugguguaggggucaaaggccacagcguugacccaggacuuguggccauggccucgagccaccacgcggcccucggugaaggaccacacggugaccaggucaucuucgccacccgucaccacguagcggccgucagggcuccagcacacacacagcaggcccccaaaguagcucuucaugagcccacgcaggagcauggagucgaaguggaagacgcgcaggcagccauccuggcucacacaggccaggugccggccaucgggcgagaaggcgaacucguugaggggccccucacccaccgcccacuuggccagcggguugcggggugccuugcucuuggcagcauagacagagaagcccucgcccugcuucagcaggcuguacuggggcggggccgaggcgcagggguggcugacguuguacagguacagguggccacuggcgugugaugccaggaacaggcucuccgacucaggcagccacuucagauaugucaccuuggucuugucgaucaaccgcugccaggggagacagugugggguugggagaaggcaguaaaacccaggcagaacuucuccccgacccaaaguccccaagaaggccguuggacauggccccgcucacacagcaggugccacaccaggcccagguccuccucggagagaagcucccaaacuggggaagacagauggacaccaggucauggaaacauggggaaacagaggcugcugcaagguggccacagggugcuccaaggagccucgaugucccaucuuuggcgaggggacaguccugcuugccacagaauuguccuguaucucgggguccucaaccuccgggccauggaacaguagugguccguggccuguuaggaaccaggccaugcagcaggaggugaguggugggcgagcaggcauuacagccugagcccagccuccuaccggagcagcgcaccauucaauccucguaagagugcgaaccccaccaugaacuaugcaugcgagggaucuaggugugcgcuccuuauuagaaucuaacaccugaugaucagaggcagaacgguuucaucccaaaaccauccccccaacagucuguggaaaaacugucuuccauaagaccagucccuggugccaaaaugguuggggaccacuguaucugucuaacccucccccgaucuuuacuacgucaggcuucaaguaggaaauuucuucacggaaaggcagcuccccaaaggaagcgaucuuuguuugguucacuauucuuuaaagcagugcacacaggaggcagcuugaagguaauuccuggacaaaugagugacaaccccccaucccgcuaggugcuuagacaaaaaaccucggcaucugccccucuuuuccucauccaauccuuccacaaauccugugggcucgaccuucaaaauacacccagaaguggcugggcgugguggcucacgccuguaaucccagcacuuugggaggcugaggcaggcggaucacaaagucaggaguuccagaccagccuagccaauauggugaaauacaaguagagauacaaaaucucuacuaaaaauacaaaaauuagccaggcaugguggcgggcgccuauagucccagcuacucaggaggcugaggcagaauugcuugaacccgggaggcggagguugcagugaggggagaucaugccacuguacuccagccugggcgacagagcgagacuccaccucaaaauaaaaaaaaaagaaaaaauacacccagaaucugaccuccucucaccaucccauucaaccaccccaagccugcaaugcugugugacuggccucaggcuccaaugccugggccugucuguccucugcagccgccacagcgaugcucugugaaguaucagccagcaccuggcacuguccugcucugaacacuucgcagccucucucaagcaggguuccagagccugaggcccuaaugcucucaggcagccaguguaugcaacuaaggagcugcucucccaggaugaggugccucccaucccugggagaacugaacaaauaaucacucuagucacuucugccuuccagggcucaggugagccccaaugagaaaggcuccuccacaggcuuccaacuaagaguaaggcaaaaucucuccgugaccuuccagacucuccaugagccagccccuccguuauuucuuggaacucaucuaccaucuucucucccucaguaacugcacuggccacacggcuucugugcaauccugcauuuguccuagcuggccccgauacucagaauguccuucuuggcugggugugauggcucacgccuauaaucccagcgcuuugggaggccaaagcaggagaauagcuugagcccaggaguucgagaccagcuugggcaacacaaagagaccccgccucuacaaaaaauacaaaaguuagccaguugugguggugcaugcauguagucccagcuacucaggaggcugauaugggaggacugcuugagccugggaggcggagguugcagugaacgaagaucguaccacugcacuccagcauggacgacagagugagacccuaucucaggaaaaaaaaaaaaaaaaaugcccuuccccaggcaacucuucucaccugccuccuucaggucuuuauuucaguaucaccucuuagugagggcuuuccugaccacccuacuaaacucuccaagcuucccucagccccuuccccacugcuucuucuaaacaggccuuaaucaccugcugacacacgaagacuuaacuugauuaacugucugucuccccagcuagacugaaagcuccaaaagggcagggccuccuguccagggcccugagaugugauaucccuagugcugggaacggugccuggcacagaacggaugcucaaaaacuauuugugaauggaugagcuaaugaauuuuuaauccacugacuguuccguucacucccuucagccauucacucauucugagaauauuuauggaacaccuccucuggaccagagagaaugagacagaagccaagagcagucccugcccgcggauaaggucguuuacugguaucuccucguaggccaaguuggcccaggacugagcaaucuccauguaugauucuacaacagcgguccugcaagguaggaacuggaaucccauuuugcagaggaggagaagugaggcucagagaauggucaccuucccaaagucacaugaugaguaaauggugcagcagggcuuugaauccaaagccuccagagcccagaacucaaagagcaagggcaucaacuaagucccgacuuauuuacuagccucaauucucuaaucugcaaaaugggcagcacacuucuguauccacugguugaugaaaacucaaagaauggccgggcgcgguggcucaugccuguaaucccagcacuucgggaggccgaggugggcggaucacaaggucagguguuugagaccagccuggccaacauggugaaaccccaucucuaccaaaaauacaaaaauuggccgggugugguggcucacgccuuuaauuccagcacuuugggaggccgaggcgggcagaucacgaggucaggagaucgagacuauccugacuaacacggugaaaucccgucucuacuaaaaauacaaaaaaauuagcugggcguggugcugggcgccuguagucccagcugcuggggaggcugagacagaagaauggcgugaacccgggaggcagagguugcagugagccgagaucgcgccacugcacuccagccugggcgacagagcgagacuccaucucaaaaaaaaaaauuagccagguaugauagugcgcaccuguagucccagcuacucaggaggcugaggcaggagaauugcuugaaccugggaggcggagguugcagugacccgagauuguaccacugcacuccagccugggcgacagagugagacuccgccuuaaaaagaaaaaaaaaauuaaaaacaauaaaaauuacaauuacaauuaaaaaaaaaaaaaagaaccgggcaugguggcucacaccuguaaucccaccacuuugggaggccgaggugggcagaucacgaggucaggagaucgagaccauccugacuaacacggugaaaccccaucuccacuaaaacuacaauaaauuaggcgggcguggcagcaggugccugaagucccagcuacucaggaggcugaggcaggagaauggcaugaacccgggagguggaucuugcagugagcagagaucgcgccacugcacuccagccugggugacagggugagacuccaucucaaaauaaauaaauaaaagaaagaaagaaagaaagaaaacccaaggaguaaaguauucagcacaaggguaacacagcacagggccuggguacaguaaaggcagcugucauuagcugcugucaccccauucuccaucucucccugguccugccccucucaggccuacacuguuccgcaggcagcugcauccuaauggcauauaguggguaggugagaaggcagagaaguugggggcucugggggcugcaaucaccuccucauugaacagcuugcugguguccuuuuugaugagauccagguacugcacuugacccgcugagaagcccaccagcagcgagauggucucgguggcagcagugaacugguugaaaucguggcaggugggcugggugcccuuguagauccgcuugucaauuggcuuguugaggucaauggacuugaggggugggagaaaaggaguuaaugguguaugccacugaggagaaggaagaggauguugagguugggggaaaccacuaagaggaagcaggguuagaacccagagggaaguggggaggugaguagguggauugcgaaggacggggcaaccacagacgggaaggggacccaaaucacagacaagaguagcaaaaaagaugguaaggaucccccuugaccacagugccuccccaaaguugggucaccucuaauucagagacacccuuguccacauaaucaggguucuggguccacacaguuccuaagcuccgauuccuuuuagccucaccacuccauccuauaaccucagcaacucccuugggaccuaguaccacacuauuccaagacccccaaaccuugaggucacccaaauuuccaggacucuaaagccuaacauccuagcauucucuucacuuuguagucccuaaaccgccacaguucugggacccgucaaaccucacggucucccacauuuuaggcccauuuauuaccuaggggcuccgaaggauccccaucauuucugggaucaccauaaacggccaggguucucaccacaucgcuuuagagauguccugaaucacaccugcagauuccccugccagggccucucauucccuugagagcucccaucagcuuccggacgcucaucuccuccaggacccucaugacuuccagaccccaauuuucucuagaaucccauucagcuucuggauccccuaucaccuucaaggcccccaucacuucuagacuucuccucauuccugggcucaaucucaagaccccucucccacaccuccaggcugcaauacuggguucuccaucaccucugggcuugcaucaccucaugauuccccauuaccugcagaaugccugccaccccagaacccgggggaucccaccucaucucagauaccccaucauguccaauagucaccaucccagaacuccuacgcauaacggggguaaaggggauuucccccaucaccuccaagaugccugcccagcaccccgcgggccucucaucacauuucagaauccuguacucccuccaaugcugucgcccuacaacguccaucacauuuagaaugccuaucucagggccccauaucaauucggggacccuccuaucaguucucuggaaccuccauccuuucagcacccagggccccacgaugcaggccgcucacccguuggcucccacgacgacagcagccuggguagaaauagagcucacggcccaaguugaagcagacgcggucuccccccgagcccagccccgcgggcguggcgggcggcuccccggccccggcgcuguccggcuccccgaggcgcacgaggcugaggcgcacggcgggcagggcgggcccggguccggggccugcgggcggcggggacgacgcggggccugcagcgccgggaccggaggcggaggcagggccgggcgggggcugcgguggcugaggcggcaccggagucugggcggaagccggacccgaccugcgagcggcgccgucgcccgggaguagcuuguagaaacccucgcgcgugcggaauugcgacuuaaucuccgcgcagucccccauggcggcgccggggcccgagccgcccuccgcgccgcccgccgccaucuugggcgccccccgggccccgccacugccggacugccgcccgcagccgggcccccucccggaagccgcugg

SEQ ID NO: 15040 - RNA, 12786 nt, Homo sapiens
agaaguggccagagaggcccaggggacagccagggacaggcagacaugcagccagggcuccagggccuggacaggggcugccaggcccugugacaggaggaccccgagcccccggcccggggaggggccauggugcugccuguccaacaugucagccgaggugcggcugaggcggcuccagcagcugguguuggacccgggcuuccuggggcuggagccccugcucgaccuucuccugggcguccaccaggagcugggcgccuccgaacuggcccaggacaaguacguggccgacuucuugcaguggggugagugccuacccucggggcuccugcagaugggguggggguggggcaggagacaggucugggcacagaggccuggcuguugggggggcaggauggcaggaugggcauggggagauccucccauccuggggcucagaguguggaccugggcccuggggcaacauuucucuguccuaugccaccacucuggaggggcagaguaaggucagcagaggcuaggguggcugugacucagagccauggcuuaggagucacagcaggcuaggcugccaacagccucccauggccucucugcaccccgccucagggucagggucagggucaugcugggagcucccucuccuaggacccuccccccaaaagugggcucuauggcccucuccccugguuuccuguggccuggggcaagccaggagggccagcauggggcagcugccaggggcgcagccgacaggcagguguucggcgccagccucuccagcugccccaacaggugcccaggcacugggagggcggugacucacgcgggcccugugggagaaccagcuuugcagacaggcgccaccagugcccccuccucugcgauccaggagggacaacuuuggguucuucugggugugucuccuucuuuuguagguucugcacccacccccacccccagccccaaagucucgguuccuaugagccgugugggucagccaccauucccgccaccccgggucccugcguccuuuaguucuccuggcccagggccuccaaccuuccagcugucccacaaaaccccuucuugcaagggcuuuccagggccuggggccagggcuggaaggaggaugcuuccgcuucugccagcugccuugucugcccaccuccuccccaagcccaggacucgggcucacuggucacugguuucuuucauucccagcacccugccccucuggcccucauaugucuggcccucagugacugguguuugguuuuuggccuguguguaacaaacugugugugacacuuguuuccuguuucuccgccuuccccugcuuccucuuguguccaucucuuucugacccaggccugguuccuuucccuccuccucccauuucacagaugggaagguggaggccaagaagggccaggccauucagccucuggaaaaaccuucucccaaccucccacagccccuaaugacucuccuggccucccuuuaguagaggaugaaguuggguuggcaggguaaacugagaccgggugggguaggggucuggcgcucccgggaggagcacuccuuuuguggcccgagcugcaucucgcggccccuccccugccaggccuggggcgggggagggggccaggguuccugcugccuuaaaagggcucaaugucuuggcucucuccucccucccccguccucagcccuggcugguucgucccugcuggcccacucucccggaaccccccggaaccccucucuuuccuccagaacccacugucuccucuccuucccuccccucccauacccaucccucucuccauccugccuccacuucuuccacccccgggaguccaggccucccuguccccacagucccugagccacaagccuccaccccagcuggucccccacccaggcugcccaguuuaacauuccuagucauaggaccuugacuucugagaggccugauugucaucuguaaauaagggguaggacuaaagcacuccuccuggaggacugagagaugggcuggaccggagcacuugagucugggauaugugaccaugcuaccuuugucucccuguccuguuccuucccccagccccaaauccaggguuuuccaaagugugguucaagaaccaccugcaucugaaucuagagguacuggauacaaccccacgucugggccguuacccaggacauucuacaugagaacguggggguggggcccuggcugcaccugaacugucaccuggagucaggguggaagguggaagaacugggucuuauuuccuucuccccuuguucuuuagggucuguccuucugcagacuccguuaccccacccuaaccauccugcacacccuuggagcccucugggccaaugcccugucccgcaaagggcuucucaggcaucucaccucuaugggagggcauuuuuggcccccagaaccuuacacgguguuuauguggggaagccccugggaagcagacaguccuagggugaagcugagaggcagagagaaggggagacagacagaggguggggcuuucccccuugucuccagugcccuuucuggugacccucgguucuuuucccccaccacccccccagcggagcccaucguggugaggcuuaaggagguccgacugcagagggacgacuucgagauucugaaggugaucggacgcggggcguucagcgagguaagccgaaccgggcgggagccugacuugacucguggugggcggggcauagggguuggggcggggccuuagaaauugaugaaugaccgagccuuagaaccuagggcugggcuggaggcggggcuugggaccaaugggcgugguguggcagguggggcggggccacggcugggugcagaagcggguggaguugggucugggcgagcccuuuuguuuucccgccgucuccacucugucucacuaucucgaccucagguagcgguagugaagaugaagcagacgggccagguguaugccaugaagaucaugaacaagugggacaugcugaagaggggcgaggugaggggcugggcggacguggggggcuuugaggauccgcgccccgucuccggcugcagcuccuccgggugcccugcaggugucgugcuuccgugaggagagggacguguuggugaauggggaccggcgguggaucacgcagcugcacuucgccuuccaggaugagaacuaccuggugagcuccgggccggggugacuaggaagagggacaagagcccgugcugucacuggacgaggagguggggagaggaagcucuaggauugggggugcugcccggaaacgucugugggaaagucugugugcgguaagagggugugucagguggaugaggggccuucccuaucugagacggggaugguguccuucacugcccguuucuggggugaucugggggacucuuauaaagaugucucuguugcggggggucucuuaccuggaaugggauaggucuucaggaauucuaacggggccacugccuagggaaggagugucugggaccuauucucuggguguuggguggccucuggguucucuuucccagaacaucucagggggagugaaucugcccagugacaucccaggaaaguuuuuuuguuuguguuuuuuuuugaggggcgggggcgggggccgcagguggucucugauuuggcccggcagaucucuaugguuaucucugggcuggggcugcaggucucugcccaaggauggggugucucugggagggguugucccagccauccgugauggaucagggccucaggggacuaccaaccacccaugacgaaccccuucucaguaccuggucauggaguauuacgugggcggggaccugcugacacugcugagcaaguuuggggagcggauuccggccgagauggcgcgcuucuaccuggcggagauugucauggccauagacucggugcaccggcuuggcuacgugcacaggugggugcagcauggccgaggggauagcaagcuuguucccuggccggguucuuggaaggucagagcccagagaggccagggccuggagagggaccuucuugguuggggcccaccggggggugccugggaguaggggucagaacuguagaagcccuacaggggcggaacccgaggaaguggggucccagguggcacugcccggaggggcggagccuggugggaccacagaagggagguucauuuaucccacccuucucuuuuccuccgugcagggacaucaaacccgacaacauccugcuggaccgcuguggccacauccgccuggccgacuucggcucuugccucaagcugcgggcagauggaacggugagccagugcccuggccacagagcaacuggggcugcugaugagggauggaaggcacagagugugggagcgggacuggauuuggaggggaaaagagguggugugacccaggcuuaagugugcaucuguguggcggaguauuagaccaggcagagggaggggcuaagcauuuggggagugguuggaaggagggcccagagcuggugggcccagaggggugggcccaagccucgcucugcuccuuuugguccaggugcggucgcugguggcugugggcaccccagacuaccugucccccgagauccugcaggcugugggcggugggccugggacaggcagcuacgggcccgagugugacuggugggcgcuggguguauucgccuaugaaauguucuaugggcagacgcccuucuacgcggauuccacggcggagaccuauggcaagaucguccacuacaaggugagcacggccgcagggagaccuggccucucccgguaggcgcucccaggcuaucgccuccucucccucugagcaggagcaccucucucugccgcugguggacgaaggggucccugaggaggcucgagacuucauucagcgguugcugugucccccggagacacggcugggccgggguggagcaggcgacuuccggacacaucccuucuucuuuggccucgacugggauggucuccgggacagcgugccccccuuuacaccggauuucgaaggugccaccgacacaugcaacuucgacuugguggaggacgggcucacugccauggugagcgggggcgggguagguaccuguggccccugcucggcugcgggaaccuccccaugcucccuccauaaaguuggaguaaggacagugccuaccuucugggguccugaaucacucauuccccagagcaccugcucugugcccaucuacuacugaggacccagcagugaccuagacuuacaguccagugggggaacacagagcagucuucagacaguaaggccccagagugaucagggcugagacaauggagugcagggggugggggacuccugacucagcaaggaagguccuggagggcuuucuggaguggggagcuaucugagcugagacuuggagggaugagaagcaggagaggacuccuccucccuuaggccgucucucuucaccguguaacaagcugucauggcaugcuugcucggcucugggugcccuuuugcugaacaauacuggggauccagcacggaccagaugagcucuggucccugcccucauccaguugcagucuagagaauuagagaauuauggagaguguggcaggugcccugaagggaagcaacaggauacaagaaaaaaugauggggccaggcacgguggcucacgccuguaaccccagcaauuuggcaggccgaaguggguggauugcuugagcccaggaguucgagaccagccugggcaauguggugagacccccgucucuacaaaaauguuuuaaaaauugguugggcgugguggcgcaugccuguauacucagcuacuaggguggccgacgugggcuugagcccaggaggucaaggcugcagugagcugugauugugccacugcacuccagccugggcaacggagagagacucugucucaaaaauaagauaaacugaaauuaaaaaauaggcugggcuggccgggcgugguggcucacgccuguaaucucagcacuuugggaggccgaggcggguggaucacgaggucaggagaucgagaccaucuuggcuaacacggugaaaccccaucucuccuaaaaauacaaaaaauuagccaggcgugguggcgggcgccuguagucccagcuacucaggaggcugaggcaggagaauggcgugaacccgggaggcagaguuugcagugagccgagaucgugccacugcacuccagccugggcgacagagcgagacucugucucagaaaaaaaaaaaaaaaaaaaaaaaaauaggcuggaccgcggccgggcgcuguggcucaugccuguaaucccagcacuuugggaguccaaggccggugggucaugagaucaggaguuuugagacuaggcuggccaacacggugaaaccccgucucuacuaaaaauacaagaaaauuagcuggguguggucucgggugccuguaauuccaguuacuggggaagcugaggcaggagaauugcuugaaccugggaggcagaguuugcagugagccaagaucaugccacuacacuccagucugggugacagagugagacucugucucaaaaaaaaaaaaaaaaaaaaggguugggcaaggugguucacgccuguaaucccagaacuuugggaggcugaggcaggcagaucacuggaagucaggaguucaagaccagccuggccaacauggugaaacccugugucuacuaaaaauacaaaauuuagccaggcuugguggcguaugccuguaaugccagcuacucaggaggcugaggcaggagaaucgcuugauugaaccugggaggcagaguuugcagugggcugggguugugccacugcacucuaggcugggagacagcaagacuccaucuaaaaaaaaaaaacagaacugggcugggcacaguggcuuauauuuguaaucccagcacuuugggaggcugagguuggaggacugcuugagcccagaguuugggacuacaacagcugagguaggcggaucacuugaggucagaagauggagaccagccuggccagcguggcgaaaccccgucucuaccaaaaauauaaaaaauuagccaggcgugguagagggcgccuguaaucucagcuacucaggacgcugaggcaggagaaucgccugaaccugggaggcggagguugcagugagcugagauugcaccacugcacuccagccuggguaacagagcgagacuccguaucaaagaaaaagaaaaaagaaaaaaugcuggaggggccacuuuagauaagcccugaguuggggcugguuuggggggaacauguaagccaagaucaaaaagcagugaggggcccgcccugacgacugcugcucacaucugugugucuugcgcaggagacacugucggacauucgggaaggugcgccgcuagggguccaccugccuuuugugggcuacuccuacuccugcauggcccucagguaagcacugcccuggacggccuccaggggccacgaggcugcuugagcuuccuggguccugcuccuuggcagccaauggaguugcaggaucagucuuggaaccuuacuguuuugggcccaaagacuccuaagaggccagaguuggaggaccuuaaauuuucagaucuauguacuucaaaauguuagauugaauuuuaaaaccucagagucacagacugggcuucccagaaucuuguaaccauuaacuuuuacgucuguaguacacagagccacaggacuucagaacuuggaaaauaugaaguuuagacuuuuacaaucaguuguaaaagaaugcaaauucuuugaaucagccauauaacaauaaggccauuuaaaaguauuaauuuaggcgggccgcgguggcucacgccuguaauccuagcacuuugggaggccaaggcagguggaucaugaggucaggagaucgagaccauccuggcuaacacggugaaaccccgucucuacuaaaaauacaaaaaaauuagccgggcaugguggcgggcgcuugcggucccagcuacuugggaggcgaggcaggagaauggcaugaacccgggaggcggagcuugcagugagccgagaucaugccacugcacuccagccugggcgacagagcaagacuccgucucaaaaaaaaaaaaaaaaaaguauuuauuuaggccgggugugguggcucacgccuguaauuccagugcuuugggaggaugagguggguggaucaccugaggucaggaguucgagaccagccugaccaacguggagaaaccucaucucuacuaaaaaacaaaauuagccaggcgugguggcauauaccuguaaucccagcuacucaggaggcugaggcaggagaaucagaacccaggagggggagguuguggugagcugagaucgugccauugcauuccagccugggcaacaagagugaaacuucaucucaaaaaaaaaaaaaaaaaaguacuaauuuacaggcugggcaugguggcucacgcuuggaaucccagcacuuugggaggcugaaguggacggauugcuucagcccaggaguucaagaccagccugagcaacauaaugagacccugucucuacaaaaaauugaaaaaaucgugccaggcaugguggucugugccugcaguccuagcuacucaggagucugaaguaggagaaucacuugagccuggaguuugaggcuucagugagccaugauagauuccagccuaggcaacaaagugagaccuggucucaacaaaaguauuaauuacacaaauaaugcauugcuuaucacaaguaaauuagaaaauacagauaaggaaaaggaaguugauaucucgugagcucaccagauggcaguggucccuggcucacacguguacugacacauguuuaaauaguggagaacagguguuuuuuugguuuguuuuuuuccccuuccucaugcuacuuugucuaagagaacaguugguuuucuagucagcuuuuauuacuggacaacauuacacauacuauaccuuaucauuaaugaacuccagcuugauucugaaccgcugcggggccugaacggugggucaggauugaacccauccucuauuagaacccaggcgcauguccaggauagcuagguccugagccguguucccacaggagggacugcuggguuggaggggacagccacuucauaccccagggaggagcuguccccuucccacagcugaguggggugugcugaccucaaguugccaucuuggggucccaugcccagucuuaggaccacaucuguggagguggccagagccaagcagucuccccaucaggucggccucccuguccugaggcccugagaagaggggucugcagcggucacaugucaagggaggagaugagcugacccuagaacaugggggucuggaccccaagucccugcagaagguuuagaaagagcagcucccaggggcccaaggccaggagaggggcagggcuuuuccuaagcagaggaggggcuauuggccuaccugggacucuguucucuucgcucugcugcuccccuuccucaaaucaggaggucuuggaagcagcugccccuacccacaggccagaaguucugguucuccaccagagaaucagcauucugucucccuccccacucccuccuccucuccccagggacagugaggucccaggccccacacccauggaacuggaggccgagcagcugcuugagccacacgugcaagcgcccagccuggagcccucgguguccccacaggaugaaacaguaaguugguggaggggaggggguccgucagggacaauugggagagaaaaggugagggcuucccggguggcgugcacuguagagcccucuagggacuuccugaacagaagcagacagaaaccacggagagacgagguuacuucagacaugggacggucucuguaguuacaguggggcauuaaguaaggguguguguguugcuggggaucugagaagucgaucuuugagcugagcgcuggugaaggagaaacaagccauggaaggaaaggugccaaguggucaggcgagagccuccagggcaaaggccuugggcaggugggaauccugauuuguuccugaaagguaguuuggcugaaucauuccugagaaggcuggagaggccagcaggaaacaaaacccagcaaggccuuuugucgugagggcauuagggagcuggagggauuuugagcagcagagggacauagguuguguuaguguuugagcaccagcccucuggucccuguguagauuuagaggaccagacucagggauggggcugagggagguagggaagggagggggcuuggaucauugcaggagcuauggggauuccagaaauguugaggggacggaggaguaggggauaaacaaggauuccuagccuggaaccagugcccaaguccugagucuuccaggagccacaggcagccuuaagccugguccccauacacaggcugaaguggcaguuccagcggcugucccugcggcagaggcugaggccgaggugacgcugcgggagcuccaggaagcccuggaggaggaggugcucacccggcagagccugagccgggagauggaggccauccgcacggacaaccagaacuucgccaggucgggaucggggccggggccggggccgggaugcgggccgguggcaacccuuggcauccccucucguccggcccggacggacucaccguccuuaccuccccacagucaacuacgcgaggcagaggcucggaaccgggaccuagaggcacacguccggcaguugcaggagcggauggaguugcugcaggcagagggagccacaggugagucccucauguguccccuuccccggaggaccgggaggaggugggccgucugcuccgcggggcguguauagacaccuggaggagggaagggacccacgcuggggcacgccgcgccaccgcccuccuucgccccuccacgcgcccuaugccucuuucuucuccuuccagcugucacggggguccccaguccccgggccacggauccaccuucccauguaagaccccucucuuuccccugccucagaccugcugcccauucugcagauccccucccuggcuccuggucuccccguccagauauagggcucacccuacgucuuugcgacuuuagagggcagaagcccuuuauucagccccagaucucccuccguucaggccucaccagauucccuccgggaucucccuagauaaccuccccaaccucgauuccccucgcugucucucgccccaccgcugagggcugggcugggcuccgaucgggucaccugucccuucucucuccagcuagauggccccccggccguggcugugggccagugcccgcugguggggccaggccccaugcaccgccgccaccugcugcucccugccaggguacguccggcugcccacgccccccuccgccgucgcgccccgcgcuccacccgccccuugccacccgcuuagcugcgcauuugcggggcugggcccacggcaggagggcggaucuucgggcagccaaucaacacaggccgcuaggaagcagccaaugacgaguucggacgggauucgaggcgugcgaguggacuaacaacagcuguaggcuguuggggcgggggcggggcgcagggaagagugcgggcccaccuaugggcguaggcggggcgagucccaggagccaaucagaggcccaugccggguguugaccucgcccucuccccgcaggucccuaggccuggccuaucggaggcgcuuucccugcuccuguucgccguuguucugucucgugccgccgcccugggcugcauuggguugguggcccacgccggccaacucaccgcagucuggcgccgcccaggagccgcccgcgcucccugaacccuagaacugucuucgacuccggggccccguuggaagacugagugcccggggcacggcacagaagccgcgcccaccgccugccaguucacaaccgcuccgagcgugggucuccgcccagcuccaguccugugauccgggcccgcccccuagcggccggggagggaggggccggguccgcggccggcgaacggggcucgaaggguccuuguagccgggaaugcugcugcugcugcugcugcugcugcugcugcugcugcugcugcugcugcugcugcugcuggggggaucacagaccauuucuuucuuucggccaggcugaggcccugacguggaugggcaaacugcaggccugggaaggcagcaagccgggccguccguguuccauccuccacgcacccccaccuaucguugguucgcaaagugcaaagcuuucuugugcaugacgcccugcucuggggagcgucuggcgcgaucucugccugcuuacucgggaaauuugcuuuugccaaacccgcuuuuucggggaucccgcgccccccuccucacuugcgcugcucucggagccccagccggcuccgcccgcuucggcgguuuggauauuuauugaccucguccuccgacucgcugacaggcuacaggacccccaacaaccccaauccacguuuuggaugcacugagaccccgacauuccucgguauuuauugucuguccccaccuaggacccccacccccgacccucgcgaauaaaaggcccuccaucugcccaaagc

SEQ ID NO: 15041 - RNA, 12786 nt, Homo sapiens
gcuuugggcagauggagggccuuuuauucgcgagggucggggguggggguccuagguggggacagacaauaaauaccgaggaaugucggggucucagugcauccaaaacguggauugggguuguuggggguccuguagccugucagcgagucggaggacgaggucaauaaauauccaaaccgccgaagcgggcggagccggcuggggcuccgagagcagcgcaagugaggaggggggcgcgggauccccgaaaaagcggguuuggcaaaagcaaauuucccgaguaagcaggcagagaucgcgccagacgcuccccagagcagggcgucaugcacaagaaagcuuugcacuuugcgaaccaacgauaggugggggugcguggaggauggaacacggacggcccggcuugcugccuucccaggccugcaguuugcccauccacgucagggccucagccuggccgaaagaaagaaauggucugugauccccccagcagcagcagcagcagcagcagcagcagcagcagcagcagcagcagcagcagcagcagcauucccggcuacaaggacccuucgagccccguucgccggccgcggacccggccccucccuccccggccgcuagggggcgggcccggaucacaggacuggagcugggcggagacccacgcucggagcgguugugaacuggcaggcggugggcgcggcuucugugccgugccccgggcacucagucuuccaacggggccccggagucgaagacaguucuaggguucagggagcgcgggcggcuccugggcggcgccagacugcggugaguuggccggcgugggccaccaacccaaugcagcccagggcggcggcacgagacagaacaacggcgaacaggagcagggaaagcgccuccgauaggccaggccuagggaccugcggggagagggcgaggucaacacccggcaugggccucugauuggcuccugggacucgccccgccuacgcccauaggugggcccgcacucuucccugcgccccgcccccgccccaacagccuacagcuguuguuaguccacucgcacgccucgaaucccguccgaacucgucauuggcugcuuccuagcggccuguguugauuggcugcccgaagauccgcccuccugccgugggcccagccccgcaaaugcgcagcuaagcggguggcaaggggcggguggagcgcggggcgcgacggcggaggggggcgugggcagccggacguacccuggcagggagcagcagguggcggcggugcauggggccuggccccaccagcgggcacuggcccacagccacggccggggggccaucuagcuggagagagaagggacaggugacccgaucggagcccagcccagcccucagcgguggggcgagagacagcgaggggaaucgagguuggggagguuaucuagggagaucccggagggaaucuggugaggccugaacggagggagaucuggggcugaauaaagggcuucugcccucuaaagucgcaaagacguagggugagcccuauaucuggacggggagaccaggagccagggaggggaucugcagaaugggcagcaggucugaggcaggggaaagagaggggucuuacaugggaagguggauccguggcccggggacuggggacccccgugacagcuggaaggagaagaaagaggcauagggcgcguggaggggcgaaggagggcgguggcgcggcgugccccagcgugggucccuucccuccuccaggugucuauacacgccccgcggagcagacggcccaccuccucccgguccuccggggaaggggacacaugagggacucaccuguggcucccucugccugcagcaacuccauccgcuccugcaacugccggacgugugccucuaggucccgguuccgagccucugccucgcguaguugacuguggggagguaaggacggugaguccguccgggccggacgagaggggaugccaaggguugccaccggcccgcaucccggccccggccccggccccgaucccgaccuggcgaaguucugguuguccgugcggauggccuccaucucccggcucaggcucugccgggugagcaccuccuccuccagggcuuccuggagcucccgcagcgucaccucggccucagccucugccgcagggacagccgcuggaacugccacuucagccuguguauggggaccaggcuuaaggcugccuguggcuccuggaagacucaggacuugggcacugguuccaggcuaggaauccuuguuuauccccuacuccuccguccccucaacauuucuggaauccccauagcuccugcaaugauccaagcccccucccuucccuaccucccucagccccaucccugagucugguccucuaaaucuacacagggaccagagggcuggugcucaaacacuaacacaaccuaugucccucugcugcucaaaaucccuccagcucccuaaugcccucacgacaaaaggccuugcuggguuuuguuuccugcuggccucuccagccuucucaggaaugauucagccaaacuaccuuucaggaacaaaucaggauucccaccugcccaaggccuuugcccuggaggcucucgccugaccacuuggcaccuuuccuuccauggcuuguuucuccuucaccagcgcucagcucaaagaucgacuucucagauccccagcaacacacacacccuuacuuaaugccccacuguaacuacagagaccgucccaugucugaaguaaccucgucucuccgugguuucugucugcuucuguucaggaagucccuagagggcucuacagugcacgccacccgggaagcccucaccuuuucucucccaauugucccugacggacccccuccccuccaccaacuuacuguuucauccuguggggacaccgagggcuccaggcugggcgcuugcacguguggcucaagcagcugcucggccuccaguuccauggguguggggccugggaccucacugucccuggggagaggaggagggaguggggagggagacagaaugcugauucucugguggagaaccagaacuucuggccuguggguaggggcagcugcuuccaagaccuccugauuugaggaaggggagcagcagagcgaagagaacagagucccagguaggccaauagccccuccucugcuuaggaaaagcccugccccucuccuggccuugggccccugggagcugcucuuucuaaaccuucugcagggacuugggguccagacccccauguucuagggucagcucaucuccucccuugacaugugaccgcugcagaccccucuucucagggccucaggacagggaggccgaccugauggggagacugcuuggcucuggccaccuccacagaugugguccuaagacugggcaugggaccccaagauggcaacuugaggucagcacaccccacucagcugugggaaggggacagcuccucccugggguaugaaguggcuguccccuccaacccagcagucccuccugugggaacacggcucaggaccuagcuauccuggacaugcgccuggguucuaauagaggauggguucaauccugacccaccguucaggccccgcagcgguucagaaucaagcuggaguucauuaaugauaagguauaguauguguaauguuguccaguaauaaaagcugacuagaaaaccaacuguucucuuagacaaaguagcaugaggaaggggaaaaaaacaaaccaaaaaaacaccuguucuccacuauuuaaacaugugucaguacacgugugagccagggaccacugccaucuggugagcucacgagauaucaacuuccuuuuccuuaucuguauuuucuaauuuacuugugauaagcaaugcauuauuuguguaauuaauacuuuuguugagaccaggucucacuuuguugccuaggcuggaaucuaucauggcucacugaagccucaaacuccaggcucaagugauucuccuacuucagacuccugaguagcuaggacugcaggcacagaccaccaugccuggcacgauuuuuucaauuuuuuguagagacagggucucauuauguugcucaggcuggucuugaacuccugggcugaagcaauccguccacuucagccucccaaagugcugggauuccaagcgugagccaccaugcccagccuguaaauuaguacuuuuuuuuuuuuuuuuuugagaugaaguuucacucuuguugcccaggcuggaaugcaauggcacgaucucagcucaccacaaccucccccuccuggguucugauucuccugccucagccuccugaguagcugggauuacagguauaugccaccacgccuggcuaauuuuguuuuuuaguagagaugagguuucuccacguuggucaggcuggucucgaacuccugaccucaggugauccacccaccucauccucccaaagcacuggaauuacaggcgugagccaccacacccggccuaaauaaauacuuuuuuuuuuuuuuuuuugagacggagucuugcucugucgcccaggcuggagugcaguggcaugaucucggcucacugcaagcuccgccucccggguucaugccauucuccugccucgccucccaaguagcugggaccgcaagcgcccgccaccaugcccggcuaauuuuuuuguauuuuuaguagagacgggguuucaccguguuagccaggauggucucgaucuccugaccucaugauccaccugccuuggccucccaaagugcuaggauuacaggcgugagccaccgcggcccgccuaaauuaauacuuuuaaauggccuuauuguuauauggcugauucaaagaauuugcauucuuuuacaacugauuguaaaagucuaaacuucauauuuuccaaguucugaaguccuguggcucuguguacuacagacguaaaaguuaaugguuacaagauucugggaagcccagucugugacucugagguuuuaaaauucaaucuaacauuuugaaguacauagaucugaaaauuuaagguccuccaacucuggccucuuaggagucuuugggcccaaaacaguaagguuccaagacugauccugcaacuccauuggcugccaaggagcaggacccaggaagcucaagcagccucguggccccuggaggccguccagggcagugcuuaccugagggccaugcaggaguaggaguagcccacaaaaggcagguggaccccuagcggcgcaccuucccgaauguccgacagugucuccugcgcaagacacacagaugugagcagcagucgucagggcgggccccucacugcuuuuugaucuuggcuuacauguuccccccaaaccagccccaacucagggcuuaucuaaaguggccccuccagcauuuuuucuuuuuucuuuuucuuugauacggagucucgcucuguuacccaggcuggagugcaguggugcaaucucagcucacugcaaccuccgccucccagguucaggcgauucuccugccucagcguccugaguagcugagauuacaggcgcccucuaccacgccuggcuaauuuuuuauauuuuugguagagacgggguuucgccacgcuggccaggcuggucuccaucuucugaccucaagugauccgccuaccucagcuguuguagucccaaacucugggcucaagcaguccuccaaccucagccucccaaagugcugggauuacaaauauaagccacugugcccagcccaguucuguuuuuuuuuuuuagauggagucuugcugucucccagccuagagugcaguggcacaaccccagcccacugcaaacucugccucccagguucaaucaagcgauucuccugccucagccuccugaguagcuggcauuacaggcauacgccaccaagccuggcuaaauuuuguauuuuuaguagacacaggguuucaccauguuggccaggcuggucuugaacuccugacuuccagugaucugccugccucagccucccaaaguucugggauuacaggcgugaaccaccuugcccaacccuuuuuuuuuuuuuuuuuuuugagacagagucucacucugucacccagacuggaguguaguggcaugaucuuggcucacugcaaacucugccucccagguucaagcaauucuccugccucagcuuccccaguaacuggaauuacaggcacccgagaccacacccagcuaauuuucuuguauuuuuaguagagacgggguuucaccguguuggccagccuagucucaaaacuccugaucucaugacccaccggccuuggacucccaaagugcugggauuacaggcaugagccacagcgcccggccgcgguccagccuauuuuuuuuuuuuuuuuuuuuuuuuucugagacagagucucgcucugucgcccaggcuggagugcaguggcacgaucucggcucacugcaaacucugccucccggguucacgccauucuccugccucagccuccugaguagcugggacuacaggcgcccgccaccacgccuggcuaauuuuuuguauuuuuaggagagaugggguuucaccguguuagccaagauggucucgaucuccugaccucgugauccacccgccucggccucccaaagugcugagauuacaggcgugagccaccacgcccggccagcccagccuauuuuuuaauuucaguuuaucuuauuuuugagacagagucucucuccguugcccaggcuggagugcaguggcacaaucacagcucacugcagccuugaccuccugggcucaagcccacgucggccacccuaguagcugaguauacaggcaugcgccaccacgcccaaccaauuuuuaaaacauuuuuguagagacgggggucucaccacauugcccaggcuggucucgaacuccugggcucaagcaauccacccacuucggccugccaaauugcugggguuacaggcgugagccaccgugccuggccccaucauuuuuucuuguauccuguugcuucccuucagggcaccugccacacucuccauaauucucuaauucucuagacugcaacuggaugagggcagggaccagagcucaucugguccgugcuggauccccaguauuguucagcaaaagggcacccagagccgagcaagcaugccaugacagcuuguuacacggugaagagagacggccuaagggaggaggaguccucuccugcuucucaucccuccaagucucagcucagauagcuccccacuccagaaagcccuccaggaccuuccuugcugagucaggagucccccacccccugcacuccauugucucagcccugaucacucuggggccuuacugucugaagacugcucuguguucccccacuggacuguaagucuaggucacugcuggguccucaguaguagaugggcacagagcaggugcucuggggaaugagugauucaggaccccagaagguaggcacuguccuuacuccaacuuuauggagggagcauggggagguucccgcagccgagcaggggccacagguaccuaccccgcccccgcucaccauggcagugagcccguccuccaccaagucgaaguugcaugugucgguggcaccuucgaaauccgguguaaaggggggcacgcugucccggagaccaucccagucgaggccaaagaagaagggauguguccggaagucgccugcuccaccccggcccagccgugucuccgggggacacagcaaccgcugaaugaagucucgagccuccucagggaccccuucguccaccagcggcagagagaggugcuccugcucagagggagaggaggcgauagccugggagcgccuaccgggagaggccaggucucccugcggccgugcucaccuuguaguggacgaucuugccauaggucuccgccguggaauccgcguagaagggcgucugcccauagaacauuucauaggcgaauacacccagcgcccaccagucacacucgggcccguagcugccugucccaggcccaccgcccacagccugcaggaucucgggggacagguagucuggggugcccacagccaccagcgaccgcaccuggaccaaaaggagcagagcgaggcuugggcccaccccucugggcccaccagcucugggcccuccuuccaaccacuccccaaaugcuuagccccucccucugccuggucuaauacuccgccacacagaugcacacuuaagccugggucacaccaccucuuuuccccuccaaauccagucccgcucccacacucugugccuuccaucccucaucagcagccccaguugcucuguggccagggcacuggcucaccguuccaucugcccgcagcuugaggcaagagccgaagucggccaggcggauguggccacagcgguccagcaggauguugucggguuugaugucccugcacggaggaaaagagaagggugggauaaaugaaccucccuucuguggucccaccaggcuccgccccuccgggcagugccaccugggaccccacuuccucggguuccgccccuguagggcuucuacaguucugaccccuacucccaggcaccccccggugggccccaaccaagaaggucccucuccaggcccuggccucucugggcucugaccuuccaagaacccggccagggaacaagcuugcuauccccucggccaugcugcacccaccugugcacguagccaagccggugcaccgagucuauggccaugacaaucuccgccagguagaagcgcgccaucucggccggaauccgcuccccaaacuugcucagcagugucagcagguccccgcccacguaauacuccaugaccagguacugagaagggguucgucaugggugguugguaguccccugaggcccugauccaucacggauggcugggacaaccccucccagagacaccccauccuugggcagagaccugcagccccagcccagagauaaccauagagaucugccgggccaaaucagagaccaccugcggcccccgcccccgccccucaaaaaaaaacacaaacaaaaaaacuuuccugggaugucacugggcagauucacucccccugagauguucugggaaagagaacccagaggccacccaacacccagagaauaggucccagacacuccuucccuaggcaguggccccguuagaauuccugaagaccuaucccauuccagguaagagaccccccgcaacagagacaucuuuauaagagucccccagaucaccccagaaacgggcagugaaggacaccauccccgucucagauagggaaggccccucauccaccugacacacccucuuaccgcacacagacuuucccacagacguuuccgggcagcacccccaauccuagagcuuccucuccccaccuccucguccagugacagcacgggcucuugucccucuuccuagucaccccggcccggagcucaccagguaguucucauccuggaaggcgaagugcagcugcgugauccaccgccgguccccauucaccaacacgucccucuccucacggaagcacgacaccugcagggcacccggaggagcugcagccggagacggggcgcggauccucaaagccccccacguccgcccagccccucaccucgccccucuucagcaugucccacuuguucaugaucuucauggcauacaccuggcccgucugcuucaucuucacuaccgcuaccugaggucgagauagugagacagaguggagacggcgggaaaacaaaagggcucgcccagacccaacuccacccgcuucugcacccagccguggccccgccccaccugccacaccacgcccauuggucccaagccccgccuccagcccagcccuagguucuaaggcucggucauucaucaauuucuaaggccccgccccaaccccuaugccccgcccaccacgagucaagucaggcucccgcccgguucggcuuaccucgcugaacgccccgcguccgaucaccuucagaaucucgaagucgucccucugcagucggaccuccuuaagccucaccacgaugggcuccgcuggggggguggugggggaaaagaaccgagggucaccagaaagggcacuggagacaagggggaaagccccacccucugucugucuccccuucucucugccucucagcuucacccuaggacugucugcuucccaggggcuuccccacauaaacaccguguaagguucugggggccaaaaaugcccucccauagaggugagaugccugagaagcccuuugcgggacagggcauuggcccagagggcuccaagggugugcaggaugguuagggugggguaacggagucugcagaaggacagacccuaaagaacaaggggagaaggaaauaagacccaguucuuccaccuuccacccugacuccaggugacaguucaggugcagccagggccccacccccacguucucauguagaauguccuggguaacggcccagacgugggguuguauccaguaccucuagauucagaugcaggugguucuugaaccacacuuuggaaaacccuggauuuggggcugggggaaggaacaggacagggagacaaagguagcauggucacauaucccagacucaagugcuccgguccagcccaucucucaguccuccaggaggagugcuuuaguccuaccccuuauuuacagaugacaaucaggccucucagaagucaagguccuaugacuaggaauguuaaacugggcagccugggugggggaccagcugggguggaggcuuguggcucagggacuguggggacagggaggccuggacucccggggguggaagaaguggaggcaggauggagagagggauggguaugggaggggagggaaggagaggagacaguggguucuggaggaaagagagggguuccgggggguuccgggagagugggccagcagggacgaaccagccagggcugaggacgggggagggaggagagagccaagacauugagcccuuuuaaggcagcaggaacccuggcccccucccccgccccaggccuggcaggggaggggccgcgagaugcagcucgggccacaaaaggagugcuccucccgggagcgccagaccccuaccccacccggucucaguuuacccugccaacccaacuucauccucuacuaaagggaggccaggagagucauuaggggcugugggagguugggagaagguuuuuccagaggcugaauggccuggcccuucuuggccuccaccuucccaucugugaaaugggaggaggagggaaaggaaccaggccugggucagaaagagauggacacaagaggaagcaggggaaggcggagaaacaggaaacaagugucacacacaguuuguuacacacaggccaaaaaccaaacaccagucacugagggccagacauaugagggccagaggggcagggugcugggaaugaaagaaaccagugaccagugagcccgaguccugggcuuggggaggaggugggcagacaaggcagcuggcagaagcggaagcauccuccuuccagcccuggccccaggcccuggaaagcccuugcaagaagggguuuugugggacagcuggaagguuggaggcccugggccaggagaacuaaaggacgcagggacccgggguggcgggaaugguggcugacccacacggcucauaggaaccgagacuuuggggcugggggugggggugggugcagaaccuacaaaagaaggagacacacccagaagaacccaaaguugucccuccuggaucgcagaggagggggcacugguggcgccugucugcaaagcugguucucccacagggcccgcgugagucaccgcccucccagugccugggcaccuguuggggcagcuggagaggcuggcgccgaacaccugccugucggcugcgccccuggcagcugccccaugcuggcccuccuggcuugccccaggccacaggaaaccaggggagagggccauagagcccacuuuuggggggaggguccuaggagagggagcucccagcaugacccugacccugacccugaggcggggugcagagaggccaugggaggcuguuggcagccuagccugcugugacuccuaagccauggcucugagucacagccacccuagccucugcugaccuuacucugccccuccagagugguggcauaggacagagaaauguugccccagggcccagguccacacucugagccccaggaugggaggaucuccccaugcccauccugccauccugcccccccaacagccaggccucugugcccagaccugucuccugccccacccccaccccaucugcaggagccccgaggguaggcacucaccccacugcaagaagucggccacguacuuguccugggccaguucggaggcgcccagcuccugguggacgcccaggagaaggucgagcaggggcuccagccccaggaagcccggguccaacaccagcugcuggagccgccucagccgcaccucggcugacauguuggacaggcagcaccauggccccuccccgggccgggggcucgggguccuccugucacagggccuggcagccccuguccaggcccuggagcccuggcugcaugucugccugucccuggcuguccccugggccucucuggccacuucu

SEQ ID NO: 15042 - RNA, 11423 nt, Homo sapiens
ggugucgugcuuccgugaggagagggacguguuggugaauggggaccggcgguggaucacgcagcugcacuucgccuuccaggaugagaacuaccuggugagcuccgggccggggugacuaggaagagggacaagagcccgugcugucacuggacgaggagguggggagaggaagcucuaggauugggggugcugcccggaaacgucugugggaaagucugugugcgguaagagggugugucagguggaugaggggccuucccuaucugagacggggaugguguccuucacugcccguuucuggggugaucugggggacucuuauaaagaugucucuguugcggggggucucuuaccuggaaugggauaggucuucaggaauucuaacggggccacugccuagggaaggagugucugggaccuauucucuggguguuggguggccucuggguucucuuucccagaacaucucagggggagugaaucugcccagugacaucccaggaaaguuuuuuuguuuguguuuuuuuuugaggggcgggggcgggggccgcagguggucucugauuuggcccggcagaucucuaugguuaucucugggcuggggcugcaggucucugcccaaggauggggugucucugggagggguugucccagccauccgugauggaucagggccucaggggacuaccaaccacccaugacgaaccccuucucaguaccuggucauggaguauuacgugggcggggaccugcugacacugcugagcaaguuuggggagcggauuccggccgagauggcgcgcuucuaccuggcggagauugucauggccauagacucggugcaccggcuuggcuacgugcacaggugggugcagcauggccgaggggauagcaagcuuguucccuggccggguucuuggaaggucagagcccagagaggccagggccuggagagggaccuucuugguuggggcccaccggggggugccugggaguaggggucagaacuguagaagcccuacaggggcggaacccgaggaaguggggucccagguggcacugcccggaggggcggagccuggugggaccacagaagggagguucauuuaucccacccuucucuuuuccuccgugcagggacaucaaacccgacaacauccugcuggaccgcuguggccacauccgccuggccgacuucggcucuugccucaagcugcgggcagauggaacggugagccagugcccuggccacagagcaacuggggcugcugaugagggauggaaggcacagagugugggagcgggacuggauuuggaggggaaaagagguggugugacccaggcuuaagugugcaucuguguggcggaguauuagaccaggcagagggaggggcuaagcauuuggggagugguuggaaggagggcccagagcuggugggcccagaggggugggcccaagccucgcucugcuccuuuugguccaggugcggucgcugguggcugugggcaccccagacuaccugucccccgagauccugcaggcugugggcggugggccugggacaggcagcuacgggcccgagugugacuggugggcgcuggguguauucgccuaugaaauguucuaugggcagacgcccuucuacgcggauuccacggcggagaccuauggcaagaucguccacuacaaggugagcacggccgcagggagaccuggccucucccgguaggcgcucccaggcuaucgccuccucucccucugagcaggagcaccucucucugccgcugguggacgaaggggucccugaggaggcucgagacuucauucagcgguugcugugucccccggagacacggcugggccgggguggagcaggcgacuuccggacacaucccuucuucuuuggccucgacugggauggucuccgggacagcgugccccccuuuacaccggauuucgaaggugccaccgacacaugcaacuucgacuugguggaggacgggcucacugccauggugagcgggggcgggguagguaccuguggccccugcucggcugcgggaaccuccccaugcucccuccauaaaguuggaguaaggacagugccuaccuucugggguccugaaucacucauuccccagagcaccugcucugugcccaucuacuacugaggacccagcagugaccuagacuuacaguccagugggggaacacagagcagucuucagacaguaaggccccagagugaucagggcugagacaauggagugcagggggugggggacuccugacucagcaaggaagguccuggagggcuuucuggaguggggagcuaucugagcugagacuuggagggaugagaagcaggagaggacuccuccucccuuaggccgucucucuucaccguguaacaagcugucauggcaugcuugcucggcucugggugcccuuuugcugaacaauacuggggauccagcacggaccagaugagcucuggucccugcccucauccaguugcagucuagagaauuagagaauuauggagaguguggcaggugcccugaagggaagcaacaggauacaagaaaaaaugauggggccaggcacgguggcucacgccuguaaccccagcaauuuggcaggccgaaguggguggauugcuugagcccaggaguucgagaccagccugggcaauguggugagacccccgucucuacaaaaauguuuuaaaaauugguugggcgugguggcgcaugccuguauacucagcuacuaggguggccgacgugggcuugagcccaggaggucaaggcugcagugagcugugauugugccacugcacuccagccugggcaacggagagagacucugucucaaaaauaagauaaacugaaauuaaaaaauaggcugggcuggccgggcgugguggcucacgccuguaaucucagcacuuugggaggccgaggcggguggaucacgaggucaggagaucgagaccaucuuggcuaacacggugaaaccccaucucuccuaaaaauacaaaaaauuagccaggcgugguggcgggcgccuguagucccagcuacucaggaggcugaggcaggagaauggcgugaacccgggaggcagaguuugcagugagccgagaucgugccacugcacuccagccugggcgacagagcgagacucugucucagaaaaaaaaaaaaaaaaaaaaaaaaauaggcuggaccgcggccgggcgcuguggcucaugccuguaaucccagcacuuugggaguccaaggccggugggucaugagaucaggaguuuugagacuaggcuggccaacacggugaaaccccgucucuacuaaaaauacaagaaaauuagcuggguguggucucgggugccuguaauuccaguuacuggggaagcugaggcaggagaauugcuugaaccugggaggcagaguuugcagugagccaagaucaugccacuacacuccagucugggugacagagugagacucugucucaaaaaaaaaaaaaaaaaaaaggguugggcaaggugguucacgccuguaaucccagaacuuugggaggcugaggcaggcagaucacuggaagucaggaguucaagaccagccuggccaacauggugaaacccugugucuacuaaaaauacaaaauuuagccaggcuugguggcguaugccuguaaugccagcuacucaggaggcugaggcaggagaaucgcuugauugaaccugggaggcagaguuugcagugggcugggguugugccacugcacucuaggcugggagacagcaagacuccaucuaaaaaaaaaaaacagaacugggcugggcacaguggcuuauauuuguaaucccagcacuuugggaggcugagguuggaggacugcuugagcccagaguuugggacuacaacagcugagguaggcggaucacuugaggucagaagauggagaccagccuggccagcguggcgaaaccccgucucuaccaaaaauauaaaaaauuagccaggcgugguagagggcgccuguaaucucagcuacucaggacgcugaggcaggagaaucgccugaaccugggaggcggagguugcagugagcugagauugcaccacugcacuccagccuggguaacagagcgagacuccguaucaaagaaaaagaaaaaagaaaaaaugcuggaggggccacuuuagauaagcccugaguuggggcugguuuggggggaacauguaagccaagaucaaaaagcagugaggggcccgcccugacgacugcugcucacaucugugugucuugcgcaggagacacugucggacauucgggaaggugcgccgcuagggguccaccugccuuuugugggcuacuccuacuccugcauggcccucagguaagcacugcccuggacggccuccaggggccacgaggcugcuugagcuuccuggguccugcuccuuggcagccaauggaguugcaggaucagucuuggaaccuuacuguuuugggcccaaagacuccuaagaggccagaguuggaggaccuuaaauuuucagaucuauguacuucaaaauguuagauugaauuuuaaaaccucagagucacagacugggcuucccagaaucuuguaaccauuaacuuuuacgucuguaguacacagagccacaggacuucagaacuuggaaaauaugaaguuuagacuuuuacaaucaguuguaaaagaaugcaaauucuuugaaucagccauauaacaauaaggccauuuaaaaguauuaauuuaggcgggccgcgguggcucacgccuguaauccuagcacuuugggaggccaaggcagguggaucaugaggucaggagaucgagaccauccuggcuaacacggugaaaccccgucucuacuaaaaauacaaaaaaauuagccgggcaugguggcgggcgcuugcggucccagcuacuugggaggcgaggcaggagaauggcaugaacccgggaggcggagcuugcagugagccgagaucaugccacugcacuccagccugggcgacagagcaagacuccgucucaaaaaaaaaaaaaaaaaaguauuuauuuaggccgggugugguggcucacgccuguaauuccagugcuuugggaggaugagguggguggaucaccugaggucaggaguucgagaccagccugaccaacguggagaaaccucaucucuacuaaaaaacaaaauuagccaggcgugguggcauauaccuguaaucccagcuacucaggaggcugaggcaggagaaucagaacccaggagggggagguuguggugagcugagaucgugccauugcauuccagccugggcaacaagagugaaacuucaucucaaaaaaaaaaaaaaaaaaguacuaauuuacaggcugggcaugguggcucacgcuuggaaucccagcacuuugggaggcugaaguggacggauugcuucagcccaggaguucaagaccagccugagcaacauaaugagacccugucucuacaaaaaauugaaaaaaucgugccaggcaugguggucugugccugcaguccuagcuacucaggagucugaaguaggagaaucacuugagccuggaguuugaggcuucagugagccaugauagauuccagccuaggcaacaaagugagaccuggucucaacaaaaguauuaauuacacaaauaaugcauugcuuaucacaaguaaauuagaaaauacagauaaggaaaaggaaguugauaucucgugagcucaccagauggcaguggucccuggcucacacguguacugacacauguuuaaauaguggagaacagguguuuuuuugguuuguuuuuuuccccuuccucaugcuacuuugucuaagagaacaguugguuuucuagucagcuuuuauuacuggacaacauuacacauacuauaccuuaucauuaaugaacuccagcuugauucugaaccgcugcggggccugaacggugggucaggauugaacccauccucuauuagaacccaggcgcauguccaggauagcuagguccugagccguguucccacaggagggacugcuggguuggaggggacagccacuucauaccccagggaggagcuguccccuucccacagcugaguggggugugcugaccucaaguugccaucuuggggucccaugcccagucuuaggaccacaucuguggagguggccagagccaagcagucuccccaucaggucggccucccuguccugaggcccugagaagaggggucugcagcggucacaugucaagggaggagaugagcugacccuagaacaugggggucuggaccccaagucccugcagaagguuuagaaagagcagcucccaggggcccaaggccaggagaggggcagggcuuuuccuaagcagaggaggggcuauuggccuaccugggacucuguucucuucgcucugcugcuccccuuccucaaaucaggaggucuuggaagcagcugccccuacccacaggccagaaguucugguucuccaccagagaaucagcauucugucucccuccccacucccuccuccucuccccagggacagugaggucccaggccccacacccauggaacuggaggccgagcagcugcuugagccacacgugcaagcgcccagccuggagcccucgguguccccacaggaugaaacaguaaguugguggaggggaggggguccgucagggacaauugggagagaaaaggugagggcuucccggguggcgugcacuguagagcccucuagggacuuccugaacagaagcagacagaaaccacggagagacgagguuacuucagacaugggacggucucuguaguuacaguggggcauuaaguaaggguguguguguugcuggggaucugagaagucgaucuuugagcugagcgcuggugaaggagaaacaagccauggaaggaaaggugccaaguggucaggcgagagccuccagggcaaaggccuugggcaggugggaauccugauuuguuccugaaagguaguuuggcugaaucauuccugagaaggcuggagaggccagcaggaaacaaaacccagcaaggccuuuugucgugagggcauuagggagcuggagggauuuugagcagcagagggacauagguuguguuaguguuugagcaccagcccucuggucccuguguagauuuagaggaccagacucagggauggggcugagggagguagggaagggagggggcuuggaucauugcaggagcuauggggauuccagaaauguugaggggacggaggaguaggggauaaacaaggauuccuagccuggaaccagugcccaaguccugagucuuccaggagccacaggcagccuuaagccugguccccauacacaggcugaaguggcaguuccagcggcugucccugcggcagaggcugaggccgaggugacgcugcgggagcuccaggaagcccuggaggaggaggugcucacccggcagagccugagccgggagauggaggccauccgcacggacaaccagaacuucgccaggucgggaucggggccggggccggggccgggaugcgggccgguggcaacccuuggcauccccucucguccggcccggacggacucaccguccuuaccuccccacagucaacuacgcgaggcagaggcucggaaccgggaccuagaggcacacguccggcaguugcaggagcggauggaguugcugcaggcagagggagccacaggugagucccucauguguccccuuccccggaggaccgggaggaggugggccgucugcuccgcggggcguguauagacaccuggaggagggaagggacccacgcuggggcacgccgcgccaccgcccuccuucgccccuccacgcgcccuaugccucuuucuucuccuuccagcugucacggggguccccaguccccgggccacggauccaccuucccauguaagaccccucucuuuccccugccucagaccugcugcccauucugcagauccccucccuggcuccuggucuccccguccagauauagggcucacccuacgucuuugcgacuuuagagggcagaagcccuuuauucagccccagaucucccuccguucaggccucaccagauucccuccgggaucucccuagauaaccuccccaaccucgauuccccucgcugucucucgccccaccgcugagggcugggcugggcuccgaucgggucaccugucccuucucucuccagcuagauggccccccggccguggcugugggccagugcccgcugguggggccaggccccaugcaccgccgccaccugcugcucccugccaggguacguccggcugcccacgccccccuccgccgucgcgccccgcgcuccacccgccccuugccacccgcuuagcugcgcauuugcggggcugggcccacggcaggagggcggaucuucgggcagccaaucaacacaggccgcuaggaagcagccaaugacgaguucggacgggauucgaggcgugcgaguggacuaacaacagcuguaggcuguuggggcgggggcggggcgcagggaagagugcgggcccaccuaugggcguaggcggggcgagucccaggagccaaucagaggcccaugccggguguugaccucgcccucuccccgcaggucccuaggccuggccuaucggaggcgcuuucccugcuccuguucgccguuguucugucucgugccgccgcccugggcugcauuggguugguggcccacgccggccaacucaccgcagucuggcgccgcccaggagccgcccgcgcucccugaacccuagaacugucuucgacuccggggccccguuggaagacugagugcccggggcacggcacagaagccgcgcccaccgccugccaguucacaaccgcuccgagcgugggucuccgcccagcuccaguccugugauccgggcccgcccccuagcggccggggagggaggggccggguccgcggccggcgaacggggcucgaaggguccuuguagccgggaaugcugcugcugcugcugcugcugcugcugcugcugcugcugcugcugcugcugcugcugcuggggggaucacagaccauuucuuucuuucggccaggcugaggcccugacguggaugggcaaacugcaggccugggaaggcagcaagccgggccguccguguuccauccuccacgcacccccaccuaucguugguucgcaaagugcaaagcuuucuugugcaugacgcccugcucuggggagcgucuggcgcgaucucugccugcuuacucgggaaauuugcuuuugccaaacccgcuuuuucggggaucccgcgccccccuccucacuugcgcugcucucggagccccagccggcuccgcccgcuucggcgguuuggauauuuauugaccucguccuccgacucgcugacaggcuacaggacccccaacaaccccaauccacguuuuggaugcacugagaccccgacauuccucgguauuuauugucuguccccaccuaggacccccacccccgacccucgcgaauaaaaggcccuccaucugcccaaagcucuggacuccacaguguccgcgguuugcguugugggccggaggcuccgcagcgggccaauccggaggcguguggaggcggccgaaggucugggaggagcuagcgggaugcgaagcggccgaaucaggguugggggaggaaaagccacggggcggggcuuuggcguccggccaauaggagggcgagcgggccacccggaggcaccgcccccgcccagcuguggcccagcugugccaccgagcgucgagaagagggggcugggcuggcagcgcgcgcggccauccuccuuccacugcgccugcgcacgccacgcgcauccgcuccugggacgcaagcucgagaaaaguugcugcaaacuuucuagcccguuccccgccccuccucccggccagacccgcccccccugcggagccgggaauuccgaggggcggagcgcaggccgagauggggaaugugggggccugcagaggacccuggagacggaggcgugcagaagcucagucucggggcggaggcuucgcgcccuuaguccuccuggacggcccguuaccuucugcguugucccgauggggaaacugaggcccugagccagaagcacacgcuggggggaggcagaaagcgcggccagaggcggagggaaaacaaagggagaaucacagacagacgggagggggacggacacacacaaggggacagagacccgaguggagagcuggaucucgccuucccggcguggggcgcagggucggccagaaagaagaucgagaagagcggggagugggggcgaaaaggggggacaggugggggaggaggcuggggaaagcccgagggaggaagagagggagggaggaacuucccaaaguugcaaaacauggcuaccuugccugcggagccgagcgcggggccggcggcugggggggaggcgguggcggcggcggcggcgaccgaagaggaggaggaggaagcgcgccagcucuugcagacuuugcaggcggccgagggugaggcggcggcggcggccggggccggggcgggcgcagcggcugcgggagcugagggcccgggauccccgggcguccccgggucgccccccgaggccgcuuccgaaccgcccacgggccuccgcuucucgcccgagcagguggcgugcgucugcgaggcgcugcuccaggcgggccacgccggccgcuugagccgcuuccugggcgcacugcccccggccgagcgccuacguggcagcgacccgguguugcgcgcgcgggcccugguggccuuccagcggggcgaguacgccgagcucuaccggcuacucgagagccgccccuuccccgccgcccaccacgccuuccugcaggaccucuaccugcgcgcgcgcuaccaugaggccgagcgggcccgcggccgcgcgcuuggcgcaguggacaaguaucgacugcgcaagaaguucccgcugcccaagaccaucugggacggcgaggagacagucuacugcuucaaggagcgcucccgcgcagcgcucaaggccugcuaccgcggcaaccgcuaccccacgccggacgagaagcgccgccuggccacacucaccggccugucgcucacgcaggucagcaacugguucaagaaccggcgacagcgcgaccggaccggggccggaggcggcgcgcccugcaagaggugaggggccucgggcggcgcaaguccagcucucccggggacaucccguccaccagcccucuucccccgugcccacugcuggggccggcgcgccgagguccucg

SEQ ID NO: 15043 - RNA, 11423 nt, Homo sapiens
cgaggaccucggcgcgccggccccagcagugggcacgggggaagagggcugguggacgggauguccccgggagagcuggacuugcgccgcccgaggccccucaccucuugcagggcgcgccgccuccggccccgguccggucgcgcugucgccgguucuugaaccaguugcugaccugcgugagcgacaggccggugaguguggccaggcggcgcuucucguccggcgugggguagcgguugccgcgguagcaggccuugagcgcugcgcgggagcgcuccuugaagcaguagacugucuccucgccgucccagauggucuugggcagcgggaacuucuugcgcagucgauacuuguccacugcgccaagcgcgcggccgcgggcccgcucggccucaugguagcgcgcgcgcagguagagguccugcaggaaggcguggugggcggcggggaaggggcggcucucgaguagccgguagagcucggcguacucgccccgcuggaaggccaccagggcccgcgcgcgcaacaccgggucgcugccacguaggcgcucggccgggggcagugcgcccaggaagcggcucaagcggccggcguggcccgccuggagcagcgccucgcagacgcacgccaccugcucgggcgagaagcggaggcccgugggcgguucggaagcggccucggggggcgacccggggacgcccggggaucccgggcccucagcucccgcagccgcugcgcccgccccggccccggccgccgccgccgccucacccucggccgccugcaaagucugcaagagcuggcgcgcuuccuccuccuccucuucggucgccgccgccgccgccaccgccucccccccagccgccggccccgcgcucggcuccgcaggcaagguagccauguuuugcaacuuugggaaguuccucccucccucucuuccucccucgggcuuuccccagccuccucccccaccuguccccccuuuucgcccccacuccccgcucuucucgaucuucuuucuggccgacccugcgccccacgccgggaaggcgagauccagcucuccacucgggucucuguccccuuguguguguccgucccccucccgucugucugugauucucccuuuguuuucccuccgccucuggccgcgcuuucugccuccccccagcgugugcuucuggcucagggccucaguuuccccaucgggacaacgcagaagguaacgggccguccaggaggacuaagggcgcgaagccuccgccccgagacugagcuucugcacgccuccgucuccaggguccucugcaggcccccacauuccccaucucggccugcgcuccgccccucggaauucccggcuccgcagggggggcgggucuggccgggaggaggggcggggaacgggcuagaaaguuugcagcaacuuuucucgagcuugcgucccaggagcggaugcgcguggcgugcgcaggcgcaguggaaggaggauggccgcgcgcgcugccagcccagcccccucuucucgacgcucgguggcacagcugggccacagcugggcgggggcggugccuccggguggcccgcucgcccuccuauuggccggacgccaaagccccgccccguggcuuuuccucccccaacccugauucggccgcuucgcaucccgcuagcuccucccagaccuucggccgccuccacacgccuccggauuggcccgcugcggagccuccggcccacaacgcaaaccgcggacacuguggaguccagagcuuugggcagauggagggccuuuuauucgcgagggucggggguggggguccuagguggggacagacaauaaauaccgaggaaugucggggucucagugcauccaaaacguggauugggguuguuggggguccuguagccugucagcgagucggaggacgaggucaauaaauauccaaaccgccgaagcgggcggagccggcuggggcuccgagagcagcgcaagugaggaggggggcgcgggauccccgaaaaagcggguuuggcaaaagcaaauuucccgaguaagcaggcagagaucgcgccagacgcuccccagagcagggcgucaugcacaagaaagcuuugcacuuugcgaaccaacgauaggugggggugcguggaggauggaacacggacggcccggcuugcugccuucccaggccugcaguuugcccauccacgucagggccucagccuggccgaaagaaagaaauggucugugauccccccagcagcagcagcagcagcagcagcagcagcagcagcagcagcagcagcagcagcagcagcauucccggcuacaaggacccuucgagccccguucgccggccgcggacccggccccucccuccccggccgcuagggggcgggcccggaucacaggacuggagcugggcggagacccacgcucggagcgguugugaacuggcaggcggugggcgcggcuucugugccgugccccgggcacucagucuuccaacggggccccggagucgaagacaguucuaggguucagggagcgcgggcggcuccugggcggcgccagacugcggugaguuggccggcgugggccaccaacccaaugcagcccagggcggcggcacgagacagaacaacggcgaacaggagcagggaaagcgccuccgauaggccaggccuagggaccugcggggagagggcgaggucaacacccggcaugggccucugauuggcuccugggacucgccccgccuacgcccauaggugggcccgcacucuucccugcgccccgcccccgccccaacagccuacagcuguuguuaguccacucgcacgccucgaaucccguccgaacucgucauuggcugcuuccuagcggccuguguugauuggcugcccgaagauccgcccuccugccgugggcccagccccgcaaaugcgcagcuaagcggguggcaaggggcggguggagcgcggggcgcgacggcggaggggggcgugggcagccggacguacccuggcagggagcagcagguggcggcggugcauggggccuggccccaccagcgggcacuggcccacagccacggccggggggccaucuagcuggagagagaagggacaggugacccgaucggagcccagcccagcccucagcgguggggcgagagacagcgaggggaaucgagguuggggagguuaucuagggagaucccggagggaaucuggugaggccugaacggagggagaucuggggcugaauaaagggcuucugcccucuaaagucgcaaagacguagggugagcccuauaucuggacggggagaccaggagccagggaggggaucugcagaaugggcagcaggucugaggcaggggaaagagaggggucuuacaugggaagguggauccguggcccggggacuggggacccccgugacagcuggaaggagaagaaagaggcauagggcgcguggaggggcgaaggagggcgguggcgcggcgugccccagcgugggucccuucccuccuccaggugucuauacacgccccgcggagcagacggcccaccuccucccgguccuccggggaaggggacacaugagggacucaccuguggcucccucugccugcagcaacuccauccgcuccugcaacugccggacgugugccucuaggucccgguuccgagccucugccucgcguaguugacuguggggagguaaggacggugaguccguccgggccggacgagaggggaugccaaggguugccaccggcccgcaucccggccccggccccggccccgaucccgaccuggcgaaguucugguuguccgugcggauggccuccaucucccggcucaggcucugccgggugagcaccuccuccuccagggcuuccuggagcucccgcagcgucaccucggccucagccucugccgcagggacagccgcuggaacugccacuucagccuguguauggggaccaggcuuaaggcugccuguggcuccuggaagacucaggacuugggcacugguuccaggcuaggaauccuuguuuauccccuacuccuccguccccucaacauuucuggaauccccauagcuccugcaaugauccaagcccccucccuucccuaccucccucagccccaucccugagucugguccucuaaaucuacacagggaccagagggcuggugcucaaacacuaacacaaccuaugucccucugcugcucaaaaucccuccagcucccuaaugcccucacgacaaaaggccuugcuggguuuuguuuccugcuggccucuccagccuucucaggaaugauucagccaaacuaccuuucaggaacaaaucaggauucccaccugcccaaggccuuugcccuggaggcucucgccugaccacuuggcaccuuuccuuccauggcuuguuucuccuucaccagcgcucagcucaaagaucgacuucucagauccccagcaacacacacacccuuacuuaaugccccacuguaacuacagagaccgucccaugucugaaguaaccucgucucuccgugguuucugucugcuucuguucaggaagucccuagagggcucuacagugcacgccacccgggaagcccucaccuuuucucucccaauugucccugacggacccccuccccuccaccaacuuacuguuucauccuguggggacaccgagggcuccaggcugggcgcuugcacguguggcucaagcagcugcucggccuccaguuccauggguguggggccugggaccucacugucccuggggagaggaggagggaguggggagggagacagaaugcugauucucugguggagaaccagaacuucuggccuguggguaggggcagcugcuuccaagaccuccugauuugaggaaggggagcagcagagcgaagagaacagagucccagguaggccaauagccccuccucugcuuaggaaaagcccugccccucuccuggccuugggccccugggagcugcucuuucuaaaccuucugcagggacuugggguccagacccccauguucuagggucagcucaucuccucccuugacaugugaccgcugcagaccccucuucucagggccucaggacagggaggccgaccugauggggagacugcuuggcucuggccaccuccacagaugugguccuaagacugggcaugggaccccaagauggcaacuugaggucagcacaccccacucagcugugggaaggggacagcuccucccugggguaugaaguggcuguccccuccaacccagcagucccuccugugggaacacggcucaggaccuagcuauccuggacaugcgccuggguucuaauagaggauggguucaauccugacccaccguucaggccccgcagcgguucagaaucaagcuggaguucauuaaugauaagguauaguauguguaauguuguccaguaauaaaagcugacuagaaaaccaacuguucucuuagacaaaguagcaugaggaaggggaaaaaaacaaaccaaaaaaacaccuguucuccacuauuuaaacaugugucaguacacgugugagccagggaccacugccaucuggugagcucacgagauaucaacuuccuuuuccuuaucuguauuuucuaauuuacuugugauaagcaaugcauuauuuguguaauuaauacuuuuguugagaccaggucucacuuuguugccuaggcuggaaucuaucauggcucacugaagccucaaacuccaggcucaagugauucuccuacuucagacuccugaguagcuaggacugcaggcacagaccaccaugccuggcacgauuuuuucaauuuuuuguagagacagggucucauuauguugcucaggcuggucuugaacuccugggcugaagcaauccguccacuucagccucccaaagugcugggauuccaagcgugagccaccaugcccagccuguaaauuaguacuuuuuuuuuuuuuuuuuugagaugaaguuucacucuuguugcccaggcuggaaugcaauggcacgaucucagcucaccacaaccucccccuccuggguucugauucuccugccucagccuccugaguagcugggauuacagguauaugccaccacgccuggcuaauuuuguuuuuuaguagagaugagguuucuccacguuggucaggcuggucucgaacuccugaccucaggugauccacccaccucauccucccaaagcacuggaauuacaggcgugagccaccacacccggccuaaauaaauacuuuuuuuuuuuuuuuuuugagacggagucuugcucugucgcccaggcuggagugcaguggcaugaucucggcucacugcaagcuccgccucccggguucaugccauucuccugccucgccucccaaguagcugggaccgcaagcgcccgccaccaugcccggcuaauuuuuuuguauuuuuaguagagacgggguuucaccguguuagccaggauggucucgaucuccugaccucaugauccaccugccuuggccucccaaagugcuaggauuacaggcgugagccaccgcggcccgccuaaauuaauacuuuuaaauggccuuauuguuauauggcugauucaaagaauuugcauucuuuuacaacugauuguaaaagucuaaacuucauauuuuccaaguucugaaguccuguggcucuguguacuacagacguaaaaguuaaugguuacaagauucugggaagcccagucugugacucugagguuuuaaaauucaaucuaacauuuugaaguacauagaucugaaaauuuaagguccuccaacucuggccucuuaggagucuuugggcccaaaacaguaagguuccaagacugauccugcaacuccauuggcugccaaggagcaggacccaggaagcucaagcagccucguggccccuggaggccguccagggcagugcuuaccugagggccaugcaggaguaggaguagcccacaaaaggcagguggaccccuagcggcgcaccuucccgaauguccgacagugucuccugcgcaagacacacagaugugagcagcagucgucagggcgggccccucacugcuuuuugaucuuggcuuacauguuccccccaaaccagccccaacucagggcuuaucuaaaguggccccuccagcauuuuuucuuuuuucuuuuucuuugauacggagucucgcucuguuacccaggcuggagugcaguggugcaaucucagcucacugcaaccuccgccucccagguucaggcgauucuccugccucagcguccugaguagcugagauuacaggcgcccucuaccacgccuggcuaauuuuuuauauuuuugguagagacgggguuucgccacgcuggccaggcuggucuccaucuucugaccucaagugauccgccuaccucagcuguuguagucccaaacucugggcucaagcaguccuccaaccucagccucccaaagugcugggauuacaaauauaagccacugugcccagcccaguucuguuuuuuuuuuuuagauggagucuugcugucucccagccuagagugcaguggcacaaccccagcccacugcaaacucugccucccagguucaaucaagcgauucuccugccucagccuccugaguagcuggcauuacaggcauacgccaccaagccuggcuaaauuuuguauuuuuaguagacacaggguuucaccauguuggccaggcuggucuugaacuccugacuuccagugaucugccugccucagccucccaaaguucugggauuacaggcgugaaccaccuugcccaacccuuuuuuuuuuuuuuuuuuuugagacagagucucacucugucacccagacuggaguguaguggcaugaucuuggcucacugcaaacucugccucccagguucaagcaauucuccugccucagcuuccccaguaacuggaauuacaggcacccgagaccacacccagcuaauuuucuuguauuuuuaguagagacgggguuucaccguguuggccagccuagucucaaaacuccugaucucaugacccaccggccuuggacucccaaagugcugggauuacaggcaugagccacagcgcccggccgcgguccagccuauuuuuuuuuuuuuuuuuuuuuuuuucugagacagagucucgcucugucgcccaggcuggagugcaguggcacgaucucggcucacugcaaacucugccucccggguucacgccauucuccugccucagccuccugaguagcugggacuacaggcgcccgccaccacgccuggcuaauuuuuuguauuuuuaggagagaugggguuucaccguguuagccaagauggucucgaucuccugaccucgugauccacccgccucggccucccaaagugcugagauuacaggcgugagccaccacgcccggccagcccagccuauuuuuuaauuucaguuuaucuuauuuuugagacagagucucucuccguugcccaggcuggagugcaguggcacaaucacagcucacugcagccuugaccuccugggcucaagcccacgucggccacccuaguagcugaguauacaggcaugcgccaccacgcccaaccaauuuuuaaaacauuuuuguagagacgggggucucaccacauugcccaggcuggucucgaacuccugggcucaagcaauccacccacuucggccugccaaauugcugggguuacaggcgugagccaccgugccuggccccaucauuuuuucuuguauccuguugcuucccuucagggcaccugccacacucuccauaauucucuaauucucuagacugcaacuggaugagggcagggaccagagcucaucugguccgugcuggauccccaguauuguucagcaaaagggcacccagagccgagcaagcaugccaugacagcuuguuacacggugaagagagacggccuaagggaggaggaguccucuccugcuucucaucccuccaagucucagcucagauagcuccccacuccagaaagcccuccaggaccuuccuugcugagucaggagucccccacccccugcacuccauugucucagcccugaucacucuggggccuuacugucugaagacugcucuguguucccccacuggacuguaagucuaggucacugcuggguccucaguaguagaugggcacagagcaggugcucuggggaaugagugauucaggaccccagaagguaggcacuguccuuacuccaacuuuauggagggagcauggggagguucccgcagccgagcaggggccacagguaccuaccccgcccccgcucaccauggcagugagcccguccuccaccaagucgaaguugcaugugucgguggcaccuucgaaauccgguguaaaggggggcacgcugucccggagaccaucccagucgaggccaaagaagaagggauguguccggaagucgccugcuccaccccggcccagccgugucuccgggggacacagcaaccgcugaaugaagucucgagccuccucagggaccccuucguccaccagcggcagagagaggugcuccugcucagagggagaggaggcgauagccugggagcgccuaccgggagaggccaggucucccugcggccgugcucaccuuguaguggacgaucuugccauaggucuccgccguggaauccgcguagaagggcgucugcccauagaacauuucauaggcgaauacacccagcgcccaccagucacacucgggcccguagcugccugucccaggcccaccgcccacagccugcaggaucucgggggacagguagucuggggugcccacagccaccagcgaccgcaccuggaccaaaaggagcagagcgaggcuugggcccaccccucugggcccaccagcucugggcccuccuuccaaccacuccccaaaugcuuagccccucccucugccuggucuaauacuccgccacacagaugcacacuuaagccugggucacaccaccucuuuuccccuccaaauccagucccgcucccacacucugugccuuccaucccucaucagcagccccaguugcucuguggccagggcacuggcucaccguuccaucugcccgcagcuugaggcaagagccgaagucggccaggcggauguggccacagcgguccagcaggauguugucggguuugaugucccugcacggaggaaaagagaagggugggauaaaugaaccucccuucuguggucccaccaggcuccgccccuccgggcagugccaccugggaccccacuuccucggguuccgccccuguagggcuucuacaguucugaccccuacucccaggcaccccccggugggccccaaccaagaaggucccucuccaggcccuggccucucugggcucugaccuuccaagaacccggccagggaacaagcuugcuauccccucggccaugcugcacccaccugugcacguagccaagccggugcaccgagucuauggccaugacaaucuccgccagguagaagcgcgccaucucggccggaauccgcuccccaaacuugcucagcagugucagcagguccccgcccacguaauacuccaugaccagguacugagaagggguucgucaugggugguugguaguccccugaggcccugauccaucacggauggcugggacaaccccucccagagacaccccauccuugggcagagaccugcagccccagcccagagauaaccauagagaucugccgggccaaaucagagaccaccugcggcccccgcccccgccccucaaaaaaaaacacaaacaaaaaaacuuuccugggaugucacugggcagauucacucccccugagauguucugggaaagagaacccagaggccacccaacacccagagaauaggucccagacacuccuucccuaggcaguggccccguuagaauuccugaagaccuaucccauuccagguaagagaccccccgcaacagagacaucuuuauaagagucccccagaucaccccagaaacgggcagugaaggacaccauccccgucucagauagggaaggccccucauccaccugacacacccucuuaccgcacacagacuuucccacagacguuuccgggcagcacccccaauccuagagcuuccucuccccaccuccucguccagugacagcacgggcucuugucccucuuccuagucaccccggcccggagcucaccagguaguucucauccuggaaggcgaagugcagcugcgugauccaccgccgguccccauucaccaacacgucccucuccucacggaagcacgacacc

SEQ ID NO: 15044 - RNA, 4236 nt, Homo sapiens
gagugggggcgaaaaggggggacaggugggggaggaggcuggggaaagcccgagggaggaagagagggagggaggaacuucccaaaguugcaaaacauggcuaccuugccugcggagccgagcgcggggccggcggcugggggggaggcgguggcggcggcggcggcgaccgaagaggaggaggaggaagcgcgccagcucuugcagacuuugcaggcggccgagggugaggcggcggcggcggccggggccggggcgggcgcagcggcugcgggagcugagggcccgggauccccgggcguccccgggucgccccccgaggccgcuuccgaaccgcccacgggccuccgcuucucgcccgagcagguggcgugcgucugcgaggcgcugcuccaggcgggccacgccggccgcuugagccgcuuccugggcgcacugcccccggccgagcgccuacguggcagcgacccgguguugcgcgcgcgggcccugguggccuuccagcggggcgaguacgccgagcucuaccggcuacucgagagccgccccuuccccgccgcccaccacgccuuccugcaggaccucuaccugcgcgcgcgcuaccaugaggccgagcgggcccgcggccgcgcgcuuggcgcaguggacaaguaucgacugcgcaagaaguucccgcugcccaagaccaucugggacggcgaggagacagucuacugcuucaaggagcgcucccgcgcagcgcucaaggccugcuaccgcggcaaccgcuaccccacgccggacgagaagcgccgccuggccacacucaccggccugucgcucacgcaggucagcaacugguucaagaaccggcgacagcgcgaccggaccggggccggaggcggcgcgcccugcaagaggugaggggccucgggcggcgcaaguccagcucucccggggacaucccguccaccagcccucuucccccgugcccacugcuggggccggcgcgccgagguccucggacaucucccgggaccagcucacaaucucaggcgcccgcggggcgcggggacuaaguguggacgggacaggcacccgcccgggcccucuccccgcacgcgucuccucuuccagcggcuccauuccgagcuccuucccaaaucccaucgguguuggggaaucacacugcggggggcacuagagggacugaggaaaaaggacagggccuguggccacuccacuccgcguaggggcugccucccagcccccuuucuucacugaccguuacucuuacccacccgcccccacacucccuccgggcccggacggcgugguccgucuucugccuuuguugugaaacgugaaccuuucccagcuccgguuucccuguaacccaaacccuucuccucccacccugagcgccggccucucccuucucugacgccccgcggggagggcaccgggaacugggcuggcggcugcugcucccucucuccaggccacucgcccgcuuuccgcccaaccaaggaacuuuuagggcaaccugggagcucagccucuggggacccgaggccgaggugggggagagcaagggccucuucccuccccagcgcuucucugcagugguguccacgcagggcuugcaaaaggcccuggaguuuggaguggucucagagaggcgucauaaccccuggaaugauccaccgaaacuugggccagggaaaggugggggagcagcuggcuggcuaugcgggaggccccacaggcuaagggaccccagcugacagccauuucuccggccagcgagucugaugggaaucccacgacugaggacgaguccagccgaaguccugaggaccuggagagaggggcggccccaguguccgccgaggccgcugcccagggcuccauauuccuggcagggaccggcccucccgcgccuugcccggcuuccuccuccauccuggugaacgggagcuuccuggcagccagcggcuccccagcagugcuccucaacgggggccccgucaucaucaacggccuggcccugggcgaggccuccagccugggcccgcugcugcucacugggggcgggggugccccuccaccgcagcccagcccucagggggccagcgagaccaagaccucucugguccuggacccucagacaggggaggugcggcuggaggaggcucagucggaggccccugagaccaaaggggcccagguggcugcuccgggaccagcccuuggagaggagguccuggggccccuggcccaaguggugccuggccccccgacggcugccaccuuuccucugcccccggggccagugccugcuguggcugccccacaagugguaccgcucuccccacccccgggguaucccacgggccugagccccaccuccccacuauugaaccugccccagguaguacccaccucacagguggugacccugccccaggcuguggggccccugcagcuguuggcagccgggccaggcagcccugugaagguggcagcugcagcaggcccugccaaugugcaccucaucaacuccggggugggcgugacugcccugcagcugccuucggccacugccccagguacccccaucucccucccucaggccuaggugagagccggggaggggugcagucaucucggagagggaggggcugucccugggcuccuggagggcaucucaucccuggcaagucccagugccccaaggcccaccacaaggcucccuccgcccgcccuccagcugcacagucuccacuucucucuggcuuggccugcucuccuggcucucaccugcgcucggucccucucuccccacaggaaacuuccuccuggccaacccugugucuggcagccccaucgugacggguguggcccugcagcagggcaagaucauccucaccgccaccuuccccaccagcaugcucgucucccagguccugccgccagcccccggccuggcccugccacugaagccagagacggccaucuccgugccugagggaggccucccgguggcccccagcccugcucucccagaggcucacgcccuaggcacccuuucugcacagcagccaccccccgccgcugccaccaccuccagcaccagccugcccuucuccccugacuccccuggccuccugcccaacuucccggcgcccccaccagaggggcugauguugucacccgcggccgugccugucuggucagcagggcuggaacuaagcgcaggaacagaggggcugcuggaagcggaaaaggggcuggggacacaggccccccacaccgugcugaggcugccagaccccgacccugaggggcugcuccugggggccaccgcagggggugagguugacgagggguuggaagcugaggccaagguucugacccagcuccagucggugccuguggaggagcccuuggaacugugacccaguguggccccguggccucucccgacauuggugcugaagacgcagggacaggaaugggaggggggagccccagaaaugcgguugcugaagaccccagucaccacauccuucugccuggguggccucuccaagcccugguggugcuggggguuguauccccggccaccuccuguccaggucuccaucccccuuuggaugggaggccucucuguuacagcccuccccaugcugugcccugccauauacgugggggacucaggguccugacucaggggcccugcccccuccacuugguacuagcuguaagcggaacacccugccccagggccggacuuccagcccccagagcccucucccugucacucccugaaacacuauuaauagcucugccgauagcugguguugucacaacugccuggaauccgaagguggaggacaggcagccccgcgccccugagacuggagacccuccccaguguggcauuuccugccaggggcgggggguggggcagcuguggggagacgggggucuuccuucaccagcuccccucgacucaagcccuuguccucauuauccggcccagaccaaagauucccucaucccugggggcagcccugccgcugugucuccuuuguauccuaaaucuuuauuuuucuaggacauguuaugccuccauuuucaauuaaaauaaaguuaucggauuacaccaccaccaggggucuggggugccuuccagugucuguccaaagcagcgcugaacacagagcccaccucgagaccuggccuucccau

SEQ ID NO: 15045 - RNA, 4236 nt, Homo sapiens
augggaaggccaggucucgaggugggcucuguguucagcgcugcuuuggacagacacuggaaggcaccccagaccccugguggugguguaauccgauaacuuuauuuuaauugaaaauggaggcauaacauguccuagaaaaauaaagauuuaggauacaaaggagacacagcggcagggcugcccccagggaugagggaaucuuuggucugggccggauaaugaggacaagggcuugagucgaggggagcuggugaaggaagacccccgucuccccacagcugccccaccccccgccccuggcaggaaaugccacacuggggagggucuccagucucaggggcgcggggcugccuguccuccaccuucggauuccaggcaguugugacaacaccagcuaucggcagagcuauuaauaguguuucagggagugacagggagagggcucugggggcuggaaguccggcccuggggcaggguguuccgcuuacagcuaguaccaaguggagggggcagggccccugagucaggacccugagucccccacguauauggcagggcacagcauggggagggcuguaacagagaggccucccauccaaagggggauggagaccuggacaggagguggccggggauacaacccccagcaccaccagggcuuggagaggccacccaggcagaaggauguggugacuggggucuucagcaaccgcauuucuggggcuccccccucccauuccugucccugcgucuucagcaccaaugucgggagaggccacggggccacacugggucacaguuccaagggcuccuccacaggcaccgacuggagcugggucagaaccuuggccucagcuuccaaccccucgucaaccucacccccugcgguggcccccaggagcagccccucagggucggggucuggcagccucagcacgguguggggggccuguguccccagccccuuuuccgcuuccagcagccccucuguuccugcgcuuaguuccagcccugcugaccagacaggcacggccgcgggugacaacaucagccccucuggugggggcgccgggaaguugggcaggaggccaggggagucaggggagaagggcaggcuggugcuggaggugguggcagcggcgggggguggcugcugugcagaaagggugccuagggcgugagccucugggagagcagggcugggggccaccgggaggccucccucaggcacggagauggccgucucuggcuucaguggcagggccaggccgggggcuggcggcaggaccugggagacgagcaugcugguggggaagguggcggugaggaugaucuugcccugcugcagggccacacccgucacgauggggcugccagacacaggguuggccaggaggaaguuuccuguggggagagagggaccgagcgcaggugagagccaggagagcaggccaagccagagagaaguggagacugugcagcuggagggcgggcggagggagccuuguggugggccuuggggcacugggacuugccagggaugagaugcccuccaggagcccagggacagccccucccucuccgagaugacugcaccccuccccggcucucaccuaggccugagggagggagauggggguaccuggggcaguggccgaaggcagcugcagggcagucacgcccaccccggaguugaugaggugcacauuggcagggccugcugcagcugccaccuucacagggcugccuggcccggcugccaacagcugcaggggccccacagccuggggcagggucaccaccugugagguggguacuaccuggggcagguucaauaguggggagguggggcucaggcccgugggauaccccggggguggggagagcgguaccacuuguggggcagccacagcaggcacuggccccgggggcagaggaaagguggcagccgucggggggccaggcaccacuugggccaggggccccaggaccuccucuccaagggcuggucccggagcagccaccugggccccuuuggucucaggggccuccgacugagccuccuccagccgcaccuccccugucugaggguccaggaccagagaggucuuggucucgcuggcccccugagggcugggcugcgguggaggggcacccccgcccccagugagcagcagcgggcccaggcuggaggccucgcccagggccaggccguugaugaugacggggcccccguugaggagcacugcuggggagccgcuggcugccaggaagcucccguucaccaggauggaggaggaagccgggcaaggcgcgggagggccggucccugccaggaauauggagcccugggcagcggccucggcggacacuggggccgccccucucuccagguccucaggacuucggcuggacucguccucagucgugggauucccaucagacucgcuggccggagaaauggcugucagcuggggucccuuagccuguggggccucccgcauagccagccagcugcucccccaccuuucccuggcccaaguuucgguggaucauuccagggguuaugacgccucucugagaccacuccaaacuccagggccuuuugcaagcccugcguggacaccacugcagagaagcgcuggggagggaagaggcccuugcucucccccaccucggccucggguccccagaggcugagcucccagguugcccuaaaaguuccuugguugggcggaaagcgggcgaguggccuggagagagggagcagcagccgccagcccaguucccggugcccuccccgcggggcgucagagaagggagaggccggcgcucagggugggaggagaaggguuuggguuacagggaaaccggagcugggaaagguucacguuucacaacaaaggcagaagacggaccacgccguccgggcccggagggagugugggggcggguggguaagaguaacggucagugaagaaagggggcugggaggcagccccuacgcggaguggaguggccacaggcccuguccuuuuuccucagucccucuagugccccccgcagugugauuccccaacaccgaugggauuugggaaggagcucggaauggagccgcuggaagaggagacgcgugcggggagagggcccgggcgggugccugucccguccacacuuaguccccgcgccccgcgggcgccugagauugugagcuggucccgggagauguccgaggaccucggcgcgccggccccagcagugggcacgggggaagagggcugguggacgggauguccccgggagagcuggacuugcgccgcccgaggccccucaccucuugcagggcgcgccgccuccggccccgguccggucgcgcugucgccgguucuugaaccaguugcugaccugcgugagcgacaggccggugaguguggccaggcggcgcuucucguccggcgugggguagcgguugccgcgguagcaggccuugagcgcugcgcgggagcgcuccuugaagcaguagacugucuccucgccgucccagauggucuugggcagcgggaacuucuugcgcagucgauacuuguccacugcgccaagcgcgcggccgcgggcccgcucggccucaugguagcgcgcgcgcagguagagguccugcaggaaggcguggugggcggcggggaaggggcggcucucgaguagccgguagagcucggcguacucgccccgcuggaaggccaccagggcccgcgcgcgcaacaccgggucgcugccacguaggcgcucggccgggggcagugcgcccaggaagcggcucaagcggccggcguggcccgccuggagcagcgccucgcagacgcacgccaccugcucgggcgagaagcggaggcccgugggcgguucggaagcggccucggggggcgacccggggacgcccggggaucccgggcccucagcucccgcagccgcugcgcccgccccggccccggccgccgccgccgccucacccucggccgccugcaaagucugcaagagcuggcgcgcuuccuccuccuccucuucggucgccgccgccgccgccaccgccucccccccagccgccggccccgcgcucggcuccgcaggcaagguagccauguuuugcaacuuugggaaguuccucccucccucucuuccucccucgggcuuuccccagccuccucccccaccuguccccccuuuucgcccccacuc

SEQ ID NO: 15046 - RNA, 1438 nt, Homo sapiens
uuucuagaacuccccucagaaggggauggguugggugacggaagcacguguuuuugcuuuucucuccugcagaaggaaagccacgcaaguuggggagaaaacccccaaggaugaaucugccaauguaagucagggacucuucuugcccuacaucucuuaggccguaccaugaggguagggauagugggaugugugggguuugaaccugaaagaggaaaugggcagagguguggcaggggcuggcucauggcaguuuuauuuccuaccagcaggaggagccagaggccagagucccggcccagaguggugaguagagugcccaguccagccacaggaacuacaaaucccagaauacucuguucucacauguuaagcacccuuauaggagagucagggcgaauggugcuggggauuguagucuccugagauggggcuuugaucaggggcugaugagguugggggaguaagauugauuggggggcagucuuuugucccugaucuuucugauuucuugccuauccccagaaucugugcggagacccugggagaagaacagcacaaccuugccaagguaggccaucgguccuggggcccuuggggagguaaaggcgggcagaucgcuugagcccaggaggucaagaccagccugggcaacauggcgacaccccaucucuacaaaaauuagccaggcgugguagcacuuaccuguggucccagcuacucaggaggcugaggugggaggauuacuugagcccaggaaguugaggccucagcgagccaucaucaugccugcacuccagccugagaaauagaaugugacugucucaaaacaaaacacaacaaaccaaaaccaaaaaaaaaaaaaacuggggccccaaaaauacuuggacuugcccaauuuauaaggcagagcucaaugugaccccuggaauaggaggcggggaagcagguccucucucuaaucucauugcugucccaaaccacaccaacucccccaggaugaagucgucuucuucggugaccacuuccgagacccaacccugcacgcccagcuccagugauuacucggaccuacagagggugaaacagguaacuugggggggaaguuggggaccacagcaagagagaucuaggucuggccccugccacuggcaugccguaugauccuagauaacaucucagaaaccucagguuuccaaucugacaaauggagaaacuggauugggucaaggaugaccgagacuccacacccccuuuucuggcaccugugacagacauuauuaaucuaucaccgcgcucauuccagaugagugccuugaauucuuuccgcacauugacccagcuguccaucaccaauuggaguuggcaggaggcuggaaugcgcuugccaaccuugguacuggauguucuccaguacuuuuccggcuccaaggaucca

SEQ ID NO: 15047 - RNA, 7195 nt, Homo sapiens
cuucauucauaagacucagagcuacggccacggcagggacacgcggaaccaagacuuggaaacuugauuguugugguucuucuuggggguuaugaaauuucauuaaucuuuuuuuuuccggggagaaaguuuuuggaaagauucuuccagauauuucuucauuuucuuuuggaggaccgacuuacuuuuuuuggucuucuuuauuacuccccuccccccgugggacccgccggacgcguggaggagaccguagcugaagcugauucuguacagcgggacagcgcuuucugccccugggggagcaaccccucccucgccccuggguccuacggagccugcacuuucaagagguacagcggcauccugugggggccugggcaccgcaggaagacugcacagaaacuuugccauuguuggaacgggacguugcuccuuccccgagcuuccccggacagcguacuuugaggacucgcucagcucaccggggacucccacggcucaccccggacuugcaccuuacuuccccaacccggccauagccuuggcuucccggcgaccucagcguggucacaggggccccccugugcccagggaaauguuucaggcuuuccccggagacuacgacuccggcucccggugcagcuccucacccucugccgagucucaauaucugucuucgguggacuccuucggcaguccacccaccgccgccgccucccagguaaguuuuugauaguaggggugcugcuuuguagguuuuauuuuuuaagucaagggugaaaagaauaaaccccaacccccacaaaaaggcgcaucagaacccuagaucugagauggaaaaggcucacagcgcacuuugcaaacugcaaagagucgggagauguuugcaauugguugcgugcguggagcgcaaggagggaacgcggcagggaggguaggcuuuggggcgaggugggggugggguggguaaugcgcugcucaaugcaacguguaugcgguagcggggcugagaacuuugagccggccccgggacugcccccugcucgggucccagaccugaagcuagcgcaguuaggcaggugggggaaaucccggggaagcuuccagcagucucuuuuccuuuccuccuccuucggagcgcccacuucggugccgggucgcccuccacccaucgggaagaggggccucgaacccucagccgcgcugccuccgccuccugcgcggagacguaacgggggacccgugcguaacggcugacgcgcuggaauccuccgucugacgcggggcacgcacggcgcgcggcgcccccuucguccgccccgccccugacgucccgggagcguucuauuuuggaacgccggggccacguugcuaagggagggggcagcccggcguuucgauuggccgccggggcgcacgccuuggccaaucagcuuucccuuccuauuuguagggugcauuuuccuuccccccucucuguccccggaacccgugguuccuuggcggcugggucucuuuucggcgccucuagaggcagagggaggggaucccugucgugacaagagcgccugucugcgacccaauggaucugcgaggcccuugcggggaucuagucccugggcucucaggagaagggggugucugcuugugugcuggcguuucuuggagagauacgguggcugucacccucuucuccaggcacacacagacacauucccacucccucugcuccucaugcccgguuccuccggugugucccaagacaggacuagaaccgcgaaccgaagggcaaccagccagguggucuccaggagcuccgcccccucuggguucccaggacucugauuggucggcgagccagcccuucccucaccacgccccccgagagaguaguuaagccuucagagcaguuccaggaguccauuuacgggaggggggagaugagcgcugcugaggcuugggggcucaggucccgcaccauucccccuccgcgacaaucugagagagcuccagugguuacuuuuaucuaccuguccguucacccuaaacugucacucgucagucucacucugagaagagacaguaacuugaaacguuguucuaaacuccuaggcccgucccccaaacacccuuuugacugggacccccgccccugcaugggaccucgcgcagagggggguguguaugugugugaguguagaggaaggcuuggccuaaggccucuccuucucccuccccuugccucuggggugggggugggguguuguggcuguguguguggcuguggcuccgucccggggguucugucacccggcuguguccagccuccucuccaccccccauaccuaagagucaccaacccggggugugauucaccacccgcuggaaccgugcaaccuuuccccgaggaagaaggaggagguagaagccaguugagcagaaauccucucauuaaccacugcgucacgguguaguggaaggguggguguuguggcuuuuucccugugacacacacauccacacucgcucacccugugcucacucacggggucgguguguguuauguguguugggugugugugugucggugucuuuguuugugugucuacgccuguguguguaugugucaccccguaggagugcgccggucucggggaaaugcccgguuccuucgugcccacggucaccgcgaucacaaccagccaggaccuccaguggcuugugcaacccacccucaucucuuccauggcccagucccaggggcagccacuggccucccagcccccggucgucgaccccuacgacaugccgggaaccagcuacuccacaccaggcaugaguggcuacagcaguggcggagcgaguggcaguggugggccuuccaccagcggaacuaccagugggccugggccugcccgcccagcccgagcccggccuaggagaccccgagaggagacggugaguaagggacaucagaacuuggccuggguagggggaagcaagagaggcaggaaguuucuuaugaauggaggggggcuccacuaaggccucaguguuacagaaaccccaagauccuugcuacacgagcgaggaccggaggcuuguuuuuuggcucuuggggguucugaaagaaguagagguucgggauggguggaggagugcuguauccccaaaucucauggccucuaucucccugacucagcucaccccagaggaagaggagaagcgaagggugcgccgggaacgaaauaaacuagcagcagcuaaaugcaggaaccggcggagggagcugaccgaccgacuccaggcggugaggacaggcccuggggugggagaggggauguugaggggagcucucuccccauucucugcccccucuccaccuguacccuuauccuggguugagaacuagacguuccacacauggaacuagguacugcuguggccagacuggguagcccagggcacaaacacagacccccauggacuuaagucaacuccuggucccccccccauuuccugaccccacggacuacucuccuagccuucauuucaucccaaggggccacauggggcccuugaggagaggggcgcccccaucauuucucccaucuggucuucagcaaguaacaacccauuuugccucaguuucuccaucucugcaaacccucaucaaaucucccgggcucuuucuacccuuaacacucuggaaagccugugaaaugaaauuauuccaccuccugcccuagccacccacagcucuccuggugcugguggcaucccccaaaacccacucccuuccuacguccucccuuggucugagaguucccugcuguaugccugcagggugagcuguuacuccuugagggaacaagggaauugucaacuuuccuucucuacuuuuucucuuccccgggagguagagagggagggguaauagaagggaacacauuaaaaacacauaacaguggcucaugccugugaucccagcacuuugagaggccaaggcaggaggauugcuugagcccaggaguuugagaccagccugggaaacauagggaggacuugucucuaccaagaaaaaaaaaaauuaguugggcaugguggugcacaccacuguggucccagcuacuauggaggcuuuagugggaggaucgcuugagccgaggagguccaggcugcagugagccaugauugcacuauugcacuccagccugggggacagagcgagacucuggcucaaaagcaaaacaaaaccaaccacauaacgauuguucauucauucaacaaaccuccugcacaccagaaacuuccccauaaaccuggccccuucuguaccauccuuuggacagaugggggaaacugagguuccuggaaggcaagacccuugccccaacucccauggccaccaggacuccaucucaggagguguuuuuucucagcccggggcugccuuccagcagcaaguccaagggagccaugacccgaguuucccggucacugacaugcuuuuuucuccuuccucucucucuucugugaccuggccucccuggccucaggagacagaucaguuggaggaagaaaaagcagagcuggagucggagaucgccgagcuccaaaaggagaaggaacgucuggaguuugugcugguggcccacaaaccgggcugcaagauccccuacgaagaggggcccgggccgggcccgcuggcggaggugagagauuugccgggcucagcaccggcuaaggaagauggcuucagcuggcugcugccgcccccgccaccaccgccccugcccuuccagaccagccaagacgcaccccccaaccugacggcuucucucuuuacacacagugaaguucaaguccucggcgaccccuuccccguuguuaacccuucguacacuucuucguuuguccucaccugcccggaggucuccgcguucgccggcgcccaacgcaccagcggcagugaccagccuuccgauccccugaacucgcccucccuccucgcucugugaacucuuuagacacacaaaacaaacaaacacaugggggagagagacuuggaagaggaggaggaggaggagaaggaggagagagaggggaagagacaaaguggguguguggccucccuggcuccuccgucugacccucugcggccacugcgccacugccaucggacaggaggauuccuuguguuuuguccugccucuuguuucugugccccggcgaggccggagagcuggugacuuuggggacagggggugggaaggggauggacacccccagcugacuguuggcucucugacgucaacccaagcucuggggauggguggggaggggggcgggugacgcccaccuucgggcaguccugugugaggauuaagggacgggggugggagguaggcuguggggugggcuggaguccucuccagagaggcucaacaaggaaaaaugccacucccuacccaaugucucccacacccacccuuuuuuuggggugccuagguugguuuccccugcacucccgaccuuagcuuauugaucccacauuuccauggugugagauccucuuuacucugggcagaagugagccccccccuuaaagggaauucgaugccccccuagaauaaucucauccccccacccgacuucuuuugaaaugugaacguccuuccuugacugucuagccacucccucccagaaaaacuggcucugauuggaauuucuggccuccuaaggcuccccaccccgaaaucagcccccagccuuguuucugaugacaguguuaucccaagacccugcccccugccagccgacccuccuggccuuccucguugggccgcucugauuucaggcagcaggggcugcugugaugccguccugcuggagugauuuauacugugaaaugaguuggccagauuguggggugcagcuggguggggcagcacaccucuggggggauaauguccccacucccgaaagccuuuccucggucucccuuccguccaucccccuucuuccuccccucaacagugaguuagacucaagggggugacagaaccgagaagggggugacaguccuccauccacguggccucucucucucuccucaggacccucagcccuggccuuuuucuuuaaggucccccgaccaauccccagccuaggacgccaacuucucccaccccuuggccccucacauccucuccaggaagggagugaggggcugugacauuuuuccggagaagauuucagagcugaggcuuugguacccccaaacccccaauauuuuuggacuggcagacucaaggggcuggaaucucaugauuccaugcccgaguccgcccaucccugaccaugguuuuggcucucccaccccgccguucccugcgcuucaucucaugaggauuucuuuaugaggcaaauuuauauuuuuuaauaucgggggguggaccacgccgcccuccauccgugcugcaugaaaaacauuccacgugccccuugucgcgcgucucccauccugaucccagacccauuccuuagcuauuuaucccuuuccugguuuccgaaaggcaauuauaucuauuauguauaaguaaauauauuauauauggaugugugugugugcgugcgcgugagugugugagcgcuucugcagccucggccuaggucacguuggcccucaaagcgagccguugaauuggaaacugcuucuagaaacucuggcucagccugucucgggcugacccuuuucugaucgucucggccccucugauuguucccgauggucucucucccucugucuuuucuccuccgccuguguccaucugaccguuuucacuugucuccuuucugacugucccugccaaugcuccagcugucgucugacucuggguucguuggggacaugagauuuuauuuuuugugagugagacugagggaucguagauuuuuacaaucuguaucuuugacaauucugggugcgagugugagagugugagcagggcuugcuccugccaaccacaauucaaugaauccccgaccccccuaccccaugcuguacuugugguucucuuuuuguauuuugcaucugaccccggggggcugggacagauuggcaaugggccguccccucuccccuugguucugcacuguugccaauaaaaagcucuuaaaaacgcauucgcca

SEQ ID NO: 15048 - RNA, 3209 nt, Homo sapiens
gggaaaauaaagaaccaaaaccccacucuagauuuacccaggaaacagcuccuuuaaugacugguuccucauuuuuuucucccucccauccaggcccggaggcuguuugauguccugcacgagcccuucuugaaaguacccugaugaccccagcugccaaggaaacccccaguguaauaauaaaucguccucccaggccaggcuccugcuggcugcgcuggugcagucucuggggagggauucugggggugucaccuucugguggcccaggugggcaccuucagcuuucuuuaguuccucaguuucccgggggcagacuacacaggcugcugcugcugcugcuuccgcuucuugucccggccugugggagccuccuccccagacucugaauucaguggcggcccuggcaucuccucuuggggcacugucucuggcauccggcuuuccugacucugcuucuuccucuucuugguggaucccggaguugcccuggcuucaggcugucccuccccuggcaguucaggcucuaguggcugaauuggcucagucacugugugaccucucucuuucuucuucuucuucuucuugguggaugugggagcugccugaggcucaaggucauccggcagcucaggccccaccaccucugucucuggcuccacuguggcaucuugcuguuuuucuuucuucgucuucuuuuugggagcugccagagcugccugggccugaggcuucgcuccuucuggcuguugaggcgccaugguccccccuggggacuccagaggcuucaucuccggcuccacuggcuccaucgccuccgucccuggcuccaucauugccaucugucccuuuucuuuuuuccucuucuucguagggggcagagggauggcuuccuccaguggcuccaccuucaccuguggcugagacucaacugucacccccuccucuggcuccaucccuuccguccccuuuugccucuuucucuuuuuggucggggacaggacugugucuucuagaggcucaguguuaaucuguuccugcuucacugucuugucuucuggcucgaagguuucuuucccuuugggcuucuuccucuucuuggugguggacgggaacagcacucccagaggcuccagugucuccacugugggcucuguccccacaggcccugcugccucugguucuuucagcugcugauuuuuuuucuucuucuucuuccgcacauccauuucuggcgaccccaaagccauguccaccuccagggccccgugcccauucacugccuccugagugacuggggccucugucaccugcaucuccuuuuucuucuucccugaggugagcagguugggggccaaggcugaccuaggcccugugacugguggguugcccccaaaggcacagaaccgaggccucaggccaggagggaucuguggugggggacuugcugggaugggcugcagagggcucccugacagggauugcuggggacccucaaggauccuuagggugcccuggggggcugaggcacaggugaguccaccuccugccuccguugagggggccagcagggucgcuucuccagcuuggggacagcugcugaggacucgauagcggugccgcuugccugccaauuugcccuugacgaucugggagccagagagaggcacaugccgcccauugaagcuacagagagaaacagggagggcagaggcuuaaguggaacaggagagggaagguuuuuugauuuuuuuuuuguuuuuuuuugagagagucuugcucuguugccuaggcuggagugcaguggcaugaucucggcucacugcaauguccaccuccuggguucaagcgauucuccugccucagccucucaaguagcugggauuacaggcaccugccaccacgcccagccaauuuuuguauuuuuaguagagacaauuucacuauguuggccaggcuggucuugaacuccugaccucaagugaucugcucgccucggccucccaaaggaugggauuacaggcaccagccacugcgccuggcuggccucugguuuuuaauaaaacaugacuagagugacuccaucuuaaagugaguagcuaggcacuuacaagguucaugcuuauggccugaaaauaaccacaucccaggcugaccaccaauuauaauuacagaauauuuauggccauacagaacauguuccaccaagccugcagaauguccaaauguccuaagaaugcagcccccauuacuuaaauauaacauaaaugagcaagcuuagguugcaggauuaauggucguggauaacaccaauagccccuaccuuuagugagcuuaucugcacacuccaaguuuaacuauaguuccuuauaguuucuuauaaguagaaauacuaacaaagggcuguggguuucucccccugcuuucugaggacacucuacucuguaaaggaguaguuuccaauaaacuuguuucuuucacugugcucugugacucaccucuaauucuuuccugugacaaauucaagaacccgcucuuggggucuggaccgggacccucuuuuccgucaacaagaccacucaccauucuggggcaaagucugcaggggccugaauaagccacagcuccguaucuggacccgucagcgccuccaaggagaaacgaggggacucugaggcugggggcuucgcgguaaaguuggggggacaagagaaccgagcagcaucugcagcagaaggggaaauggggucgacugacaccuccuugccgguccaaucuugcagggcgcgccuaucgguccauuggucuuaaccucgugagcacuccaguccccucaaccugguuucuccuuucugcccaccuguuccccaggggcgaccucaauuucaccgauccaaccccugggggcgccuugcucuccacggguagccccccacaagauaacccucucuccguucgaauucccguucgcccacugggaaugcacgcucuucgcaaguccugcuugcagguacgccuccuuuuccgcccgaacccucucggacgccccuuucuccuuccaccaacgcacccuccgcaccccgucaacccgcacccucaccgccggccuggggcuccuccauccugggacccacaccucaggcaacccuguagcccgggcugcucgcaccagguugcagaccacguggauccaaagggguagggcauca

SEQ ID NO: 15049 - RNA, 20678 nt, Homo sapiens
cccuaugaggugggagcugucgcuccacuuugcgugugggaagacugaggcaccgaggccaugccaccagcccaaaguacagcagacaggcucagaaacaggaggcugccuguccuccauccccagggcaggaaguaaggccgagcuccaaacccacucugccccagggcaaggcuuuaggcaggggaaggauacggccaggucagcacauuagaaaguggggccagacguggugguucacgcuuguaaccccaacacuuugggaggccaaggcaggaggaucacuugaggcuaggaguucaagaccagccugggcaacauaccaagaccccugucucuacaaaaaaaaaaaaaaaggcgggacuggaugcaguguugggaacugggguccgaaaaguucccagacacucccuucuccgcaggccucagccuaccugaaacagaacaaguaucaacaagcggaagagcuguacaaagaaauccuccacaaggaggaccuacccgccccucucggugagccccuagccccugucugucuucccuccugguggcuucucuauguccccaucucagugucccccaucuuucccccuaggugcccccaacacaggcacagcuggugacgcagaacaggugaggaugggcugugcuucggcuccuggggugggcguggggacugcaugggccugggggacugagcagcauccccggccccuccccaggcccuucgccgcagcagcucacucuccaagauccgugagucuaucaggcgaggaagugagaagcuggucucccggcuccgaggcgaggcggcggcaggagcagccgggugaguguugaucaggucggcaaagagcccugacaucagcagaauccacagcccaccccacccccacccccaucuugcucaagaaccuuccauggcucccaucuccccugugauacacacagaucaaacccugugcuggaaaggucccucguggaggggggccacuccuggauucacucauuuccucccugcugcccucuuugcagaaugaagagagccaugucacucaacacacugaacguggaugcuccaagggcuccugggacucaggugagggggacaucugggucaaaaauagaggaggccauguggguaggugcagagaugaggcaaaggcagggcggucgggccagugguggagucagcaggugguggguuggugucagaagagacccaggacaggagcaaagauggguuuuacuugggguagaggcgaggggguuggauaguuggcugccaggcuggaccuggagcuggaggguggauguaacacuugccccucaccuccccuccaaccauccccugugccugucuccaguuucccagcuggcaccuggacaaggccccucggacccucagcgccagcacccaggaccugagcccccacuaacguccagugaacugcgcuggccgcagcuucuugggaacagugcaggagggaugggcugguggggugagagggggucuaucaucuccuggcccccccuugccucuggguaccugguggauagcugccuucuccugcgauuaaaggcuguggacgugacagugagaaaugucaccugacuucauaagaccuucuagcaccaccgccgcugggaaccagggccaggcaagacucaggagucaccaggaaccguuuauggccccacccgccccacucagagcugcugagcaaucugcucuauccucuucagcgucuccucugauucuagcugcuccaggcugagcagggacaggcccagcugauccuccugcagagaacagaggaaagggagaggggggcacuguugggcaggggcccaggcagcugcugcacuuccccaaccacccccccgaauggccaguagggacaggauguuugaaugaauuuggagauguccguauaauccagagcgggccaucccugucaacauaagauggggcugagggaggagccagcuagggagucggagaaggaccggcuuucuccaggccagcaccgucucuccugaaaacgcccaaugccuccucaccccaacuucucucacccugccgugccugggccaccugcuggcaucuguggccccucgaaucucccccuuccccccagagccuggcacguagaugcacgauaaacuucucuuugcugagggcaggaggacaggcaggcugaggguggggaguggggagaauccaaggggacuuucuggaggagaagcucagccugggagggugccgggagggggacgcaggccucacccgguggaagggcugugccaucugccgcaggaaguacuuggccaccuggacacccucguccacggucagguugagguuggcaucugugaggugcuccuggauccagcggggcagcuucccccgcuuguccccacgggcaaaccgcugugggcagaagcgcaggccagggacagaaggucauucggggagccugggccacucuccacccugcaacccaccccaccugggaaaugaacgggaaacagccugguucuuggagccugggaugggagcacaggggcaccccugaagcugcaccuugucggcaaagaccaugaggccguaguccgucuugccccugauggcccgacccacacacugggccgcguggcgcauggcaucgaagguaagaaagucauucucacgaaucuggaacuggucccgcagguauuccagccgcgccugcagauacggaggaugagaagcuggggaggugggggagccacuccucccuugauccuaacacugugggacucccugggagacagagcuacucaccuugagaaugcggcucuguguguagacguaggggacgccaaacaugaugacggcccgcccguaguggugcacuggugggcagaggagagggggcgagggggguuacaaguguggcuggugggacagggacagccucacgcgacccaggaugcugugucugaguuggggggagaggguguguucccgccgggugccuagggacagaggggaggggagggccccucugugcaccuaggcugggggugggugguuccccgcgggagcagacagcagagcgggcagguguuccagagagcucugggaagacaccuggggaggaagagcccaguccacucaccaaagucgauucccucggacacuuugccccgggccacugacagcaggauggccccgcggccauucucgcaggccugagguggggagaccgagacgcaaguuaggucacuccucagagccaccuccccgaccccucuccacgcuggccucgcacacccaccuccugguacuucuccagggcgacacugguuucggcaccauccugggucucaauaaagagcagcuuguuccucuggauguucucaaggauccccuggggaaggacccagggaggucaggguggguucagggcacagccauccugguuacauccaacucuucuggggacucccacaucaccaugucucugggccucagcuggcucaucugagauguggugagggaggguggaauuguccaaccucaguucuuuggggaaacagugaucuggguggggaaccaaucauugcuggauaaguggggcaggcauguggcccaagcggguggccaaucagggcaccccaaccccugccagcgauugguggaggggcugacugugaggcaggcagagccaaucagaggcugcccugagacuucccauaugacacuacaauagagacaguguggagccaaugcaaggacagaccacugggacagaauggagaguccagaaacacacagccaccugugcaguucaguggggagagcuuuuacuggagcaaguggauuuucaaauggaaccaaaaaaugaaccuugacccccuacuucacaccacauagaaagaugaauuugagguaccucauagaccuggaugugaaagcuaaaaccacaagcuccuagaaggaaacaaaggagccucucucuaugaccuugggguaggcaaaggugucuuaaguaggacacaaaaggcaccugcgcuguggggacugggucaccuuucccgccgcguggaagccgccuauugaagcacaaggccgauguccuggcugugaggaugacguucccgccucccaugcgugccuuuccaauaccuggauuagccaaguucacucaccucaccccaaagugcuuucacccacuccugagagcccggccauggugugcucagaggcacaaagugcagaguggccuccccucccacccauguccugcuggucacccagggccuggcuguggugagcccuguuuccagaaugccccacgaccuccucuagcugcuucccugaaggggcuccugcagacccuugagaggcucgccccgagucuugguccagccuuaauucucuagaauuccucuaacccagcuagagccacgccugcuaucugggccuccccaccaggccaucugugcuggaggauaacagggauggguaaccccaaaagcagcagagaagcaaggaaccuagaacgugggggugacucugccacaggguacuccucugagggaggggcccacauuggggcuuauaucugcauucucagccugauguacugggggcggggcaugggggugugugcugcuuacaccccauuccuacaugcugcacacacucuccugucacacaggaaaccugucaccaucagagugugagaggaaugaagcugacauagcggugcagugccagggacugaggagagcaggugcagggaggggguggccaggcguaccugcucauaccaggaggccacggugcucuccauguacugguagcuggugaagaaggccacgaugccaucagggaccacagcggacaucuccagcaggagguucccauaguuccggaucacagcugcaaggggucagagguugggcccucuccuggcccagguccuccucccuucucugucuuagaacuaggaguuucuggaaaccccacugaggcugccugucaggcuuuucacacauaucccccuccuccuccucccgggcgugucugaggacccgccuugccacuuccugaagucacaccuggcuaugugauuugccauggccaaugaaaugagugcagaaggggccgggcgcuguggcucacgccuguaaucccagcacuuugggaggccgaggcggguggaucaucugaagucaggaguuugagaucagccuggccaacauggcgaaaccccaucucuacuaaaaauacaaaaauuagcccagcguggcggcagaggccuguaaucccagcuacucgggaggcugaggcaugagaaucgcuugaacccgcaaggcagagacugcagugagccgagaucaugccacugcacuccagccuaggcaacagagcaagacucugucucaaaaaaaggccaugugucacuuccaggggagcacccuuaggaaccagugcacaauacacugugaccacugugaucccaccugucacauuaugcugccucugacacacccagcgguggagguucccaggugaggagacacagggcaggccccuaccagcucacaguggacguguaccacgggcaagaaggaaacucugggcugagcaacuaaggccagggauauuuguuacagcagcaugacucagcccaccugacugauacaccuccccucuuggaacccacagaaaccagccccacuggcagcauaccaauauccucccgggucucaaauuuggagcugauggccaccuggucauugccacggccgaugaucuggagagcaacagaggucacgauaagcgaggcagcagcaacugcuccagcgugagugcugaccaccugcuggugcuguucuaagcuuuuuuuuuuuuuuuuuuuaaagagagacagggugucaccauguugcccaggcugaucuugaacaccuggccucaagugaccaucccgccuuggccucccagagugcugggauuacaagcaugagccaccacacccagucugcucuaaacuuuuuauaaacacagugucauugaaugaacccucagcaacccuguuaucugcauugcacaaaugaccugggcucagagaaggugaguugccugcccaaggucacacagcaaacagguggcaaagauggaaccggacccgagucuguccacacucuccaacagcagcuacacucuagccagccccaggcccugggccagccggaucccgaagaacaccccucgccaugccggcgggcaucccaccagccggcaaccucacacaaccaccaugcagugggggucauuaccgguccacaaccucugacaggcaacuccaaaagccaaaagcucugaacacauuucuuuuucaaguuuggcacaaacucaugaagcagcaaaaccugcccugccccgagucucuccagaggccugacuuacuccuuagugugaugcuucccaaucuuuuacugccgaaaugggaguuugacucgggggagcugcccagaccccacugugggcaucacacaccacacagcauaggccuugucucuaaaggcuggaaaauucugaauuccaaaacaaauggcugcgcgcaguggcuuacaccuguaaucccagcacuucgggaggaccaggcgggcggaucacuugaggucaggaguuucagaccagccuggccaacguggugaaaccccgucucuacuaaaauuacaaaaauuagcugggcaucguggcacaugccuguaccagcuacucaggaggcugaagcaucagaaucaccugaauccaggaggcggagguugcagugagcugagauccgugccacugcacuccagccugggcaacagagcaagacuccgucgcacaacaaaaacaaaaaaccacauccagccuggggacuucagauaagggacugagggcucauguugacaugcacguguuacagagacggagacggagaggaaggcucacuuaccugggucacagccagaccacguacucggcaagaugcuaagaugcugacuaagcgccuaccugugccaggcccugggcgaccuaagugguuuaccccaguucucucucucaauccucucaaccacccugggagaucagggaggauacauucccauuucacagaugagaaaacugaggcuugagagucgagcccacagagaagcagaaucaagccuaagucugucugaaucccgaacccagccucuucgcuguaaagcucuccugccugagcagugggggaagccaaggaaggagggcggccccuugcccccaucuccccucccggccccagcccuagccucucccacucaccauagggcagaggcagacccgugccagcgucauggugaagguugccauggugacgggguggaaguccaggaucuugggguagauguccagcggggacagugucuguggcgggacagugggagggaucucagcaggacugggcagggaccaggaggcccauggagggaggucagggacuaggaggggacggggaaggguccuuaccccagaugugaugaugacagacuggaaacgcucaaauacggguuugauggccagcgaggcguccaugcagcuggagagagaugagggcagugagggcccggggggcugggcccccgacccacagagcauucacacccucaccgggcagggucccaccugaagugcaggaugggguuggcaauggucgggguucugucgucaaagggcucgaugaugauggugaagccugcagagggcaggcaaggaggggugagauuaccccacuacagccacagcugcacccacucagucauucccucuccugcucccucgcuucaccccaaucuccaccccguacugccugggaguaaaugcgaccaaacaugacugcuuaagccccaaaccaggcaucugaguccaaaauacaccccaaccuguccgcuucgggcccacaccugugcaaacuuucacgaaggaucccaaguagagagcccacagccccgcccacugcucacucucccagcaccgcaugggcugcccagcacccacgccaaagccaggagccagagccucaagcuuucucccaugaccuuuucuuguuuuuguuuuuugagauggagccucgcgcugucgcccaggcuagagugcaguggcaugaucucggcucacugcaagcucagccuccuggguucaagugauugauucuccugccucagccucuugaguagcugggauuauagggacaccccccuacaacacacccagcuaauuucuacauuuuuaguagagaugggggaccugcagugguccacccgccucaggcucccaaagugccaggauuacaaguaugagccacugcaccuggccucccacgaccuuucuaccuaagccaucagcaaagccgggcagcucugccuccaaaaccuaccugcaauucgcccacugcccccgaccccacgcggggccagccaccaucaccuccugccuggacccaucauccccugcucgcuucacggcagccagagggacccuagggaaaccugagucccugaguccagccaugucaccuccccgccccaagaagccucccauggcccccacaugccuccaguggccuggugccugaccuucaaaaaucagcaggcucaguccccccagggccuuuauacuugcuggucccauguggccuggaaaaccucccaaggcugcuccauuuggucaucugagacugcucaaaagucagccccuccgagaggcccuccccagccaccuuuucuacgcagacauauuccaacacaacaauguauuuuuuuucaugauaacugucacuuucuggaauuauuuccuuguuuauuuggcugcaucuuugcuacugguuuucccaucuggaauauaaguucugggggguuagggaugagaucuuuuuugguuccugcugcuuccacagugcugagccuggccuguuuguugaagaaauaaaugaaugaaugaauuuacauauucgguuucacacagugaaaaaaaaucaaguccucugugcuggggacacaguggugaccaagccagccuugccccugcucgcauggguucgcaguccaguaggagacagacuuguccucagauagugaugacugagagugggcagugcugggacagaggugcccagaggaggggccugacucagccugggggucagggagggcuuccuggaggacaagacaucucuacuaagcugagaaccuaaggaugagggggaggugguugggggaugaggaagaugaggaaggaugauccaggugaaagaccaugagguguuggcagaugggaaauaguggguagagaaugacaaagguagggauggaagauggggcaggacagagagacagaggcagaagcagcagccagccggccucgcuacccagccccagggcaagggcccagaucuccauccuccugucaggcccugccgcaggacaugaggcccgaucugguuuccuggguacaggagaaacccccaggaggcagacugagccccuggucagcuucacgcugaggauggggagggaacaccggcccauaaagccuccagaaugaugucccucucucguaaccugaaaaucugaacaucagccucuacuccucuugucccuggucccaaaacccaggcaccacgcuccccauaucccagccucucuaccucccacaucucucuccaaaccauaccuuucucucuccccauggccacauccuggccaaggccccuccccuccugcucaggucccugccugccacccagucuccugccucuagucccugccagaagaacucuuuuuuuuuuuuugagacagacucucauuuucacccaggcuggagugcagcuggugugaucucggcucacugcaaccuccgccucccggguucaagcaauucuccugucucaggcuccugaguaguuggaacuauaggugcgugccaccacguccagcuaauuuuuguauuuuuaguagagacgggguuucaccauauuggucaggcuggucucgaacuccugaccucaggugauccacccaccucagccucccaaagugcugggauuacagacaugagccacuaugccaggccuauuuuuuuucuuuuuuuuuuuugagacggagucuucgcucugucgcccaggcuggagugcaguggcacgaucucggcucacugcaagcucugccuccuggguucacgccauucuccugccucagccuccugagcagcugggacuacaggcgcccgccaccacgcccagcuaacuuuuuuuguauuuuuaguagagacggaguuucaccauguuagccaggauggucuugaucuccugaccucgagauccgcccgccucggccucccaaaguacugggauuacaggcguaaaccaccacgcccggccuuuuuuuuuuuuuugagacgaagucuugcucuguugcccaggcuggagugcagugccacaaucuuggcucacuguaaccucugccuccugggcucaagcaauucuccugccucagccucucaaguagcugggauuacaggagcccaccaucacaccuggcaaauuguuguauuuuuaguagagacaggguuucaccauguuggucaggcuggucucaaacuccugaccucaagugaucugcccaccucggccccccaaacugcugggauuaugggcgugagccaccaugucuggccccagcuaauuuuuguauuuuuaguaaagaugggguuucgccauguucaccaggccagucucgaacuccugaccucaggucaucugccugccuaaccauuccaaagugcugggauuacaggcaugagccacugcguucagcacccagaagaaaucuuuccaaagcacaacucugggccgggcaugguggcucacgccuguaaucccagcacuuugggaggccgaggccgguggaucaugaggucaggagaucgagaccguccuggccaacauggugaaaccccaccucuacuaaaaauacaaaaauuagcuggguauaguggcaugcgccuguagucccagauacucgggaggcugaggcaggagaauugcuugaacccaggaggcagaggcugcagugagccaagaucacaccacugcacuccagccuggcaacagagcaagacuccgucucaaaaaaaaaaaaaaaagcacaaaucugaccuggcaccuugcuugcuagaaucugccauggcuccccagugcccucaggagcacaaagaucaacucauuaccgugcccucuagugugagcugaccccauagaauuucucuggccuccucccuuaccacugcccaugccauccuucuccacucugcagcccgaggaagucugugaaaauguaaaucugagcacaaggcuuacucaagaacuauguauggcuccccacugccuucaaaauagggcccacacuuccaagccaaaccccacaaagcccuguguguccugccaacaacccucuagacccugcugggacccugauuccagcugcuaggaggcccagcagggacagaaaaaggugagcuuaccuuuggcguaggugcugacaaggguggcaaaguuagcaaggagggugagcggggagaagucagcaaggucggugaucuccagaguaugcagcagggaccggaggcguucagcacagaaucuggcggggaggagagacggggucggggggcagacggaagcaugagcaggaccagcagcccugccuccgccaucacgacggucacgugccugucuccccagccaaugagcacucagugagggugggcacugggccuguuuuggaaacuugcacccccacgcuguacaccugcaugucacaaauagccauugccgcauaauggcacagacagagcaauaaucagacacuccagagucauguggucacuugucacaccugcuagcacgaccuccuaaguggguucuuuuuuucuuuuucuuuuuuuucuuuguucagauggagucuugcccugucauccaggcuggagagcacugguaccaucucgacuccgccuccuggguucaaaugauucuccugccucagccucccaaguagcugggauuacaggugccugccaccacacucagcuaauuuuuguacuuuuaguagagacggacuuucacuauguuggccaggcuggucuugaacuucugaccucgugauccaccugccucagccucccaaagugcugggaugacaggugugagccacugcaccuggcccuaaguggguucugaucaaaacaagagacgcacaaucacacccagaaccccccagucauggcauuaaucccgcauggccacauggucacgcauucacacccagagccucucccacugccucucacgcaccuauggggacacacacggugucggaaccccaugggcucacagaggaaugcagucaacacccacaucccacagagucccacggauaccacguccacacacucacgcaugugcagggccacucggccacaaccacacacaggcagggccgaggcagggucauagagcagcuggcuuugaagccaggugggcagucacacuugcaaaccugccucccgcacgucagcccucccagccuggcuccucuaaccccaggcgccuaccccggcuggucgcuagcugaggaugagucuguccccuccacugggccauggagccucuacggcuguguccccagcaugaagcaggcacuuggggaauguguguugagugacugagauccccucuuugcccucacaagucuccaauccuggggaagaugggcaaacccacauggaagguggccucacccacagaggcagggcagccagggccuuuggagcccacaggcauggcuucaagccccaacuaccgggcacagugcuguguggcucugggcaaaggcuuccccucugggagucccaguguccucauuugcaggguggggaugcuguacugggggugcaacugagguaaggaacauaaagggcuuagcuccuccuuagugcucagggcaggguaggugauuggcuucgcugcucucucauuaacccaccaaagaacccugugaaguaaagacccgacuccuuggccauuuuacaaaggaggaaacugcaguucaaagaagacccaugacuuacccaaaggaaaagcccccucguaucccuuggucauucucugccugcccugugccucaagagacugacucccccaaaaugcgcccagacuacuccauggggacgccccugcccucagguuuggaagauuagaggcaucggugggaagauacaugggccggggacaccuccuccagcucccagccugcgaggcccugguacugguuucugcucccagcagaagccccuguccaggcccccaccaguugguucucaacacacucccucccugccgcuguggccuggcuuagcucccagcucucaccucccacccuccuuggcuccucccccagcccgccccucuguaaauggugcucccacucucucuugggugggggagauucuccaauccagccagguguugccugccaggccccugcccgacgcacggacccaggaucagcuccaaccuugcucccggaccucccaggucagaccagacaaggucccacgugccucgcccagcucacucacuccugaugcugcaguggugaccuggggcuacaggcguggaggacacggcucugcauaaccgggaccugccgggcccccaccccgcgcgcugucuggggccgcaccugaggggcuugcgcuggaugcacacgcgcugggccaggccgcucaggaaggcgggcgggcucuccugcaccacaugcugcacacgcagccgccacuucacguacuccagcagccgccucaggaagcccaggaaaugcucggccgugcggauggagccaggcacugccucugcgaggagacgcuaucagcggcgacggggaggcgggaaagggacuggggggcagcggggggucggggcucacccugcagcacuucgucgggcagcacgggguuggccaggugggcguccgucucccgggcggcgcuggccucccgcagccccuccaccagacgccgguacucgucccgcaggcgcugcucgucugucucuuugauccugcggagagaugagcuggggcugggagggggcuggcaacccuggggacaagucagacaggggccagggucccaggggcagggcgggcaccaccgccagacguccccggccccaccugagcaccgucuucugcagggucuccagguugcccuggcaccggucaaggguccggcgggugagguugacgcucauggagucgaugcagacguugucuggagaagggggagagagccggcucaggcaggccugcaggggccucacucagaggggcuggcaucccuuuggccccuggcgccccccucaccaauguugugggccucgucgaagaccacgacggccuugcgggccaguuccuuggacaccaggucugcaaucuugggguccaggagguagugguagcuauaaaccaccacauuggcaugcaggaucuggggggccggggagcaggguuaccagggcccugccaccccaaccccuaccccuaccccuggccacacuggcccgucacucccacacaggccugcacaggcagacacaggccaggcagaaguaugagcagauggauagagacagaccaacagauacgggcacccaccaacagggagaugcagacaggcagacucacagcaagcaacagacagacaugggcagacaggagacgggcgggcagcccacacccucacacucgccccucugcccaucccaccagccuccucacugaguaucgagcaaggaaguaugggcaccagcccuggcgccgccccagggccuucaggucauccagguuguagaugccagcggggaggggcaccucacgcccaugggcaucaaauuccugggacaagagugccaggggucagggaggcugccugccccaggcuaccuguccugccucccucccucagcccugcccuccaguaaccucauagaaucggcaguggggcaggcuggugucaugcugguacugcgcccgcacauaggaggcugugaggcuguggcauuucccaucgacguccuucccaaagcgcaggggugucaccuggggguguggggcaucuuagcacccagacaggguggaaacccaaccacucuucaaacccuggucuccacaccucccagcuggcugggguuuuggacaacuugaaccucagucuguugcauuauuaguuaagacgcgugggaacuuaaugcagggauacaagaguaguaaaauugggcugggcgcgguggcucacgccuguaaucccagcacuuugugaggcugaggugggcagaucacgaggucaggaguucgagaccagccuggccaacauggugaaacccugucuccacuaaaaauacauuagccaggcgugguggcacaugccuguaaucccaguuacucgggaggcugaggcaggagaaucgcuuguauccgggagguggagguugcagugagcagagaucgugccauagcacuccagccugggcgacagagugagacaccaucucaaaaaaauaaguaaaaauaaaaauacaaaaaugagccaggugugguggugcacaccuggaaucccagcuacucgggaggcugaggcaggagaaucccuugaacccagaaggcagagguugcagugagccgagaucaugccacuguacuccacccugggccacggagccagacucccucucaaaaaaaaaaagaguagcaaaauuguuacauucuuacaacuacaaguuauacauacauauuuuuggagacaagucccucugcuacucaggcuggaaugcaguggcccaaucacggcucacuacauccuugaccucccaggcucaagugauccuucccccacucagccucccgaguagcugcggccacaggugugcaccaccaugcccggcuaauuuuugucuucuuaguugagaugaggucuugcuauguugcccaggcuggucucaaacuccuggucucaagcaauccucccaccucagccucccaaagugcugggauuacaggcugagccacugcgcccagccagccaaaacuaauauuuuauuuuuugagacggagucuugcucuguugcccaggcuggagugcaauggcacgaucuuggcucaccacaaccuccgccucccagguucaagcgauucuccugucucagccucccgaguagcugggauuacagacaugugccaccacacccggcuaauuuugucuuuuuaguagagacaggguuucuccauguugaucaagcuggucucgaacuccugaucucaggugauccacccgccucggccucccaaagugcugggauuauaggugugagccaccgugcccagcccaaaacuaauauuuuaaaacaauaagccugaaaaaucuuuagcauauagguugaagauaacuacuucauccuuggaaaugccaaaacgcauggaaccuuggcagggccuaagaaucaaaggagguuccacacagucugggacuccccuuaccccugaccugcucuguacccucuaaggcaccaucacagccuaaggcuuuuucugaagaacaaauccuuuuccuacgccaaaaggaaagcuccaaggcagccagcccuuccuucuccauuuccccuuucaucagucaccgaggccugugcucuuugucauccacuagauguauuauuucucacauauucuuacaaauaaugugauauaauauauagucugugggcccagugugggaguuugagaccagcccggccaacaugaugaaaccccaucucuacuaaaaauacaaaaaacuagcagggcgugguggugggugccuguaaucccagcuacucaggaagcugaggcagaagaaucacuugaaccucggagguggagguuguggugaaccgagaucacgccacugcacuccagccugggcaacaagagugaaacuccauuucaaaaauaauaauaauaaauaaggcugggcacgauggcucaugccuguaaucccagcacuuugggaggcugaggcgggaggaucacaaggucgggaguuagagaccagccuaaccaacauggugaaacaccgucucuacuaaaaacacacaaauuagccggguguaguggggcaccuguaauccuagcuacucaggaggcugaggcaggagaauugcuugaacccgggaggcggagcuuguaguaagccaagaucacuccccugcacuccaggcugggugacagagugagacuccgucucaaaaacaaaacaaaacaaaaauauauauauauauacacacacacacacacacacacacacacacacauauaaaaacauauauacacacacauauauauguaaguauaauauauacacauauauacauucuguggguuaccacauguaaaguauucagaacagugccuggcacacagugaguacaauuuuuuuuuuuuuuugagacggaguuucacucuuguugcccaggcuggagugcaguggcgcgaucucggcucacugcaaccucccccucgggaguucgagcaauucuccugucucagccucccaaguagcugggauuacaggcaugugcccagcuaauuuuucaauuuuuuuucaguagagacgggguuucuccauauuggccaggcuggucucaaacucccgaccucagguguccacccgccucggccucccaaagugcugggauuauagucgugagucaccaugcccagccaaguacaaugauuuuauagcauaauuuaaugauaacuaauauuguauuugucauauaucauuaugcauauaaauaucaugacaauuucuuuuuuuuuuuuuuuaagacagagucucacucugucacccaggcuggaaugcaguggcaugaccucagcucacugcaaccucugccuccuggguacaagcgauuggcauuaccgacguguacaccaccacccccggcuaauuuuuguauuuuuaguagaaaugggguuucgccguguuggccaggauggucucgaacuccugaccucaaaugaucugcccaccucagacucccaaagugcugggacuacaagcgugaaccacugcaccuggccuaucaugagaauuucuaacauucuuuuagcucuuuguacaugcuaagggcaucggcugcaacauuucacccaauuuuaucaucagcaaccuuaugaagcagguacauaauuauccccauuuuacagaaaggaagacugaggcccagguggcagaaaaugccucuccauaaauacugggcuaguaaguuucagagccaggaaaccaggcuugccagagacucuaagagcugccuuuuuaaccucuccuaggccuggguagaauuugaagacucccuggaggaagugugcuugccugggccacgaugaaugagaauuugaccacugagacgggaauucuguguguagccacugcaugccuuugcaagagauauggccuggggauccaggacuugugguuggacgaaagaguuuucucuaccucugggcuaagggcaaggagaaggaacaggugcucaccucagggugaauacacaaguuuuugcgggagcucagagccagucccagaaacggcagcuucucgcccuccugcuucucauagaaguugagcaacuuucgaagcucuucaaucaccuacuccaaaguuggggggcagggggagcuugugcucauuggaggcacaaaccccugcccugccaggucccagucucuuccccagcuucccaaacacccccgaaagcuggugacggccaccgccagggggaccaauagggccuagggaacaguggggcuggagcaccaggaugagucccagcuuaccuucucaaucucuggcacaguucuugagcaguagaugaguuuggucaccuccagcggauaugccugccgauaacaagcggacucagucccugucccgccccuuccuuugucugccuuuacggguucagcgcaucacucacucucugguaugccaugaucagggccaacagggauacugucuucccggugccugagggcaucuccaggacuccaugacccugcauguuggggaccagaggggcaacacacagggucucagaaccuugggcacacaaacucuggggacucuccccgacccccaaugccaccaacucagaacagcaggauaacacagcagcaguuaagauugggcaguggguuugaaccucacuucugccuccuccuuguugaguggucuuaggcaaguaccuucaccuccccagaccucaguaucccuaucucuaaaaugagccuaaagccaggcgugguggcucacaccuguaaucccagcacuuugggaggcugaggcaggugaaccaccugaggucagaaguucaagaccagcugggccaacaaggugaaaccccgucucuacuaaaaauacaaaaaauuagccagaugugguggcgcgcaccuguaauucaaucucaaaaauaaauaaauaaaauaaaaugggccuaauaauaaaaccuuccucauaacaugacuaugaggauugugagaaauugcagguuaaauauuuggcacaguagcugauauauagugaacuuuucucccuucuuuuuuaagagacaagugucacuauugcccaggcuggaaugcaguggcacaaucauggcucacugcagccuccaacuccuggccucaagcgauccuccugccucagccucccgaguaggugggauuacaggcgcccgccaccacaccuggcuaauuuuuguauuuuuaguacagacgggguuucaccguguuggccaggcuggucuccaacuccugaccucaagugauccgcccgccucguccucccaaagcucugggauuacaggcgcgagccaccgcgcccagccuauucaccauuauuguuuuagauaacggaagauuaugggguccuggauucccagggaccucggacuucuaaaauccagacguccugcaaucugucuuaggcccaggcguggcagccccaccggucgagugggcgggucgggcccaccggccacccaccuuggcguccagcgugcguuugagcucccgcauguaggagaacugcucgggguagauguagucguacgggaaguagaccaggagcccguccacguugagccuggcggcaggggcugcugggucaguucccguccccucagccccucucccgccuccacagugcccggucgucgagcccagagaagggugacgggcccggcgcccccgguaacccucagguccucaggagccucggggcccccucagugucuccucgcuaucacugcugcucccugcggcugcccccgucccaccccuucacccuccccucgcccccuuggggacccaggcgcgcccaccgaugaccccaucuucaagaccccccgcgcccgcuagcgagcgcgacccccagcccccuucucacuucauggcgccggccggacugugcagcggggucgacccgccucccucaugaauauucagcg

SEQ ID NO: 15050 - RNA, 3835 nt, Homo sapiens
ggagggggcugagaauuguguggccaguaugugggcagaaagagaaacugaggcuggggcuuagaggaaaucacagggggaggccagcagaugcgugaaacuuggugaaucuuuauuaaacuaggguccaccccaggaggacggcuggggcggggacagggucucccgcugcaggcugcgcggaggcaggaggcacgggguggcguggggucgcauggcugcaggcuucggcguucagugauugucgcugggcacaggggcggcgcuggugcccacggcagccugcaccuucuccaccagcccggcccacuggcgcugcaugucuuccaccaggggcucgaaccagcucuugaggcgggccuggaaggccucggccugcaggcguaucugcugggccugcuccuccagcuuggcgcgcaccuccgccaccugcuccuucaccucguccaggcggucgcggguccggcugcccaucuccuccauccgcgcgcgcagccgcucgccccaggccugggcccgcuccuguagcggcuggccggccagggagcccacaguggcggcccgcacgcggcccuguuccaccaggggccccaggcgcucgcggauggcgcugaggccgcgcucggcgcccucgcgggccccggccugguacacugccaggcgcuucugcaggucaucggcaucgcggaggagccgcuuacgcagcuugcgcaggugggaggcgaggcgcacccgcagcuccucggugcucuggccgagcauggccugcaccucgccgcgguacugcaccaggcggccgcacacguccuccauguccgcgcccagccgggccugcgccgccugcagcuccuuggacagccgugcccgcgucuccuccgccaccggggucaguuguuccuccaguuccgauuuguaggccuucaacuccuucauggucucguccaucagcgcccugcggccgagagggcgggagggugucgcacagugggaggcggggagaagggcugggauggggcgggcgagauggggaugagccagagagacccaagagggagagaaggaacggggcagaggccgagagaaggagacagagacagaugcagagagcagaugcagagggcagaggcagagacgaagaaggagcuaggaggccgggcaagguggcucaugccucuaaucccagcacuuugggaggccgaggcgggaggaucgcuugagcccagaaguucaagaccagccugggcaacacagugagaccccaucucucugucucuauauaaaagagcuagggaaggacagagacagagccaggacgagugugagagacugagucagaagggaagagagagagacaaagcugagagagagaauuccagagagcuaaagccaggagucagaaaugggaagaggaagcuagaaccagcagagacccaggccccccaagacuuagcgacaggggcagaaugaaaccuggaccuggggagguauagccgcccaccaggagggucaagggccaggauggggacacucaccucaguuccugggugaccugggagcugagcagcuccuccugcaccugcucagacagugucugcacccagcgcagguaaucccaaaagcgacccagugccaguucccagcgcuggccgcucugccacucggucugcuggcgcagcucgggcuccggcucugucuccaccgcuugcuccaccuuggccuggcauccuguguggaacaaguucaaggugggucaggguccuucugaccccguccaggcaucuaguaccuaggggcacacagaaggugcuccacaaaugcuucuuuggagccauggugggcagggugaggggggagucgguuuaaucacuuggaaagcauuauguauuuauaaacagggucuugcucugucacccaggcuggagugcagcggccugaacaugguucacugcaaccuugaccuucugggcucaagcgauccuccugccucagccuccugaguagcugagagcacagguguguggcaccaugccuggcuaauuuuuguauuuuuaguagagacagggucucacuauguugcccaggcugguguugaacuccugggcucaagugauccucccaccuuggccucccaaagugcugggauuacaggggugagccaccgcgcccagcggaaaagcauguauugaguguccuugugugccccaggcagggcugugugggggugauggagaauaaagaucacagcugccccgugucugguauucacuaucugccugcaaugcauuagaaaccucuaacucccagccaggugcgguggcucacgccuguaaucccagcacuuugggagaucgaaacgggcagaucaccugaggucaggaguuccagaccagccuggccaacauggugaaaccccgucucuacugaaaauacaaaaaaguuagucgggugugguggcaugugccuguagucccagcuacuugggaggcugaggcaggagaauggcguggaccugggaggcggagcuugcagugagccgagaucccgccacugcacuccagccugggcgacagagcgagacuucaucucaaaaaaacaaaacaacaacaacaaacaacaacaacaaaacaacuucuaacuccuaucucaaggaugggggaaaccgaggcccagagagcgucaaaucgcuguucagagccaggaagcagcacagaagccucagaagagggggcccagggucugccugaauggggccaggagguugaggugaggaugagagggggaggagcggggggaaccgagcaagccccgcccccauaccugccaggaaugugaccagcaacgcagcccacagaaccuucaucuuccugccugugauuggccagucuggggaaggagaaacugucaaucaaccgccagugaggacuccucccacccccagcccggccccaacccggccucaccccagguuagccuuccaagccuuguugcauuaucugcaacagccuaaucccagcacauuuaccaagccgcccccaacccauucccuauuuaacucccuccuggucuucucuuaucuccccauccccaggucggccuccauagaaaauuccaucuuccucucccgggguucaaauuccauccccccacccccuccccaccgccgguuccaucucagucccagucucgcauuccucauucucccuucacauucuaagcuccaaccucacaguuaagcgccguguuccauuuaugagcuaauucaguccucauuuuaaaguucuccaaucgacggcuagcuaccgugucgcugccccuggcuccccaguuauggagaucugaggacacuggggacacccaguaggugcucgauaaaugauagugacaacucguggaguccugcuauggcuuacaucccaguccagcugcucuccccaccccaccuucuagcgggucgggucgucucugcugcccagcccuucccagguccaguccccugcugcuugccucacccccgcuccuccucuccccaagcccgaccccgaguagcucuccugagacuaccuggaggccagggguucccagggucccagcucuuucuagaggccccugagcucauccccgugcccccgacugcgcuucucaccggcuccuggggaaggacguccuucaccuccgcuggggcugaguaggacucaaggaucccagacuuguccaauuauagggcucccccugucccgcccccucccccagggauagggcgggcugggccagcccccagucacgaggugggcuguucucccccugccccaggcacagcagggcagagggaggaagg

SEQ ID NO: 15051 - RNA, 9505 nt, Homo sapiens
cggguugggcaggcagccgcaggccccauccucggcggccccugaggcgcuggcgguugcagccccggggguccguuccgaacuucgacucguacuggugccggcgcccaggcugccucccagcggcggcagcgugaagcccggcggcgagggcggagguggcggcagccccacgagggccggcgcaggcggcgguggcggcccugcgggcggcgagcuggcagccaacacguuccccauggucgccugcuaggggagaggucagagggcagaggucagggcccgcgcgcccccgacucagccccagcaaauccgcacccggcuccggccccgguucucacuggcggcggcgccugcucccggccugggcuccgcucccaccccgugcgccacgcgcaaccgaacccgcugccgccgccgccaccaccgucgccccgccccaccuagcccauugguuuagugugcccugaggcccgcccaccagcgucaagacucggucuucccauuggacuugugcauaaagucccgcccacuuucccugaaauguccuuuuguauugguucucacucgcaggguagccacggcgccccucccacccuucccauuggcucgcagcgccugcgccuauuggcucgcgucgccgcggguuccggugcuaacccgccauuggucugugcugagcauuuugccacgcccgcugaggcaucgccccgccucucuccuggaggaggcccucuuuugauuccgccccgcggcgagguugcugugauaauuggucggcuuugacccuugcagcauuuugauuggcuccagcguguacggggucgaccuugguggcguaucagcuugguacucucauuggcuaacguuccagggucgaaggacagguaaagguggguugcgcggcagaggcggcuaggcagcaaggucaggccucgcgucccaccaggcaccgcggcagccgggcccccaccccaccucugguucggaguagccgaccuaaaaccggaagugcuggcccuucccagagugccucgggagaauucuaaucuguucugcgaacccugcgcugcuccucguuacccacaaugcccucaucaccucuuagcgaaacaguugccuuagacccaccccuuucguuacccaucaugccucuuguuccucgcgucacugcggcuucuaucuuuggcccauucauuccucucccauuacccaucaugccucugccccauucauuugagcuucauugcccagacuacuuuuagcuccagccugccugcucacuuucgucguucuuccggcccuucucuaauuagccaucauguuuuggauccaugaacuccuguccguuaccucccuugcccccggucccuauuuuuccauuauucaucacucugccucuggcccauucauucagguuuauuauccgucaugccuugggcuccuauuacaacauuauucaugauuuugccuuuagucuacuuuuacuugccguuuauucauuaaacuugagccucuuauacuuucguuacugcuuuuuuaauuuuuauuuuuuuaaagacaagguuggacucugucacucaggcuggagugcaguggcgccaucauagcuuacugcagccuugaacuucuggccucaaucgauccuccuaccucagccuccagaguagcugaacuacaggugcgugccaccacgcccggcuaacuuucguagaggcggggucucacuguguuucccaggcuggucucuuaacuccuggacucagucgagcuucccgccucaguuucccgaagugcuggaauuacaggaaugagccacugcaucuggccaauugcuauuuuuaucuuugucccauucaucauacugcuguugcaauuaugaauguucauuaaacagcaugcccuggaccccuccccauuccauuacucaacauucuguuuuuagggcugggcgcaguggcucacgccuguaaucccagcacuuugggaggccgagacggguggaucacgaggucaggagaucgagaccaucuuggcuaacgcggugaaaccccgucucuacuaaaaauacaaaaaauaagccgggcgugguggugggcgccuguagucccagcuacucgggaggcugaggcagaggaauggcguuaacucagaagguggagcuugcagugagccgagaucaugccacugcacuccagccugggcgacagagcgagacuccgccucaaaaaaaaaaaaaauuuuguuuuugauugauacauuuuugcucauuacucucucaauucuuauuuuguaucuuuggucccuuuguuuuugucuuuaacucucuugaccccaguucacugauucucucaagcccuuagacuccuuccucauuccccuucaugucucaccccauccccuucacaucccacagaaaaggcaagaccuggucaaaguauaaauucauauuuuguaggaaauguaguuuacaaaacaguaucaauugcuacccccaauucagaugacccacuuuccccggaagggggauguuuagguccuauuccacugggcaaggguaaaaugauucaguagucuuccagguuaacaguaaauucuucucccaaggcuggggccaucaaggcacagucuguaugaggcucacccugucugacccuaggcuggggcugcuugcuugguaggcaggaauuggggugggggugggggcucagggaagggucuggacccugagacuucugcuuacaggagggugcugggaaaacccugccuugggcuggggaauccccucuuucccaccuuuggggaacaggguggggaggggguaagugggacccugcugccuggagggcucaggucugagcagcagggagcccucagcgcccacuccagcagaccuauugggaauuuacuaccugaagacaaauuauaggucuagggucuucuuugugauuuugggggagucgaggcauuggggggugagagguauggucuaaggucacagucugggagaggaguccuugggaucagagguugugcagaagcaccuuccccaccuccugccucaugagauaagguugccaggauuccauuaucacggugaauuucucugggcucauggguuaggggucauaguggagccaccaagguagacaucacaaauggaaugcauauguguuaacugacaguggccuggccagaggucagggggcacuagauccuuggcaagaaagcuaagggaucaacaggugagaugugagacgccaggcgcauggcagcucacacauacauggcccgggacaugacaaagccuuugcccugguaggaaucagaggggcugcuauaggacagagcaucauagaugggguugaucuuguccagauacucuuccuccuccucccccuccucauccucuagauccagggaaacgucuuccacagcagguggcccuggaggcaccgggaugggggaccccaggcuuguggcuccagggugcaaggguccugaccguucuuccaaggugggcagcucaugguaucgaggcauuuccuggagguagagagaggacaggaacucaagaucacuuccuacgcacgacacagauuaccaaucugcucuugaccccaaaauccugaccgcucucuccccaugccaacaagaugccaccucacuccuuguccccugaggccauauugcacugggacauucauucagcccuuccuuaacccaaagcccagcucgugcaacucacccuguuaauccugggacucacuuuugacacucgaucucugcaaaucuuuccccaugaaccuuucaccucagucuugaccucaaauacuuaaccuugggcucuaaacaguccuuugaaccuugagcgcaaccucagugucugaccccugaccuccaguagaccacugaggggagugacuugauuugucuugucccagcuucaggcacaguauccagcaaauguagauaaucaauuuucuuucauucuguuuuuuuuuguuguugagacggaguuuugcucuugucucccaggcuguugugcaauggugcaaucugggcucacugcaaccucugccucccggguccaagcgauucuccugccucagccucccaaguagcugggauuacaggcgcccgccaccacgcccagcuaauuuuuguaauuuuuaguagagacaggguuucaccauguuggccaggcuggucuuggaacuccugaccucaggugauccaccugccuuggccucccaaagugcugggauuacaggcgugagcaaccgcacccggccuuuuucuuuuuugagacggagucuugcucuguugccuaggcuggagugcaguggcguggucucagcucauugcaacuucugccuccuggguccaagcgauucuccugcuucagccuccugaauagcugggauuacaggagcaugucacccaugccuggcuuauuuuuguuuuuaguagagaagggguuucaccuuguuagccaggguggucuggaacuccugacgucaggugaucugcccgucucagccucccaaagugcugggauuacaggugugagccaccaugccugaccagauaaucaauuuucauugaccuaaugacuuuuccucuuuuuuuuuuuuuuugagauagggucucacccugaugcccaggcuggaguguaguggcacagccccaaccaccugggcuuaagcaauccgcccaccucagccuacaggcauuugccaccacauccagguaaauucaguauuuuuguagacgcaaaauguugcuggguagcccauguugcccacgcuggucucgagcuccuaggcucaagggguccagcuaccuuggccucccaaaguacugggauuauagaccagagccaccaugcccggcccaggugauuuuauuuauuugguuuuauuuauuuuuuugagacggaaucuugcucuguugcccaggcuggagugcaguggugugaucuuagcucacuguaaccucggccuccuggguucaggcgauucuuccuccucagcgccccggguagcuaagauuacaggcucgcaccaccacacccaacuaauuuuuuguguuuugaguagagacgggguuucaccauguugcacaggcuggucucgaacuccugaccccaagugauccuccugccuuggccucccaaagugcugggauuauaggcgugagccaccgugcccagcccccaagugacuuuaaauucuaaccuugugaccuugggccuuuucaccccugaccucccccauggaauccugaacacaucucaaugcauuaagcaccaaccggggacacacccuugaccuugaguuaugaccuuuagucuuugaccucuuuugccaggccugaccccuggcccuucaacccagacccccaacccaccuuugucuucccaugagcuccuaccugcucagugcaugaggcgccagcaucaaaguagggggucuugagugggcugugcuccgaggcccccagagugaagagcugggagggcuguagugggagaggggcggggaggucaggaacugcccccaccacccagccagcuucucccugccaggccccucccagcccugggguggguguggagguggggauagcuugggcuccagggaaagugcucaccaucuccugugccuccagcuucgcuuuugggguugguggcuuguaggagggaggucccuccaggcugugggguaggagguaggacaaguggagauuaagacccaggcaucccucugacuccgggguuauggcacaugcuguucccucuaccugggucucccuuuccccugcccccuuuucuugccuggaguaagaguuuuuauucauuccaugaauuccucuuuuucccggaagccuucagguuuccccaguggaucaggaauuccuguuacacggacauaccuagcuguacuucccccucagggcacuuacugaauuuguacuugaaauguuauuuauaauuaccaugccccacugugagcucugggagggaaaaaagaucuguguugggcugggggcaguggcucacgccuguaaucccagcacuuugggaggcugaggcgggcggaucaucugaggucagcaguucgagaccagccuggccaacauggugaaaugccaucuccccaaaaaauacaaaaauuagcugggcaugauggugcacgccuguaaucccagcuacucaggaggcugaggcacaagaaucgcuugaacucgggaggcagagguugcagugagaugagaucacuccacuccagccugugcaauagagugagaugccaucucaaauuaaaaaaaaaaaaaaaaaaaaaagaaagaaagaucagccaggcgugguggcucacgccuguaaucccagcacuuugggaggccgaggugggcagaucaccugaggucaggagugugagaccagccugaccaacauggagaaacccugucccuacuaaaaauacaaaauuagccgggcgugguggcgcaugccuguaaucccagcuacucaggaggcugaggcaggagaauugcuugaacccgggagguggagguuguggugagccgagaucgcgccauugcacuccagccugggaaaaaagagcgaaacuccaccucaaaaagaaaaaaaaagaaaagaaaagaaaagaaaaaaaagaaagaucugggucgucagcaaggugucuccagaauccacuaugaggaguucaguaaauauuugugaaaagaaugaaugaauaaaugaagugccuuccugucccucaaauuagguuaaaguuccugucccucauucuacacacccacagaccaaagcauacaguaaugacaggugcuuacgaugcauucugucagcucagauguccccucuuccaggaagcccuaccugaccauccagccugggucagaugcccccucuggcuucucagagcuugcucaacugcccuaucccaucacuggucaugcuacaccaucacuaucuggagacaguuuugucuccuccuccauauugugagcuccaggccgucucggacacagugggucacagcauggagcugcacacagaggagaucagcagcaaguuauugguuugaacuaacuagaugauuaagacagugguguaacagaccuuccugugcaucagaaaaacuuagagagcuugugguaaauacagauuccaggcugggcaugguggcucacgccuguaauccgagcacuuugggaggcugagguggguggaucaccugaggucaggaguucaagaccagccugggcaacauggcaaaacccugucucuacaaaaauacaaaaacuagcuagguguggugguacguggucccauuuacuugggaggcugcgguaggaagauugguugagcucaggaggcgaagguugcagugagcucagauuauaccacugaacucuagccugagggacagagugagauccugucucaaaaaaacaaauuuugcauagcucgcauaccucagacugcucugagcuauuuuucuuuucuuuuuuuuuuuuuacaaggucucacucuguuggccagacuggaguacaguggugugaucauagcucacugcagccuccacaugcccccacccccaccucagcccacccaaguagcugggacuacaggcaugggcuaccaggucuggguaauuuuuguauuuuuuuuguagacagguuucgccauguugcccaggcuggucucgaacuccugagcucaaguuaucuacuuggguuggcuucccaaagugcugggauuacaggugugaggcaccgugcccagucuuuuauuuuuuaagauacagggucuugcucugucaccugggcuagagugcaguggcaugaucauagcucauugcagacuugagcuccugggcucaagugaccucccaccccagccuccugaggagcuggaccacaggugugcaccacuuugccuggcuaauuuuguuuguuuuauuuuuuuagagauggugucucacuuugauguucagucuggucucgaaccacuagcaacaagagccuuggccuuccaaagugcuggcauuggcugggcgcaguggcucaugcuugugaucuuagcacuuugggaggccgaggcggguggaucacuugaggucaggaguucaagaguagccuggccaacauggugaaacuccgucucuacuaaaaauacaaaaauuagccgggcgugguggcgcgcaucuguaaucccagcuacucgagaggcugaggcuggagaaucgcuugaaccagggaggcggagguugcagugagccgagauggcgccuuggcacuccagccagggcgacagaccaagacuccaucuuaaacaaaaacaaaaacaaaacaaagugcugggauuagaggcaggagccacccugccugacccacccugccugaccaguguuacucuuuaucuucagguuucuggaauuugugauacaaagagcaauggauagccaaucaauagcuuacguuauuuuaauguaaauucuccauaacaauuuaggaaccgcccuuucuucuuuuauuaacaacuggccagccaugguggcucacgccuguaaucccagcacuuuuggagucugaggaggggggaucccaaggucaggagauagagaccauccuggcuaacacagugaaacccugucucuacuaaaaauccaaaaaauuagcugggcaugguggugggcgccuguauucccagcuacuccggaggcugaggcaggagaauugcuuuaaccugggaggcagagcuugcagugagccgagauugcaucacuguauuccagccucggugacagagugagacuccgucacaaaaaaaaaaaaaaaauguaguaggauccugggcuccgaggagucuuugcagagcggagcggucagagccacccugcguggccauuuuuuuuuuuuuuuuuuuuuuuuuguagauggggguagucuuccuauguuacccagacugggcucaaauuccugggcucaaacgaucgaucuccccaccucagccuccaaaagugcugggauggcagguguaagccacugugccuggcccccagcuaauuuuuaaauucaaugccauacuuuauagcagagagaaacccauaccucccuacuccauuuagaccccaguuccuuuaggucugucuguuucacacagccauuauggagaauuuucucccacccucaccccuaccccauacuccucaguucuucgaccccucucccauccccgucucagggcccaucacuuacucuucguccuccucugcccccugcagcgucugcuccuuccgcugcugccggcagauaaggaugcccguggcagccacagcaguagcaaugauggcggcgaugaugcccccgaugaugccgccuguggccccugcgccugcuguguugggggucucugcaaggagagggacagcgugagggggucuccaggaggaagccacagcuccuuauucca

SEQ ID NO: 15052 - RNA, 9505 nt, Homo sapiens
uggaauaaggagcuguggcuuccuccuggagacccccucacgcugucccucuccuugcagagacccccaacacagcaggcgcaggggccacaggcggcaucaucgggggcaucaucgccgccaucauugcuacugcuguggcugccacgggcauccuuaucugccggcagcagcggaaggagcagacgcugcagggggcagaggaggacgaagaguaagugaugggcccugagacggggaugggagaggggucgaagaacugaggaguaugggguaggggugagggugggagaaaauucuccauaauggcugugugaaacagacagaccuaaaggaacuggggucuaaauggaguagggagguauggguuucucucugcuauaaaguauggcauugaauuuaaaaauuagcugggggccaggcacaguggcuuacaccugccaucccagcacuuuuggaggcugagguggggagaucgaucguuugagcccaggaauuugagcccagucuggguaacauaggaagacuacccccaucuacaaaaaaaaaaaaaaaaaaaaaaaaauggccacgcaggguggcucugaccgcuccgcucugcaaagacuccucggagcccaggauccuacuacauuuuuuuuuuuuuuuugugacggagucucacucugucaccgaggcuggaauacagugaugcaaucucggcucacugcaagcucugccucccagguuaaagcaauucuccugccucagccuccggaguagcugggaauacaggcgcccaccaccaugcccagcuaauuuuuuggauuuuuaguagagacaggguuucacuguguuagccaggauggucucuaucuccugaccuugggauccccccuccucagacuccaaaagugcugggauuacaggcgugagccaccauggcuggccaguuguuaauaaaagaagaaagggcgguuccuaaauuguuauggagaauuuacauuaaaauaacguaagcuauugauuggcuauccauugcucuuuguaucacaaauuccagaaaccugaagauaaagaguaacacuggucaggcagggugggucaggcaggguggcuccugccucuaaucccagcacuuuguuuuguuuuuguuuuuguuuaagauggagucuuggucugucgcccuggcuggagugccaaggcgccaucucggcucacugcaaccuccgccucccugguucaagcgauucuccagccucagccucucgaguagcugggauuacagaugcgcgccaccacgcccggcuaauuuuuguauuuuuaguagagacggaguuucaccauguuggccaggcuacucuugaacuccugaccucaagugauccacccgccucggccucccaaagugcuaagaucacaagcaugagccacugcgcccagccaaugccagcacuuuggaaggccaaggcucuuguugcuagugguucgagaccagacugaacaucaaagugagacaccaucucuaaaaaaauaaaacaaacaaaauuagccaggcaaaguggugcacaccugugguccagcuccucaggaggcuggggugggaggucacuugagcccaggagcucaagucugcaaugagcuaugaucaugccacugcacucuagcccaggugacagagcaagacccuguaucuuaaaaaauaaaagacugggcacggugccucacaccuguaaucccagcacuuugggaagccaacccaaguagauaacuugagcucaggaguucgagaccagccugggcaacauggcgaaaccugucuacaaaaaaaauacaaaaauuacccagaccugguagcccaugccuguagucccagcuacuugggugggcugaggugggggugggggcauguggaggcugcagugagcuaugaucacaccacuguacuccagucuggccaacagagugagaccuuguaaaaaaaaaaaaagaaaagaaaaauagcucagagcagucugagguaugcgagcuaugcaaaauuuguuuuuuugagacaggaucucacucugucccucaggcuagaguucagugguauaaucugagcucacugcaaccuucgccuccugagcucaaccaaucuuccuaccgcagccucccaaguaaaugggaccacguaccaccacaccuagcuaguuuuuguauuuuuguagagacaggguuuugccauguugcccaggcuggucuugaacuccugaccucaggugauccacccaccucagccucccaaagugcucggauuacaggcgugagccaccaugcccagccuggaaucuguauuuaccacaagcucucuaaguuuuucugaugcacaggaaggucuguuacaccacugucuuaaucaucuaguuaguucaaaccaauaacuugcugcugaucuccucugugugcagcuccaugcugugacccacuguguccgagacggccuggagcucacaauauggaggaggagacaaaacugucuccagauagugaugguguagcaugaccagugaugggauagggcaguugagcaagcucugagaagccagagggggcaucugacccaggcuggauggucagguagggcuuccuggaagaggggacaucugagcugacagaaugcaucguaagcaccugucauuacuguaugcuuuggucuguggguguguagaaugagggacaggaacuuuaaccuaauuugagggacaggaaggcacuucauuuauucauucauucuuuucacaaauauuuacugaacuccucauaguggauucuggagacaccuugcugacgacccagaucuuucuuuuuuuucuuuucuuuucuuuucuuuuuuuuucuuuuugagguggaguuucgcucuuuuuucccaggcuggagugcaauggcgcgaucucggcucaccacaaccuccaccucccggguucaagcaauucuccugccucagccuccugaguagcugggauuacaggcaugcgccaccacgcccggcuaauuuuguauuuuuaguagggacaggguuucuccauguuggucaggcuggucucacacuccugaccucaggugaucugcccaccucggccucccaaagugcugggauuacaggcgugagccaccacgccuggcugaucuuucuuucuuuuuuuuuuuuuuuuuuuuuuaauuugagauggcaucucacucuauugcacaggcuggaguggagugaucucaucucacugcaaccucugccucccgaguucaagcgauucuugugccucagccuccugaguagcugggauuacaggcgugcaccaucaugcccagcuaauuuuuguauuuuuuggggagauggcauuucaccauguuggccaggcuggucucgaacugcugaccucagaugauccgcccgccucagccucccaaagugcugggauuacaggcgugagccacugcccccagcccaacacagaucuuuuuucccucccagagcucacaguggggcaugguaauuauaaauaacauuucaaguacaaauucaguaagugcccugagggggaaguacagcuagguauguccguguaacaggaauuccugauccacuggggaaaccugaaggcuuccgggaaaaagaggaauucauggaaugaauaaaaacucuuacuccaggcaagaaaagggggcaggggaaagggagacccagguagagggaacagcaugugccauaaccccggagucagagggaugccugggucuuaaucuccacuuguccuaccuccuaccccacagccuggagggaccucccuccuacaagccaccaaccccaaaagcgaagcuggaggcacaggagauggugagcacuuucccuggagcccaagcuauccccaccuccacacccaccccagggcugggaggggccuggcagggagaagcuggcuggguggugggggcaguuccugaccuccccgccccucucccacuacagcccucccagcucuucacucugggggccucggagcacagcccacucaagacccccuacuuugaugcuggcgccucaugcacugagcagguaggagcucaugggaagacaaagguggguugggggucuggguugaagggccaggggucaggccuggcaaaagaggucaaagacuaaaggucauaacucaaggucaaggguguguccccgguuggugcuuaaugcauugagauguguucaggauuccaugggggaggucaggggugaaaaggcccaaggucacaagguuagaauuuaaagucacuugggggcugggcacgguggcucacgccuauaaucccagcacuuugggaggccaaggcaggaggaucacuuggggucaggaguucgagaccagccugugcaacauggugaaaccccgucucuacucaaaacacaaaaaauuaguugggugugguggugcgagccuguaaucuuagcuacccggggcgcugaggaggaagaaucgccugaacccaggaggccgagguuacagugagcuaagaucacaccacugcacuccagccugggcaacagagcaagauuccgucucaaaaaaauaaauaaaaccaaauaaauaaaaucaccugggccgggcaugguggcucuggucuauaaucccaguacuuugggaggccaagguagcuggaccccuugagccuaggagcucgagaccagcgugggcaacaugggcuacccagcaacauuuugcgucuacaaaaauacugaauuuaccuggaugugguggcaaaugccuguaggcugaggugggcggauugcuuaagcccaggugguuggggcugugccacuacacuccagccugggcaucagggugagacccuaucucaaaaaaaaaaaaaaagaggaaaagucauuaggucaaugaaaauugauuaucuggucaggcaugguggcucacaccuguaaucccagcacuuugggaggcugagacgggcagaucaccugacgucaggaguuccagaccacccuggcuaacaaggugaaaccccuucucuacuaaaaacaaaaauaagccaggcaugggugacaugcuccuguaaucccagcuauucaggaggcugaagcaggagaaucgcuuggacccaggaggcagaaguugcaaugagcugagaccacgccacugcacuccagccuaggcaacagagcaagacuccgucucaaaaaagaaaaaggccgggugcgguugcucacgccuguaaucccagcacuuugggaggccaaggcagguggaucaccugaggucaggaguuccaagaccagccuggccaacauggugaaacccugucucuacuaaaaauuacaaaaauuagcugggcgugguggcgggcgccuguaaucccagcuacuugggaggcugaggcaggagaaucgcuuggacccgggaggcagagguugcagugagcccagauugcaccauugcacaacagccugggagacaagagcaaaacuccgucucaacaacaaaaaaaaacagaaugaaagaaaauugauuaucuacauuugcuggauacugugccugaagcugggacaagacaaaucaagucacuccccucaguggucuacuggaggucaggggucagacacugagguugcgcucaagguucaaaggacuguuuagagcccaagguuaaguauuugaggucaagacugaggugaaagguucauggggaaagauuugcagagaucgagugucaaaagugagucccaggauuaacagggugaguugcacgagcugggcuuuggguuaaggaagggcugaaugaaugucccagugcaauauggccucaggggacaaggagugagguggcaucuuguuggcauggggagagagcggucaggauuuuggggucaagagcagauugguaaucugugucgugcguaggaagugaucuugaguuccuguccucucucuaccuccaggaaaugccucgauaccaugagcugcccaccuuggaagaacggucaggacccuugcacccuggagccacaagccuggggucccccaucccggugccuccagggccaccugcuguggaagacguuucccuggaucuagaggaugaggagggggaggaggaggaagaguaucuggacaagaucaaccccaucuaugaugcucuguccuauagcagccccucugauuccuaccagggcaaaggcuuugucaugucccgggccauguaugugugagcugccaugcgccuggcgucucacaucucaccuguugaucccuuagcuuucuugccaaggaucuagugcccccugaccucuggccaggccacugucaguuaacacauaugcauuccauuugugaugucuaccuugguggcuccacuaugaccccuaacccaugagcccagagaaauucaccgugauaauggaauccuggcaaccuuaucucaugaggcaggagguggggaaggugcuucugcacaaccucugaucccaaggacuccucucccagacugugaccuuagaccauaccucucaccccccaaugccucgacucccccaaaaucacaaagaagacccuagaccuauaauuugucuucagguaguaaauucccaauaggucugcuggagugggcgcugagggcucccugcugcucagaccugagcccuccaggcagcagggucccacuuacccccuccccacccuguuccccaaaggugggaaagaggggauuccccagcccaaggcaggguuuucccagcacccuccuguaagcagaagucucaggguccagacccuucccugagcccccacccccaccccaauuccugccuaccaagcaagcagccccagccuagggucagacagggugagccucauacagacugugccuugauggccccagccuugggagaagaauuuacuguuaaccuggaagacuacugaaucauuuuacccuugcccaguggaauaggaccuaaacaucccccuuccggggaaagugggucaucugaauuggggguagcaauugauacuguuuuguaaacuacauuuccuacaaaauaugaauuuauacuuugaccaggucuugccuuuucugugggaugugaaggggauggggugagacaugaaggggaaugaggaaggagucuaagggcuugagagaaucagugaacuggggucaagagaguuaaagacaaaaacaaagggaccaaagauacaaaauaagaauugagagaguaaugagcaaaaauguaucaaucaaaaacaaaauuuuuuuuuuuuuugaggcggagucucgcucugucgcccaggcuggagugcaguggcaugaucucggcucacugcaagcuccaccuucugaguuaacgccauuccucugccucagccucccgaguagcugggacuacaggcgcccaccaccacgcccggcuuauuuuuuguauuuuuaguagagacgggguuucaccgcguuagccaagauggucucgaucuccugaccucgugauccacccgucucggccucccaaagugcugggauuacaggcgugagccacugcgcccagcccuaaaaacagaauguugaguaauggaauggggagggguccagggcaugcuguuuaaugaacauucauaauugcaacagcaguaugaugaaugggacaaagauaaaaauagcaauuggccagaugcaguggcucauuccuguaauuccagcacuucgggaaacugaggcgggaagcucgacugaguccaggaguuaagagaccagccugggaaacacagugagaccccgccucuacgaaaguuagccgggcgugguggcacgcaccuguaguucagcuacucuggaggcugagguaggaggaucgauugaggccagaaguucaaggcugcaguaagcuaugauggcgccacugcacuccagccugagugacagaguccaaccuugucuuuaaaaaaauaaaaauuaaaaaagcaguaacgaaaguauaagaggcucaaguuuaaugaauaaacggcaaguaaaaguagacuaaaggcaaaaucaugaauaauguuguaauaggagcccaaggcaugacggauaauaaaccugaaugaaugggccagaggcagagugaugaauaauggaaaaauagggaccgggggcaagggagguaacggacaggaguucauggauccaaaacaugauggcuaauuagagaagggccggaagaacgacgaaagugagcaggcaggcuggagcuaaaaguagucugggcaaugaagcucaaaugaauggggcagaggcaugauggguaaugggagaggaaugaaugggccaaagauagaagccgcagugacgcgaggaacaagaggcaugauggguaacgaaaggggugggucuaaggcaacuguuucgcuaagaggugaugagggcauuguggguaacgaggagcagcgcaggguucgcagaacagauuagaauucucccgaggcacucugggaagggccagcacuuccgguuuuaggucggcuacuccgaaccagagguggggugggggcccggcugccgcggugccuggugggacgcgaggccugaccuugcugccuagccgccucugccgcgcaacccaccuuuaccuguccuucgacccuggaacguuagccaaugagaguaccaagcugauacgccaccaaggucgaccccguacacgcuggagccaaucaaaaugcugcaagggucaaagccgaccaauuaucacagcaaccucgccgcggggcggaaucaaaagagggccuccuccaggagagaggcggggcgaugccucagcgggcguggcaaaaugcucagcacagaccaauggcggguuagcaccggaacccgcggcgacgcgagccaauaggcgcaggcgcugcgagccaaugggaagggugggaggggcgccguggcuacccugcgagugagaaccaauacaaaaggacauuucagggaaagugggcgggacuuuaugcacaaguccaaugggaagaccgagucuugacgcuggugggcgggccucagggcacacuaaaccaaugggcuagguggggcggggcgacggugguggcggcggcggcagcggguucgguugcgcguggcgcacggggugggagcggagcccaggccgggagcaggcgccgccgccagugagaaccggggccggagccgggugcggauuugcuggggcugagucgggggcgcgcgggcccugaccucugcccucugaccucuccccuagcaggcgaccauggggaacguguuggcugccagcucgccgcccgcagggccgccaccgccgccugcgccggcccucguggggcugccgccaccuccgcccucgccgccgggcuucacgcugccgccgcugggaggcagccugggcgccggcaccaguacgagucgaaguucggaacggacccccggggcugcaaccgccagcgccucaggggccgccgaggauggggccugcggcugccugcccaacccg

SEQ ID NO: 15053 - RNA, 1929 nt, Homo sapiens
ugcuuccugcucccgggggagggaagccugucccgccggggaucuacccuggccaccccuggcaccccaacuuccauccucgaauggggcgggggaagggagugcccagcccaagaagaccuagcucccuugagguguguguguguagggggggcgcauaaucccgaguccucccgccugggggacccucuggaacuccaccccgcagagcucaggcuccagcuggcugcaaguccuccuuaucccggcauccacccccaacaucucuugggagccagaaauagcccuaacucuucuuuaagaauaaggacuucccccguccuucagagcuccaggaucccaaacuaccuugccaguccuuguccccucagagacccagaaauacagcgccucaaacccuggcccuuugggaacacagacuuucaggccccuuggcgugaccaguuucaccagcccaacguccugcugccgcugucgugaaauucuuaaguuuugaacaagggacucugcaaauuucuguaucugguccugcccguaaagccccucugagugccagguccccaagcugccaagcugcuccucauccccucggagauuaaggaauacaguuccccaacuucugccuucugagaaucagaacaucaccccccccccccgcccccgccuuccugcccccuccccagguuucuggcugcccagucccuaaccucuuggggguccaaaugccccaaggcucguacccgccugugaggagauggaagcccagccucccaaccuuuuggcuucugcggggacccagacuuagcgucccccgcccuccucgcccccacugcccucccccgcgggugugaagaggagccgguggcgcaggcuggggccgggccgcugcccguuccgguaaagucucagccccagcggaagggguuaagguuggaggaagcgccaggaggggggaggcugcgagugagugacgggugcugacgugggggaggcagagcagcuggguugcggucaaguucugcgggaagggauuucccccagcaggcagcugaggcagaaguguuugccuugggggagagucggagagggaggguguggggagggccuggggcuggagacuggugggccggguggccucuggcaagcacccugcuuuucaacagcauggacagcucaccacugggggcagagacugucugauuaagcccauuucauagaugaccccccagagguacccagaaggggagggaacuagguuuuauuagcucuuuauaaucuaggccacuuucuccugcuagggcucuggagauggccugcaaccacccugggagcucugcucaaacauuacccauuuccaugcauugagcacuuacuguuugcccagcccuguucugugcacuguauuaauacauguguacaagaucucacugaauccuaauugugauaggugcuauuaugagacccaguuuccaaauagggaaacugagacucagggacaugaaaucacucagugggccaguggcggagcagcccucugcuacuucucugcagaaacaggccuguucaucucuaccugugguuuccaggccccaaacuaauucucacagaagugcuuuguauaaaucaugucauuucuuccucccagagacccucacacgcgaugguuccuguuuuuacagagagggaaacugaggcacagagggaguagaacguggccacgcugagauuccaacccaggucaauagaauaauaagaaucaugaugaucaauugcagugagugcuuacuaugugcuaggcacagaccaaacccucccgugcaggacuucucagcagccucacaaacauguucuucagacugcaggugauaaaccauggggguugugaaaucaauuuaggggaucuucaaauuaauguagugggcugugacc

SEQ ID NO: 15054 - RNA, 12483 nt, Homo sapiens
gcgcuaggauuaugcaaauaagcaggccucgggcccaggauccaguccgaacuagcgcccuccacccccagcgcaucccaguuuuguaaggcgcguuccugccccgcacacgcacgcgcgaacccuucagcuucuuguuccuuugggccgcgggcuguaccaaguaaacccaggcagcgaggggcaaagcacggcgccccccgcgcgggucucgucgacggcccgacgcgcauagccccucuucccacagcgcuacaggacuaguccgucucgccgcgcaagcgcccuaggcucuucacgcccccugcgcgcuguccuacccuacuugcgacgcaggcgcagaggcugggcgugcagccgccgccgcagagccggagcgggggccgccggcgccggugagugucccgggcaggggugcgcgaggcaugccgggaagcgggcgcuacggccccgcugcaugaugggagcgacgacucccgucaccggggagccggcggucuggggccguggugacccgagggcuucuuuuucucccccuacgcguuugugccgcccuggggcauccugggagaaccgagcgcuccgccuugaagcgcugugggagucgguccgcuagucguaggccuggugcauccugggaaagagugucccagauccuugucgagaccgguuccuuuuaucccacaccugccgcugaccguccuggaggcuuggagcgcuuccacacggggagucugggaagguggucgcuauaggccuaaggcauccugggaagaacugccacaacgaauugugggaacuggccguuauugucccguaguggaagguuuugcccuggucucuuugcucgagcauuggaacgggugccuauuguguucacgcggggcaucuugggaauugacugcuauaggcccagggcauuguggggucuccagcacuguguuugccuuucaguuuggcugccauaggcgugguaggagugggacuugugaaccaagggauggcccuaccugacgucuggaauacucuggaaggggccuugugugacgugggcuuggaaaaguguaggcugaugggcauugucuccugguaacuucagggaaugucuugauugucccaggugugugguugccguauaaaauauacaaugucuaguuaaauuugaauuucagauaaacaauuauauccaaaagauacaaccuuuuagaaaaguaugucccaaauaucacauggaacauagcuauauuaauucuuugggcuaguugcagugauaccaauacuuugggaggcuaaggcaggaggaucgcuugagaccaggaguucaagaccagccugggcaauauagugagacccccgucucuacaaaaaaaaaaaaaaaaaaaaaaaguaaaaauuaagccuggcaugguggcgcauaccuguagucccagcugcucuccuaggggcuaguaggguaccuugagcacaggaguuugagguuacagugagcuaaccucccaaccugguuaugggggaguacaugaguuaaggccuggaagccccuuuccuacagaucacccuacugcacuccagccugggcaacugagcgagacccugucucuuaaaaaauauaaauaaguaggcugggcgcgguggcucacgccuguaaucccagcacuuugggaggccgaggcggguggaucacgaggucaggagaucgagaucauccuggcuaacacggugaaaccccaucucuacuaaaaauacaaaaaauagucgggcgugguggcaggcgccuguagucccagcuacucggaaggcugaggcaggagaauggcgugaacccaggaggcggagcuugcagugagccgagaucgugccacugcacuccagccugggcgacagagcaagacuccgucucaaaaaaaaaaaaaaaaaaaaaaaaaaagccgggcaugguggcacgcgccuguagucccagcuacuugggaggcuggggcaggauaaucgcuugaacccaggaggcagagguugcagugagccgagaucgcgcuacugcgcuccaaccugggcgacagagugacacuccgucccaaaaaagaaaauuaaauaaauaaauaaauaagggccaggugugguagcucaugccuguaaucccagcacuuugggaagugggaggccaaggcaggaggauuguuugagccaggaauuugacagcagccuucgcaacauagugagacaccaucuccgcaacaaaaacccaaaaacaaacaaaaaaauuaauuggaugucuucuguuuuuauuugcuaaaucuggcaaucuuaucuugguauaaaguagaauucccaaauuagauggggcccuguaggcaauaggguaucauuagaauucuccucugccaauuaugaaaucugucuuuaaaagccaagauuuaggugcuuucuuuaggaaguugcccugccaaugaugccaaugguccuuugccccagccaccuccagguuucaaucugaagcuuuucucuuuaguccccagcauuaaacuugacauccagacuuugaagggaccauguauuuuccaccauuguauccccagugcaugggccuuggcauguaagagauauagcugaggcugcaucaacuggcccugcuugguucucuacugucagggaguacaguggaagacaguagugguguguguguguggugggguugguggggggcgggggcgguccguuggugaagagggagagagagaagucacagaaggcuuccuggcagaggcaguauuucagcgggcaagaaguauagagguucuuauguuuguggugggcuuugaagggugaaaaggaguucuccaggccaaaaagggggaaggagggcugggcgugguggcucuugccuguaaucccagcacucugggaggccaagguaaauggaucaccugaggucaggaguuugagaccagccuggcugacauaaugaaacccugucucuacuaaaaauaccaaaaaauuagccgggcaugguggugguggcugccuguaaucccagcuacuagggaggcugaugcaggguagagguugcagugagcugagaucgcgcuacuguacuccagccugggcaacaaagugagacuccaucucaaaaaaaaaaaaaaaaaggaggaggaggacauucuugacagcaacaguggguguacuaagacccacagaugugaaaaggccuugugugcacagggagagaugagaggucuggaacaucuggaguuuauagaggggcaggggugggaguaguaauggccacucuugauggaauaccagccacacaccagcaauuucuaucagugagccuacugaaucuucagaaaaaccuuuugagcugagaaaucauuuuaugaaaggucuggcuuccaauccuaguucauccacuuaccagauggugaccuugggcuacucacuuaucaccucugugucuguuuccucaucuguacaaaggagauaauucccagucuaguuauggggaguacgugaguuaaggccuggaagccccuuucuuccagagaaggaaacaggcuagagaaguuaaguucuuugcuuggugcuacacagcuagaguguggcaaaccuagacacuaucuugccaauugauacagaacuaaggcugauaaucacaaacuaguauagccauaccaauuguuuaaauauuaaaauacuuccagauggguuggugugucacugcuacacaaguacucccugucccuaacugccacuuuggaccccccuugugguauuauauauauaaauauauugguuuucauccacaguuccuggcugguaacuccuacagccuuuguuacagucucuuguuauaauguuguguaccuuaggccuggggcaggucugaagaaacagaaucucucugaccuccuccugcccuccauuuccugccccagggcaagacucuaaucuuccccaccuucuugauuguuggucuuaagacacuuuucagagaaguccaugcccaaugcugcugucuuaaagccuccguaaaaacccaagaggacuggguuuggagagcuuccgcauagcuaaccaccugaggguuccuguaggguagcaccccagggagggcgugaagcucccugccccuucccuuauaccuugcccuacacaucucuucaucuuuguucuuugcaauauccucuauaauaaaccaguaaaucuaaguaagcauuuccuugaguucugugagcagcuccagcaaaaauuuuuuuuuuguaagaugggucauccaggcuugagugcaguggcaaggucacggcucacugcagccuugaccuuccaggcucaauuuauccuccugccucagccucucagguagcugggacuauaagcacaugccaccacaccggcuaacuuuuguaauuuuuuuuuuuuuuuuagagacaaguuugccauguugccuaggcuggugucaaacuccugagcucaggugaucugcccaccucggccucccaaagugcugggauuacaggcaugggucacugcgcccggccuuauuuuuauuuuuuuaaaaaagucgggugugguggcucacgccuguaaucccagcacuuuggagggcugaagugggcagauugcuugagcucugggcaacauggugaaacccugucucuuccaaaaauacaaaaauuagcuggguguggggacagcguuggaauggaaucggaggggacaccuagcuguugucugcuguguaguguguggggaaaaagccccacacauuuggucacagaauucuguguugaugauuguugugauagugugagaguagaggaaaaacacaguuugaggguuuuuuuuccccauaacacuuccccaaccccagaccuccccaugguccagcaacuaaaggguuaaggccugguauccgucccgcuccacucucaguucugauuggugcccacaccaguccccacuguugaauauuuggagugucaccucucccuaccccacugaauaagaaccagaaggcagccuuguugcccacaugcggaaauuaagaccuagagagggggacgggugcgguggcucaugccuauaaucccagcacuuugcgagguugaggcauguggaucaccugaggucaggaguucgagcccagccuggccaacauggugaagccccaucucuacuaaaaauacaaaauuagccgggcgugaggacgcacacuuguaguuccagcuacucgggaagcugagguaggagaauugcuugagccugggagguggagguugcagugagcugagaucacaccacugcacuccagccugggcaacagagagagacucugucucaaaaaaaaaaaagaccuagagaggggcagggcuugcagucaagacccuguagacagucagggacagagcugggguccucugugccccaugccagcagugagcacacaguugggcuugguggggaugggugcuauguaaaaauuuauugaaucaucacaggucuuuccuuucccccuauccagcaucccucucuaccugccaacauccuguauuagagaacuuguggccggagguguggcuguggagagcuggccggggagggacgcugcucagcugcugcucugcuccugucuccuguccccucccccggucaugacagagacccgugagccagcugagacugggggcuacgccagcuuggaagaagaugaugaagaccuuuccccagguaagguggccuuagaggugguggcgucggcuugacugucauccuggcuuaggguuuggcccccacugggaaauguugauggggaguggcugcuugucuugcuagggguucuauucugacugagacugcuuguccuaguaggggaucucuuccagucgggacuucuggggacuguagauugacuggggucgcucuccuugcuagagguucuagauuggcuaugauuuccuucuuugcuggggguucuagaucggcuaugagcuuucuccuugcuggaggcucuaggucgacuguaaccacucugcuuauuggggcuucuagaucggcugugaucucucuccucgcuggagcuucuagauugucugcgcucucucuccuugcuggggcuucuccaucgucugcgaucucucucuuugcuggggcuucuggauugucugugcucucucuccucgcuggggcuucuagauuggcugcgaucucucuccuuguuggggcuucuagauugucugcgcugucucuccuugcuggggcuucuagaucgucugugaucucucucuuugcuggagcuucuagauugucugcacugucucuccuugcuggggcuucuagaucgucugugaucucucucuuugcuggggcuuccaaguuggcugugaucucuuuccuugcuggggcuucuagaucggcugcgaucucucgccuuguugggacuucuagaucggcuaugaucucuugccuuguugggacuucuagaucggcugcgaucucucgccuuguagggacuucuagaucggcugcaaucucucgccuuguugggacuucuagaucggcugcgaucucucgccuuguagggacuucuagaucggcugcgaucucucgccuuguugggacuucuagaucggcugugaucucucugcuuguuggggcuuccugauugacugcgaccacucuccuuccuggggcugcuagauccccugugaucucucucuuugcuggagcuucuggaauggcuaugacuucuuuccuugcugggguuucuagaccaguugugacuucuuccucuucuggggguucuagauugguuuugacuuuuccccuugcuguggcuucuagacuggcugugucuucccaucuggcucagaauucccuuccgggugcgacuucuugcccugcuaugguuucucuuccaacugugacuucucacucugcugugcguccucuucugacugccacuucuugaccuucuggggcuucuagauuggcugugacuuugcggccugcugcgggugcuggccugguuauaacucuugacccugcuggacauuucaguggggcuguaacucuuuucccuacuggggaugaucaucugaccguagcucuucaccuuccuugaugaggauggagauggguugucacucuucuccuuggagggaauuccagucgggguuugacacuuggcuguacugggaguuacagccagcucggaacuccucccuauaccugagccuccuggugggcgguaacucuucuugcucagauuucuaggcuggcugucacuccuuucccuguugcugguucuaggccggccguaacucuuuccccggcucccuuuuugcugugaagugggaguucucacccugcuggccaugccuggucuggcaccaugaguucuuauccugccaggagugcuggcccugcugggugaccucuuggagcugcggcuuccccuucugccagguguccuaccccggcugugugugccccuccgcugguggcaucucacgucgcuggccuugcuggcuuugcugguccuggugucggugcucacccugcuggguguucuugcuuugcugcggacucgggaccugcugcugggccgguuagaaggggcucuuuuuguacuggucgauuugguggacuuggaacugcuugggcucaugacugaguuacgggaugucgcugguuuggugggcacuaaggaucuguuggguguugcugauuugguggacuucaaggaggcaggaggcuugggauccgcagugggcauggaggauccacugggugccagagacauacugggcuuugaagaucucuuaggugaagacauggugggcgcaaaagggcuugugguccuggaagucacaguagacaugaaacaccugguagccguggacgaugaccugauugccugucacaggccaacugugugaaguaauagugggcauugaagacucuggagggugagugguaugaagucagaggugggaggagagaggggaggggucccagccugaggcuggagauauuuccucugguuugcagccauucagcagaugucuucugaggcugacucaugcccagcauugcuggggacacagagauggggcagacccaggcccugccuucaaggagcccauagucaguggguggggaggggggccacugcccagaguggucagggugugauggagagcagugcaggggccggggagcccauacgagagagacacugaccgcuuggggagucagcgaggacuucacagaggaggugacaugagcuuggcuuuaaaaaggagcaggaguuuugccaguagagaaagaaagggucaggcugggcgcgguggcucacaccuguaaucccagcacuuugggaggcugaggcaggcagaucaccugaggucaggaguucaagaccagccuaaccaacaaggugaaaccccaucucuaccaaaaauauaaaaauuagccaggugugauagcacacgcuuguaaucccagcuacuugggaggcugaggugggaggaucgcuugaaccuuggaggcggagguugcagugagccaagaucacgccauugcacgccagccugggugacagcgagacucucucucgaaaaaaaaaaaaaugaacgggucaaccaggugggcgaggagcagaggccaaggcuuuggggagggagaucagggucuuggggccacuaucauccacucacccacacguccucugcugcggaccccaagaucauaccugcccuugaggaguucccagucagauaagggagauacccuggggggcagcugacugcagucagcuucuagggcaguaacaggaggaggugcuggggcaggggaagcuggagagagaccuggcugggagccuggggcuucagggugguggcuucacagaggacagaguuugugcugggucuugaaggaugaguagggggucaccagguggauagaguggggaacagcccauaccaaggccucaggaaacgauuguuaaauggcaggaacuaguaggagagagcugcagggacggauguucagaaggaaagaguuauaaccuguucugggcuggugaugcuggggacccagcaggagggugguaaaaaaagugacuggcugccugggaugaggaggucugggacggccucaccaaagaggaaggccucccacuggguccuaaaggauggugggaaaaacuagggcaggacauucccaccagagggaggaacagugugugugaagccucagaaaagguuugucaaauuccaugcagagauauccaugccauaaauaugucauaaguacuuucuuugcacaaaggaaguguuuuagaugcuggggccacagcagugaaccagacaaagucccagcucucggggacaggcaguaaacaaacacacaaguaaauguugaaugcagugagucagaagauggagaaaaaugagccggcugcgguggcucauaccuauaaucccagcacuuugggaggcugagaugaguggaucacuugaggucaggaguuugagaccagccuggccaacaaggugaaaccccgucucuacuaaaaauacaaaaauuaccugggcaugcuggugcgccccuguaaucccaguuacuugagaggcugaggcagaagaauugccugaacccaggaggcggaguuuccagugagcugagaucacgccacugcacuccagccuggaugacagagcgagacucuaucucaaaagaagauggagaaaaaucaagcagaguaaggggcguagggagugcuggggaguggccagggcgucacugagaaggugacacuugagaagagacauggaauggagagugacaucggcagaaaggguggcaaagacccugaggcagguaugggccugggguguuggaaggugaggagccugguaugaagagccuguggccacugugaugacaggagcaagggcggagcacagggugcaguagcaggauccucuggguucugggagaaacugaggaauggggcugggauggauacaaggugaggcuuuuggcaggcuccuaccaccaaggccgaagaagcugguacuucccacaccguggucacagggaccccauccccaaccauuacucugugugugcgcccccauaauggcagcugaugucgcccuuuuccguauaucaacuauaaauuuuuccccuuuucuuuuuuuuuuuugggaacggagucuugcucugucacccaggcuggagugcagugguucaauauuggcucaucgcaaccuccgccucccggguucgagcaauucuccugccucagaguccugaguagcugggacuauaggcacccaccaccccacacuuggcuaaauuuuguauuuuuaguagagacgggguuucaccauguugcccagagugggucaugaacuccugaguucaggcaauccgcccaccucagccucccaaagugcuagauuacaggccuuuuucuuuaaaccuaaacuuguccuaggccuguccuugauaacugugaaaucacaguaauauaucuuaccuauaaauaaauguuuuaauucaccuaacucucucucucucucucuccauggccacagauauaaaaguacaucuguguguaugcauguguuuuaauuugcacaaauaccuuuucaaaugguugucucccuaaaaugauccagugucagccauggcccagguucagcuuuuccugccagagcuguguaaccacaggggagugagucgucuagccucccugugccucaguuuccacauccaucaacuggggauaguaauaguaccacccucaaaggguuguugaggauuuagugaguuaauguauaagaacagggcuccuacaauagcaaggaugcuguuguuacugguggguuuuuacuacuccggcuuuguccuuccuaaaugccucccaccccaccuccccauggaguuuuuguuuucuuuugcaaucaaucgaaagaaucaaauaauuuuuuuuuuuuuuuuuugcuuuuuucuaagacagcagagucuugcucugucacccaggcuggagugcaguugugugaucucggcucacugcaaccuccgccuccuggguugaagcaguucuccugccucagccucccgaguagcugggauuacaggcgcccgccaccacacccagcuaauuuuuguauuuuuaguagagacgagguuucaccauguuggccaggcuugucuugaacuccugaccucaugaucugcccaccuuggccucccaaagugcuaggauuacaggaguaaucuaccgcgcccggccaaaaaaauucuuuuuaaguggugaggucucacucugucacccaggcuggaagggaguggcgcaaucauggcucaaaugcagccuggaacuccucggcucaagugauccucccgccucagccucccgagaagcugguacuacagguaaugcaucaccaggccuggcuaauuuuuuaauuuuuuguagagacggagucuugcuauauugcccaggcuggucucaaacuucugggcucaagugaucuucccaccuuggccacccaaaagugcugggauuacaggcauaagccacugugcccaguccugucccaugcaguucuuggaagacauucauuugcuugacacaaagauacagggaaucuacugggugccagucuuguucugugccauggggacucaucuguggggaagggaaggguagugucuaggcuauccuugucauacuauggcaagucugaauguggggauucagggaggggacagcuuggccuagcccucuuuccucugauaccacugucuuccccugucugucccccuccaggccccgagcauuccucugauucagaauacacucucucagagccggacuccgaagaggaagaagaugaggaggaggaggaagaggagaccacugacgauccugaauaugauccuggcuacaaggugaagcagcgccuuggcgggggccgugguggcccaucccgccgggccccccgugcagcccagcccccggcccagccuugccagcucuguggccgcucaccccuuggggaggccccaccgggaaccccacccugccggcucugcugcccugcuacagccccccaggaagcaccagccccugaaggcagggcccucggggaggaagaggaggaaccaccucgggcuggggagggccgaccagcugggcgggaggaggaggaggaagaggaggaggagggaaccuaccacuguacggaaugugaggauuccuucgacaaccugggggagcugcacgggcacuucaugcugcaugcccggggugagguguaggcagagcccccauacggggagcuuggcagaagggguggggugggaggagggggcugaggaaauugggguugugacaguggucaugggggaugggguacugccggucuguguugucuuagaaguagaugugugauggccagaauaaaa

SEQ ID NO: 15055 - RNA, 12483 nt, Homo sapiens
uuuuauucuggccaucacacaucuacuucuaagacaacacagaccggcaguaccccaucccccaugaccacugucacaaccccaauuuccucagcccccuccucccaccccaccccuucugccaagcuccccguaugggggcucugccuacaccucaccccgggcaugcagcaugaagugcccgugcagcucccccagguugucgaaggaauccucacauuccguacagugguagguucccuccuccuccucuuccuccuccuccucccgcccagcuggucggcccuccccagcccgaggugguuccuccucuuccuccccgagggcccugccuucaggggcuggugcuuccuggggggcuguagcagggcagcagagccggcagggugggguucccgguggggccuccccaaggggugagcggccacagagcuggcaaggcugggccgggggcugggcugcacggggggcccggcgggaugggccaccacggcccccgccaaggcgcugcuucaccuuguagccaggaucauauucaggaucgucaguggucuccucuuccuccuccuccucaucuucuuccucuucggaguccggcucugagagaguguauucugaaucagaggaaugcucggggccuggagggggacagacaggggaagacagugguaucagaggaaagagggcuaggccaagcuguccccucccugaauccccacauucagacuugccauaguaugacaaggauagccuagacacuacccuucccuuccccacagaugaguccccauggcacagaacaagacuggcacccaguagauucccuguaucuuugugucaagcaaaugaaugucuuccaagaacugcaugggacaggacugggcacaguggcuuaugccuguaaucccagcacuuuuggguggccaaggugggaagaucacuugagcccagaaguuugagaccagccugggcaauauagcaagacuccgucucuacaaaaaauuaaaaaauuagccaggccuggugaugcauuaccuguaguaccagcuucucgggaggcugaggcgggaggaucacuugagccgaggaguuccaggcugcauuugagccaugauugcgccacucccuuccagccugggugacagagugagaccucaccacuuaaaaagaauuuuuuuggccgggcgcgguagauuacuccuguaauccuagcacuuugggaggccaaggugggcagaucaugaggucaggaguucaagacaagccuggccaacauggugaaaccucgucucuacuaaaaauacaaaaauuagcugggugugguggcgggcgccuguaaucccagcuacucgggaggcugaggcaggagaacugcuucaacccaggaggcggagguugcagugagccgagaucacacaacugcacuccagccugggugacagagcaagacucugcugucuuagaaaaaagcaaaaaaaaaaaaaaaaaauuauuugauucuuucgauugauugcaaaagaaaacaaaaacuccauggggagguggggugggaggcauuuaggaaggacaaagccggaguaguaaaaacccaccaguaacaacagcauccuugcuauuguaggagcccuguucuuauacauuaacucacuaaauccucaacaacccuuugagggugguacuauuacuauccccaguugauggauguggaaacugaggcacagggaggcuagacgacucacuccccugugguuacacagcucuggcaggaaaagcugaaccugggccauggcugacacuggaucauuuuagggagacaaccauuugaaaagguauuugugcaaauuaaaacacaugcauacacacagauguacuuuuauaucuguggccauggagagagagagagagagaguuaggugaauuaaaacauuuauuuauagguaagauauauuacugugauuucacaguuaucaaggacaggccuaggacaaguuuagguuuaaagaaaaaggccuguaaucuagcacuuugggaggcugaggugggcggauugccugaacucaggaguucaugacccacucugggcaacauggugaaaccccgucucuacuaaaaauacaaaauuuagccaagugugggguggugggugccuauagucccagcuacucaggacucugaggcaggagaauugcucgaacccgggaggcggagguugcgaugagccaauauugaaccacugcacuccagccugggugacagagcaagacuccguucccaaaaaaaaaaaagaaaaggggaaaaauuuauaguugauauacggaaaagggcgacaucagcugccauuaugggggcgcacacacagaguaaugguuggggauggggucccugugaccacggugugggaaguaccagcuucuucggccuuggugguaggagccugccaaaagccucaccuuguauccaucccagccccauuccucaguuucucccagaacccagaggauccugcuacugcacccugugcuccgcccuugcuccugucaucacaguggccacaggcucuucauaccaggcuccucaccuuccaacaccccaggcccauaccugccucagggucuuugccacccuuucugccgaugucacucuccauuccaugucucuucucaagugucaccuucucagugacgcccuggccacuccccagcacucccuacgccccuuacucugcuugauuuuucuccaucuucuuuugagauagagucucgcucugucauccaggcuggagugcaguggcgugaucucagcucacuggaaacuccgccuccuggguucaggcaauucuucugccucagccucucaaguaacugggauuacaggggcgcaccagcaugcccagguaauuuuuguauuuuuaguagagacgggguuucaccuuguuggccaggcuggucucaaacuccugaccucaagugauccacucaucucagccucccaaagugcugggauuauagguaugagccaccgcagccggcucauuuuucuccaucuucugacucacugcauucaacauuuacuuguguguuuguuuacugccuguccccgagagcugggacuuugucugguucacugcuguggccccagcaucuaaaacacuuccuuugugcaaagaaaguacuuaugacauauuuauggcauggauaucucugcauggaauuugacaaaccuuuucugaggcuucacacacacuguuccucccucuggugggaauguccugcccuaguuuuucccaccauccuuuaggacccagugggaggccuuccucuuuggugaggccgucccagaccuccucaucccaggcagccagucacuuuuuuuaccacccuccugcuggguccccagcaucaccagcccagaacagguuauaacucuuuccuucugaacauccgucccugcagcucucuccuacuaguuccugccauuuaacaaucguuuccugaggccuugguaugggcuguuccccacucuauccaccuggugacccccuacucauccuucaagacccagcacaaacucuguccucugugaagccaccacccugaagccccaggcucccagccaggucucucuccagcuuccccugccccagcaccuccuccuguuacugcccuagaagcugacugcagucagcugccccccaggguaucucccuuaucugacugggaacuccucaagggcagguaugaucuugggguccgcagcagaggacgugugggugaguggaugauaguggccccaagacccugaucucccuccccaaagccuuggccucugcuccucgcccaccugguugacccguucauuuuuuuuuuuuucgagagagagucucgcugucacccaggcuggcgugcaauggcgugaucuuggcucacugcaaccuccgccuccaagguucaagcgauccucccaccucagccucccaaguagcugggauuacaagcgugugcuaucacaccuggcuaauuuuuauauuuuugguagagaugggguuucaccuuguugguuaggcuggucuugaacuccugaccucaggugaucugccugccucagccucccaaagugcugggauuacaggugugagccaccgcgcccagccugacccuuucuuucucuacuggcaaaacuccugcuccuuuuuaaagccaagcucaugucaccuccucugugaaguccucgcugacuccccaagcggucagugucucucucguaugggcuccccggccccugcacugcucuccaucacacccugaccacucugggcaguggccccccuccccacccacugacuaugggcuccuugaaggcagggccugggucugccccaucucuguguccccagcaaugcugggcaugagucagccucagaagacaucugcugaauggcugcaaaccagaggaaauaucuccagccucaggcugggaccccuccccucucuccucccaccucugacuucauaccacucacccuccagagucuucaaugcccacuauuacuucacacaguuggccugugacaggcaaucaggucaucguccacggcuaccagguguuucaugucuacugugacuuccaggaccacaagcccuuuugcgcccaccaugucuucaccuaagagaucuucaaagcccaguaugucucuggcacccaguggauccuccaugcccacugcggaucccaagccuccugccuccuugaaguccaccaaaucagcaacacccaacagauccuuagugcccaccaaaccagcgacaucccguaacucagucaugagcccaagcaguuccaaguccaccaaaucgaccaguacaaaaagagccccuucuaaccggcccagcagcaggucccgaguccgcagcaaagcaagaacacccagcagggugagcaccgacaccaggaccagcaaagccagcaaggccagcgacgugagaugccaccagcggaggggcacacacagccgggguaggacaccuggcagaaggggaagccgcagcuccaagaggucacccagcagggccagcacuccuggcaggauaagaacucauggugccagaccaggcauggccagcagggugagaacucccacuucacagcaaaaagggagccggggaaagaguuacggccggccuagaaccagcaacagggaaaggagugacagccagccuagaaaucugagcaagaagaguuaccgcccaccaggaggcucagguauagggaggaguuccgagcuggcuguaacucccaguacagccaagugucaaaccccgacuggaauucccuccaaggagaagagugacaacccaucuccauccucaucaaggaaggugaagagcuacggucagaugaucauccccaguagggaaaagaguuacagccccacugaaauguccagcagggucaagaguuauaaccaggccagcacccgcagcaggccgcaaagucacagccaaucuagaagccccagaaggucaagaaguggcagucagaagaggacgcacagcagagugagaagucacaguuggaagagaaaccauagcagggcaagaagucgcacccggaagggaauucugagccagaugggaagacacagccagucuagaagccacagcaaggggaaaagucaaaaccaaucuagaacccccagaagaggaagaagucacaacuggucuagaaaccccagcaaggaaagaagucauagccauuccagaagcuccagcaaagagagagaucacaggggaucuagcagccccaggaaggagaguggucgcagucaaucaggaagccccaacaagcagagagaucacagccgaucuagaagucccaacaaggcgagagaucgcagccgaucuagaagucccuacaaggcgagagaucgcagccgaucuagaagucccaacaaggcgagagauugcagccgaucuagaagucccuacaaggcgagagaucgcagccgaucuagaagucccaacaaggcaagagaucauagccgaucuagaagucccaacaaggcgagagaucgcagccgaucuagaagccccagcaaggaaagagaucacagccaacuuggaagccccagcaaagagagagaucacagacgaucuagaagccccagcaaggagagacagugcagacaaucuagaagcuccagcaaagagagagaucacagacgaucuagaagccccagcaaggagagacagcgcagacaaucuagaagccccaacaaggagagagaucgcagccaaucuagaagccccagcgaggagagagagcacagacaauccagaagccccagcaaagagagagaucgcagacgauggagaagccccagcaaggagagagagcgcagacaaucuagaagcuccagcgaggagagagaucacagccgaucuagaagccccaauaagcagagugguuacagucgaccuagagccuccagcaaggagaaagcucauagccgaucuagaacccccagcaaagaaggaaaucauagccaaucuagaaccucuagcaaggagagcgaccccagucaaucuacaguccccagaagucccgacuggaagagauccccuacuaggacaagcagucucagucagaauagaaccccuagcaagacaagcagccacuccccaucaacauuucccagugggggccaaacccuaagccaggaugacagucaagccgacgccaccaccucuaaggccaccuuaccuggggaaaggucuucaucaucuucuuccaagcuggcguagcccccagucucagcuggcucacgggucucugucaugaccgggggaggggacaggagacaggagcagagcagcagcugagcagcgucccuccccggccagcucuccacagccacaccuccggccacaaguucucuaauacaggauguuggcagguagagagggaugcuggauagggggaaaggaaagaccugugaugauucaauaaauuuuuacauagcacccauccccaccaagcccaacugugugcucacugcuggcauggggcacagaggaccccagcucugucccugacugucuacagggucuugacugcaagcccugccccucucuaggucuuuuuuuuuuuugagacagagucucucucuguugcccaggcuggagugcaguggugugaucucagcucacugcaaccuccaccucccaggcucaagcaauucuccuaccucagcuucccgaguagcuggaacuacaagugugcguccucacgcccggcuaauuuuguauuuuuaguagagauggggcuucaccauguuggccaggcugggcucgaacuccugaccucaggugauccacaugccucaaccucgcaaagugcugggauuauaggcaugagccaccgcacccgucccccucucuaggucuuaauuuccgcaugugggcaacaaggcugccuucugguucuuauucagugggguagggagaggugacacuccaaauauucaacaguggggacuggugugggcaccaaucagaacugagaguggagcgggacggauaccaggccuuaacccuuuaguugcuggaccauggggaggucugggguuggggaaguguuauggggaaaaaaaacccucaaacuguguuuuuccucuacucucacacuaucacaacaaucaucaacacagaauucugugaccaaauguguggggcuuuuuccccacacacuacacagcagacaacagcuagguguccccuccgauuccauuccaacgcuguccccacacccagcuaauuuuuguauuuuuggaagagacaggguuucaccauguugcccagagcucaagcaaucugcccacuucagcccuccaaagugcugggauuacaggcgugagccaccacacccgacuuuuuuaaaaaaauaaaaauaaggccgggcgcagugacccaugccuguaaucccagcacuuugggaggccgaggugggcagaucaccugagcucaggaguuugacaccagccuaggcaacauggcaaacuugucucuaaaaaaaaaaaaaaaauuacaaaaguuagccggugugguggcaugugcuuauagucccagcuaccugagaggcugaggcaggaggauaaauugagccuggaaggucaaggcugcagugagccgugaccuugccacugcacucaagccuggaugacccaucuuacaaaaaaaaaauuuuugcuggagcugcucacagaacucaaggaaaugcuuacuuagauuuacugguuuauuauagaggauauugcaaagaacaaagaugaagagauguguagggcaagguauaagggaaggggcagggagcuucacgcccucccuggggugcuacccuacaggaacccucaggugguuagcuaugcggaagcucuccaaacccaguccucuuggguuuuuacggaggcuuuaagacagcagcauugggcauggacuucucugaaaagugucuuaagaccaacaaucaagaagguggggaagauuagagucuugcccuggggcaggaaauggagggcaggaggaggucagagagauucuguuucuucagaccugccccaggccuaagguacacaacauuauaacaagagacuguaacaaaggcuguaggaguuaccagccaggaacuguggaugaaaaccaauauauuuauauauauaauaccacaagggggguccaaaguggcaguuagggacagggaguacuuguguagcagugacacaccaacccaucuggaaguauuuuaauauuuaaacaauugguauggcuauacuaguuugugauuaucagccuuaguucuguaucaauuggcaagauagugucuagguuugccacacucuagcuguguagcaccaagcaaagaacuuaacuucucuagccuguuuccuucucuggaagaaaggggcuuccaggccuuaacucacguacuccccauaacuagacugggaauuaucuccuuuguacagaugaggaaacagacacagaggugauaagugaguagcccaaggucaccaucugguaaguggaugaacuaggauuggaagccagaccuuucauaaaaugauuucucagcucaaaagguuuuucugaagauucaguaggcucacugauagaaauugcugguguguggcugguauuccaucaagaguggccauuacuacucccaccccugccccucuauaaacuccagauguuccagaccucucaucucucccugugcacacaaggccuuuucacaucugugggucuuaguacacccacuguugcugucaagaauguccuccuccuccuuuuuuuuuuuuuuuuugagauggagucucacuuuguugcccaggcuggaguacaguagcgcgaucucagcucacugcaaccucuacccugcaucagccucccuaguagcugggauuacaggcagccaccaccaccaugcccggcuaauuuuuugguauuuuuaguagagacaggguuucauuaugucagccaggcuggucucaaacuccugaccucaggugauccauuuaccuuggccucccagagugcugggauuacaggcaagagccaccacgcccagcccuccuucccccuuuuuggccuggagaacuccuuuucacccuucaaagcccaccacaaacauaagaaccucuauacuucuugcccgcugaaauacugccucugccaggaagccuucugugacuucucucucucccucuucaccaacggaccgcccccgccccccaccaaccccaccacacacacacaccacuacugucuuccacuguacucccugacaguagagaaccaagcagggccaguugaugcagccucagcuauaucucuuacaugccaaggcccaugcacuggggauacaaugguggaaaauacauggucccuucaaagucuggaugucaaguuuaaugcuggggacuaaagagaaaagcuucagauugaaaccuggagguggcuggggcaaaggaccauuggcaucauuggcagggcaacuuccuaaagaaagcaccuaaaucuuggcuuuuaaagacagauuucauaauuggcagaggagaauucuaaugauacccuauugccuacagggccccaucuaauuugggaauucuacuuuauaccaagauaagauugccagauuuagcaaauaaaaacagaagacauccaauuaauuuuuuuguuuguuuuuggguuuuuguugcggagauggugucucacuauguugcgaaggcugcugucaaauuccuggcucaaacaauccuccugccuuggccucccacuucccaaagugcugggauuacaggcaugagcuaccacaccuggcccuuauuuauuuauuuauuuaauuuucuuuuuugggacggagugucacucugucgcccagguuggagcgcaguagcgcgaucucggcucacugcaaccucugccuccuggguucaagcgauuauccugccccagccucccaaguagcugggacuacaggcgcgugccaccaugcccggcuuuuuuuuuuuuuuuuuuuuuuuuuuugagacggagucuugcucugucgcccaggcuggagugcaguggcacgaucucggcucacugcaagcuccgccuccuggguucacgccauucuccugccucagccuuccgaguagcugggacuacaggcgccugccaccacgcccgacuauuuuuuguauuuuuaguagagaugggguuucaccguguuagccaggaugaucucgaucuccugaccucgugauccacccgccucggccucccaaagugcugggauuacaggcgugagccaccgcgcccagccuacuuauuuauauuuuuuaagagacagggucucgcucaguugcccaggcuggagugcaguagggugaucuguaggaaaggggcuuccaggccuuaacucauguacucccccauaaccagguugggagguuagcucacuguaaccucaaacuccugugcucaagguacccuacuagccccuaggagagcagcugggacuacagguaugcgccaccaugccaggcuuaauuuuuacuuuuuuuuuuuuuuuuuuuuuuuguagagacgggggucucacuauauugcccaggcuggucuugaacuccuggucucaagcgauccuccugccuuagccucccaaaguauugguaucacugcaacuagcccaaagaauuaauauagcuauguuccaugugauauuugggacauacuuuucuaaaagguuguaucuuuuggauauaauuguuuaucugaaauucaaauuuaacuagacauuguauauuuuauacggcaaccacacaccugggacaaucaagacauucccugaaguuaccaggagacaaugcccaucagccuacacuuuuccaagcccacgucacacaaggccccuuccagaguauuccagacgucagguagggccaucccuugguucacaagucccacuccuaccacgccuauggcagccaaacugaaaggcaaacacagugcuggagaccccacaaugcccugggccuauagcagucaauucccaagaugccccgcgugaacacaauaggcacccguuccaaugcucgagcaaagagaccagggcaaaaccuuccacuacgggacaauaacggccaguucccacaauucguuguggcaguucuucccaggaugccuuaggccuauagcgaccaccuucccagacuccccguguggaagcgcuccaagccuccaggacggucagcggcaggugugggauaaaaggaaccggucucgacaaggaucugggacacucuuucccaggaugcaccaggccuacgacuagcggaccgacucccacagcgcuucaaggcggagcgcucgguucucccaggaugccccagggcggcacaaacgcguagggggagaaaaagaagcccucgggucaccacggccccagaccgccggcuccccggugacgggagucgucgcucccaucaugcagcggggccguagcgcccgcuucccggcaugccucgcgcaccccugcccgggacacucaccggcgccggcggcccccgcuccggcucugcggcggcggcugcacgcccagccucugcgccugcgucgcaaguaggguaggacagcgcgcagggggcgugaagagccuagggcgcuugcgcggcgagacggacuaguccuguagcgcugugggaagaggggcuaugcgcgucgggccgucgacgagacccgcgcggggggcgccgugcuuugccccucgcugccuggguuuacuugguacagcccgcggcccaaaggaacaagaagcugaaggguucgcgcgugcgugugcggggcaggaacgcgccuuacaaaacugggaugcgcuggggguggagggcgcuaguucggacuggauccugggcccgaggccugcuuauuugcauaauccuagcgc

SEQ ID NO: 15056 - RNA, 2817 nt, Homo sapiens
gggggaauauuuccugaaugacacccauaacagcuuuauuuucaaaggcgggaucccuccccgggcuugugaugggacggcgcugugggcccgagcagcagagccgugcaggacaggcaugggcagggguggggcagcuggcccgggaggccggcaggucccagaagacaccucacacggguuccaucugcagcuccuccccguccacagccucaaucugguggaaggcagcgugggagccgaugaccaccaggguggcuccugcaggaaagccggcagcucagggccacacuccugcaccuggcucccaccauccaccccagcugcucagacccuguacucacccagcacccagaagacggccgagcccgcaccagccagccagaagaaggggaaggagaugccuccagccagagcauacugaugcgcugggcucaccucucggccugggggcagauggcauuggggugcuguuccgacucuccaugcccucucccagaguaaccccugcugccccccaacaauccguacaagcuccagguucucgggaucgaauccaaacuccucaugccaaggcccuccagguccuggggucacccuguuccccugcuguccccacugcccuccagaacacagcacaccguccucgccugccucagccccacccucugcccucugccccacauccuccaggaaguuccugggaucccggcuuccugcucccuagacuagggcucuccugcugcaacccucgcgcagaccagggucucaaacugguggcccaagggccaaaucugaccuguggauguguuuuuugagcuguuuugcaaggaugugauuuguggcuggcaaagugaacgauuucacauaaaaauaccaacuucaggcuucucauagaagucucagggauggggucuacaugcucuggugacggugaucagcugaagccaagucgugccugugcuucaggcacucccuccaccccagcccaucaagcacauaacuugcaggccccugaagagccuggccuucaggucuaccuaacuguccaaucccaacucccugaccccacuccaaaccuugauuuuccccuggggggaauuuccccuggcauuuuguuuucccagugguccuugguacuacuagucugggaaccacaugaaacauacuccucggcuucccucucuaaguuccaaguucuuucuggucacaccccagaaagcaggaaaagaaacgggaacagaucuaggccaguguaagguggccaccugguguccagugugggcaccugcagcugauguuggccgcagagagcggcaaggggaggagagagaggggaggagucaugugguuugaaaaggaguagguuuaaggcacagcagccagguggauccuggguuugaggaauagcaauuugagggggcugagacucgauggaaggaucgguugugucugagauuuuaagggaucagguuugggggaucuaguguacaucuaggcuugggcggacuuggguuuugaaggacuuggauuuggggucugaggucugucugcauuccaaaagaccaagauuugagggaccaaggauucaucugggcaggggguuucucaccaaagagcacaagcuuggacuccaaggugcgcagauagagaauguaacaggcgccgaaaaagacagccagagccaccagcaacauaggggacgucacccuggaggaggagugcagggaggcagcgguuagacagcuggggcugggccagcccgacggcccuggccuucuccaccggcgggcggcaagcuacauccuggagaccagggagggccaggugacauuuagucacacugcauccuggccagggugauggugggguaggggaccuggcccuuuggugacaagguagucuagcagagccaauccuugggggcggggccugggcggugagaagagggcccugggcggugagaggagggaccgggcggugaagggcggggccugagcggcgagaggagggguccagccggucggggcuagugcgggugcggggcccgggaggcacucacacacaguacaggaugaggcccaggaacacgaacacauaguugcucugguaguacuccacguugcguacgaggcgcuggcacagcucucccagguugcggggccgugagaagcgcugcugguccacgaaggugcuccagggccggauggucgcgcggcgccgcuccagccacucccggccugcaccggagggaaucagcuucggcagcaggguccugcgggggguggggccgggucagugguggaccgggauggagccccagacccccgcaaaagaaggggacuaagggugccuggacucccucccgggaccccagauuccuguacagcaggcagggaggggacuaggggcccagacuccagggucccauuagaggagaccggggccaacacuucugcggcucggggcugggacuccaggcucucgagggaggagggaggagggggccgggggcccggacucccgggucucugguccgagggccuagagccagcucgcucacgugccgcucagcccuuccgccucggcaucuuucugcugguccuucugcgcugccaugucugcgucgugagggguagagcugcuguaaccagcccgguacccugaagaccccgccggccccgcccgacgccggccccacccagcggagucgacguggcgcagccccggagcagcuggggacuguaguucugccgccgaguauugugggaguuguaguccugacggugacuaagaggaugggcgcuaugauggcgg

SEQ ID NO: 15057 - RNA, 12582 nt, Homo sapiens
ccccccuggagccugggcccugcccugguugaggcaagggcccggaguccucaagcccucagcccccacgggaaaagcaugcugggggcggggagagcccgggaguggagagcuggggaggauggagagcugggagacccggagaggccaagaagggggcaaaugagguggagagauagggaggagggagaggaggauggagaggagcagguggaagagaaaggcggaggaggguggggugucccaggggcucccggugcugggccucagugggagggccuggcgacacacuccugguccccugugaggagccggcuccaguccccggcuccaguccccggcugggccugccucccugccgcuggcugccgccaccgcucagucuccccuccgaggccgccgccugccugcccgccugccgccugcgcuggguccuggagcgcaguggggugguucaggagagagagaagagggagggagggaggcagggaggagggcgggcaggaggaagggagggaggcaggcaaagagagaguagggaggugagucgggggagggggagccuguauugguuggggcugggggccccccgcgaggagaaugcugaugagaagaaggagcugcauuggauggaaggcccacccccgagccacccccucuaccacaccaugccaccgcccugcccaggcagcccugggcacaggagcccacagagaugagaggcaagaagacccagggagaaggccacugagaugaggggagagggcuacagagaugaagagaaaugaagagaagagagacagccgucaagacuguccagagaagugggcugaggcccacaaaccccacaaggacaaggacaggaaaagcccagggauaagaaagaaaggcccauggagacaagggagcagccuacagagacaagcaaaaggaccucggagacaaggggcaguaauguggacauagagaccucccgcgaaggaaaacgggagaagccagagacacaagagagaggccccuggaaacagaaagcacuccucagauauggggagcgguccacagggcagggagagagccaaggagagccgaagaaggucacagaaacaagggaggccuacagacaccaggguaccaaaaagacaaggauguggcucauagacacaagagagccacugaggcaggagcugccagccuggagaugcggggcaagccucccccaauauaaauagcuccuauagaggugaggggauggguggugaguaugagaauucccuauagugcacagagaaauccuugggacccacagagaugaguggguggagagaaggggcccucauucucuagucacaggagcagagaggcagugggaaagguggaugggacaaggagaggaagcuggagggcagagccagaagugggagacuccuucccagggaacacccugcagccucucagaaggagcugagcaggacagggggauggaagagagaagcgacacagaucuuggaguggggguggguggugcauggcuggguggggggugaaauuuggggggaagaaacaugacaguuggcgccgaaggcugagcccgugacucaccaccacccccgaugcucgugauggggaggagacacugacacacucacgugcggcccacagcauaugugaccgcaugccucgaacacacagcuggcacauggcaacuccuggaccacaugccagcccagcacaggaagcccucugcaagcuggcauguggggcauccuggacacacaucugacacauauaucugacgcugaaggaccaccaacuuugcacacaccuccuuaccccacuuggucaacaucuacaccgcccccucaaacauccacacuuaacuccagucaggccuaaaagcccagauucacaccugccucugggacuuugcuuaugaaggaccucaacacagaacaccauccuuucgaccagggcgguggcucauuccuguaaccccagcacuuuggaaggccggggcagguggaccaccugagguugggaguucaagaccagccuggccaacauggcaaaaccccgucacuacuaaaaauacaaaaauuagccaggcccgguggcacacuccuuuagucccagcuacuugggaggcugaggcacaagaauugcuugaaccuaggaggcagagguugcugugagccaugaucaugccacugcacuccagcaugggagacaaagcgagacuccaucuccaaaaaaaaaacaaaaaacaaaaaccaaccaccauccccucuaaauucaaccugucccggaaaucccagccaguccugcacuaccaccuccagaaagaccucagcuuauccucagcuuauuccuauaugaucuggagaaaagagaccugcaccacccaaaucaaguugagaaguccaagcaaaaggccugagaaguuaccuggauccucaaauuuucuuuuuuuuuccuuuucuuuuuuuuuuuuuuuugagauggagucucgcucuguuguccagacuggagugcaguggcaugaucucggcucacugcaagcucugccuccuggguucacaccauucuccugccucagccuccugaguagcugguacuacaggcgcccaccaccacacccggcuaacuuuuuuuguauuuuuaguagagacgggguuucaccauguuagccaggauggucucgaucuccugacuucgugaucugccugccucggccucccaaagugcugggauuacaggcgcaagccacugcacccggccagguuuucuuuucuuuuauuuuuucuuucuuucuuuuuuuuuuuucuuuagauggaguuucgcucuuguugccuagguuggagugcaauggcgccaucuuggcucacugcaaccuccgccuccgggguucaagugauucuccugccucagccucccgcguagcugggauuacaggcaugcaccaccaugccugacuaauuuuguauuuuuaguagagacggaguuucuccauguuggucaggcuggucuugaacuccugacaucgggugaucggccugucucggucucccaaaguguugugauuacaggugugacccaccgcacccagccugauccucagauuuucaaguggggaaaaggagguuucagcagaagcaagaaucugcccaaggucacacagccugucaaaaacugagcauggcuuccacuucucugucaccuaccccaggugauuuugcccuaagggcaaacccagacugcuucagagcaggccgagccuagcuuuagcucacuaauuuccaccaacucuuuccuccacuucuugcauucaacccuucaacaugcaaccacuugaacuuccugccuggcaggcaggugagccugggggccaagaauguagacuguaaggucaacuccuggguuggaauccugacucuuccuaacuaugggaacuacgacuaguuacuucucuggggccucgauguuuuguagagucagcaugacaguuucucucucauaggguuguugagaggauuaaacugaguaaugcauguaagcauugagcauaauaccuagcacgucauaauacacucaagagauguuaguuauuauuauuaggcucccggagauacuaauaaaaauaacaacuggccagacacaguggcucacacauguaaucccaccauuuugggaggccaagacaggaggauagcuugagcccaggaguucugagaccagccugggcaacauagugagacccuaucucuauaaaaaaaaaaaaaaaacccgggcaugguggcucaugccuguaaucccagcacuuugggaggucaagguagauggaucaacuugaggccaggaguucgagaccagcccagccaauguggcaaaaacccaucucuaccaaaaacuaggaaaaauuagcagggcauggcgguguaugccuguaaucccagcuacucaggaggcugaaaauugcuugagccugggaggcagagguugcaguuagcugagaucacaccacugcacuccagccugggugacagagcuagacugucucaaaaaaaaaaaaaaaaaaaaaaaaaaaauuagggacugggcgcaguggcucacgccuguaaucccaacacuuugagaggcuggguggggggguggaucaccugaggucaagaguucgagaccagccuggccaacauugcaaaaaccugucucuacuaaaaauacaaaaauuagccgagagugguggugucugccuguagucccagcuacucaggaggcuuaggcaggagaaucacuugaacccaggaggcggagguugcagugagcugagaucgugccacuguacuccagccugggcggugggcgacagagugagacuccaucucaaaaaaaaaaaaaauuaaauuaaauuuuaaaaauaggccaggugcaguggcucacgccuguaaucccagcacuuugggaagccaaggcagguggaucacgaggucaggagauugagaccauccuggccaacacggugaaaccccgucucuacuaaauauacaaaaauuagccaggcgugguggcgagcgccuguagucacagguacucaggaggcugaggcaggagaaucgcuugaaccugggaggcggagguugcagugagccgagaucgcgccacugcacuccagccugggcggcagagaaagacucugucucauaaauaaaauaaaauaaaauaaaauaaaauaaaauaaaauaaaauaaaaauaaaaugaguaacuccuagaugucuuuuacucucugccucacaugagaugaaauggggcucacaugaaauggggcuguuauuagccccauuucacagauuagaaacuuaggcucaggacaguugacuugcccuagaaccaggauuccaauccgggaaucuguuuuaacuauacaugccugguguuagggaauuuaauccaugagaagguuaggacaucuagugaccaaauggccauagaauuggccccgggucucacugugagacgcaucccauaguggcuucagguaaguaaauaaauaacacaauucugagagucaguuuccucauccgauaaguugaaauuccucuguguuuggguucaaggaguaggucuggaaauguuucuuuucuucuuucagauggagucucgcucugucgcccaggcgggagugcaguggcgugaucucggcucacugcaaccucggccuccugggugcaaucaaaucucgagccucagccucccgaguugcugggguuacaggcacgagccaccacgcccagcuaauguuuuguauuuuuaguaaagaugguaguuucaccagguuggccaggugggucucgaaugccugacuucaagugaacccgccucagcgucccaaaauguugggauugcaggcgugagccaccacgcccagccuggaaacguuucuaacaguacuggggcaacucccucccaaggcccugaggggcgcaggaacgaggugaguaggaauggccagagccccuuggacacauggggccccaaucucgagguguaagggucagagucaccccggaaggagguggaguggaguccgcccguuaccggcucacuuccuucaggcucucaccccgauuguccuucagguccucuacccaccacacucccuauuucuuccaaugaaauugucccugcuucuuuuucuccauauccucgcucuccuugcuuccccuaugacauuucuccucucuccaccucccaaaaguccccucggucuuuucucuguuucuuccuguugccuucauuccccuccuuuuaauaaagugagucuggaaccuugguuucccuuuucucucuccaugugacuggugcugcaugcaguuugcccucuccccaucgcgcuaagugguuucacuuucucccucugacccucggggaaaccacaaagguucccgugccuccauucccccgcuccagcccucaaggugccgcgugccucaauuucccaggcucuuuuccucccucucccuguccccaacgcugacucccucacggcguccccaaaauggcgcccgcggccgcgcuccgccgccuaacgucaucgcgccgcccuccgcucagaguuccccucuggagccgucggaggcggagucgaggaggaggaggagcauccucuaaggaggauuaaaggggcgggcacuauccacccgagggcugaccggugagggaacgacgcuaaaggauugguugggcgcugcggggaaucucgacgcuccucacuauuggcccaagccucagagacaugaacgucgauuggccgaacggcagggcccgagcgggcaaugauugguugcguccggccguccgugcggcggccgaggaggaaggugggaggggcguugcugaggguagcugggggcgagagcgaggcuacggagcaggcgagaggcgacggcgagagcuagagcgggcgcagcguuaggguggccgugcaaggggagccguggcccgggcccggggcgugcgagacggcggaagcaggugagcgcgagcgggcgcgcagaggccggccgggcugcgcucccugccgccgcggccuccucuugccaggucgccugcgcacugagggccugagggggugcgcgccgggcaguuagggcggagcggcaccaacggccgacccggcgcgcgggcagccgggcgggggccgggcuggagcggcggguggggaaggggccuggagucgcgugcggggcugagugaggaggggcggggcucgggcugaggcuuugguggggcaccugggcgggaaggggaggccucagagcugucccaagagggcuccgcggcuccccaggguuugggguaaaggacuuggugguguggcaaguccaggacgaaggggcugggccgguuagacggcacgugggugcccaguuaggggcuuagggcgugagaaagauaauuaaguuaaugcaggggaaaaauaucuaguucuuccuggaaagaauuggggcggugagagggguuuuggugugaagacauuaggaaaucgauauccccaagggaacgguuuagagcuaaggagggguccaguuguaauggaugggguuaaauuaaugugaagaggccuuaaaccaaugugucaggagguuggguacccuuggaaugcguggaaaggagucuuuguacaaagaaggauuaaguguauuuuaaaagggugucugggugucccuagaaugagcuggggaagguagucuuuuuuaaguacagguaauuaggccaaggugaagaugggauuugguuauuggaaggggaggaaguagggugggagagaucugugugcuaaagugaggggugccugggaauuccuggaaugagacugagagguugcuaagacgcuggggggucugaguacccccagaauaggaggcuggugagaggggcuugagugugaggaagaggggucugugcuggauuaagguggugauggagguucuguaugagaauaggagguccggguaucccuaaaggggguuugggcagcacgagggguguguguaaaaggagcuuaagccauugugaaagauggguguguggaucuuuacacaaagaagaggaguuauguugcuacgaagaggagggucugagcaucccuagaauggguuaggguggguugggucuucuagcaaauuaaaaaagauuagguuaauaauguggaggaggaucuggauauuccugagauggauuugagggggggcucuguuugcaagagaggcauagguugauauaaaaugaggguaugggcaucccugaaugaguggcuguguaugaacaggaaggguuuaaaucaaugggaagaggggaucuggguaucucagaggggauuagaauugucgauuuggucuugguacaaagaagaggugaugaauguaaagaguggauagauacccuggagacaggagcuagggugguggaagggccuagguccgaagcggggaggaguaggcuuuugugaaaaugggucuggguauucuggauaggggguuaggguuguaggagagggccuugauuuguagaggagguuaaguaauuaaacagggcugcguaucaugaagugguuaaggugggcaaagucuggguguggagauggguuaggccagugugagaaaauuugacuggggggaagggauauaguuugacgugaggaaucugggcaccugaggaagaguugguggguagcagggguugcguguaaaggggagggguggcaccuuguacagugcugaaaguggagugguggggcauugggcaguuugaguggucugaguguaaaaagaagucugagaaccugggagaaggagcagaggccaugggagggguguggcugggagaaacagguggggaaggccuauaugggguuucaguuggguaccuuggagaggaauggggugaggugaguugguaagaaaaggagucaguggaaggaggucugaguggagguucccaugugcugggcggaacuguggggcccacugugaggugugggagaugaggggacuggacagguuacaaggaucugguggguggaguuugaugcaaguugauacagaggugagacuguggguaaauuccuggggaagggacugccugggagauuuguguuugguguuuguuaugcugaggggaggaaggauuauugggagggaggcagaauuuuaaaaaucgaaggaagaacuuaaggggguguagaucuaagguauuaggaguggagagugaugaagggaagagcugaggaaucggugaccuaacugguuuguccccacugucuccucuuccagcccagggccuugcugccgccaugacugaggaaucagaggagacaguccuguacauugagcaccgcuaugucugcucugagugcaaccagcuguauggaucacuggaagaggugcuuaugcaccaaaacucccacgugccccagcagcacuuugagcuggugggcguggcugaucccggagucacuguggccacagacacagcuucaggcacgggccucuaucagacccuugugcaggagagccaguaccagugccuggaguguggucaacugcugaugucacccagccagcuccuggagcaccaggagcugcaccugaagaugauggcaccccaggaggcagugccagcugagccaucaccuaaggcaccaccccugagcuccagcaccauccacuacgaguguguggauugcaaggcucucuuugccagccaggagcucuggcugaaccaccggcagacgcaccuccgggccacacccaccaaggcuccugccccuguuguccugggguccccaguuguucuagggccuccugugggccaggcccgaguggcuguggagcacucauaccgaaaggcagaagaggguggggaaggggcgacugucccaucugccgcugccaccaccacugagguagugacugagguggagcugcuccucuacaagugcucugagugcucccagcucuuccagcugccggcggauuuccuggagcaccaggccacucacuucccugcuccuguacccgagucucaggagccugccuuacagcaggaggugcaggccucgucaccugcagaggugccugugucucagccugaccccuugccagcuucugaccacaguuacgagcugcgcaauggugaagccauugggcgggaucgccgggggcgcagggcccggaggaacaacaguggagaagcaggcggggcagccacacaggagcucuucugcucagccugugaccagcucuuucucucaccccaccagcuacagcagcaccugcggagucaccgggagggcgucuuuaagugcccccugugcagucgugucuucccuagcccuuccagucuggaccagcaccuuggagaccauagcagcgagucacacuuccuguguguagacuguggccuggccuucggcacagaggcccuccuccuggcccaccggcgagcccacaccccgaauccucugcauucauguccaugugggaagaccuuugucaaccuuaccaaguuccuuuaucaccggcguacucaugggguagggggugucccucugcccacaacaccagucccaccagaggaaccugucauugguuucccugagccagccccagcagagacuggagagccagaggccccugagcccccugugucugaggagaccucagcagggcccgcugccccaggcaccuaccgcugccuccugugcagccgugaauuuggaaaggccuugcagcugacccggcaccaacguuuugugcaucggcuggagcggcgccauaaaugcagcauuuguggcaagauguucaagaagaagucucacgugcguaaccaccugcgcacacacacaggggagcggcccuuccccugcccugacugcuccaagcccuucaacucaccugccaaccuggcccgccaccggcucacacacacaggagagcggcccuaccgguguggggacuguggcaaggcuuucacgcaaagcuccacacugaggcagcaccgcuuggugcaugcccagcacuuccccuaccgcugccaggaauguggggugcguuuucaccguccuuaccgccugcucaugcaccgcuaccaucacacaggugaauaccccuacaagugucgcgagugcccccgcuccuucuugcugcgucggcugcuggaggugcaccagcucgugguccaugccgggcgccagccccaccgcugcccauccuguggggcugccuuccccuccucacugcggcuccgggagcaccgcugugcagccgcugcugcccaggccccacggcgcuuugaguguggcaccuguggcaagaaagugggcucagcugcucgacugcaggcacacgaggcggcccaugcagcugcugggccuggagagguccuggcuaaggagcccccugccccucgagccccacgggccacucgugcaccaguugccucuccagcagcccuuggaagcacugcuacagcauccccugcggccccugcccgccgccggggucuagagugcagcgagugcaagaagcuguucagcacagagacgucacugcaggugcaccggcgcauccacacaggugagcggccauacccauguccagacuguggcaaagcguuccgucagaguacccaccugaaagaccaccggcgccugcacacaggugagcggcccuuugccugugaaguguguggcaaggccuuugccaucuccaugcgccuggcagaacaucgccgcauccacacaggcgaacgacccuacuccugcccugacuguggcaagagcuaccgcuccuucuccaaccucuggaagcaccgcaagacccaucagcagcagcaucaggcagcugugcggcagcagcuggcagaggcggaggcugccguuggccuggccgucauggagacugcuguggaggcgcuaccccugguggaagccauugagaucuacccucuggccgaggcugaggggguccagaucaguggcugacucugcccgacuuccucuuuggcaccuccauucccuguugcugaaggcccuccagcauccccuuaagcaucuguacauacugugucccuuccucuucccauccccaccaccuuguaaguucuaaauuggauuuauucucucgugaggggggugcucugggguccuugacacacauaaaggugcccccccaccuuccaccucuuagcacuggugaccccaaaaaugaaaccaucaauaaagacugaguugccagcaguguguagaguggaauuugggagucaugggucuuaccucucguggcugcaucaccaacacccagaagugggccuggcagguauuagggguaguaggagcucaguaaacauuugcugggcugaagagaaugaccugguguucaugggcauggcucucauagcagggccuucacuucacugcuagauggagguagcauggcucucuugccacuagaggucccauggcucuguggaaaagcucaagaguguuuguacugguggcaggaacuuucagagaaaucagauuuuuacacuccugucccugacuccuggccugauguggaccuugucucccaaggccaucugauuuucucauugauccccaagagcaaaugcagguaggcaugaucucuagagcuguggaauuaaaggagauucugaauaauaugugucuggauguaggaagauucaugagagguggugacuugaauuccccuggaguuggacuuuggcucagccaacagauuuuuauugugagugauggauuguugggauggcuggcuaauguuugaacaucuagucagucucaaguacuauauaacugaauaauauucacacugauuacgugagaacauuuugcagggaaggaaucuccagucaaaagcauugagaugacuugcccaaggucacauucaauccaggcagggcagagcuugaauuuaagccugauuucauuucauuugguuuaaucaccgauaugcuuuucucucuacucuguugccuucugcauacuuuggggagggugguagaga

SEQ ID NO: 15058 - RNA, 12582 nt, Homo sapiens
ucucuaccacccuccccaaaguaugcagaaggcaacagaguagagagaaaagcauaucggugauuaaaccaaaugaaaugaaaucaggcuuaaauucaagcucugcccugccuggauugaaugugaccuugggcaagucaucucaaugcuuuugacuggagauuccuucccugcaaaauguucucacguaaucagugugaauauuauucaguuauauaguacuugagacugacuagauguucaaacauuagccagccaucccaacaauccaucacucacaauaaaaaucuguuggcugagccaaaguccaacuccaggggaauucaagucaccaccucucaugaaucuuccuacauccagacacauauuauucagaaucuccuuuaauuccacagcucuagagaucaugccuaccugcauuugcucuuggggaucaaugagaaaaucagauggccuugggagacaagguccacaucaggccaggagucagggacaggaguguaaaaaucugauuucucugaaaguuccugccaccaguacaaacacucuugagcuuuuccacagagccaugggaccucuaguggcaagagagccaugcuaccuccaucuagcagugaagugaaggcccugcuaugagagccaugcccaugaacaccaggucauucucuucagcccagcaaauguuuacugagcuccuacuaccccuaauaccugccaggcccacuucuggguguuggugaugcagccacgagagguaagacccaugacucccaaauuccacucuacacacugcuggcaacucagucuuuauugaugguuucauuuuuggggucaccagugcuaagagguggaaggugggggggcaccuuuaugugugucaaggaccccagagcaccccccucacgagagaauaaauccaauuuagaacuuacaaggugguggggaugggaagaggaagggacacaguauguacagaugcuuaaggggaugcuggagggccuucagcaacagggaauggaggugccaaagaggaagucgggcagagucagccacugaucuggacccccucagccucggccagaggguagaucucaauggcuuccaccagggguagcgccuccacagcagucuccaugacggccaggccaacggcagccuccgccucugccagcugcugccgcacagcugccugaugcugcugcugaugggucuugcggugcuuccagagguuggagaaggagcgguagcucuugccacagucagggcaggaguagggucguucgccuguguggaugcggcgauguucugccaggcgcauggagauggcaaaggccuugccacacacuucacaggcaaagggccgcucaccugugugcaggcgccgguggucuuucagguggguacucugacggaacgcuuugccacagucuggacauggguauggccgcucaccuguguggaugcgccggugcaccugcagugacgucucugugcugaacagcuucuugcacucgcugcacucuagaccccggcggcgggcaggggccgcaggggaugcuguagcagugcuuccaagggcugcuggagaggcaacuggugcacgaguggcccguggggcucgaggggcagggggcuccuuagccaggaccucuccaggcccagcagcugcaugggccgccucgugugccugcagucgagcagcugagcccacuuucuugccacaggugccacacucaaagcgccguggggccugggcagcagcggcugcacagcggugcucccggagccgcagugaggaggggaaggcagccccacaggaugggcagcgguggggcuggcgcccggcauggaccacgagcuggugcaccuccagcagccgacgcagcaagaaggagcgggggcacucgcgacacuuguagggguauucaccugugugaugguagcggugcaugagcaggcgguaaggacggugaaaacgcaccccacauuccuggcagcgguaggggaagugcugggcaugcaccaagcggugcugccucaguguggagcuuugcgugaaagccuugccacaguccccacaccgguagggccgcucuccugugugugugagccgguggcgggccagguuggcaggugaguugaagggcuuggagcagucagggcaggggaagggccgcuccccugugugugugcgcaggugguuacgcacgugagacuucuucuugaacaucuugccacaaaugcugcauuuauggcgccgcuccagccgaugcacaaaacguuggugccgggucagcugcaaggccuuuccaaauucacggcugcacaggaggcagcgguaggugccuggggcagcgggcccugcugaggucuccucagacacagggggcucaggggccucuggcucuccagucucugcuggggcuggcucagggaaaccaaugacagguuccucuggugggacugguguugugggcagagggacacccccuaccccaugaguacgccggugauaaaggaacuugguaagguugacaaaggucuucccacauggacaugaaugcagaggauucggggugugggcucgccggugggccaggaggagggccucugugccgaaggccaggccacagucuacacacaggaagugugacucgcugcuauggucuccaaggugcugguccagacuggaagggcuagggaagacacgacugcacagggggcacuuaaagacgcccucccggugacuccgcaggugcugcuguagcugguggggugagagaaagagcuggucacaggcugagcagaagagcuccuguguggcugccccgccugcuucuccacuguuguuccuccgggcccugcgcccccggcgaucccgcccaauggcuucaccauugcgcagcucguaacuguggucagaagcuggcaaggggucaggcugagacacaggcaccucugcaggugacgaggccugcaccuccugcuguaaggcaggcuccugagacucggguacaggagcagggaagugaguggccuggugcuccaggaaauccgccggcagcuggaagagcugggagcacucagagcacuuguagaggagcagcuccaccucagucacuaccucaguggugguggcagcggcagaugggacagucgccccuuccccacccucuucugccuuucgguaugagugcuccacagccacucgggccuggcccacaggaggcccuagaacaacuggggaccccaggacaacaggggcaggagccuugguggguguggcccggaggugcgucugccggugguucagccagagcuccuggcuggcaaagagagccuugcaauccacacacucguaguggauggugcuggagcucagggguggugccuuaggugauggcucagcuggcacugccuccuggggugccaucaucuucaggugcagcuccuggugcuccaggagcuggcugggugacaucagcaguugaccacacuccaggcacugguacuggcucuccugcacaagggucugauagaggcccgugccugaagcugugucuguggccacagugacuccgggaucagccacgcccaccagcucaaagugcugcuggggcacgugggaguuuuggugcauaagcaccucuuccagugauccauacagcugguugcacucagagcagacauagcggugcucaauguacaggacugucuccucugauuccucagucauggcggcagcaaggcccugggcuggaagaggagacaguggggacaaaccaguuaggucaccgauuccucagcucuucccuucaucacucuccacuccuaauaccuuagaucuacacccccuuaaguucuuccuucgauuuuuaaaauucugccucccucccaauaauccuuccuccccucagcauaacaaacaccaaacacaaaucucccaggcagucccuuccccaggaauuuacccacagucucaccucuguaucaacuugcaucaaacuccacccaccagauccuuguaaccuguccaguccccucaucucccacaccucacagugggccccacaguuccgcccagcacaugggaaccuccacucagaccuccuuccacugacuccuuuucuuaccaacucaccucaccccauuccucuccaagguacccaacugaaaccccauauaggccuuccccaccuguuucucccagccacaccccucccauggccucugcuccuucucccagguucucagacuucuuuuuacacucagaccacucaaacugcccaaugccccaccacuccacuuucagcacuguacaaggugccaccccuccccuuuacacgcaaccccugcuacccaccaacucuuccucaggugcccagauuccucacgucaaacuauaucccuuccccccagucaaauuuucucacacuggccuaacccaucuccacacccagacuuugcccaccuuaaccacuucaugauacgcagcccuguuuaauuacuuaaccuccucuacaaaucaaggcccucuccuacaacccuaacccccuauccagaauacccagacccauuuucacaaaagccuacuccuccccgcuucggaccuaggcccuuccaccacccuagcuccugucuccaggguaucuauccacucuuuacauucaucaccucuucuuuguaccaagaccaaaucgacaauucuaauccccucugagauacccagauccccucuucccauugauuuaaacccuuccuguucauacacagccacucauucagggaugcccauacccucauuuuauaucaaccuaugccucucuugcaaacagagcccccccucaaauccaucucaggaauauccagauccuccuccacauuauuaaccuaaucuuuuuuaauuugcuagaagacccaacccacccuaacccauucuagggaugcucagacccuccucuucguagcaacauaacuccucuucuuuguguaaagauccacacacccaucuuucacaauggcuuaagcuccuuuuacacacaccccucgugcugcccaaacccccuuuagggauacccggaccuccuauucucauacagaaccuccaucaccaccuuaauccagcacagaccccucuuccucacacucaagccccucucaccagccuccuauucuggggguacucagaccccccagcgucuuagcaaccucucagucucauuccaggaauucccaggcaccccucacuuuagcacacagaucucucccacccuacuuccuccccuuccaauaaccaaaucccaucuucaccuuggccuaauuaccuguacuuaaaaaagacuaccuuccccagcucauucuagggacacccagacacccuuuuaaaauacacuuaauccuucuuuguacaaagacuccuuuccacgcauuccaaggguacccaaccuccugacacauugguuuaaggccucuucacauuaauuuaaccccauccauuacaacuggaccccuccuuagcucuaaaccguucccuuggggauaucgauuuccuaaugucuucacaccaaaaccccucucaccgccccaauucuuuccaggaagaacuagauauuuuuccccugcauuaacuuaauuaucuuucucacgcccuaagccccuaacugggcacccacgugccgucuaaccggcccagccccuucguccuggacuugccacaccaccaaguccuuuaccccaaacccuggggagccgcggagcccucuugggacagcucugaggccuccccuucccgcccaggugccccaccaaagccucagcccgagccccgccccuccucacucagccccgcacgcgacuccaggccccuuccccacccgccgcuccagcccggcccccgcccggcugcccgcgcgccgggucggccguuggugccgcuccgcccuaacugcccggcgcgcacccccucaggcccucagugcgcaggcgaccuggcaagaggaggccgcggcggcagggagcgcagcccggccggccucugcgcgcccgcucgcgcucaccugcuuccgccgucucgcacgccccgggcccgggccacggcuccccuugcacggccacccuaacgcugcgcccgcucuagcucucgccgucgccucucgccugcuccguagccucgcucucgcccccagcuacccucagcaacgccccucccaccuuccuccucggccgccgcacggacggccggacgcaaccaaucauugcccgcucgggcccugccguucggccaaucgacguucaugucucugaggcuugggccaauagugaggagcgucgagauuccccgcagcgcccaaccaauccuuuagcgucguucccucaccggucagcccucggguggauagugcccgccccuuuaauccuccuuagaggaugcuccuccuccuccucgacuccgccuccgacggcuccagaggggaacucugagcggagggcggcgcgaugacguuaggcggcggagcgcggccgcgggcgccauuuuggggacgccgugagggagucagcguuggggacagggagagggaggaaaagagccugggaaauugaggcacgcggcaccuugagggcuggagcgggggaauggaggcacgggaaccuuugugguuuccccgagggucagagggagaaagugaaaccacuuagcgcgauggggagagggcaaacugcaugcagcaccagucacauggagagagaaaagggaaaccaagguuccagacucacuuuauuaaaaggaggggaaugaaggcaacaggaagaaacagagaaaagaccgaggggacuuuugggagguggagagaggagaaaugucauaggggaagcaaggagagcgaggauauggagaaaaagaagcagggacaauuucauuggaagaaauagggagugugguggguagaggaccugaaggacaaucggggugagagccugaaggaagugagccgguaacgggcggacuccacuccaccuccuuccggggugacucugacccuuacaccucgagauuggggccccauguguccaaggggcucuggccauuccuacucaccucguuccugcgccccucagggccuugggagggaguugccccaguacuguuagaaacguuuccaggcugggcgugguggcucacgccugcaaucccaacauuuugggacgcugaggcggguucacuugaagucaggcauucgagacccaccuggccaaccuggugaaacuaccaucuuuacuaaaaauacaaaacauuagcugggcgugguggcucgugccuguaaccccagcaacucgggaggcugaggcucgagauuugauugcacccaggaggccgagguugcagugagccgagaucacgccacugcacucccgccugggcgacagagcgagacuccaucugaaagaagaaaagaaacauuuccagaccuacuccuugaacccaaacacagaggaauuucaacuuaucggaugaggaaacugacucucagaauuguguuauuuauuuacuuaccugaagccacuaugggaugcgucucacagugagacccggggccaauucuauggccauuuggucacuagauguccuaaccuucucauggauuaaauucccuaacaccaggcauguauaguuaaaacagauucccggauuggaauccugguucuagggcaagucaacuguccugagccuaaguuucuaaucugugaaauggggcuaauaacagccccauuucaugugagccccauuucaucucaugugaggcagagaguaaaagacaucuaggaguuacucauuuuauuuuuauuuuauuuuauuuuauuuuauuuuauuuuauuuuauuuuauuuaugagacagagucuuucucugccgcccaggcuggagugcaguggcgcgaucucggcucacugcaaccuccgccucccagguucaagcgauucuccugccucagccuccugaguaccugugacuacaggcgcucgccaccacgccuggcuaauuuuuguauauuuaguagagacgggguuucaccguguuggccaggauggucucaaucuccugaccucgugauccaccugccuuggcuucccaaagugcugggauuacaggcgugagccacugcaccuggccuauuuuuaaaauuuaauuuaauuuuuuuuuuuuuugagauggagucucacucugucgcccaccgcccaggcuggaguacaguggcacgaucucagcucacugcaaccuccgccuccuggguucaagugauucuccugccuaagccuccugaguagcugggacuacaggcagacaccaccacucucggcuaauuuuuguauuuuuaguagagacagguuuuugcaauguuggccaggcuggucucgaacucuugaccucaggugauccacccccccacccagccucucaaaguguugggauuacaggcgugagccacugcgcccagucccuaauuuuuuuuuuuuuuuuuuuuuuuuuuuugagacagucuagcucugucacccaggcuggagugcaguggugugaucucagcuaacugcaaccucugccucccaggcucaagcaauuuucagccuccugaguagcugggauuacaggcauacaccgccaugcccugcuaauuuuuccuaguuuuugguagagauggguuuuugccacauuggcugggcuggucucgaacuccuggccucaaguugauccaucuaccuugaccucccaaagugcugggauuacaggcaugagccaccaugcccggguuuuuuuuuuuuuuuuauagagauagggucucacuauguugcccaggcuggucucagaacuccugggcucaagcuauccuccugucuuggccucccaaaauggugggauuacaugugugagccacugugucuggccaguuguuauuuuuauuaguaucuccgggagccuaauaauaauaacuaacaucucuugaguguauuaugacgugcuagguauuaugcucaaugcuuacaugcauuacucaguuuaauccucucaacaacccuaugagagagaaacugucaugcugacucuacaaaacaucgaggccccagagaaguaacuagucguaguucccauaguuaggaagagucaggauuccaacccaggaguugaccuuacagucuacauucuuggcccccaggcucaccugccugccaggcaggaaguucaagugguugcauguugaaggguugaaugcaagaaguggaggaaagaguugguggaaauuagugagcuaaagcuaggcucggccugcucugaagcagucuggguuugcccuuagggcaaaaucaccugggguaggugacagagaaguggaagccaugcucaguuuuugacaggcugugugaccuugggcagauucuugcuucugcugaaaccuccuuuuccccacuugaaaaucugaggaucaggcugggugcggugggucacaccuguaaucacaacacuuugggagaccgagacaggccgaucacccgaugucaggaguucaagaccagccugaccaacauggagaaacuccgucucuacuaaaaauacaaaauuagucaggcaugguggugcaugccuguaaucccagcuacgcgggaggcugaggcaggagaaucacuugaaccccggaggcggagguugcagugagccaagauggcgccauugcacuccaaccuaggcaacaagagcgaaacuccaucuaaagaaaaaaaaaaaagaaagaaagaaaaaauaaaagaaaagaaaaccuggccgggugcaguggcuugcgccuguaaucccagcacuuugggaggccgaggcaggcagaucacgaagucaggagaucgagaccauccuggcuaacauggugaaaccccgucucuacuaaaaauacaaaaaaaguuagccgggugugguggugggcgccuguaguaccagcuacucaggaggcugaggcaggagaauggugugaacccaggaggcagagcuugcagugagccgagaucaugccacugcacuccagucuggacaacagagcgagacuccaucucaaaaaaaaaaaaaaaagaaaaggaaaaaaaaagaaaauuugaggauccagguaacuucucaggccuuuugcuuggacuucucaacuugauuuggguggugcaggucucuuuucuccagaucauauaggaauaagcugaggauaagcugaggucuuucuggaggugguagugcaggacuggcugggauuuccgggacagguugaauuuagaggggauggugguugguuuuuguuuuuuguuuuuuuuuuggagauggagucucgcuuugucucccaugcuggagugcaguggcaugaucauggcucacagcaaccucugccuccuagguucaagcaauucuugugccucagccucccaaguagcugggacuaaaggagugugccaccgggccuggcuaauuuuuguauuuuuaguagugacgggguuuugccauguuggccaggcuggucuugaacucccaaccucaggugguccaccugccccggccuuccaaagugcugggguuacaggaaugagccaccgcccuggucgaaaggaugguguucuguguugagguccuucauaagcaaagucccagaggcaggugugaaucugggcuuuuaggccugacuggaguuaaguguggauguuugagggggcgguguagauguugaccaagugggguaaggaggugugugcaaaguuggugguccuucagcgucagauauaugugucagauguguguccaggaugccccacaugccagcuugcagagggcuuccugugcugggcuggcaugugguccaggaguugccaugugccagcuguguguucgaggcaugcggucacauaugcugugggccgcacgugagugugucagugucuccuccccaucacgagcaucgggggugguggugagucacgggcucagccuucggcgccaacugucauguuucuuccccccaaauuucaccccccacccagccaugcaccacccacccccacuccaagaucugugucgcuucucucuuccaucccccuguccugcucagcuccuucugagaggcugcaggguguucccugggaaggagucucccacuucuggcucugcccuccagcuuccucuccuugucccauccaccuuucccacugccucucugcuccugugacuagagaaugagggccccuucucuccacccacucaucucugugggucccaaggauuucucugugcacuauagggaauucucauacucaccacccauccccucaccucuauaggagcuauuuauauugggggaggcuugccccgcaucuccaggcuggcagcuccugccucaguggcucucuugugucuaugagccacauccuugucuuuuugguacccuggugucuguaggccucccuuguuucugugaccuucuucggcucuccuuggcucucucccugcccuguggaccgcuccccauaucugaggagugcuuucuguuuccaggggccucucucuugugucucuggcuucucccguuuuccuucgcgggaggucucuauguccacauuacugccccuugucuccgagguccuuuugcuugucucuguaggcugcucccuugucuccaugggccuuucuuucuuaucccugggcuuuuccuguccuuguccuugugggguuugugggccucagcccacuucucuggacagucuugacggcugucucucuucucuucauuucucuucaucucuguagcccucuccccucaucucaguggccuucucccugggucuucuugccucucaucucugugggcuccugugcccagggcugccugggcagggcgguggcauggugugguagaggggguggcucgggggugggccuuccauccaaugcagcuccuucuucucaucagcauucuccucgcggggggcccccagccccaaccaauacaggcucccccucccccgacucaccucccuacucucucuuugccugccucccucccuuccuccugcccgcccuccucccugccucccucccucccucuucucucucuccugaaccaccccacugcgcuccaggacccagcgcaggcggcaggcgggcaggcaggcggcggccucggaggggagacugagcgguggcggcagccagcggcagggaggcaggcccagccggggacuggagccggggacuggagccggcuccucacaggggaccaggagugugucgccaggcccucccacugaggcccagcaccgggagccccugggacaccccacccuccuccgccuuucucuuccaccugcuccucuccauccuccucucccuccucccuaucucuccaccucauuugcccccuucuuggccucuccgggucucccagcucuccauccuccccagcucuccacucccgggcucuccccgcccccagcaugcuuuucccgugggggcugagggcuugaggacuccgggcccuugccucaaccagggcagggcccaggcuccagggggg

SEQ ID NO: 15059 - RNA, 1125 nt, Homo sapiens
aacauuaaaguucuaugagguauuuggugccuuaucucgaguccucaggggaggggggcccagggggagaccuggggcucaccugccccucccucccuccuacccccuucccaauauuugguuucacagcuguaguuaaagcuugggauuugguuauuuuucccccucccaggaauuuuuuuuucuuguuuuucuuuuccuaggugugaggguuggauggggaggguccccagcacccccggcugcacaggggucccuccaccaacaucagggcaucugccccaucccugcccccugcuccuccucuccucuuuaccccacucccacauacugggguggggagaggucccagguggugggacuugauggggaggaagcaggaugaagugggugguggugaguccuggauuuucuuuccuuuuuuuuuuuuuuuuuuccuuuuuggucuagaaucauaguuuuuguuugagucaucuccaccaugccuuccaugcugccugucuucucggaggggguuuuugguuguaauuccuuucauuuugcucugcucaaauguccuuccuauuuggucaggagcccuuggcccccucuccacccuugggcuggggcccaagcccucuugccagucccuucucucuucaggaaauaaacauggacaaacucagagguaggguaagggcagggagucguucagcggagaugcuuacauuccggugagguuggguagacgaggugccaggccccaucgugccggggugggaggggcggcuacuucaccacugcccggacaaggcacccagaggccccugcaauggccgagucucugcugccuccgucgcccagcccaacaguuucauuucccgggugggagaagggagacaaggaaaaaagagaacgcugaggccuggagcuccaucugccucuccucagaguguccggcagaaaguggaagcugcccaggccaaagcccugcggucucagggcucuccucucucucugcuccugcccaacaaggggcaggggccacacuacggcugucaggccccacccugauuucaauggcucguguccuucacugcaacacuuugguuugaggagagacacagaaagaacaagauugagaga

SEQ ID NO: 15060 - RNA, 1125 nt, Homo sapiens
ucucucaaucuuguucuuucugugucucuccucaaaccaaaguguugcagugaaggacacgagccauugaaaucaggguggggccugacagccguaguguggccccugccccuuguugggcaggagcagagagagaggagagcccugagaccgcagggcuuuggccugggcagcuuccacuuucugccggacacucugaggagaggcagauggagcuccaggccucagcguucucuuuuuuccuugucucccuucucccacccgggaaaugaaacuguugggcugggcgacggaggcagcagagacucggccauugcaggggccucugggugccuuguccgggcaguggugaaguagccgccccucccaccccggcacgauggggccuggcaccucgucuacccaaccucaccggaauguaagcaucuccgcugaacgacucccugcccuuacccuaccucugaguuuguccauguuuauuuccugaagagagaagggacuggcaagagggcuugggccccagcccaaggguggagagggggccaagggcuccugaccaaauaggaaggacauuugagcagagcaaaaugaaaggaauuacaaccaaaaacccccuccgagaagacaggcagcauggaaggcaugguggagaugacucaaacaaaaacuaugauucuagaccaaaaaggaaaaaaaaaaaaaaaaaaggaaagaaaauccaggacucaccaccacccacuucauccugcuuccuccccaucaagucccaccaccugggaccucuccccaccccaguaugugggagugggguaaagaggagaggaggagcagggggcagggauggggcagaugcccugauguugguggagggaccccugugcagccgggggugcuggggacccuccccauccaacccucacaccuaggaaaagaaaaacaagaaaaaaaaauuccugggagggggaaaaauaaccaaaucccaagcuuuaacuacagcugugaaaccaaauauugggaaggggguaggagggagggaggggcaggugagccccaggucucccccugggccccccuccccugaggacucgagauaaggcaccaaauaccucauagaacuuuaauguu

SEQ ID NO: 15061 - RNA, 9289 nt, Homo sapiens
caaugggagguguggauagugaggggucccacacgccuggagccgagggucugugucaagagcggcaggggcugcaggagauaagagaaacgggugagggcgccgcgcggggcuggacugggaagagaacgcugggcggacggagggggcggaaggaaaacuaaggggucugcagggaucgaagagccuuggggccugcgcuagggcgggagcggcgcgggcuggaaggagagcacuccuuccugugugcccuggggcuccuuuagugugcgggagccuacgcuggaacucgcccaccacccacugcugcgagcucucacccugccgaggagcucagucugguaggagacaagcguuguaaagcgggaaaguugaauuuccagggcccuaguggguuccuuccuggaaagacuuacugauauacugugugaaaaacccccauucuuucccuaaguaguucacaauucaagagugggagaaagaaucguagacgaggaaagggcaaauuucaagucucccgggccaccucguagacauuuauuggguaccugcuuugugcaagcuuugcagcaggcacugggccucgcccuaggggaguucucuguuggaaauggggcuguaaucaaggaaaaauggaacucucgggccccugguugccuacuuccaggaagguccuuuguggaauggcuguugugugcaggggccuggcaacucaaaaauuaggaaggggauuggaauaguagauaaggaaaguuuagcuccagcuccuuuagugaauaauuuacucaaggaguauguauugggcauuaacugaaagcagggcccuguacugggcuguguguuuugggaauucacagucuaauggggaaguuggucugguagaaauggacugugcauagggacaguuaaacucagggucggccaggcaguggcuuacaccucuaauuccagcgcuuugggaggccugggugggaggauugcuugagcucaguaguucgagaccagccugggcaacauagggagaccucucuacaaauaauuuaaaaauuagccaggggcuaggugugguggcucacaccuguaaucccagcacuuugggagaccaugguggguggauuucuugaggucaggaguugaagaccagccugggcaacaugaugaaaccccaucucuacuaaaaauacaaaaauuauccaggcgugguggugaaugccuguaguuccagcuacucaggugaccgaggcgggagaaucgcuuggacccaagaggcggagguugcagugagccgagaucgugccacugcacuccagccugggcaaaaagagagaaacucugucucaaaaaaaguaaaauaaaauaaauaaaaauaaaaauuugccaggcaugauggcagauaccuguggucccagcuacucaagaggcugaggcaggaggaucaccugaguccaggagguggaggccucagugagccaagaucgcaccacugcacugcagccugggcaacagagugagacccugucucaaaaggaggaaaaaaaaaaaaaaaccucucaaggucucacuucccaagggaggcucacugcagccuccaccuccugggcucaagugaucaaaccaccuuagccucccaaagugcuaggauugcagaugugagccaccacaccuggccugggagcauuucucagucacuaaauauguacugugugcuagacauuguucuuggcacuggacgugcuucagugaugugcaggcuaaacugcuaccgucuaggugcuuaauaugagcaacuuuuuuuuuuuuuuuuccuccuugagacagagucucacucugucuccaggcuggagugcaguggcgcaaucucagcucacugcaaccuccgccucccgguuucaagccauucuccugccucagccucccaaguagcugggauuacaggcgugcaccaccacgcccagcuaauuuuuguauuuuuuuuaguagagacgggguuucaucauguuggccagcauggucucgaucucuugaccuugugaucgccugccuuggccccuagagugcugggauuacaggcgugagccacugcgcccggcaauaugagcaacuucuauaugcaaggcuguaaaccagacuccaccugcccucuggcacuaauagauuaggugaaaaagagguaaagaagguggguuugaauucauaaaauuagcugcuaggccugggagggaggcagucauuuguugaguguacucugagucccugcugugugaaggggccugggugggguugagcccacauacguagaagggaagauggggcauauagagggaaguuugaaaguuaaaauuccugucccugcucagagguuuuguugcugacuggagccuccacaaugaaucagacccacaaacucucaguccagugaggaacagugagaugccaccccaaacucaugauauuugccaugauagagguggcacaggauaccauaggaacccugaggauguagagaugucagagaaggcuucacaaaaggugcuggguaggaguuugucagacaaaaagaggagagaaguuucuuggcaaagggaauagcaacaucaaagacuuagggucuaaaaacaaucuuucuggagaacuacacaggguuacagcugaccuuuacaaguaccagggacuuugugucaguacuacuuuuagccccauuuuacagguaagaagacaaccucagaggaaguaagugguagagcucagauucaagccaagggcagucugguuccagggccuguguuuuuaaacacuuggguguaucuguguguguauauguaagaggcagaggaaaagcauugcacaaagagaaagcugcacgcaggcaaaggcuaugguauucucagaaaaggugugccuggcccucucgguaaagaggccaggcuggcugggccgggugugguggcucacaccuguaaucccagcacuuugggaggccgaggcaggcggaucacgagggcaagagaucgagaccaucuuggccaacauggugaaaccccaucucuacuaaaaauacaaaaauuggccgggcgugguggcucaugccuguaaucccagcacuuugggacgcccaggcgggcagaucacgaggucaggagauugagauuguccuggcuaacacggugaaacccugucucuacuaaaaauacaaaaaauuagccgggcgugguugcaggcgccuguagucccagcuacucgggaggcugagccaggagaauggccugaaccugggaggcagagcuugcagugagcagagauugcaccacugcacuccagccugggcgacagagcgagccuccaucucaacaauaacaacaaaaaaauacaaaaauuagcugggcaugguggcgcacacuuguagucccagcuacucgggaggcugagacaggagaaucacuugaaccuaggagguggagguuguagugagccgagauugcgccacuguacucuagccuggcaacagagcaagaguccaucucaaaaaaaaaaaaaaaaaaaaaaagaggccgggcuguuggccggggugguggcucacaucuguaaucccagcacuuugggaggccaaggcggguggaucaccugaggucaggaguucaagaccagccuggccaacauggugaaaccuugucucuacuaaaauauauauauauauauauauauauauauacaaaaauuagccaggcaugguggcacaccccuguagucccggccacucaggaggcugaggcacgagaauagcuugaacccaggagcgagagguugcagugagccaagauugugccacugcacuccagcuugggugacagaccaagucucugucucagaagaaaaaaaaaaaaaaaaaagaggcugggcugagugguguuucucuccugcaggcugccgugggguguguguaggcuucagagacaugggaucacggaagacugaagcagaaacaguggauuaagacuuccugagcgauagcuggugaguagugggaugugcaagagaauuccaccuccccuugguuuccugcugucucacuggcuccugccccucuuucuccaggcacugccuuccccacaauggcagaggugguggcugagguggccgagaugccaacacagaugucaccaggggcaguggagaugucaacaccuaugucggcagagaugauggagaugucaacagaagugacugagaugacaccuggggaggcccuugccucaucccucuucuuccagcaucaccaguucaugugcucugaguguggcagccucuauaacacacuggaggaaguccucucacaccaggagcagcacaugcuugcugucucagaggaggaggcacugaccacacagaauguuggccuggagccggagcuggugccgggugcugaggggcccuuccaguguggugaaugcagccagcucauccucuccccuggggagcuccuggcccaccaggaugcccaccuccgagagucugcaaaccagauccaauaccagugcugggacugccaggagcuguuccccucgcccgagcuguggguggcucaucgaaaggcccagcaccuuucugcuacgguagcugagccaccagugccaccuccuuugccucccccaacaccacugccuccaccuucucccccauccgaagucaagauggagcccuaugaguguccugagugcucuacccucugcgccaccccugaggaguucuuggagcaucagggcacccacuuugacucccuagagaaagaggagcgcaauggguuggaggaggaggaagaggacgaugaggaggaugaagaagaugaugaagagauggaggaugaggaggccauggcagaggucggugaugaugcugugggaggugacgaguccacagcuggcugggcucagggcugcggggacuguccccagcaccagcccucagcaggggcucgccggcaacaccggcggacggcucacagcccggcaucugccacccaccccuuccacugcagccagugucagcgcaguuucagcuccgccaaccggcugcaggcucaugggcgggcccauguugguggcacacaugaguguacaaccugcuccaaggucuucaagaaagcagcaucgcuugagcagcacuugcggcugcaucgcggggaagcccgcuaccucuguguagacuguggccgcggcuuuggcacagaacucacguugguggcucaccggcgggcccacacugccaacccauugcaucgcugucguugcggcaagacguucagcaacaugaccaaguuccucuaccaccggcgcacucacgccggcaaaagcggggcaccucccacaggagcaacagcucccccagcuccagcggagcccaccccuccaccaccacccccugccccaccugcccagcugcccugcccacagugcuccaaguccuuugccucagcuucccggcugucccggcaccggcgugcaguacacgggcccccugaacggcgucaccgcugugggguuuguggcaagggcuucaagaagcugauccacgugcgcaaccaccugcggacacacacgggugagaggcccuuccagugccacucauguggcaagaccuuugcuucuuuggccaaccucagccgccaccagcugacccauacgggugcacgucccuaccaaugccuggacuguggcaagcgcuucacacagagcuccaaccugcagcagcaccggcgguugcacuugcggccagucgccuuugcccgcgccccccgccuccccaucacuggucucuacaacaagagucccuacuacugcgggacuuguggccgcugguuccgcgccauggcgggcuugcgacugcaucagcggguccaugcccgagcucggacuuugacgcuacagccucccagaucaccaucuccugccccacccccaccuccagagccucaacagacuaucaugugcacagagcugggggagaccaucgccaucauugagacaucccagccacuggcgcuugaggacacccugcagcugugccaggcugcacugggggccagugaagcaggcgggcucuugcaguuggacacggccuucgugugacgcagcugaaaagcaacaacaaaaggguuugguugcaacagccaguguggguaccucuggggagagaggaccuccucugacaaacuggucugguacccaccaugugccaggauccacccuggccucuuuuuacccacugacuccccagaacaacccuuccaggcuucucuugucaucuuucucugccugaggggaaacugaagcucugaaaugcgaugugaucuguaccaggucacccagcuaugcugcaaaguggguuggccaaggcccuuugcacugcaucacccuggugcccagcaacaucagguaaccuucacugagcaccaagcuuaugccaggucugugcuggccacucucauauaccucuucagauccucugcuuguacccccagcccuugccuucccuggauuuugggcacccaggacuuugcucugccugguggaggguacuugauuucucugggcuuccuucaucucaauucugacaguguggaaggaaaucuguagguacccagguccucagcuccagacugggugaugcuggagacccaggagcaagucagcacaggcucugcccacaggaggcaugcacaaucugguaggagaaacgcacaaguacagauagcuugcucucugagugugucucauugauucauucagccuguguguccuaaagccucccuucucccauacugggugaugcugggggcagagaugagucaggccuaaggcuucucugggcugugauggggaugugcagggacagugggaucccaggaaacagaccuccauggugggagaucaggaguuaaggacuuccuagagaagguagucccugaaggaaaaguaggaaucuggcagugaaagaggaaaagaacauuccaggcagacagcacugcaagagggugagcucuugguguauuuggagaccauccaguuauucaucugacugccuaccugaggcaagcaccacacuuaccacuguauguguacuaugaucccaacaggcuugugacauagauuucauauuaucccuguuguauagauuuuuaaaacugguggcugggcgugguggcucacgccuguaaucccagcacuuugggaggccgaggcgggcagaucacgaggucaggagaucgagaccauccuggcuaacacggugaaaccccgucucuacuaaaaauacaaaaaauuagccaggagugguggcgggcgccugugguggccagcuacucaggaggcugaggcaggagaauggcgugaacccgggaggcggagcuugcagugagccgagaucgcgccacugcacuccagccugggcgacagagugagacucccucucaaaagaaaauaaaaauaaaaauaaacuggccaggugcgguggcucacgcuugcaaucccagugcuuugggagacugaggcaggaggaucacuuaaggccaggaguucgagaccagccugggcaacagcaagaccucaucucuacaaaacuuaaaaguuagccaggccugguggcacaugccuguaauccgagugcuuugggaggcugaggcaggaggaucacucgagcucaagaauucaagaccugggcaagagagagagacuuugucucuauuaaaaauaaaaaugauuggccgagcaugguggugcacaccaguauucccagcuacucuggaggcugaggcggaggcaggauugcuugauaugagggagauugaggcugcagugagcuguguucacaccacugcacuccagucugggcaacagugcaagacccugucacuuaaaaaaaaaaaaaaggaaaaaaaaacuaaggacagagauuugcccaagguuucacagcuaggcagagaugugagauuugaguacgggaggccccugcggcccacauuuguaacccauacuauucugagugauuaagaccugaaacuugugcagggguaggggaucagaggaagauucauucuaacuagaggaaaaguaaaccagugucagagcuauugggauuugaaggggcuucgaaacaucaaaggucuugagagcaggaagauucccaccuuuuucagagguuaccuaggauaauagucuuucucuccauugauugauugauugauugagauggagucuugcucuguugcccaggcuggagcacaguggugcagucucagcucacugcaaccuccaccuuccaggcucaagcgauucuccugccucagucucccuaauagcugggauuacaggcccccaccacugcacccagcuaauuuuuguauuuuaguagagacaggguuuugccacguugaccaggcuggucucaaucuccugaccucaggugaucugcccgccuuggccucccuaagugcuaggauuacacgugugugccacugagccuggccauaauagucuuuaucucccuaagcacaugcaggugauuccugauaggcuccucccaggccccugcagcccagggugcucaggcagggcaggcagaaugcaguuggggauggaauuguccaggagggaggccuagacuuuggaaggccuugaaagcuggcugaguaguuccagguugggggagggucguaacugguguuagaucugggcucaaaguggggugagugggaagcuaaagaugguccagcagaagacagggcuggaccugggaaggggucauggggugguagaagggugagggacaccucacugacuucacggcugaccacgugugaguagcagggaggaaggcguccccaggaucccaaggucugccccucgcccagaacagccauccucccccuuauccaucagcuugcucuguauguucauucauugauacuacaaaccaggcgaaaucugggugguguugagcaaggaaggggcagggucuguccuaucccaggcaguguaaagaugccccuggaguggguugagcaaacuggagagcccagaccccacaggaacagucccuucacuccaucugggacauuugaaacuccucccuuuuuguucaccgguggaauccaguagggggcauacccauugcuccuccccaggcccccuuccaccucugggguguccuggccacacucacugcucggugccauguggaggagauaacauuuccuuccgcccaugccccacuaucuggccccagcauguuuuaagug

SEQ ID NO: 15062 - RNA, 53251 nt, Homo sapiens
cuguaacuucucgccuccucuucgccgucccucccacagcggcugcucggcucccgcccccucgcccucccacagcgggucuucccgcggccgcucuggcccaagcguccccucgucucucugaucuggcccauccggcuucggagggaggcgagggugggugagcaaagggauugggucugugggguccaggcccgaaccccugaagacgggcuccgcccccggcacccgcucgcgccccgcccccggcuggaggagucucuccuggaccauccgaaccuagccugucccggcccgcagccucuauggaggcuccugccgggccguagagcccuucgcccccuggggacccacccgucuauaagguccguuuggccugcagcagccugaguccguaaugcugggcacuguucaugggaucggcccccuauggagcccugugucuauaggggacuccuacggucccuaggguucggccccguccauaaugacuccauauacagggccuuccaucgcucuauagggcucagcccucggcuuccagagccugucagcaguggccguacccuucgccgggacugccgggucuccgggaccucuucgaucuacaaggucauguuaugccuauagaggucgcauuugcagggccucaccccggguagaggguccucuccagguuuuuacggccuguccccgcucuaagggucagugcaggaggcggcgauggcccugggcaagguucuggccauggcacugguuuuggccuuggccgugcuggggucgcuguccccuggggcccgggcgggggacugcaaggggcagcggcaggugcugcgggaggcgccaggcuucgugacggauggugcgggcaacuacagcgucaauggcaacugcgaguggcucaucgagggugaguggggccgcgugggucacucacuaauucgcugguaguucauucaugugugcauucauccacucaccacauucccagagcucgguucugguccaggccuuuugcucuaaaaugccugacacccaggguugcagccaaccugggcccugcccuggaaggccuccaagucuggugggggagaugcaccuacacccagauuuacaauuacaagacaggagcaucagugccgggccuucugaguaacuguuaagaacucagggucuggguccaaucauuuggcuuugaauuugguucuacuacuacuacuuuuuuuuuuuuuuuuuuuugagaugggggccucacucugucacccaggcuggagugcaaugguaccaacacaauuuacuuacugcagccucgaccuccugggcucaagugauccucccaccucagccucccaaguaacugaguguguagagacagagucucaccaugucgcccaggcuaguccugaacucuugggcucaaacgauccucgcaccucagccucccaaaguguugggauuguaggugugagccacugugccuggcuucuuauuauuagcuuugugacuuugagcaggugguuuucuuucucugagguucuguuuccuucccccacaaaugggauaacaacaguacucaccucauagaguuguuggaaugaaaugaaaacagguauuuaacaugccugauguguggcauauaguaacuguucaauaaauggcauuaggauuauuguuguuguuauuugugaaguacuucaauaaaagcauuuuucuucagucauucaugugccagacauuauguuucccauuggacauagcccagacugagacagcuccagcaaucccuggugacuuaggucuuggagucuaguuggggagacaaacacauuaauagugagagacaagaguggucuuugauggaggaaccccagaggccugggagagcccagagaaagugccugaucuggggccggggagaacagagaggcuuccuggaggaggaaaugucuaagcugagacuuaaaggaccaauaggaaucugucaggagugggaggaaaggccccagcccuacccuucugggcucccagucagugggagagacaaacccacuccgaggcuguuuguuuuccuuuuccacccaauaaacuccuaugcaugccucagaacccugccccaguggcucuuucucugugaagacauguggcuuaaccugggguauagcugagaucagaggcaucuguacgagggagcagaagggcauuccaggcaagaauagcugugcaaaggcggggaagcgggagagugaugcuuuugaagaacuagaaauccaguguguuaaaacauagaauacuggcaggguaugguggcucaugccuguaaucccagcacuuugggaggccgaggccggcagaucgccugaagucaggaguuugagaccagccugggcaguauggugaaaccccaucucuacuaaaaauacaaaaauuagcugggugugauggcgcgcgccuguagucccagcuucucaggaggcugaggcacaagaaucacuugaaccuggagguugcagugagccaauauugugccacuacgcuccagucugggcggcagagcgagacuccaucugaaacaaaaacaaaaacauagaauacaagacaacgaaugagccagaggcugcagggugggaggagccagcagguguagggcucugugauuuugagcuguauccugagggcaauacaggggugaaagagaaguugaaaggcaguaccugcagaagcccaggaaggccucacagaguaguggauguaaaagcuggccuccagacaggggagguccugggcaaaggccagaggugugacagagccuggaucaugcagggccucccuugggaggcuguggagcuuugucuuugucugggggcucuggggagcuauggaaggguuuugagcagggagaggacaugaucugauuuauguuuuagaagaucucucuggcugcugugugggguauggaugaaggccuguuucucagugauagcaugucuaccuguucccagcuugggggccauuccugucaagcuagugggaugagaacagaauaggaaguguguguguguguguguguguggcgaaggggucugugugcuggauauaaaucacucucuggccuuaaagagucccagacugguuaggccaggugcgguggcucacgccuguaaucccagcacuuugggagaccaaguggggcggaucaccugacgucaggcuuuagagaccagccuggccgacaugaagaaacccccucucuacuaaaacuacaaaaauuagcccugcgugguggcgcacaucugugguuccagccugggugacagagcgagacucuaccucaaaaaaaaagaaaaaacgucucagacugguugggaaugguggggcuggacacagauauucagcccccaguguguucacugagacagugcucagggcuaagaaggaaaguggaggggugggguggauguaccuagggaggaaagaggacugugcugcagauaacagagcaggagccacuaaaauaggguucugaagcaugcauaggaguuuauugagugggaaaagggagcaaacagccucuaugaagacgugaggguggcuggagugucucaggauccccaucuagguuugccuggucuuauggcacuuuugacugggagguaaugagagccagaagcaggggaagaggggccuugaaugucacacugagcagccuggccuuccccuugggguugaugggcagccacaggagguuuugagcaggaguagggcauugcccucagguuggguguggggcagacuggagacuugaugagcugaucuggcaagagaggaugaguuccuaacuagggcaggggcuuagagggguggagagguguagacagugcaaucgauguuuguggaguuucaccuauaagacuuggggaccaacuggguagauguuggggugagggaggaggcugggagaccuccagaucccccuugaugaucuucuguucuuaccaaugccugucacuucuuaccuauaagaaccaacaucuuccucuaucuauuauaaaauaaacaaccagccaggggcaguggcacaugccuguaaucccagcacuuugggaaucugagaugcaaggauuacucgagcccaggaguuagagacuagccugaacaacaugguaagacacugucucuacaaaaaaauuacaaaagauuagcugggcuuggugggugguggcaugugccuauagcuccagcuaccggcgaggcugaggugggcagaucccuugagccuaggaggcugaggucucagugagccgagauugcgcugcuauacuccagccugggcagcagagcgagacccugucucagggaaaaaaaaaaaaaaaagauaaacaaccaaccuacuaacuuuuguauuauguucauacuuuaucuaguccuagacuuuuuuuuuccgagagagaaucuugcucuguugcccaggcuggagugcaguggcuugaucucggcucacugcagcuucugcuucccagguucaagugauucuuguuccuugguuuccugaguagcugggauuacaggcaugugccaccaugccgggcuaauuuuuguauuuuuaguagagaugguguuucucuauguuggccaggcuggucucaaacuccuggccucaaaugaucugcccugggauuacagacgugagccaccacgcccagcccaguccuaguccuuauaacauccucauggauaagaggcauccugcuuuugagcaggagggaguuugggaucagauuucugucuggagugguauggggguuggguggaaacagaagaccuucaacuuagggaagaacuuggggaggcagauggugagcuggccuccagcaggcacuuaacaaagauguacuugugauuccagaaacagagcuuuauaguuugguugaggcugguaagauucugggaggucugguuguguggccgugcugaaugguucuucugcauuccccaaagcauggguggggucugugucugaugucuugggggcucugguuagagccugagggagagcuuccagcuuuaguauucugucuuuuauguauuucuucauuucaucauccagcauuuccugagccuuugccaagcccgggucugggcaaugcugcagagggaauuagguccacauccaggcccugcucuaugggccuuguaggcugcagggagacagaccuggacauagauguuccuggcccagaggaaugaagguuauaaugggaugugagaacccuggagagggggcaucuaacccagcuagggggcaucaggaagaggccugguggugggaagggauaauauguugcagacagagggagaagcuuguacaaaggcccagcucccauuagagcuguaagcaguggggugauuugagacaaagcgagggucugaacagcagguuagggaccuggacuuucuccuagggugguagggagccaugcagggcuuuggggcaggggagggacggggccagauguugaguugggaagaucagagacucaugucaggggaagaaggagguuggaucagugguucuggugagacaggaugaggccgggcagccagggcacacucuggcucuaagcuggcaggcuggagucaucaccucguugaauguucaccccagccuuuguggguggggggaauuauccccauuuuacagucauggaaacuaaggcucagagagcccauggaacuggcccaggaucacccagccauuggcagugguggcugagugucuccaggauccagauaggcacacugagggucaugggggaaagggcuggcccaggguccuccagcuggucaugggcagagccagagccagagccagagccuaggccuccuaauuucccucacccagaggacuccccugagcugccuguucagaaggcuucucaugugggauguggaaugagagaggcuaccugaacuaggacuggcagagaauaagacagugacaguguuagggguaguggcacucuccacgauaugugggccccauugucaacauuucuuuuuuuuuuuuuugaaacagaguuucacucuugucgcccaggcuggagugcaauggcaugaucucagcucacuguaaccucugccucccggguucaagaauucuccugccucagccucccaaauagcugggauuacaagcaugugccaccauauccagcuaauuuuuuguauuuuuaguagagacgggguuucaccauguuggccaggcuggucucgaacucuugaccucaagcgauccacccaccuuggccucccaaagugcugggauuauaggcgugacccacggcacccagccucuuuuuuuuuuuugaguccccucugucgcccaggcuggagugcaguggugcaaucuuggcucacugcaaccucugccucccggguucaagcaauucuccugccucagccuccugaguagcugggacuugcaccaccaugccuggcuaauuuuuguauuuuuuuuuaguaagagacaggguuucaccauguuggccaggcuguucuggaacuccugaccucaggugauccaccugcccuggccucucaaaagugcugggauuacaggcgugagccacccaccccacucuguugucaccauuucgugugcauuauugcuccucaugagguugcagucagaugucagcuggggcugcagucagcugaauguucaccuuggcuggacauccaggaaggucccucccagggcuggcaguugaugcuggcugucagcuggaagcucaguugggacugucagccggaaugccuguguguggccuuuucuuguggcuuuggcuuuucuuuguuuuuuuuuuugagacgaagucucgcucuugucccccaggcuagagugcaauggcacaaucucggcucacugcaaccucugccucccagguucaagcaauucuccugccucagccucccaaguagcugggauuacaggcacccgccaccaugcccagcuaauuuuuguauuuuuaguagagacgggguuucgccauguuggcuaggcuggucucaaacuccuguccucgugauccgccugccuuggccucucaaagugcugggauuacaggugugagccaccgugcccagccggcuuuggcuuuuccuaucaugacagcuguguucugagaaggagcauucuacgaggcccaggugaaaaguacaagucuucuuaugaucuagccuuggaaguuucagaauuucugcuguuuuuuuauuggucaagcaagucacuaaggcucuucccagauacgagaggcagggaauuaacuuucaauggcaggaguggccuauaaguuugauuccaccacaguaccacuauaucccacuuuagagaugaggagaccgauccagaggggguggguuacuuggccaagaucacacagcugguagcuauuugguggcagagccaagacauaagcucaggcagucugguuccagaguuugugcuuguaaccaucacaauaagcagaggugagacucuggauggggacagaggggaacuaugccgcuccaagguuaggccucuguucugggggaagaagcuggacucuucucuugcagcucuauucagcgugggccagggguggugucacggaggugcucuucucacugggauuaugaccuugacccuccagccuggacaugucugaaacucaggcauggacaggaagagagaggcaucaggaacacuggauucugcucuguguggccacugggaugggguuuucucuguacuuaauuuucccaucugaauggugggaguguucauucugaucucaggugaccuuucuagaggucuggaauauuaugauucuuucucugggcuccugucccucuggcugucacagcccuugacugcccuagguuaugagacugggggccccuucaaggcggggcccaggucugacucauucuugagcccccagcaucaccuggaucaggguuugguguacaauugugggaggcugcagggagguguggggagaagguccgcuuuagagcuuggucccucugugcucaccucccagccccaagcccccagcaccggauccugcuggacuuccuuuuccuggacacagagugcacguaugacuaccuguucguguaugacggugacuccccgcgagggccgcugcuugccagucuaagugggagcacccgaccuccgcccaucgaagcuuccucaggcaagguuaguggggauggggccguggcagauacaccgagggaaauggaagaagaaaggagggacagagagucaguaagagggcauccaagagcagagcacagggacaagggaagguggagagaggcaaaggaaggagaugaggcucugggucccccaggguggaagggggcaggagugggccacccucccaggacaauccccaggcccugcccaccuuacccagcacaccuugugcccgcagaugcugcugcaccucuucagugaugccaacuacaaccugcugggcuuuaacgccucauuccgcuucucccugugcccggguggcugccagagccacgggcagugccagccaccgggugugugugccugcgagccgggcuggggggguccugacuguggccugcaggagugcucagccuacuguggcagccacggcaccugcgccucggugagccgguccccagcccuguuuccccuggggcccugaucugugagcgcagccuccacgcccaucuccuaggucugaccuugcuccugcaugaaacuccccccaccaccccacccuccuccgugacacccacuucccucuccuuccagagcuugccccucaccuguuacuccaaccccaccccaccuucaccugcagggccuccccugcugaggauaucccacucucaucuauaccccacucucaucugugaacaccacccuccuuccuccagccaggcccaaaucuguccucccauccagccacucuguguggccuuggaccccugccaugacuuccagccucgcaccacugaccuuacgccgaagcuguguacauccagcuuucaaucuggauugcgcuuugagcccuccccgccuugaccuccccagaucugagcucuuucaguccaggcugaaugucaacuacgcugucuguauucucccagccugccgucuuucugucuuuucuccuuuuucucugugcaucuuuuccuuuuucuguuggucuucuuuuuuccgucugucugcuuccuucugauuguuucucuuugucucuuguuucugucugacaguuugccuuuccccucuuccugucucucucugucucccuuucucucucucucuuuccuuuuccauccucucccuuccugucugucucuuucucucucccuuugugcccugucugucucauucugccucuuuuccucucugugucuccuuugucucucuguccuugucucucccucucuuaucucugccuuuaugucuccuuucccgcagccccugggaccaugccgcugugagccuggcuucuugggacgugccugugaccugcaccugugggagaaccagggggcugggugguggcacaacgugagugccagggacccugccuucucugcccguauuggggcagcuggcgccuuccuguccccaccagggcugcuggcaguuuucggaggugagcagauggggcgaguaucugggaucuggaggcccggcagccuauggccagggcaugagacuauccaccccuccacaggccaggaccucaacaaugcccugggugaccucguccuauacaacuucuccgccaacaccugggagucuugggaccugaguccugccccgguauggaccccuccucugcccuggaggagccuuuccacucaaucagacccagccggggacccccggaaugauccccuaucaccuagugcucccacaguuccugcagcuugauauaggaaccuacuucucccuguuucugccuuuucucuccgguuuucuuuuuucuucuuccucuuccuuuaucugccuuugugcaucuuauuuuuccaugugucuccuguugcucaaucugucucuguuuucgucugucugacuuuugggcuucuguguucucuguuucugugucuccaucucucuggaucuguuucucucugccauuugucccuuuaacucugucuccuugccuuuucucucucuuauuguauuucucuguuucuaugagucugucucuucuuuucucucucugccggucucugccuuucucuuugucucugucuuuaucucgccuucucuccauguuucucuggcucugcaucucucugucuaagccuggcucuggcucucuugcugugucucuaccucugucucuuuucucuuccucacaggcugcccgucacucccauguggccguggccugggccggcucccugguacugauggguggugagcuggcugacggcucgcucaccaacgacgugugggccuucaguccacugggcaggggccacugggagcuccuggcaccaccugccuccagcuccucggggcccccaggccuggcaggucacgcggcugcccugguggaugaugucuggcuauaugugucuggaggccgcaccccgcacgaccucuucuccucuggccucuuccguuuccgccuugacagcaccagcgggggcuauugggagcaggugauuccggcaggcggacggcccccugcugccacuggccacuccaugguguuccaugcccccucccgugcccugcugguccaugguggacaccggcccuccacugcccgguaagugaccugucccauaacccaugcuccacaggccaggcccagcucaacaccauaggccuuuagucuuuagaggucuuugcccacugucggacuccuguggucucucagucacuccuuccuucauguauuuacuuauuccuucguucacucauucauucauucacccacucacacauucucugauguuuuauucaaucucuuggugaauugccuuccacacacucccacccauguaucuauucaacagagcccugcuugguguccagcccuugcuagcuuaugcagguaacucagagaugacucaggguccugcccacagggaacuucuaguuuggaggggacauagagucagucauggccagucucaucccugggugaucacauggcuccuaagagccuggaggagggagagagacgcuuccugcccugagccccugcccugcuucuccuucgguagguucucugugcgagugaacuccacugagcuuuuccacguggaucggcauguguggacgacgcugaaggggcgggaugggcuucagggcccaagggagcgagccuuccacacagccaguguucugggcaauuacaugguggucuauggugaggaggcuccccaauccugccugccugccugcugagggccugagccaacccugagcugaggcucccugcaggggaguccccccaccuccccuaggcuugccagcuaugccccuuuccuccauucccagggggcaaugugcacacccauuaccaggaggaaaagugcuacgaagauggcaucuucuucuaccaccuuggcugccaucaaugggugucaggagcugagcuugccccgccaggaaccccugagggugaguggucccuguucuucccuaggggcuccugagggucccaccucucuccauagugauucugggcucaagccaccucaguccguaagggugagccugacauccaggccaguuggugccagccuuaggaggcaagccugggauggagaugggacuagggcaucgucaccauggagaugggaggcccuuaccgcaguauccaauguggguuccaauccagguuuugccaguuuccagcugccccagggaaaugccuaagaggcagcaacuuuuccuucuuuuuaacuuucuuuucuuuucuuuuuuuuuuuuuuuuuuugagacggagucucgcuguugcccaggcuggagugcagugaugugaucucagcucacugcaggcuccaccccccggguuucacgccauucuccugccucagccuccugcaucgcugggacuacaggcgccugccaccucaccuggcuaauuuuuuguauuuuuaguagagacgggguuucaccguguuagccaggguggucucgauuuccugaccucaugaucugcccgccucggccucccaaagugcugggauuacaggcgugagccaccaugcccggccucuuuucuuuuuuuuugagagggagucucgcuccgucgcccgggcuagagugcaguagcgugaucucagcucacugcgaccuccaccucccggguucaagcgauucuccugucucagucuccugaguagcugggauuauaggcaugcaucuccaugccuggcuaauuuuuuuguguuuuuaguagagacaguguuucaucauguuggccaggccagucucaaacuccugaccucaagugauccucccacgucagccucccaaaguacugggaucacaugugugagccaccaugcuuggccuuuuuaacuuucaauuuagguucagugguacaaguacagguuuauuauauagguaaauugugugucauggggauuugguguacugauuauuucaucacccagguauuaagccuaguacccaacagguagguuuuuuuuuuguuuuuuuuuuggggauggagucuuacuguguugcccaggcuggaaugcaguggugcaaucuuggcucacugcaacuuccaccuccuggguucaagugauccucccgccucagccuccuaaguagcugggaguauaggcgcaugccaccacacccggcuaaucuuuuuguauuuuuaguagagacgagguuuugccauguuggcaaggcuggucuggaacuccugaccucaggugauccgcccaccucggccucccaaagugcugcgauuacaggcgugagccacugugcccagccccaguagguaguuuuuugauccucucccuccuccaacccucagguaggccccucaagugucuguuguucccuucuuugugucccuguacacucgauguuuuguucccacuugugagaacaugcaguauuugguuuucuguuccuguauuagucugcugaggauaagggccucuagcuccauccaugcugaugcaaagaacaugaucucauucuuuuuuauagccacauaguauucuaugauguauacguaccacauuuucuuuuuuuuuuuuucuuucuauguauuuuuuuuuuuuuuuuuuuuuuuuuuugagacggaguuucgcucugucgcccaggcuggagugcaguggcgggaucucggcucacugcaaccuccaccucccagguucaagcgauucuccugccucagccucccgaguagauggauuacaggcgccuaccaccacagccggcuaauuuuuguauuuuuaguagagacgggguuucaccauguuggcuaggcuggucucaaacuccugaccucaggugauccaccugccucggccucccaaauugcugggauuacaggcgugagccaaugcgccuggccuccauuuucuuuauccagucuaucauugaugggcauuuagguugauuccaugucuuugcuauugugaacagugcugcuuugaacauacacguuagaacaauuuauauuccuugggguauauacccgauaaugggauugcugggucaaaugguaauucuguuuuaaguuauuugagaaaucuucaaacugcuuuccacaaugccugaacuaauuuacauucccaucugcaaccucacucgcauguguuauuuuuugacuuuuugauaauagccauucugacuggugugagaugguaucucauugugguuuugauuugcauuucucucaugauuagugauauugagcauuuuuucauaugcuuauuggccacguguaugucuucuuuugaaaaaugucuguucauguccuuugucuacuuuuuaaugggguuguuuuuugcuuguuaguuuauuuaaguuccuuauagguucuggauguuagaucuuuguuggaugcauaguuugcaaauauuuucucacauucuguacauuguuuacucuguugauaguaucuuuagcaguaacuuuuucaagaucacaguagauaagugacagagccagcauggcuauccccaaacaacaaucuguauaaaacuaucacuuaaggccgggugcaguggcucacaccuguaaucccagcacuuuaggacgccauggcgggcagaucaugaggucagggguuugagaccauccugguuaacaugguaaaaccccaucucuacuaaaaauacaaaaaauuagcuagucaugguggcaugcgccuguagucccagcuacucaggagacugaggcaggagaauugcuugaaccugggaggcagagcuugcagugagcugaguucgcaccacugcacucccaccugggcaacagagugagauuccguccccaaaaaaacaaaaacaaaaacuauuacuuaaucucugugccucaguuugcucaucugugaaaugaaaauuauaacacguaaugccauuggauagcuguaagaguaaauugagaugauccuucaagaaugaugcccagugaagugcuccacacauuuccuuucuuuuuuaaaauuuuuauuauuuauuuuugagacagagucuugcucuguugcccagacugaagugcaguggugugaucuuggcucacuccaaucucugccuccgagguucaagcaauucucaugcuucagccuucugaguagcugggacuagaagcgugugccaccacacccggcuaauuuuuguauuuuuaguagagaugggguuugccauguugaccaggugggucucgaacuccuggccucaagugauccaucugccucggccucccaaagugcugggauuacaggcgugagccaccgugccuggccuaauuuuuguauuuuuuuaguagagaugggguuucacuguguugaccuugugaucugcccgccugggccucccaaagugcuaggauuauaagcaugagccaccgugcccggccaggcauuauuauuauuguuguuacuauuuuguuuuauuuuacuugagauggagucuugcucugucacccaggcuggagugcgguagcauagucuccacucacugcaaccuccaccucccguguucaagcuauucuccugccucagccuccugaguagcugggauuauagaugugcaccaccacuccuggcuaauuuuuguauuuuugguagaguugaaguuuugccauguuugccaggcuggucuugaaguccugaccuuaaguaaucugccugccugggccucccaaaguucugggauuacaggcaugagccaccacgcccggccuauuguuacuauuuuagaggcagagucuuguucuguugcccaaccuggagugcaguggugcagucauagcccacugcagccuugaccucccgggcucaagcaguccucccaccucugccucccaagugguugggaccacaggcccaugcuacccuucccagcuaauuaaaaacagaauuuuuggccaggcacuguggcucauuccuguaaugccagcacuuugggaggccaaggcgggaaaaucgugaggucaggaguucgagaccagccugguuaauauggugaaacccugucucuacuaaaaauacaaaaauuagcuggcguggugguagaugccuguggucacagcuacucaggaggcugaggcaggagaaucgcuugaacccaggaggcggagguugcagugagccaagaucgugccacugcacuccagccuggguaacagagggauacuccaucuccaaaaaaaaaaaaaaaaaaaaacacacauaaaaacagauuuuuuaaaauuuuuuguagagaugaggccucccuauguugcccagaguggucuugagcuccuaggcucaagucauccuuccaucucagccucccaaauagcugugaccauaggcacacaauaccacgccuggcuaauuaaauaaaauauuuuuguuuuuuagagauagggucuugcuguguuguccaggcuaguguugaacuccuggccucaagcgagccuugugagauccagccucccaacgugcugugauuauagacgugaacuaccacgcccagacauauugucuuucuuauagcaguuaggguccugucucagggccagaggggucaccagggaggagauauggagaaaccuuucacucucauuaaaucagacacugcuuugaaaucggaugaaagccacaggcccucucuucagaagaugcuuauaccugcaaguugggcguaucacuucggggacgugugggcuucccagagucgcaucuguucacuccuccucccugaaaaggagagagaggagaggacaagcguaaggaaggaaccuuagcacuuaagggaugggaaggaggaaaggccccagaggaacccugugugaccaucaggaauaaaguccaggccuggugucugaggcccucauucuaggucucgucugccuaucccuugguccccuucacugggcaggagucaggagugugauguuucuggaggccucuuccugcuucgcaguuugugauuaccugggccaagucccacacguuuacagugcacgcaggucaguaagaggguagggaagucaccauucacugaccacuuaccugucagucaggauucuuggcuguaacugacagaaacccaacccagcuggcuuaagcaaaaaggagaauuucuggcugggcacgguggcucaugccuguaaucccagcacuuugggaggccgaggcgaguggaucacgaggucaggagaucgagacuguccuggcuaacacaguaaaaccccguuuuuacuaaaacacaaaaaauuagccgggcuugguggcgggcgccuguagucucagcuacuugggaggcugaggcaggagaauggugugaacccgggagacagagcuugcagugagcugagaucguggcacggcacugcagccugggugacaaagcgagacucugucucaaaaaaaaaaaaaaggaauuuccuggcucacuugagugaaaacuguaggggcugucuucaggcugggcuggaucuaggugcucacaaaauggcaucagccauuucucacucaauuuuucagcuggguucacuucagucucuugccuuguguagauggucacaggcagcucguggauuaucuucugccauaaaaugcccagaaagaagggagugucuuugccccaagaauugagaaucaggcccuguaccccucccugagccagucacugagacugaugggccugggcuaaggccucacuucugccagaaccagggacaacuccaccuaagucucacagauugggaaagggaaagguugguuuuccagaggaaaaucaggcgcuaucaccagaagagaggcuggugcuagacagacaaaaaugggagacugaggcagccuacugggggcucagcagauucuucaguccucccagcucccugaggacgagaugaugguucuuuuuauagaggaggaaaccaagacucagagaaguucagucuccuguccagggucacacagcuagucaguaguugauccacgauuugaacccaaguaagugguagaugcaggauuugaacccaagucuuucugacccuaaagaucagaaagaugauuuggguaggggcgagggagcucagcuuguucagggccaggugggcugggagaguguccuugggcaggugagguugaagcagccaccggaauagaaggcugggcuguggcccaggagaaucaggagccauggaggugguggaggggcugggggucuaauaaugucauuggggucucuauuccccuaggccgagcagcgccucccaguggucgguacucacauguagcugcggugcuugguggcagcguccuguugguggcugggggguacagcggccggccccguggggacuugauggcguacaaggugccccccuuuguguuccaggcaccugccccugacgugagcacuggggugacagggaaaggguggcuggggggaggagguagcaggguuuccacaggugaggggaaaggcaggaggggaucccugggagaaggaguggggaucccuaggaccaugagagaagggaaggaggucccuggggcagaggaaagaggagcuagaggucccugggccugggggaggaauggaugggcaugcugagcacucaggguccucugggauagcuaaagcaagcggggacuugggaggccggcccaggucugagaggccuccuccuccguccccuugccucccccucuguccccuugccucccugcaguaccacuuggacuacugcuccauguacacagaccacagcgucugcucccgggacccggaaugcaguuggugccaaggagccugccaagcugcacccccuccugggacccccuugggggcugugagugacagcccuagacccucuguucccuagcauagagaccugcccucagugucucccucugccuaaccagauggacaagaacuuucccucaacugggagacuuguuuucaugccggagauccuccuuccugauuccugacugcggagcccugaaccuuugccuaucccacccagcccgacccuuuugagcccgugaccccauccccgcaucccccguccucuggaucucccacauuccaagucaacuccccguucuucaguuuuuucgcccuuuccaucgcaggacccuguauccacagcccuuccuucccagaucucuugagcuccaguugacagugagcccuuuccccucuccuccucgcaguguccagccgccagcugccugggccugggccgccuccugggugacugccaggccugccuggccuucagcagccccacagccccuccacggggaccuggcacccugggcuggugcgugcacaaugagagcugccucccuaggccuggugaguguccgcagcagugggccggcaggagggggccagagcacuccacacugacccaccggcccccacccccugucuucucagagcaggcccgcugccgaggggagcagaucucaggcacugugggcuggugggggccugcgccugucuucgucacgucccuggaggccugcgucacccagagcuuccugccuggccugcacuugcucaccuuucagcagccgcccaauaccucccagccugacaagguggguaggaggcguggcccugggugggguguugaugauccugauccuaggguuuguuuuuucucaaaugcaucuuuaucacucuuauguuuacuccaaaacucuuuacauucaagggucuuauuuuccuuauggacuuuauuuuuuauuuuuuuugagagggagucuugcucugucacccaggcugaagugcaguggcgcagucucagcucacugcaaccucugccuccuggguucaagugauucuccugccucagccuccugaguagccgagauuacagaugcccgccacugcgcccagcuaauuuuuguauuuuaguagaagacgaaguuucaccauguuggucaggcuggucuugagcucuugacuuuaaaugauccgccugccuuggccucccaaaacucugggauuacaggcaugagccgcugugccuggccuccuuauagauuuuaaaaagaauuuuuacauugugguaaaauacacauaaaauuuuucaucagugacauuuagcacauuuacaauauugugcaaucaucaccacuaucuuguuacagaacauuuucaucaccccagaggacaacccuggacucacuaaguagucacucucuauuccacucuuccccccggucccuggcagcuacuaaucuguuuuccaucucuggauuugccaguucuggacauuucauguacauggaggccuguacuauguggccuuuugugucuggcuucuuucacucagcguaauguuuucaaggcucauucauuuuauaacuucauuuggaaaggaacucuauuccuuuuuaugguugaguaauauuccauuguauagauggaccacauuuuguuuauccauucaucagcugauggacguuugggcuguuuccaucuuuugacuauugugaauaaugcugguaugagcacuuguguacacguuuuuguuugaacaucuguuuucaauucuuguggcuguauaccuaggagcagaauugcuggguuauauguuaauuccauauucaucuuauugaggaauguccaaacuguuuuccacaguaccucuuuauugauuuuuuguuguuguuguugagacagagucucucucucugucgcccaggcuggagugcaguggcacgaucuuggcucacugcaaccugcagcucccggguucaagugauucuccugccucagccugcugaguagcuggaacuacaggcacuugccaccacacucggcuaauuuuuuguauuuuuaguagagaugggguuucacuguguuagccagcauggucucgaucuccugaccucaugaucugccugccucagccucccaaagugcugggauuacaggcaugagccaccaugcccggccucuuuauugauuuuaaaaauagcucauauauucacaugguucaaaaaucacagugacaucaaaagucauuggggcugggcacgguggcucacgccuguaauuccggccgaggugggcggaucucuugaggucaggaguuugagaccagccuggccaacauggugaaacccugucucuacuaaaacuacaaaaauuagccgggcgugaugucgggugccuguaaucccagcacuuugggaggcuaaggugggaggaucacuugaggucaggaguuugagaucagccuggccaacauuacgaaaucccaucucuacuaaaaauacaaaaauuagcugcucauggugaugcgugccuguagucccagcuaccugggaggcugagggaggaguaucucuugagccugggaggcagagguuacagugacccaagaucacgccacugcauugcagccugggcaacagagugagacuccauuuuaauuaaaaauaaauaaauaaauaaaaggcugggcacgguggcucacgccgguaaucccagcacuuugugaggccaaggcaggcggauuacaaggucaggagagcgagaccguccuggcuaacacagugaagcccugucucuaauaaaaauacaaaaaaauuagcugggugugguggugagcaccuguagucccagcuacucaggagucugaagcaggagaauggcgugaacccgagagguggagcuugcagucagcugagaucaugucacugcacuccagccugggugacagagagagacucugucucaaaaaaaaaaaaaaaaaaaaagaaaaagaaaaagaaaaaaaagucacuaaauggacagucucucucauuuaccccacucccuaccccuuaagugguccaaaauuaucuagcuccagcauggcugcaacuuaaggccaccauaccucccuggaagauccauuuggguuucuuugaucuuauuccagaauuuaccuauucagaugcaaguaagcaugacaucauaucauuuuucuuucucacuaaacuaauauacuaugaacauuauacgacugcuuccuuuuuuucuuccuggcaagcuucccauaacagaacuuaagaaacacucucauucuuuuuuuuuuuuuuuuuuugagauggagucucucucuaucgcccaggcuggagugcaguggcaagcgauuucagcucacugcaacccugccucccgggcuuaagugaucuucccaccuuagccucccaaguagcugggauuacaaacaugcaccaccaugccuggcuguuuuuuguauuuuuuuuguuuguuuugagacggaguuuugcucuuguugcacaggcuggagugcaauggcgcaaucucggcucagugcaaccucugccucccggguuugaacgauucuccugccucaggcucccaaguagcugggauuacaagugcacgcuaccacucccggcuaauuuuuuguauuuaguagagaugggguuucaccauguuggucaggcuggucuugaacuccugaccucaagugaucugcccaccucggccucccaaagugcccgccgugcccagccuucauucuucuuuuuuuuuuuaaguuguauaauauuccauuuacauuuguaguuuauuuaaauagccucccacuggugaacacuuggacuguuccacucuucugcuauuacaaaaucacacaccaggaaaauaaaucuugcacuuugucugccacuuugaauauuagaucugggcuuugaagugcuuagcuggaaaggugaggaguuggauaagaagacacugaaguguccaguccuggaguuuuaaugugagauggaaauggcuagaggccagggguaaaggugggcucugggacccugucgucuauugucugaauuuaggucuugccucuuuucccagagugaccuuugacaagccaccuaaccccugucccucugccucagucucucauuugguaaaauggggaagaagguuggguugaccagucuuuucuggcucugauguggccugugaguccagaaagggacucacacauacacccaucccugguggcacaggucucaauuguccgcagcacgaccaucacccuaacacccagcgcagagacagaugugucccuggucuaccguggcuucaucuacccaaugcugccuggagggccagguggaccaggggcugaggacguggccguguggacgcgggcccagcgccuacacguccuggcccggauggcccguggcccugacacggagaacauggugaggccgccugggacauucaggggguuguuuaugguaaauagggaguuaggggugugguauagagcaucuguggugauuugaagguucuggggaagggcuggggagaaauuagaggcaggagauggauuuuuuguguguguguaagacagagucucacucuguuguccaggcuggagugcaguggcgcgaucucggcucacugcuaccuucaccucccagguucaagcaauucuucugccucagccucccacguagcugggauuacagaugugcaucagcacuccuggcuaauuuuuuugcauuuuaaguaaagauggguuuucaccauguuggccaggcugguuuggaacuccugaccucagaugauccgccaccuuggccucccaaagugcugggauuacaggcguaagccacugcgccuggcugggaauggaucuuucguagaggagggagggugcugagguuuucaauugugagcagaauuugagggaaacuuugaagcaggugaggaaggucugagucagacuugaaaggccccugaaggcugggcauggagguguacaccuguaaucccagcccuuugggagguaggggcagguggauugccugaacccagaaguuugggacuagccugggaaacauggcgagacaucaucucuccaaaaaauacaaaaauuagcuggccaugguagcaugcaccuguagucccagcuauuugggaggcugaggugggaggaucacuugaaccugggaaguugaggcugcagugagccaugaucgcaucacugcacuucagccugagugauggaaugagacccugucucaagaaaaaaaaaaaaaaaaaagccccugaggaggagggucccugggggucucaccucugagguucucaggaucuaaggagcucugaggcccucuucuuaggagggggugggguacaggguggguuuggagguaucaggggucugaggaaggaaugggaaggguucugaggccccugccuaucacucacaccuaccccaggaggagguggggcgcuggguggcucaucaggagaaggagacgcggcggcugcagcgcccugggucugcucgccucuucccucugccugggcgggaccacaaguaugcaguagagauccagggccagcucaauggcucggcaggcccugggcacagcgagcuaacucugcugugggaucggacuggugugccaggaggcagcgugaguacccaggaccuaccuccaacccuagccgcaggccccagccucagaucaccugggcuuucugaaccccaggccacaaacucugaaaucccuagauucuggccucggacuccuuaacucuuggccucugaacucuggaccuccucuugaacccuguggccccugaccucugccuauagacccuaaccugaucccauauuuugacccccaucuucugacuccucacccuugacccugcugacccugaccucugcccuccauacuuugaccuauaauaaucuccagauuccuccagaccuuggaccucuuuacugauuuccuaaauccugacuuccuaugugccugaguucucaaccugggcuccaaacccuuacuuucaguuagcgccagacucugaccccugccccagaccuugacugcugccuuccugugaccccuuccccaggagaucuccuucuucuuccuggagcccuaccgcucgucguccugcaccuccuauucuuccugccugggcugcuuggcagaccagggcuguggcuggugccugaccagugccaccugccaccugcgccagggcggagcccauugcggggaugacggggcuggugggucccugcuggugcuggugccuacccucugcccacucugcgaggagcaucgggacugccacgccugcacccaggugccuguggggccaccaggggaggucacaagguggagggagccacagcaggcaaugggcagucaagggaaccccugguggggggugugggggaaacagcaagggcuuuuggccuugaucugcagagccugguggggagggugagauggagcuguagagagaggcaccuggggagucaggacucucccuguuguaggggccagagaaugcaacuccauccuuuuccacuagcggggaguuucucagcauaggcacuggagcccaggaguaggccuucaggccugccaccuccaagugaugucaggcagcccucgacacccugcuuccucuuguucccugggaggguuuguuuccuugugaguggcaagggagccguuaaggguccaggcucuaagucccugcucugucucaaacagagugaggcuuccuauuucucuccccccaccccaccaccauccaggagcucaacagaagucccagaauugcacuucuguggcucugguugggccuuguacaggcuccugggccaaugacuggaguuguggggagggaauguggccccuugcccaccucuggauccugaggauugaauaagccccacccggaccacacagaaggggugcuauugccuaaaggagacagugggugcugggcgggccgacccaugggugucuguggucgaagggagggguccagagacgcaggcagcuggggagggagauggccuuacagggacagucugcaggguggggcagggggugggaugggcacugggaguccaaaggaaagggcugagugggguucugacuccucugcccaacugacccccaggaccccuucugugaguggcaucagagcaccagccgcaaaggggacgcggcaugcagccggcggggccggggucggggugcccugaagaguccagaggagugucccccgcucugcagccagugagucaggcugggugcagggaguggguggguggaugugccuggggaugugugcuggcuguggagugaccuggcccccugcuccccaccccaggcgacugaccugugaggacugccuggccaacucuagccagugcgccuggugccaguccacccacaccugcuuccuguuugcugccuacuuggcccgguacccacacgggggcugucgaggcugggacgacagguauggucccuggggcagggcuaacagaggaagauuccccaccggcaaggggcuggggcucugacccccaccccugccauccugcaguguacacucggagccacggugccggagcugcgauggcuuccugaccugccaugagugucugcagagccacgaguguggcugguguggcaaugaggacaaccccacacugggacggugagcccgggcaggugggugggcagggugcccggcuguguccuuccuccaugaccggucauucuaauggccucuuugcuucucugcccucuugcccaucccauggccaccuucccuuuuccguacuguuuuucuguuguuuauuuuacccucccgcucuuuuuucuccauuuuuccuccuuuuccggcucucugcgauucguuuucuuucuccuugucuguuucugucucuccgcucucccuuucacugcaucucugucuaugucucucuucugucuuccaaaauuguuuuugucugcgacuucuccugguuucucugucucucuuuccaaauuuguauuugcaucccucuccuuccaauuggccuccucucucccugucauuguuucuauguauggcuccuguuucuauguugucccccgcuucuucacucucccacccugcaggugccuacagggggacuucucagggccccucgguggggguaacugcucccugugggugggggagggccuggggcuucccguggcccucccugcccgcugggcauacgcccgcuguccugacguggaugagugucgccugggccuggcccggugccacccgcgggcgaccugccugaacacgccccucagcuacgagugucacugccagcggggcuaccagggugauggcaucucacacugcaaccgcacgugagugaggcggggguugcuauggagauguugccccaggcuggggcacauggagguggagggaggaagccaucauggcgcuggguccccuccuguggaaccagcauccccaguuagccagggguuuuuaccuugcacacuagguccuuauuagagugacaggguccccaguguaacccugguuaccauggaaauggggcacccauaggcugugggccauagucuucagcguugccauggaggcggaggaggaccuaguugaaagagguuuucacaguggugcuaugugguugcuauagagacaggcuuggugaugcauggaguuaccuuggagacagggucacccacauagcccaaaaccauggaaacagccaguggcuuugauggugucaugguggguggagaugauggggugcuuuaggggcucugggccugccuggcgcuuuccccacccccaacacggccccucaggugcuuggaggacuguggccauggugugugcaguggccccccggacuuuaccugcgugugugaccuaggcuggacaucagaccugcccccucccacacccgccccggguccgccagccccccgcugcucccgggacuguggcugcagcuuccacagccacugccgcaagcggggcccuggcuucugcgacgagugccaggguaagcagcccuuguccugggcccagccuggacccagggagccuccucccuucuuggggcuccaguuugcucuucuuggagggggccucaguguccucucaugcagcucuagguccccugccccauuccuguuccugacucaaacagguuucagugccacccgucacucugguugggcuucaguucccccucuugggacuugcuguuuccccugaucugggccuugguuucucaccuuugaagcggcuggguggggucaggguuuagcugagccaguaggccugggccuguuuccacccuugacuugacucugucccaccugcuggggccuccacagacuggacauggggggagcacugcgaacgaugccggcccggcagcuucggcaacgccacaggcucuaggggcugccggcccugccagugcaacgggcacggggacccacgccguggccacugcgacaaccucagugggcucugcuucugccaggaccacaccgagggugcccacugccagcucugcuccccaggcuauuauggggauccccggugagccaacgggccagccagggcuggguagggugugcuuggggacacaguggggagggucaggacuggucugacacuggcucuucuccaucuccccagggccggugguuccugcuuucgggagugugggggucgcgcccuccucaccaacguguccucaguggcacugggcucacgccgggucggggggcugcugccuccagguggcggggcugcaagagccgggccuggccuguccuacuguguguggguugucucggccacugaggagcuacagcccugugcucccgggacccucugucccccacucacccucaccuucucccccgacagcagcacccccugcacggugagcacugaggaaacgaggguucaggcgcaugagccagaaccguguccccugacccagccugcauccucagacccugacccuaguauugcuguuuuuuuuuuuuuguuuuuuuaauccuucaaaacccaaacuccuccucagauccccagcacuuuguuccuaggcccacagacagacccccccauuucccagauagcuuccuauuuccucagcucccaucuccaauucuccagauucucaaucuccccauuccuagagcaggaaugguaaauuguuacaccuuguacaccaacucugauugauugguacugacugccaggagcugcauguugagaaaggggcucaaugcaagagugccugauagaugagccgugucuacuuuggacacaggaaggggagugguggccuuaugccauaguuugacagucuccccuggauguucaaacagcccauuucccagucucagauugcccuccccucuugaaccccuccuccucccagaccccaggugucguucucauccucauugucuccuaauccucgauucugcaccccucuagcugagcuacguccuggcguuugauggauucccacgcuuccuggacacugguguuguccagucggaccgcagccucauagcugccuucugcggccagcgacgggacaggccccucacuguucaggcccugucugguacgggggcuaggggaagugggaccucuuaguccugggcuauguaucccuugccccugaacucaccaccugaagugggcucaggacccagcucugccgcugcuuauggggugauguagucccucaccaucucuggaccucaguguccuuaguugagaggaaaauaggauugcgccggcugagcuacgucugcagagagaagggcugaaugagacaugucucuggggcauauagaaugugguuggugugaggaucccacaccacucacucuuuccagcuaggcaggaguguaguagcgcaaucucagcucacugcaacuucugccuccugggcuccagcgauucuccugccucagccucccgaguagcugggauuacaggcgcaugccaccaugccuggcuaauuuuuguauuuuuaguagagacaggguuucaccauguuggccagucuggucuugaacuccugaccucaagugauucgcccaccuuggccucccaaaaugcugggauuacagacauaagcugcugcgcccggcauauauauauauauaacuuuauugaggcauauuuuauauauacuaacauaucaaguaauuccugucacaccuacccccaaaucaguaucuuuucuaaagagauccagucucauguaagggcaguaggaguuguggaagguuuggagcuugcugauuacagggcccaauucacguuuugaggaucgcugggccaccaugaguggggaguguaggcagccaggaugaccaguaggggaugggugccgguguccaggugggacaggacuugggcuuggauagcagcucaggagguagcuagcagucggugagagauuuaggcuugaagaucaaucuugauggguuggcugagggagggggugcagaaugguucauccuggcgaugauuaugaauaauauggugccuuccuucccugcccagucacacuggguuuucuuagcaucuggggguggaaggggccaggaacgugacuuugcuaccagccucuggccucucucuucacagggcugcucgugcugcacugggaggccaauggcuccucauccuggggcuucaaugcuucggugggcucugcccgcugugggucagggggccccgggagcugucccgucccccaggaaugcgugccccaggacggugcugcaggugcggggcucugccgauguccucagggcugggcuggcccacacugccgcauggcucuguguccugagaacugcaaugcccacacuggggcaggaacuuguaaccagguacaggugggagagggcaagucuggugggacagggcuggugaucagggcuccccugagucccuugucaucccccagagccugggugugugcaucugugccgagggcuucgggggccccgacugcgccaccaagcuggauggcgggcagcuggucugggagacccucauggacagccgccucucagccgugaguuguggguacccgcugucuagggaugguugcucccaggucguucucccaccuccauuccugggaccaccccuacacccaggccuggcacuuuguccugacccuagccugauccccaauguccgcacccaccccuaggacacugccagccgcuuccugcaccgccugggccacaccaugguggauggacccgaugccaccuuguggauguuugggggccugggccugccccaggggcugcugggaaaccuguacaggugaggacugcccugggcaggugggauucgcaaauaagagaaggucaccucgggaugcuaagagucaccucagaggagugcagaaaagccucuaagguaaaggacagcccaaaggaugcugggacacuugucacaggaagcucacccggggacacuuggggaccaggguacuuauuuggguggugcuacuccagggaauggcaagaggacugucauaggaaggucaccccaggggaugcggggacaucugucaggcagggucaccuugaaggaugcugggaugacuguaaugaggcugcuuuuuugcacccuggccccagguacucagugagugagcggcgguggacacagaugcuggcgggagccgaggacgggggcccaggcccaucgccccgcuccuuccaugcagccgcauaugugcccgcuggccguggugccauguaucugcuggggggacuuaccgcuggaggcgucacccgugauuucuggguccucaaccucaccacccugcaauggcggcaggagaaggugagcaucucuccccagcccacuccccagcccucacacugggcccugacagagacagcugugguagcuccugccagcuccauccccagaggaaacagaagccccaaacuugaauuuccucggccauccugggucacacuguuguccugagccaguccugggcugggacacagcuucacucagcagcagagagaggccaggggagcaagggcuucccaaagccacaccaggcuugagcagguggaaaugccaaggggcccacugugccucugccaggacccaggcugguccgacuggcccugggggggucauucccuccuuaguacuucagggaggacuguggggggcugaggcucgcuucuacccacaaggugaccccugaccucuagccccaucggugaccuugccccuccaucccucaggccccccagaccguggagcugccagccguugcuggucacacccuuacugcccgccgaggccugucucugcuccuggugggcgguuacuccccggaaaauggcuucaaccagcagcugcuggaguaccagcuggcaaccggcaccugggugucaggagcccagagugggacaccccccacagguggggcuggggaccgggaggggacagcccccguggaccucccgggcaucugggcuuccugugggcucuccauccacugcugugcucuguggccaccugucucccucucuuucccauccccaugcagauucucagggcacccucuugaauguucagauuuucugacuguccuucccagacuccacaacuaacugcccacucccggccacauguggccaccguccccugcccccagggucugagcucccugcuucucaaggguucuuccucgaucacaccuccuuucuuugaucacuguccccuagacauucuggacgcccugucucccucccgagagccuggcagaacuuacugccaguugaggacucccuucucuuucccagagucucuaaugauuguccauuugaacccaacugagagggacggguggagaggggcucccaggccuccagucucagggccggggaagggaguggucaccgaacaggggaccgggaggucggcggggucagugcuguugucagccccucccccagccugucacccugccccucaccaggucucuauggucacucugcugucuaccacgaggccaccgacucccucuacguguuugggggguuccgauuccauguggagcuggcggccccaucccccgagcucuacucccugcacuguccugaccgcaccuggagucugcuggccccuucucagggggcaaaggucaggaaaagaggcucagacccaaggauguauggggcaggagggagggguccucuuucccagugccccagggacuggcuccaucccagauuccugcuuccccuccuuucuauguucccuaacuaagcgacacccccacaucucccccgcuuccaucccugauuuggaggagagaacccgaggccaggaggucagaggcaugaguucugcccagcucuccccugagucuuggugcggcccuggcaggccccuuccccguccuggguuuuuccacucguauaaaccaggacugaggcuccccgcucuuucugccuucaaggccaaggagaaugugugugggagggcagggagcccugucugcacugguuagagaggcuggugguuucaguccacacguuuccaagcccgucuuggaggcagggggcuagaagcaagagacucgaggagccucaaccccaggacgcccccacugucacuagcgagaucguaugaggaaugugcguggcucaucucggggucugggccaaguuccuggggagcagccugggucauggggguuccgggaagucaggaagaagauggcucugugggcugcucuugcugguacaggagguuuccuggaggaaaucucaccucaccugaaggaggugagauuugaagaggguuaggauugggugggcugguagggggggauagguagggaaguacagggguggcuggagggcuaagagggagcagaggacagcucugacaggcuguccuguccccccaccccccgucuccccaacagccccgcccccggcuuuuccacgccucagcccuguuaggggacaccauggugguucuuggggggcgcucggacccugacgaguucagcagcgacguucugcucuaccaggucaacugcaaugccuggcuucugcccgaccucacccguaaguccccauuguggcucccaggaggcugagggacauccaggaggagccccauccccauccugggacucccacuccuuaggagucacugggccccugcagacccacuggcagagcucccgcucuucuggauuaucugaacaccaggacaugcccuccuuccuuuuuuuuuucuuagagaaguuuauuuuuuacucuguaaaaguaacaauguucacuauauauaauuuguaaaauaggaaagaaaaaaaaacacccauaaucccucucucuagagacaaccacuauuagacauggggguguuuccuaccagucuuugcuguucauagguagaagcaugccugucacuugccuuuuuauuucaauguugugagugacuguugugaguguguuucugggacugucuccuuuucuuuuugcuucucucucugacccuuugucucuuuuucuauuuuuauuagcaacagggucucacuguguugccuaggcuggagugcagugaugcuaucuuggcucacuguagccucugccuccaaggcucaagcaagcaauccucccuccucagccucccaagaagcugggacuacaggcaugccaccacgccuggauaauuuuuuuuuuuuuuuuuuuuuuguagagacaggguuuugcuauguugcccacgcuggucuugaacuccugggcccaagcaguccaccugccucagccucccaaagugcugggauuuaauucccuuuuucucuuaaucugucuuuucagauucaguagacagagacuacuucaugucugugucucucaguuauuuuuugaggauuuaaaaaaauugaggugaaagucacauaacauaaaauuaaccaucuuaaaaauacauuggcugcagccugggugacagagcaagacucuuucucaaaaaaaaaaaaaaaaagcauuggcauuuagugccuucagagaguuguccagccgccacaucuaucugguucgaaaacauuugucucucuucuuauuucccucuuuguguuccuuuguugucugcuugugucucucucccucucuuuuuuuuugcuugcugucuauccucauguguuuccucucugcuucugcuguuuuuuuuuuuuuuuuuggagacauggucuuguucuguugcccaggcuggagugcaguggugcaaucucagcucacugcaaccucaaccuccugggcucaagugauccuccuaauuuagcuucccaaguagcuggggccacaggugcgcaccaccaugcccagcuaauuuuuuauuguuuguagagacggggucuuucuacguugcccaggcuggucuuaaacuccugggcucaagcagucuuccugccucagccucccaaaguguugggaucacaggugugagccaccgcccuuggccuuguuucugcuguccuuugacccuguguuucuccucuuucccugcauccuucucugacuggcaucauggugugggucucuuccuggagucuccugcucucuaucugucugaauacaccaucuuuccucaggcucggccucuguggggcccccaauggaggagucuguggcccaugcuguggcagcagucgggagccgccuguauaucucuggggguuucgggggaguggcccugggccgccugcuggcacugacccugcccccugaccccugccgccugcuguccucaccugaagcuuguaaccagucuggggccugcaccuggugccauggggccugcuuguccggggaucaggcccacagguaaccauggcgaccaugacaggcaguggggaguggagcccucuaauggggguccugugcuaggccacaccaggauggaggccucaggaguauaccgucugguucaggaaaggggugaaucaccgcaggcaggguggccgggggagcucugaguggggaucccugccugggacuggggucucaugcaagaaugcuugcuggaggagcugggucugaacugggccuuaaaagaacgguagaguugagaccaucagugauucagaagugaggcugagaccggaagcuggagggggucagcucagaaagggcuucccaugccuggcagaggcacuggcucuguccagcuccacagauccuucagcugcgguuccaggaaugcagacauccuggacacugaaaguguuuucuuaggcuuagcacagacucacuucgcugcccagucacccucacugauaugaggcuauuaguuggccuuauuugcccgaaggguguguugucaguuacuacaggaauguuaaugguuugauuucggagugcuccuuaccccagaccccacuggagguauuguguaacaguggguacacccacugcuuuucuaaaauccagaacagucugaaacguguguaccucuugggauuugggguaagggauuguggacccccccugugcaggacagggagccauggaaggccugagcaggacagggcagggacgggccugggcagugagaucccuggcgcuguugugagggguagagugacgagagccugcagguggggaccagguugggcaaggggcugcagggguggggaggaggggacggucagggagaaauccaggaggcagaaggcuucgguggcugcaugggcaggaggaccuggggugugguccagcgucuccagccugggugacagguggaugugggaccaucuauuaccaaauggugguggggacagccaggcucaggaggccugugcuauguccagcuugggaugcaggguugggggccugcaggacagugucugggaggcagaaggagggggucuggaugggugugagugagccaggccucauguccuuuaggcugggcugcgggggcucccccugcuccccaaugccucgcuccccggaggaaugucgacgucuccggaccugcagugagugccuggcccgccauccucggacccugcaaccuggagauggagaggugagugguggggaaggcagggaugagaagcagcagguguagggcagggagguccuggucuccacucuggucagcugucccacccaccccagggucucaggaaccaccgaguucucagcuggcucaggaggggugcugagggucccaucuagccugucuucccucaccaggcguccaccccccgcuguaagugguguaccaacugccccgaaggugcuugcauuggacgcaauggguccugcaccucugagaaugacugucggaucaaccagcgagaggucuucugggcagggaacugcuccgaggcugcgugcggggcugcugacugcgagcagugcacgcgggagggcaagugcauguggacgcggcaguucaagaggacaggugagcagugggccuaguuccugagaggggagucuuggggccuggacuccugggucugagggaggaggggcugggggccuggucuccugggucugagggaggaggggcugggggccuggacuccugggucugagggagaaggggcugggccccugaucuccugggucugagggaggagggacuggggccuggacuccugggucugagggaggagaggcuggggccuggacuccugggucugagggaggaggggcugggggccuggacuccugggucugagggaggaggggcugggcaccugaucucuugggucugagggaggaggggcuggggcuggauuccuggguuaagggaggaggggcugggccugagcuccugggucugagggaggaggggcugggcuugcgaucuccugggucugagguucuaauccccgugccccacccccaggggagacccgccgcauccucuccgugcagcccaccuaugacuggacgugcuucagccacucucugcugaaugugucccccaugccgguggaaucaucacccccacugcccugccccaccccuugucaccuccuacccaacuguaccuccugccuggacucuaagggagcagaugggggcuggcagcacuguguuuggagcagcagccugcagcagguacugcaccuggccaggaccgugccaggcaagggcccgggcaggucucccuccucucugcgcuggcagggaccuuucuuccaccaucuccuccacccuccuccuuccaucucccuggcucuagcugcagucgugcuuccuucucgugccaccaucucuuuccucccucguugccucaugagggucccuguuguguccuccagccaugcuucugugugugccacuuucccaaccccuggccucugccucuccaacucuuguccaugguaucauggucuccucauccuuuccaugacuuuaaaaaaauuuuaauuuaauuuuuuguuuuuaauuuugucgauauaauucauagguucacauccacgacucuuaaugcuucuuccuucaaccucccaaaccuuuucugcuucccuccucucucucuuucucucucuacuuauggaacuuuugguuauaagaaacagacacucccucgagcugguuuuguuauaaggaaguguggguauuugauggacucugagagcaggaaguguuucugcucuguugcucucaggccacaugacccguaaucucagcuguucuccacacuucuccauugucggguuucugucggucugauagucaacacacauggccucagauugcagccuugacucccagucuagaugccuucuaauuccagagaccacguucaucucuguguuugucgguuagcucacauucucgaggagaaacucugacuuagugcacgagcuacauguccagccuugguguagugggauguggccagggagggcuaggagcacgugguucaaacguggcacgucagaucuaggccucuucuaggcugugggguggagagaugauuccugaagguggguguggccuaggcaggcauguguguacccgugacaguccaccccuuggagugccuggcacaugcucucuuguuuccagaaacuccauuccaaagacgcuuccaccugacaugauuaaacugucgugguggcagacaaaggcauucgcaccccaccccacugcccccccgugggagauaagacacauucaccucccacugucacauguggaagcaaugucacucagccagagcccacuccucauucauaccucgauuaugcaagacccaauugaggcaaaacugcucaccauccgacaacccaugaacuaagugaucaguccagccaccacccagacacuaguagacaacagugcagggaugugggacacuugccauuuugagagguggacuaaagaaaccaacagcacuucguggaaauucgagaccaggagggcaggguguggaggaccaagaaucccacagaccuuggcauccagugccaggagcccugccugggagugguacauuagcucucacccggagguaguuugccuugcgaucaaaagcucaggcugugaagucagugggaucuggguuugacuccaacuuggccacuuccuggcuguuugacuuuggaugagugacuuccccucuccaagaccucagggagaguuugcuaaaaugggaaucauuucacuagauccuguccccuagggagguuguaccaguuaaaugggggagaauuuacuuagagcauagagcaaugccugccauucaggaagcacuaaaaaauggcuaaugaucaugaucauuguuacuguaaugagcaguggugagagggccaaucuggcugacccaaguccugccacugggaggauucccagucuccacuguaugggacacaccaagaggguggcugcgggaguuccccaugggggcugucaauguggccagaagggcagaagccccugugauuuuggucugugguaagcagaggccucucgucuccaagccugggauccuaaugguaguauggguucuccccagauauuauugaaauuuccaucauuuaucuuugugggagcuccagggagcagaaggcauacccacaguccugcgggcaugcgcuguucccccagccucucggugcuugccaaguucucacacgccugaagagcuggggcagcuaaggagaugggggaguggccaggaggguggcaaggggaagagguggggccagugaauuggagagcacagccuguccccaggggccagaugagcauuguugaugguguaugugaaugugagaggggacuuuuaccagacuuucuaugaaaccuccuagcuuuaaagugauggcuuagcugggugggguggcucaggccuguaaucccaacacuucaagaagcugagacagauugauuacuugaggccaggaguucgagaccugccugggcaacauagcaagacccucaucucuacaaaaaaaaaaaaaaaaaaauuagccaggcauaguggugugugucuguagucccagcuacuugggaggcugaggugggaggaucacuugugucugggagguugagacugcagugagccauuauuacagcacugcacuccagccugggugacagagcgagaccccgucucuaaaaaaaaaaaaaaaaaaaaaaaaaauuaggccaggugcaguggcucacaccuguaaucccagcacuuugggaggcugagguggguggaucgugaggucaggaguucaagaccagcuugaccaauauggugaaacccugucucuacuaaaaauacaaaaauuaaccaggcaugguggcaggugccuguaaucccagcuacucgggaggcugaggcaggagagucgcuugaaccuggguggcagagguugcagugaacugagaucgcaccacuguacuccagccugggugacagagugagacuccgucuaaagaaaaaaaaagaaguguuggcuuagauuccaccgcacaaaucaaacauaauaggcgugcaggugauaccuguuaugauuuggcucaagggcugccugauucuaaccaucccgcauuguucuuuuuuucuuuuuuugaaacagagucucgcucugucgcccaggcuguagugcaguggcaugaucucggcucacugcagucuccaccuuccagguucaagugauuauccugcuucagccucccaagcaucugggacuauagaugcacgccaccacaccuggcuaauuuuuguauuuuuaguagagacugggugucaccauauuggccaggcuggucucgaacuccugacuuugugauccaccugccucggccucccaaagugcugggauuacaggcaugagccaccacgccuggcccagcauuguucuuuuuaauggcuuuggccugugagucuggggcaggcagcggagacacuccuucucuggucugccuccuuccucucauccucccucccucucuucagcgaauuuaucauugagcaccuucuuucugcugggugcuuugcuaggcaguggggaaugucagcagaugagcuagaguccugcucucagaacuuauguucauacaccuuuuccaugaacucaggaaaugcaguguaugguguugggcaucuuugcauuuggucacuagggagauuacagcagaaagugcuguccaggacugaggauucaggguucucuaccccucccagauugucccaccaucugccaacaagugcccuaaauuuagaucuggaagcccagcccagcagagaauuugccucuggcaguucagcaagucucagugauuugcaggccccucagugggcucagagcuccagccacagcagucaggguuuucuauuucaggauuccaugguugcuuugccuuuuccuaagugcuuucaggcagccggcccaaauuaaccucuuuccucuuauucuucacuuauggcccaagcaauaaauaaagugccuuauacacugagguaaguucccaagagccugaaucucauugugcacguuuuugggguccugacauacaaauauggcuugugaguugcuacccagccccuaaccaaggacucuucagguucucagugugggguaagagaagccuuuuugccucagcagccacauuuguucuuuuucuugucuuuucuuucuuucuuuuuuuuuuuuuuuugagacggagucucgcucugucauccaggcuggagugcaguggcgcgaucucugcucacugcaagcuccaccucccggguucacgccauucuccugccucagccuccugcguagcugggacuacaggcgcccgccaccacgccuggcuaauuuuuucuauuuuuaguagagacaggguuucaccauguuagccaggaugguguuggucuccugaccucgugauccgcccgccucggccucccaaagugcugggauuacauuuuucuaagaaacugugguuugcaaccccacuccugauacucuuuucugucuccuucugggaacauugccauuguuccuuuaccuggaagaaacagaagugcccuuagugaggaggggaacucccuccaccaaugcaguaguaccuguuggaacccaggauagaaaguacagcagggccucacaaggaacuggagacagacuggaaagcugccuuucuaucugucuuuagggcacgugguucucaucucugucucuuucugcagccugcucuuuuccugccugucugcguccucuuuauuuaaucaucauuugcuuaucuaaacaaucccuucaacccaagucuacgcgaucuuccaguuuauuuucuuuuuuugagacagagucuuacucuguuguccaggcuggagugcaguggugcagucaugacucauugcagccucaaacucccgggcucaaaaaauccuaccucagccccccagguagcugggucuacagaugugugccaccacacacagcuaauuuuuuauauuuuguagagauggugucucacugugcugcccaggcuggucuggaacucuugggcucaagugauccucccacuguagccucccaaaguauugggauuacaggugugagccacugcggccaggcaaccuuccaguuucaagauccuccccagccugacuucccgccuugguguguaguuacaaacgcuugagagggaaaacaugaugaccccagcuaguguccacuuugcucuaccuguggccagggaggggugagaccucaaagaggguguggucugggaagauacccagaauguguuuguuuaagcuuauuuccccaucucucucuucccugcauccccauccccucccccccauacagugucugagcccuuccuaccugccccugcgauguauggccggaggcugugggcggcugcuccggggaccugagagcugcucccugggcugugcucaggcaacucagugcgccuugugccugcggcgcccccauugcggcuggugugccugggggggccaggauggggguggccgcugcauggaggguggacucagcggcccccgugauggugagagggcuuugggcacugggggagaggggcuggcccuugguuggggucugauacagugaacauagggauacugggccagacccagagguggggcucagaggaggcaggagggagggccuaggcaacuggggcaggugguacagagguccagguaaaaugcuauauccccggugcuagggcugacaugugggcguccgggggccuccugggccuuccuguccugccccccugaggacgagugugcaaacgggcaccacgacugcaacgagacgcagaauugccacgaccagccccacggcuaugagugcagcugcaagaccggcuauaccauggacaagugaggccgcaggcggcgcuggggccaggcaggcuagggugggagagucuguggggagcaguaauggaugaggccuagagccaagcaggacagaagaaaagaaagcucgaggcaugaaggcagugggauugauuccugaaggucaagaguggugaggcugagcagggaagagugaguuucauaggguaccccaauggccgggcacaguggcugaugccuguaaucccagcacuuugggaggccgaggcagguggaucacuuaaggccaggaguucgagaccaguccacagggagaccccaucucuacaaaaaaauaaaaaagaaaauaggguacccucaaaagaggagagaggguugugggcuacaccuggaggggguggugggcuagauccugaagagaagauagcaacgggacagagcagggaugagcaaccaguugagaagagggugggguaguugguugggugcuaggccaugaagccacgaggaggguggccaccugcccugacccccacuuugccccugcagcaugacagggcugugccgcccugugugcgcccagggcugcgugaacggcucauguguggagcccgaccacugccgcugccacuuuggcuuugugggccgcaacugcuccacggaaugccgcugcaaccgccacagugaaugcgcugguguuggggcgcgugaccacugcuugcucugccgcaaccacaccaaggugggccgcccggagccucagacccccgacccugggacccaggcccucacuugccuucaucccacgcucaggcggcucgcaucucauccugagcccugauaagccagggacagauaagccagagcccugucccagggagauguguggagacuugggggacgcugccuggguuuggaucccagagggucugcccuggaauaguggacggagugggugcugcgccaggaggacaggcacguggaggaggauuugagauaauggagggaagggcuuuugaacucagcacuuugggcugcaggugugcaagggaaggcgggggcuaaaucccgcugggauuguccaaaccagguacccgagccucugcugcccucccgugggcucucagaaccugccccugugcccccaacgcccuccuaccccugaugacucuccagccucucuaacuacccuguccuggguucucagggcagccacugugagcagugccucccgcuguuuguggguucagcugucggaggcgggaccugccggcccugccacgccuuuugucguggaaauagccacaucugcaucuccaggaaggaguuacaaauguccaagggagagccaaagaaguacucacuggacccagaggaggugaaagagaggggucagaugccugggucugagggaggaggggcuggggagcuccugggucugagggaggagggggcuggagaccuggacccuuggguugagggaggaggggcuggaggccuggauuccugggucugagagaguagaggugggggucuugaacuccugggucugagggaagaggagcuggggccuggacuccuggaucugagggaggagggggugggagccuggccuccugggucugagggaggaguggguaggagccuggacuccugggucugagggaggaggggguugguccaggccuuucuaugaucacacuguccuuccuuggccagauugaaaacugggugacagaggguccuagugaagacgaggccgugugcgugaacugccagaauaacagcuauggggagaaaugcgagagcugccugcagggcuacuuccuccuggacgggaagugcaccaaguaagaggaaccgggggggggggggggggggggggggggggaggccggggaucccacccuucucacugggaguagcucuggagccaggcccccucuuuaguccuccacccccagucaggagaggaugacauccccagggagcgcccaggcuggggucaggguagggaaggagcuggaaugugaugccacucccuaccuccaaggcuagugcugaagugcaguccacagagcggccccaucgagaacaagauggggcggcugagggcagaggccuuggaacaaccuccccuuuccaucuccuucuuucugaguguucagugagugcuggagucugugcaacucggguucuaaucccaaugguaauuuaacugcuuuguggccuugggcaaacagcuugaccucugugaaccucaguuuccucuucuggccuguugcacagaguugagcucacauaugggguguccauccuggaccacugcaggccaugggggcuccguaacccucaacuucuuccccagaugccaguguaauggccacgcggacacauguaacgagcaggaugggacgggcuguccaugucagaauaacacagagacgggcacaugccagggcagcucccccagugaccgucgagacugcuacaaguaccaggugcggcugcagaagcuaguggugggccgagggcccuacaccuuguggaggucagggcugggaugagguagccaggcucgggcaggacugacaacaugguuccaaaucagugguuuugggaucaagugcagcuugacagacuguuccugagccccauucaguuacaggcccuaggcagugaugcuggggaccaagauaugagccucugggggacucucagacugguggggagacagucuccauuacagguagucacagcuaaagguggcacaugccagaaaaucuaucccaugguagcucaaccgaaaaaagaaaaugggcugggcaugguugcucaugucuguaaucccagaacuuugggaggcugaggcgggaggaucacuugagcccggggguucaagaccagccugggccauauagugcaaccccaucucugaaaaaaaauuuaaaaauuagccuggcaugguggugcacaucuguggucccagcuacuugggagguggaagugggaggauugcuugagcccaggaggucgaggcugcaggacucugucucaaaacaacaacaacaacaacaacaacaacaacaacaaacacacacacacacacacacacacaacagaagaaaagaaaauguauugacucuuagaacugagggucuggggucugccuucaggacuggcuauauccgggugcucacacaaugccaucagaagucucucugcaucuugacucugcuuuccucugcauuggcuucauuuucaggcagauucuucccaguuggcagacccccucugaugaacugaggcuagcagagaucucauaucauuuaauacccagauucaaauuccccucgagugcauuucccuuuuucuucugcacagaggcuccuggagugccugcacuggccaccuggcuggcugcuguguuccagacuugccuccaugaugucccaggcuccuuccucagaggacaacucccgccaccuccccgccaccuucucucuccagucccagagggaagagaaagucccuugcucucagucuuccuuacccaucuacagaaacauaauagcugcaaacauaauagcugccaccccaaauggcaacaguuuuacaagccuuacugacccuuaacauuucuauccugggccagaauuucugcuuuuuuauuuuuuuuuuaauuuuuaauuuaauuuaauuuuuuuuggacacagaguauugcucuguugcccaggcuggagugcaguggugggaucuuugcucgaggcagccuccaccuccuggguucaagugauuauccugccucagcuuccugaguagcugggacuacaggcgugugccaccaugccuggcuaauuuucuguauuuuaguagagaugggguuucaccauguugcccaggcuagucucaaacuucugagcucaggcaauccaccugccuuggccccccaaagugcugggauuacaggcgugagccaccacacccagcccagaguuucugcuuucuugauaagggaaaggccuauuggcuuuuaccagggagucucagagauuaaaucagaccuccuccucuaccaggucuguuggcugcuuagaaguagcaguuuuucuugguuccuuuuuuuuuuugagacggagucucacucugucgccaagcuggagugcaguggcgugaucuuggcucacugcaaccuccgccucccagguucaagcgauucuccugccucagccccccgaguagcugggacuacaggcacguaccaccaccccccgcuaauuuuuguauuuuuaguagagacaggguuucaccauguuggccaggauggucuugaucucuuaaccuugugaucugcccaccuuggccuuccagagugcugggaucacaggcgugagccaccacccccggccgguucuuuuuuuuaauguauuuauuuuuaagacagggucuggcucuuucacccaggcuagagugcaguggugcaaucucagcucauugcaaccucugccucccugguuuccaucauccucccaccucagccuccugaguagcugagacuacaagcaugugcuaucauaccuggcuaauuuuuuuuuuagagaugggguuuuaaccauguugcccaggcuagucuugaacuccugagcucaagcaauccacucaccuuggcuucucaaaguguugggauucuaggcgugagccaccgugccugguugggcuuuuggguuuuuuuuuuuuuuuuuuuuuuuuugauacagggcuuacucugucacccaggcuagaguauaauggcgcaaucauaguucacugcagccuugaacuccugagcucaagugauccuccugccucagccuccugaguaacuguaacuauaggcacacaccaccaugccuggcuaauuuuaaaaaaauuuuaaagacgggggucuuacuauguugcccagacuggucucgaacuccugggcucaagcggcacuccugccucagccuccugaagcacugggauuacaggcaugagucacugcgucuguuuucucuugguucuaauagugauugcaguaauaacuagaaugccaggagcgccugccacagagcuggaugcugugcuguguagacaguggugacagcauagauaugaaaggcuuugcaagacugugcuggggccucagugggguacagacuuaagaggaagacagauucagagacauuaaauguccuagcugggcacaguggcucaugccagcacuuugagaggcugaggcgggcagaucacuuaaggucaggaguucgagaccagccuggccaacauggugaaaccccuucucuacuaaaaauacaaaaauuaguugggugugguggcggacaccuguaaucccaacuacucgggaggcugaggcaggagaaucgcuugaacccgggaggcagagguugcagugagccgauaucacaccacugcacuccagccugggcaacagagcgagacucugucucaaaaaaaaaaaaaaaaaaaaaagucucaccccagaucagguggucaguuaggcuuggugccuggagugacccuggucugaucucagaacuugagugguuuccacuaagccacaggaaucauagccguuaucuauccagccacacauucauucagcacacagucauugagcaccuaguauauggcaagcaccgugcagguugcuggggacacaguagggaacaaagcaggcaaauguucugucuuuaggaguuugcauucucauggaggcaucagaaaugaacaaacaagucagaugcucguguguuagacagcgaggagcgcuaaggaaaguuaaguaggaagcgggggcuagggcuguuggggagugggaaugguagacgcaggacacaguggccagggaaggccuaggugagaaggaggcucuugagcaaagaucugaaggaggcaagggggcuugacaagcugacaagugacaggagaaccaugcaggcagaggguccgccagugcaaaggccccagggugggagggcgccuggcacaguauagaagaagcauccaggcaggcaggcgaggcuggcugacccugcgccgagugccaugcacaugaucucagugguccugugagcgagccgugguuacucccugugugcagagcucauggguuaagucugugugcucaggcucagugagguuaagucacuaguccaaggccacacagcuaacaaggagguagagccagaaugcagccgcguucuucacugcugugccucagagugccagaggccucaguaucagggugcucaggucacuaggguggcaccaggggcagcagugcuggagugccagguccuggcaaggucuacacuguggcagagaagguccggggggucacagggaagugacuggggcagugggggugaggcccagggcaauggcuacuuagcaguggguauagaguauucgucacugcugcuugggggacaggcuggcaccgcacucagcccugauggucaccgccucuaacccugcccgcagugcgccaagugccgggaaucauuucacgggaguccgcugggcggccagcagugcuaccgccucaucucgguggagcaggagugcugccuggaccccacgucccagaccaacugcuuccaugagcccaaacgccgggcgcuaggccccggccgcacuguccucuuuggcgugcagcccaaauucaccaacguggacauccgccugacgcuggacgugaccuucggggccguggaccucuaugucuccaccuccuaugacaccuucgugguccguguggccccugacacuggcguccauacuguacacauccagccacccccagccccaccaccuccaccacccccugcagauggugggccccggggggcuggggauccaggaggagcaggggccagcagugggccgggcgccccagcagagccacggguacgggagguauggccgcggggccugauuaccuacgugacggugacggagccgucggcagugcuggugguccgcggcgugcgggaccggcuggucaucaccuacccacacgagcaccaugcccucaagucgagccgcuucuaccugcugcugcugggcgugggagacccaagugggcccggcgccaacggcucagccgacucgcagggccugcucuucuuccggcaggaccaggcccacauugaccuguuugucuucuucuccgucuucuucuccugcuucuuccucuuccucucacucugugugcuccucuggaaggccaagcaggcucuggaccagcggcaggagcagcgccggcacuugcaggagaugaccaagauggccagccgccccuucgccaaggucaccgucugcuucccaccugacccuacugccccggccuccgccuggaagccggcugggcucccaccucccgccuuccgccgcucugagcccuuccuggcaccccugcugcugacaggggccggugggcccuggggacccaugggagggggcugcugcccaccagccauccccgccaccacugcugggcugcgagcugggcccaucacucucgagcccacagaagauggcauggcuggcguggccacacugcugcuccagcugccuggcgggccccaugcacccaacggcgccugccuggggucagcccucgucacacugcggcacaggcugcacgaguacuguggggguggugggggugcugggggcagugggcaugggacuggugcgggccggaagggacuguugagccaggacaaccucaccagcaugucccucugacaugcccaggguucucauccacagcagcugggucaccugauagggccgcccuggacuuggggucccuccaccugggggccccuggacacugucuacuuggagaccacuggcccccuucccccaggguugcccagauggggccuccuuuguucugcauucagcagcuauuuaucgaguaccuacucugucaggcacugucauaggcguggggcaaagcaggaaccaagagacgagguucccugaucucaugggacuuagguucuggugaagggagacaaucagugcacaugcacacaccccacacgcauacacacaugaacacaugcacaugugcacacacaaguaagauggcuucagagagggagaagcacugugaggccuccagaggauguggcagugagggacgauggggugaagucagcugggcauucaaagaagcuagacugagaacgccugagaagaaccagcuacgggaagagcuuugggaagcaaaggcagaggcccuggggugggagcaggcuuguuuuauuggaaggaccagaaaacugguaagugugacccagaucaagugugaggagaugaggcuggggauagucaggggcuggaucacccagggccuugugggccccacauaggguuuuggguuuuauucucagggcaaugggaagcuguuggaugguuugaugaaggggagugacaggauccgauguaccuauuuaagaauuuaagagggucgggugcgguggcucaugccuauaauccuagcacuuugagaggccaaggugggcugaucacaaggucaagaguucgugaccagccuggccaauauggugaaaccccaugucuacuaaaaauacaaaaauuagcugggcaugguggcacacacuuguaguccgagcuacucgggaggcugaggcagaagaaucgcuugaacccaggaggcggagguugcagugagcucagauugcgucacugcacuccaaccugggugacagagcgagacuccaccucaaaaaaaaaaaaaaaauuuaagaggucacucaguugugcuguggagaauggaccggagggacaagaggggcagcagggauggugggcuggaguagggugcuggcaaugagggagucuggcucagaugugggauguguauggaagaauauaaaugaugguguggaugucagggugagggaggagacaaaaccacgaugaccccuagcuuuguggccugaacuguggguggcugaggggaucguuaauugaauggggcagacugaggcuugugaggaagaucagagucugguucuugacaugagaugcccuucagacaucucuucacucagguccaacuagggauacagaaacacugaauauuucaacagcagaaauugaauggggggauugauagcgcuggcgagggaagcagcuggaaagagacagauggcacccugagacagcccagaggugaauaggacccccaggcugcagggauaaagcucaguggugguguuaccucaccggggaccagggucacacagcaaagcuggaacaacagaggcguguugugggggagccucagaggggacaaaaccucugccugagaucccaccccaggugggcaugggggccacugagguuggggaugaaaaugccgguaccgucagugcacagcccuguuccagacagugcugccuggaagauuucugggcucuccugaggcgccaccccgcaccugagccaccuccuuggacuccuguccucuaccccuugaggaccucccucccuucuacccuagcugucuucuugaacuugggacucuccuuucccaagacuuccaucacuagcuccuggagggacuggacuuugcaucuucccuucgcguggagccucagugugagaggcccuagccaaugcgugcaugucagaggugguggggaccacaucagaagaagaggggggugaugaaauuaacaaauaaaaaguauggggaaaacccagg

SEQ ID NO: 15063 - RNA, 3286 nt, Homo sapiens
cggaguugguuuucagguuuuuauuguggguguauuucuggcagcgggacagggguggugaggcagucccucccaggaguggccagagaaggccagaggcgagacugguggaaaaggacggggaagacagggaacuuccuuacucucggaucuucaguucccgcgccaucuggcagagggcgcagggcagacaaaaggugagggccgcccagucgugcccgacggagcccuagaggguaggagagagcggucaggagccccgcggugggucccaggaggccaguccccagcucccugcucccgcggguccccagcccggcgcgcaccuggaugugguagcgcucccgcaugccggugcggauggagugcaggccuccgggcagguagggcgcgcagcagcacucgccaaagucgucggagaugcggcaggcaaggcacagaggagcaaaagugccgcacagaccugggcggggcgcaggcgcucaggggcggggccagccggggccucccgacggcuccgccccggggggggcgcgguugauucgccgcggaggggcauugagggucccagccaaggagaggucccagagggaauuagagguccgaggagaggauggcuuagcgauuggaaggcaggguuuuucuuuuuuuuuuuuucuucuuuuuuuuuuuuuuuagaaauuggaggcugggugcaguggcuuacgccuguaaucccagcacuuugggaggccuaggcgggaggaucacgaggucagggguuugagaccagccuacccaacauagugaaaccccgucucuacuaaaaauacaaaaauuagccgggcgugguggugugugccuguaaucucagcuacuagggaggcugaggcaggagaaucgcuugaacccgggaagcggagguugcagugagcauagacugugccauugcauuccagccugggcgacagagcaauacuccgucucaaaaaaaacaaaaaacaaaacaaaaaaaaaaacgaaagaaagaaaaaaaaagaaaaagaaauuaaagucucggucugucauccaggcuggagugcaguggugugaucacaugucucacuguagccucgaccuccugggcucaagcaauccucccgccucggccucccgaguagcugggacuacuggugugugccaccaccucgggcuaauuuuauuuuuuauuuuuauuuuugagacggaaucucgcucuguugcccagacuggagugcaguggcgugaucucggcucacugcaaccucugucucccggguucaaucaauucucuuucucagccucccgaguagcugaguuuacaggcgcccgccaccacgcccgguuuuuuuuuuuguauuuuuaguagagacgggguuucaccaucuuggccagacuggucuugaacuccugaccuugugguccaccugccauggccucccaaaguccugggauuacaggcgugagccacugcgcccgaccuauuuuuuauuuuuauuuuuguagagauggggaucucauuauguugcccaggcugaucuugaauuccuggccucaagggauugucaugccuuggccucccaaaguguugggauuacaggcaugagccacugcacugggccaggagcuaggguuugaagagggaguugggggucacagugaggaaagcugagcaugcaaaggggagguugagggccugauaaguugagugugggaaggcaugagguaguauccuaaggaguguugggggucugaggaaagggugacuguuagagugggaauuccaaguccagggaagggaggugggagugggguuagcaagcggugggaggagguuggaggugagcuucccucuccugauuccccccaaacccaucuuccaccaggccuggagagggagcaggcaggcacucacagacaggcaugucguugcagcaguccgugagaccugugugccagucacugagcugggucugguagcagcuggugguggcgcacuggggcugacuggucacaggguaggacauagcugcagaggugggaggguaggggucagcuggcagccucgcagcaucuccugggccccgcacuucggccacccuucccugugccgggcagucugggcggggccgccaggccgcccacugaagggacaccacugugccucccccuucccuucugcuacaucugggcaccggcaaccccagucugucccuguugcugcuggcuccugcacgucugguuaggcugggggugggggucuccugcacaucugaggaaggguggggaccacaucuggguggggccuggcggugccgccuccuccuccacgucugggccuggguucuggguugcagcauuucuggggccucugggguggaagcaggcgccgucugucuucgaagcaagggugcccaggggagggaggcggccagguuccaguacugagaggguugcugguccacccagcggucccaccuuugccuuucacguugucgugcaucucaaacugcaucuugcuggcccugaggagguggcguuggggacggcagaaguggcuguggcaacaguggcagagucuguccaagggacgcuggauacuggggaggugggggcaagggacuggggcacugggggcugggcucucagggggaggggagcuggggagaaagaggccaagucagccugucaaccaggagagacauggaauagggaauggauagggcgggggcgagaaacucgcccaugucuuuccaacugcccgacagauugcagaggacccuccccauacccgagauagagcuugagggagaacaagaaauggagauggacagagucagagacaaggggagaaagaucagagccaggugcccguagagaugucaccaguaaugcccacaugugcccagcacuuugacuccucugcaagcccaucucacagaugagcacugaggcucagagacaugaggaggaacgccccacgucugacggcccaggccaaggggguucauagaggugaugcugggccccaagacuucuaaauucagcucagcacaccccaguuaagaaggacagauuugggggcauugggaaggacagagaugucccgagagaccgacaaucagcgauaugaaaggagacagagugauaugagugggaugaggaggagggagaacagagcagaggcgcccaaccucaaagaagagggcugcggaggggauguuccuaccugcaggaucgcgauggcagugauggaggcagacguguggagacacgggcacugacuucu

SEQ ID NO: 15064 - RNA, 23511 nt, Homo sapiens
ggccggcccgcggccugaagcuagugcgcaggcgccgagcguucuccuaccaccaucccccacccucauuaucgggagcauggauuagggggcggagacagagggagaaagaucccccaggaaaagcgcaauaggagaacuaggagacaggagagggaaagcggggcucccuccuccaacggcucucaggcacagccacgccuccagcgcuggcgccccgccucgucuuugaguuggcagaggaccuggcccgcccccaccccaggcagaggcucagaggcgccccacuuucccccuucaaaaggcgggccgggccgcgugcuagggcaucccucccugggaaggugagugggauggcgagacugagccagcacaugggaggcuucccagcacgugggaagaucgggacuucccugcuggggugcuccccgcggggcuccgcacuaguccugcccgaaggacgcuuuucgccacccccgggguugccuuuuuguuggccgcgagcccuuuaaugcgcgguagggggcggagccagaucuuaaauucuggcgguugggggcggagcacggcagcggagggagaccagaauugguuagggagcuggacccagagaagagcaagcucgggauuggguaauaggggggcccgacaguaguguguagcgaggauuggcccuccgggcagggccucgcggcuggaauuggcccccgcgggaggaccgcggggaauugauggaguuggccgggggaacggagcccgccgaggccgcuauggccccggccucgaagaaugccaaagagggcucaaggagccacggucgccggcgguggcgaaaagacaaggccaaaggugagcgcgcggagaccggcagcagcccggaaggaaccucguacauccuacggggcaguggggacagcguggacuggcccacugccacagggaguuggggggguccgcggacuggcccauugccgcuugcggggacaacgggaugauccauugugagaagggggugaugugacagccgagaggcccacccuggcacagggacuagcugacgcccggaucggcuugggagcagaguccggaaugcgagcuucguggaccaggguucccgcucggauuccguauucgcugugugaccaagggcaacggaugcccucaguguuucccaccuggggaaugcuucaagcgccgauguucagggcuccagcgcucuugagaggauaagggggaaggagguuagcagguguuacucaaagaggaagucuagcggugagucaaggagagguaggaggaaggggugcccauaguggagagugcagcggggccaguaaaguucaucgcagucccggccucccacccggcaagucaguccauccauccauccauucauugucagucaacccgcuucagccggcuccacuggggccuagcccugaccccuacccuuuccaggacaacgggcccuggcuuggcuucagaccuccacaccugccucagcaaaagggaaggccucauuucucuagggugucacauuauuuucaggucucaaaaggcggaacaaaggcugacagaccaacagaaaugcugcaagccucaggcaggggcagguccucaguuacaagcauuuaucaaucagcauggggacccgugggagguucccaugcaggaaggaaacuaacaccaccccucagccccagggaccccaaacucauugcuuccccugccguagaacacaucauuagcccagaauagaccuggaguuggcuucagacacacgcaggcucagacaggcucagagggcagacggacuggagcccaagggcacucgcugucacagcaagacacugagccucacaccaguauagcauacccagaggcaguacagacuguaguuaagaaacgugggcgucggagauccgguuccucaggcugggagcugugauguucugggcaggagacucccucuuucccugccucagcuuucugagcucuaaaauggguaugaugauaggaguaccuccuuuugugagguuagaaugaauguagagcguuuggcacaggcacgcagcaaacccucaggagaagugaagguuauuguuacuguuaguccccaccggacggugaacauccuaaaagcagggcuguaucugccuuguuuacccuguauuucuagagccugguaugccaggcaaauaggcacucaaauauuuauuggauuaauaagugaaggaaugugugaacuguaacagagaucauaauaaucacgcuucccuuaggguugucaugaggagucagaauccaguugggcagggcucccugcaaaacgagccauucacaaaggcucauuccugcaaacuccaagauuugccugucauuuccugaagccccgcccucgugccaggcuuuagauaaauuaaucagaccucacuccugccucaagggcaucugggcuggcuggagcaauccucgucaucaguuucaucuugccaguaacuggaugaggcuaguguccuuaggaucaccccauuucccagaugacgacacuggggcucugagggaccaaggccgccugggcuuccuuacuuggccagugagggcaaagagauggcugccucagccuccucggggcagggaguuuguggacgcacaacugcugugggcccaaacuugauucugggcccaagagguuccagucacacagauucauucagcagacauucacugaacacugagcugugccaggccugggcugacagauucacaguugagcuggggacacagauauuacucagauaagacuaugauuguaaacugugauaaauacaacagagaaaaacacccugggaagauagaauugagaggcuucccaaggaggcaauauuggacccaagauggacaggcguuaagugcugugcagggggcaggcaggggaacagagaggacaguauggagaaagacccgaggcuugaggaaacacugaguuacagugcagagggagcucagccagggccaggaggaagaggaagaggaaacagggcaggcaguuuaagagaggaggaugguagcuggguacagcggcucacaccuguaauccuggcacuuugggaggccaaggugggaggaccccuugaguccaggaguuugaggccagcgugggcaacauagcgagaccccgucucuaccaaaaacacaaacauuagccgggcauggugggguguaccuguagucccagcuacuugggaggcugaggugggaggaucaauugagcccaggagguugaggcugcagugagcugugaucgcaccacucuacuccagccugggcaacaaugagacuuugucucaaaaagagagagagagaggaggaugguaccuggcuugggaggccaugugcaggauugggggcuuuauccugaaagcaagggaggggguguugaaggguuggaagugugugaacagauuugugugcuaaaaagauccuguggcugcuauguggacaacaaaucaaagagaacaaaaucagaaauauauaaagaucugucauagucacccagguaaugaugcuaccgccuggaccagggaggaggcaguggagguggggagaagggccagguuccagaggccuuuaguaggcauagugggcaggacuaggggauggauugcaugggaguugggggguggggagguggccaggaugacauccuggguuccagcuugagcaaauggggagagguuuguucucaacacacacacagagaccaagacacgcacaagcauguauauccauucauacauaaacaaacacgcccacacaagcucacaggccaagagaaacagagacacagauacauucacaggcauacaaacauucauaccuucaaauguaccagugccgacggacacaggccaggacacacgccagccaugacacauaccugcagagguacauauguacacgugaaccccagacacacucacacccgaccagaaagcauauacuuugaagcacagacagagggagcagcacacagaaacacagcagagaucagcagcucugcccuggagcugcccccugcuggccgugugaccccggggguuaugucaccuuucugugccucaauuuugucaucugccaaaagggaugauaauggucucucccucauagguuguggggcaggcgacaugagucacuucacauaaaacacauaaagaaaucucaucaccuccuuugagaaugaaaaaaaaaaaaaaaagaaaagaaaucccagcacuuugggagaccaaggcaggaggauugcuugagcacaggaguucgagaccagucuaggcaacacagcuagacucgaucccuauuuuuaaauuaaacacacacacgcacagagaaagagaccaggcacgcagaggcuguuggugcaacguuugcucuuuuaugcacacacucucggggauccagccacucauuguccccaccugcaucugauuccaggcuuccuggcuucagaagccuuugcuuccucccaggccccacaccuggcccuuccuccaucccccauccacccccaccccacuuccuuccccaccgcccuccuuaccccugcucaguccccaggagucggauucagcuguccagaaacucuucagggcaaagaaagguccagugcccagucagugggacaccacccaaagccaaauccccucugcccuaccucuccccuaguccuuacccacggccccagugggccuaccccugccccagugcccucugccagggauuccuggcgaguugcuggcaaccucagcaucccuuccugccagcuccacccagcccaguccucggggagccgccuggaacaggacaaagggcagagcucuggagucccuagggccuggguccagccccuuccccacuccuuugugcagucacuuguuuuguuggaaauguccccucuccucaucuuuuuauuuauuuuauuuuaauuuuuuugagacagaguuucugucuuguugccgaggcuggagugcaauggugugaucuuggcucaccgcaaccucugccucccagguucaagcgauucuccugccucagccucccgaguagcugggacuacaggcacgcgccaccaugcccggcuaauuuuguauuuuuaguagagacaggguuucuccauguuggccaggcuggucucgaacucccgaucucaggugauccaccggccucagccucccaaaguggugggauuacaggugugagccacggcgcccggcccccacuccucaucuuaaaagaucccuaccggcauggaugcuaccacuuuaccaaggggcggcagugcaccaggcacuguccaaaggcugaauaaaaaaggcaaaagucccugcccucagggaguuuacaaucuagugagggaaucagagagcaaacaauauaaauucaggcaugucucagagauauuugggguucaauuccagaccacuugauaaagugagucacacaaauuuguugguuucccagugcauagaaaaguuauguuuacacuauccuguagucuauuaaaguguacaacagcauaugucuaaaaauaccauguacauauuuuaauuuuuuuuuuucuguagagacggaaucucacuauguugcccaggcuagucucgaacuccuagccucaagugagccuccugcuuugaccucccaaagugccaggauuacaagcaugagcuaccacgccuggccccauacuaugcuaaugaucaucugagccuucagcaaauccucaucuuuuugcugguggagggucuugccccaguggugguggcugcugacucacgaggguggugguuguagaaaguggcuguggcaguuucuuaaaauaagguaacaaugaacuuuucugcuucgauucacucacaaaacuguucucuguaacaugugaugcuguuugauagcauuugguccacaguagaacuuucaaaauuggggucaggccaggcacgguggcucacaccuauaaucccagcacuuugggaggccgaggugggcaaaucacccaaggucaggaguuugaggccagccuggccaacaugguaaaaccccgucucuacuaaaaauacuaaaauuaaccaggcgcgguggcaggcaccuguagucccagcuacucaggaggcugagguaggagaaucacuugaaccugggaggcggagguugcggugagcugagaucgcaccauugcacuccagccugggcaacaagagcgaaacuugucucaaaaaaaaaaaaaaaugggggucaguccugucaaagccugcuggugcucuaucagccaagucuaugucauagucuaaauccuuuguugccauuguuccugcuaucaaauguauuucuguuuuuuuauuuuuuuauuuauuuuuuguagagggggagggucucacuauguuacccagguugaucucaaacuggccucaagcuaucuuccugccuuggccucccaaagugcugcgauuauaaguaugagccacugcacccagccuacaaaauguauuucuaaauguauuucuauuuuuuauuauuuaauaagacuuagagcugggcaugguggcacaugccuguaaucccagcuauucaagaggcugaggcaggaugaucacuugagguccaguguucaagaccaggcuaggcaacacagcccugucucuuaaaaaacacaaaaaauuagccagaugcagugacucucccagcuacucaagaggccaaggcaggaggaucucuugaggccuggaauucaaaaccagccuaggcaauauagcaagacucugucucuaaaaaccuggaaaaaaaaaaaugaaccaggcauaguggugcccaucuguaguccccacuacucaggaggcugaaguaggaggaucacuugagcccagaaguucaaggcugcagugagguaugaucgugccacuacacuccagcccaggugacacagcaagaauccaucucuaaaacuaaaaauuuuaaaaauaagaauaacaaauaauaagacuuaaaaguugaaauuggccgggcgcaguggcucacgccuguaaucccagcauuuugggaggccgaggcaggcgaaucacgaggucaggagaucgagaccauccuagcuaacauggugaaaccccgucucuacuaaaaauacaaaaaauuagccaggugugguggcgggcgccugucgucccagcuacucaggaggcugaggcaggagaauggcgugaacccgggaggcggagcuugcagugagcugagauugcgccacugcacuccaaccugggcgacagagcgagacuccgucucaaaaaaauauaauaauaauaacaaauaacaagacuuaaaagucgaaauuacuccuuggcuggugggcugcagaacagaucauguguuagcgggcaugaaaacacauuaaucuacuccaccagggcccuuugguaaccacaugcauugucauugagaaauauuuuguuguuuucugugcaguccgucucaacagugggcuugaaauauucaguaaaccaugcuguaaacagacgugcugucauccaggcuuuguuccauuuaagagcauaggcagaguacauuuggcguaauccugagggcccuagaauuucuggaaugauaaaugaacaccggcuucaacugagucaccagcugcauuagccccuaacaagggggucagccuggccuugaagcuuuggcgcccaggcacugaccuccccuccagcuaggaaaguccuggauggcaucuucuuccaauaccuggugguuuuaucuacacugaaaauauguugcuuaauguagccgucuucaucaaugaucuuagcuagaucuucugcauaacuugcugcggcuccuccagcagcacuugcuacaucaccuugcacuuuuuuuuuugagacaaaguuucacucuuguugcucaggcuggagugcaauggcacgaucucggcucacugcaaccaccgccucccagguucaagugauucuccugccucagccucccaaguagcugggauuacaggcaugcgccaccacgcccggcuucuuuuuuguauuuuaaguugagaugggguuucuccauguuggucaggcugguuucaaacucccgaccucaggugauccaccugccucagccucccaaagugcugggauuacaaucgugagccacgaugcccggccgucacccugcacuuuuauguuacagagaugccuucuuuccuuaaaucucaugaauccaccucugcuagcuuccaaccuuuuuucugcagcuuccucaccucucucacccuucaaagaauugaagagggauagggcuucgcuugggauuaggcuuuggcuuaaggaaauguggcugguuugaccuucuauccagaccguucagacuuucuccauauccacaauaagccuaguucacuuuuuuuuuuuuuuuccagacggagucucacucugucacccaggcuggagugcaguggcgcgaucucggcucacuacaagcuccgcuucccagguucacgccauucuccugccucagccucccuaguagcugggacuacaggcacccaccaccacgcccggcugauuuuuuguauuuuuaguagagcugggguuucaccguguuagccaggauggucccgaucuccugacuucgugauccgcccgccucggccucccaaagugcugggauuacaggcaugagccaccaugcccagcuaagacugguucacuuucuuaucauucauguguucacuggaguagcacuuuuaauuacuuucaugaauuuuuccuuugcauucacaacuuagcuaacuggcagaagaggccuaguuuuuagcccguuucagcacuggacaugccuuccucacuaagcuuaaucacuucuggcuuuugauuuaaaaugagagacauaagacucuucuuucacuugaacacuuugaggucauuguaggguuguuaauuggccugauuucuauuuuauuuuauucuauuuuucaucucauuucauuuauuugagacagacucucgcucuauuuuccaggcuggaguacaauggugugaucuuggcucacuacaaccuccaccucccggguucaagcgauucuccugccucagccucccgaguagcugggauuacaggcacacaccaccaugcccagcuaauuuuuguauuuuuaguagagaugggguuucagcauguuggccaggcuggucucaaccuccugaccucaagugauccaccugccucagccucccaaagugcugggauuacaggcauuagccaccgugcccggccucaauauuguaugucuuagggaauauggaggcucgagaagagagaugggggaaauggcuggucaguggagcagucagaacacacacagcauuaaucgguaaaguucgcccucuuacguggacaugguugguggugcccccacucacaauaguaacaccagagaucauugaucacagaucaucauaacaaauauaauaauaaugaaaaagugugaaacacugugaaaauuaccagaaugugacacagagacacaaagugagcaacugcugucagaaaaauggugccaacagacugguuugacgcaggguugccacaaaccuucaauuuguaaaaaaugcaguaugugcgaggcacagugaagcaagguauuccuguaguaaacuguauaguaugcuagauggugacaagugccgcagagaaaaaucacccaauacaccaucucaggaaggccaagugagcccacaaagcaaaccacaugcagaacaugccggccauggccccacuuauaaauuaugucucccacccugagccagcagaacagccaagugcaguuuccagaugaggaaaacagacucauccagggucgccagcaagggcuugggccaucuuucuuuccuuuucuuuucuucuuuccuuucuuucuuuccuuccuuuccuuucuuucuuuccuuucuuuucugacagagucucgcuuuaucgccaggcuggaguacaguggcgugaucucagcucacugcaaccucugccuccuggguucaagugauucuccugucucagccucccaauaguggggacuacaggcauccaccaccauaccgcuaauuuuuguauuuuuaguagagacgggguuucagcauguuggccaggauggucucgaucuccugaccucguggcccacccacgucggccucccaacgugcuggcauuauaggcaugagccacugugccuagcccacaucgucccauuuucacagcugcaagccuaacacugccuccugaggccucugucuauccaucugucugccagcccuggggaggggccguccucuccugagcuaacuagccccucugcccucgcucugcuucuucaugccuuccuuccugcuucauauauccacugagcaccugcuaugugccaggucccaugauaggccccagggccaccugggggaugacaguccgggacagaagauucacuuccagccaagcaaaugacccugaggccucagagccccucagucacacaggccccuuucaaggcccuaaucuuuuuuguuuuguuuuaagacagagucucgcucugucacccaggcuggagugcaguggcacgaucuuggcucagugcaagcuccgcgucccagguucacaccauucuccugccuccgccucccgaguagcugggacuacaggugcccaccaccaugcccggcuaauuuuuuuguauuuuuaguagagacgggguuucaccguguuagccaggauggucuugaucugcugaccucaugauccgcccgccucggccucccaaaaugcugggauuacaggcgugagccaccacgccuggcccaaggcccuaaucuuguauuuguaauucuguauuucuucuuccuaaagggccacaccccgguaccuuauaaguuucauggcuccauaaaaccuaguccuguccugggggagaugaacaaacacguaaacaaauuauaaagugucaaauggcaggauggaacagaacuaaauaucauggcagaaaauaacgggggcgugcauaucuuagcuggggagaagcaacuggggaguaccucuuggaagugacaagcugaggccagacaaggaaucuguggaaugacacgggugaaugacaugggugaggaaucucucucucugagccucuguuucccugugugagguggggaugccagucacagcagggugggcugagagggguaaguggcagguccagguuacccaguguggucacaccacccaguaggaccgacaggcagcucaggccccuagcugagccuggcacugcccuuaaucggcuuuuguccuuccaggagggacaggcagggcuggcuaccuccucucuccccccaacagcuggggcuggcugugccagggccagacuaggaggcgggagcugagaucacugggccuuuggcucccugaguccucucuggggacagagagggcagccuggcugggugagaggggacgguuuguucaggacuggggcuaggacuccuggguccuaaaggaugaaggggcugggggccuggacuccugggucugagggaggaggggcuguggguguggacuccuggguucuaaggcagaggagccuguaacaggacuaccaguugagcugagucugggagcagguggggggcagagcagggagcugagcccucuacucuguuuacagcacgugguccucacugaucuuucugggugggagguggcuugugcggcuacacccugggcaggccagccccgcccccggguuuauugccccaggcugcuacuggcacaagccacagaccagcagucccagcccagggaagcucggaagaugccuaggaggggugaguguccagccagcugagagacgggaauggccgcugccaggccccaggaccuagaagggaaaggaaauaccuucuucuaggggaacaggcaaggugcugggcuuugggagggaagucacuggagcagaugguagcauuccaccaagggcagcuuguucaggaccugggugacagggcauccaagaaacagggcagccugaauggcugggaaaggauaucagaggaaagaucacuggggacuggaaaguguggagaucagacguaguccagggcaaguuuugagauguggcuuccagaguccuagcggggagccccacauaaguguggcuguggacccagagagcuggguuuacaaaagcucugccacuugcagugcaacuuuaaccuccucacuuaaaaccugagccucaguuuccucuccuguaaaauggggaugcuggcaauaauagagauuugaaccuagguggugugggucccagaggguuagcacgcuaaagcagcaaacacacagaaagcucucagcacgggaccugcacggauaugcucaaggucgacaccagugaugaguaucgcuguuccaggcaggggagcagggccggccaugcaacccaggaccaguggacaagccugaaggccaggggaccccacugggggagaagcaagacugaguuuuggggaucucacagagaaacagggagggaacugggauuuggaggggguuccacagccagacuugaaggaugaggaaugacucuucagugaagucuagaauugugaacuccugaguucagggagagcugcgcuuggggaccagggucccgagagaugggaaugggagggcuggggcugaacucucccaaauguuguuggaggggaagggccuauggguagcacuuggggccuaagaaggaaagaugggaugggggacccggacuccuggguccugagaauggggaccaacuggagguuuagacuucuuggaaucuaggagaaggagucuugggccccaggagaauucauggagacaggugacuagacucuuggguuccuggaaggaagaaagaaggaccggcagccuccuggaucacaggagaggugaaugaguuagggaagcagagucgugugggcucagggaauguccggauucaggaggccagggcagcaaguuucugagucccaaagaggugauagcaggggcuccuggguccugaagaggaagggcuuggggcuuggacuccugggucugagggaggagggagcugagggcccaaacuccuggcucccgaggagggacaaaggcacugggaacuggggccccaaacuucugauucccagagacaagagggugaccucuuaugucuaagggaggaggaaccugggguccugggccccuggaacugaaagaagacagcacugagguuugaaggaggaguggguaagcuauggcccagacuccugggccccagcuaagcaaggcuugauccagccccaccuaacaggccuccccaccugcccacagccucaaggcucauccacaacauggaccugcgcacaaugacacagucgcuggugacucuggcggaggacaacauagccuucuucucgagccaggguccuggggaaacggcccagcggcugucaggcguuuuugccgguguacgggagcaggcgcuggggcuggagccggcccugggccgccugcuggguguggcgcaccucuuugaccuggacccagagacaccggccaacggguaccgcagccuagugcacacagcccgcugcugccuggcgcaccuccugcacaaaucccgcuauguggccuccaaccgccgcagcaucuucuuccgcaccagccacaaccuggccgagcuggaggccuaccuggcugcccucacccagcuccgcgcucuggucuacuacgcccagcgccugcugguuaccaaucggccggggguacucuucuuugagggcgacgaggggcucaccgccgacuuccuccgggaguaugucacgcugcauaagggaugcuucuauggccgcugccugggcuuccaggugagcccccugccccgugccccucugggcccacaaugaaggcaccugguggccccuggccuggccuauaguaugguaaaguaaccaguggucagcauuaucggacucagcaaacagcagguacagaaaggagaaguuggcuggagcucagacagagcugcaccaggggucucaaacucauggucccuaggucauaucugcuaggugguaagaaaugcaacuugcagagcuuuuuucaccaggauauccacuacucucuauuguccuacaugcaagagauguauucacucuuuguuaccugucuggccccugaagucacuugaguuugagaccccucagggagggaucuggagccaugugacccuauagucauucuggcccucucugggccuccccgcaccucagccucccccucccaccccacaucuccaggcuucccuucaggcuagccuauccucagcaacccagcccaggcauuccuggaaaccuccccucaccagggcugaacccacaaguauugaucagcccagcugggccagccagcuccucccugugucccagccgugacccuagagucaugagaaagagaucccggggcugcccaaaccagcaucccagccacaauagccaggcaucaggugcccucuggccuacugggcgcacagccaggggcagggcccagcucugccuuggugcagggcagucuccccuuuaaaauguccguccccgggagggcagaggccuccccugucuuggucacugcuccagcccagugucuagcaugcaguaggaacuuggccaguacagagugaacagaagaacccgccaaucccuugccuuggccuccuauggcuccauuuccucuaauccuguguccccauuguauuuuuuuuuuuuuuuuuuuuuguauuuuguuuaguagagaugggguuucaccauguuggccaggcuggucucaaacuccugaccucaagugauccacccaccuuggccucccaaaguacuggguuuacaggcaugagccacugcaccuggaccccacugucuuuccuuaacugccugucugcucugucagacgcugucucucccugcccccgugguggcuggcugguccuaugucuaggccucagucucccucucugacugucuuucugccucaggucccugugccuggggggcugucucuggccaucucccuguuccugucuuccagcugccuccucuccccauccauccucucucugacuuucaggaagucccugcaccauccuacuccccaccucacagccuaccaguggcaccaccccgcacugggaaugaaauccaaauuccucugcccaggcccuauaugagcccccuuugccucuccaaugucaccaccugccccucuccccacugcucacucugcuccagccacacuggcccccugacugucgcuacccaggucaagcaccaagcaugagcucaccuuuuuuuuuuuuuagagacagagucucgcucugucgcccaggcuggagugcaguggugugaucuccacucacugcaaccucugccuccuggguucaagcgauucuccugccucagccuccuaugagcucaccuuuaagccuucaugcucucuguucccugugcagggaacacccuccccucgcuucagucagaucucuccuccgagacccgcuaaguagccugaccccuagucaucacuggugcccucuccaccuacugccuuuuuuuuuuuccaaaccauucgucauuccuugucaugauacugcgcguggcuuugcuuaucugcugaucauuuguuuucccuuugagaacaucagguccgugaaccagccgagagcuaugcccagcacacaguaggagcucaugaaacguuuacugaaugaaugugucuuccccgcacaucccugugccucgcuccugcccuguccccaucccucucuugagcggugggugacgcagccgcgucucuccacaguucacgccugccauccggccauuccugcagaccaucuccauugggcugguguccuucggggagcacuacaaacgcaacgagacaggccucagugagucccagccagguucuacucgcagccuacucucuuggcccuccuccccacuccugcccaagcagccugacccacuggggcucccugacaccccuucugaccccuagguguggccgccagcucucucuucaccagcggccgcuuugccaucgaccccgagcugcguggggcugaguuugagcggaucacacagaaccuggacgugcacuucuggaaagccuucuggaacaucaccgagauggaagugcuaucggugagggccuguugcagauggggacacugaggcccagagacucaucugaggccacaguaggucucuguggggcuccaggcccagggauggcacacaaggggaaagacuggggaucagagggagaggugaagggcaccccugcaggcagaccuucccuagcaccccuucuguccccucccuccagucucuggccaacauggcaucggccaccgugaggguaagccgccugcucagccugccacccgaagccuuugagaugccacugacugccgaccccacgcucacggucaccaucucacccccacuggcccacacaggcccugggcccguccucgucaggcucaucuccuaugaccugcgugaaggacagguaggguuccagccucagccagggacagggacagagccgaggagcgugggcagcccccaccuuggcauccccauggaggggugcagcccuggccagcucuccccaaccucacacaccgucucccuccucacccccaggacagugaggagcucagcagccugauaaaguccaacggccaacggagccuggagcuguggccgcgcccccagcaggcaccccgcucgcggucccugauagugcacuuccacggcgguggcuuuguggcccagaccuccagaucccacgagcccuaccucaagagcugggcccaggagcugggcgcccccaucaucuccaucgacuacucccuggccccugaggcccccuucccccgugcgcuggaggagugcuucuucgccuacugcugggccaucaagcacugcgcccuccuuggugagccucaggcccccacagccaccugcgccugcucccaucccacccagcuugcuuuaagcuccuccagccucagccucacacccucuaccuuucucuccccccacaccucccagcuccugcucacccagguccugcccaaucuuccaccucagccacuuuauccucuguccccaacuguggcacccagacucuccaucuccuccaccuccacuucccacccaccguccugucucccugggccucugucgucccccucugauagcuccaggcccugcucuccuguccuaccagccuccuggcccacaguccagcuucucugaccucccucuucgaagaucaacaucuugggaggacacugaggcacagagcagaguguggccaugccccagggcacagagcuugcagcccagccccucuguacugacccugaacccugaccuuccauucccgcccucugaggccccccuccugcaacaggccugagcucagcuccccuuucccaccaccugcccucccugcucccaaccuccagccccgacagacuuucccagugcuucccugggccucuccagguccugagucauccugacccucugucuaccacaugagcccaaaucugugccucagucugccagucucuaaaacugcagucugcuaggccuuggagugccccacaccccaccuuggagagcccaguucucccagcuugaguuccucccugcccuccuccccaggccucugccccugccagguugucaccaaccaccccucucccaaaccaggcucaacaggggaacgaaucugccuugcgggggacagugcaggcgggaaccucugcuucaccguggcucuucgggcagcagccuacggggugcgggugccagauggcaucauggcagccuacccggccacaaugcugcagccugccgccucucccucccgccugcugagccucauggaccccuugcugccccucagugugcucuccaagugugucagcgccuaugcuggugaggcccacacccucagcagggaaacaggacugcauggaugucugacuccugcagggacgggcuggggaccaggacuccugugacugaggaaggagaggccaggcagaggaaucuaagacuccuugucccuuuuuuuucgugugugugugugugugugugugugugugugugugugugugugagagagagagagagacagacagacacaaggugucaugucgcucaggcugagugcaguggcucaaacacaccucacugcagccuugaccucccaggcugaagcaaucauccugccucagcuucccaaguagcuggaacuacaggcgugcaccaccacuaccacgcccagcuaauuuuuguguuuuucgcuauguugcccaggcuggucuugaacuccugggcucaagccauccucucgccuuggccucccaaaguacugggacuacaggcgugagccacugcgcccagccuccuuaucccuuuugaagcgauuggauauucucgggucccugggaccacagaugccugaaguucugggcguuaaaacugggcccagaaaggggaaaacaacucagcuacccacauauauucugcaggugcaaagacggaggaccacuccaacucagaccagaaagcccucggcaugauggggcuggugcggcgggacacagcccugcuccuccgagacuuccgccugggugccuccucauggcucaacuccuuccuggaguuaagugggcgcaagucccagaagaugucggagcccauagcaggugagugauucacucccgucacaugcccagccagggugggcaggagggacagccuagcacagcaaaagucccagggaagaugcugggcauggugguucagaccugcaaucccagcacuuugggaggcugaggugggcagaucacuugaggucagggguucaagaucagccuggucaacaugacgaaacccugucucuaguaaaaguacaaaaauauuagccaggugugguggugcacaccuguaaucccagcacuuugggaggccaaggugggcagaucacuugaggucaggaguucgagaccagccuggccaauauggcaaaaccccuucucuacaaaaaaauaaauuagcaggguaugguggaguacaccuguagucccagcuaccagagaggcugaagcaugagaaccgcuugaaccuggguagcagagguugcagugagccaagacugagccucuguacuccagccugggugacacagcgauaccuugucucaaaaaaaaaaauuuaaaaaaagaguacgcuuacugggcuguggugaggucugccuccaaccauuuggccaguacaauauauggcacccaguaggugcuauuagaagaugccagcaccccugguguguccauucuguuccagugacccucugggccacaaaguacuuaaguaguuauucucacauuguuuugcaccucaccuucguagauuuauaaagacaaguaaggcugggugugguggcuuacgcccauaaucccaacacuuugggaagccaaggcaggcggaucacuugaggucaggaguucaagaccagcuuggccaacauagugaaaccccaucucuauuaaaaauacaaaaaugggccaggcgcaauggcucauaccuguaaucccagcacuuugggaggccgaggcgggcagaucacgaggucaggaguuugagaccagccugaccaacauggugaaaccccaucccuacuaaaaauacaaaaauuagccgggcaugguggcaugcaucuguaaucccagcuacucaggaggcugaggcaggagaaucacuugaacccaagagacgagguugcagugagccgagaucacgccacugcacucaagccuggguaacagagugagacugucucaaaaaaaaaaaaaauacaaaaaguagcuggacaugguggcaugccuguaaucccagcuacucaggaggcuguggcgggagaauugcuugaacccgggaggcagagguuacagugagccgagaucgcaccacugcacuccagccugggcaacagagcaagacuccaucucaaaaaaaaaaaaaaaaaguaaaaaacuaaaacuguagcaucuuggcccucaugguaggcagugugggucugauaaaaugaacagagcugaggccaagcugggcacgccaggugggcuggaaguguaucuuuagcaucguuugggcacuugcuugccuggucacgugaacggauaaaacugaagaacacaaaggaaauguggggaagcagauccauguggcuacaggugccagaccccuagaaaugugauacacccuggagacuuguuagcucccugugaacagagccucccuucaagccacugggccugcuuacuauucaaaucauuuugauccauuuacaccuugugguaaguguaaucccagcacuaugggaggccgaggcgagcggaucacuugaggccaggaauucgagaacagccuggccaacauggcgaaaccccaucucugcuaaaaaaaaaacacaaaaauuagccgggcaugguggcacaugccuauagucccagcuacucaggaagcugaggcacgagaaucacuugaaccugggagguggagguugcagugagccauguucuugccacugcacuccagccugggugacagagcgagacuuugucucaaaaaaaaaaaaacaaaaaacgauauauuaugauccccaguggguagcgguaccuaaucccacaucuuaucccacugaguccugccaccuaugaaccaaggacuauuuucauuuccuugaucuagaagaaaaaauagguuccuagagguaaacugcaccuaaucuucccagucacacacacacacacacacacacacacacacacacacacacacacacacacauccuucacuagaacacacugccccacugccaagacccccaccaugaccaccuggggcaucuggaacuccacccauccccuaggcaagagucuggggaaacacagccuuucacagcgcuccacaggcgacugcccuucccauggcauucccugccagccacacacacaaccaaacuaacggagccaggccuaucugcucucccucucucagagccgaugcgccgcagugugucugaagcagcacuggcccagccccagggcccacugggcacggauucccucaagaaccugacccugagggacuugagccugaggggaaacuccgagacgucgucggacacccccgagaugucgcugucagcugagacacuuagccccuccacacccuccgaugucaacuucuuauuaccaccugaggaugcaggggaagaggcugaggccaaaaaugagcugagccccauggacagaggccugggcguccgugccgccuuccccgaggguuuccacccccgacgcuccagccagggugccacacagaugccccucuacuccucacccauagucaagaaccccuucaugucgccgcugcuggcacccgacagcaugcucaagagccugccaccugugcacaucguggugagcgacagagggggccgguacaggugcauuuagagaagagcagggcacccggggaggagggggaccgggcacggguacaccugggaaaaagagcuccggaguggggagaaagggacaggcguguccccaggggagaacaaugccccgaacgaacgggaggaggacaagagucagggcugccuccguuuuacuuugcaauuuugaguaccaagagacaggaucaguggggcagccccuugggcuuggagaaucaagagaaaaaaaagguggguuuggcgggguggggagggagaggcuggagagaggccggggaucgcaguuaaagucauucucccauccuucccacaacuccccccauucccuccauucucuccccaacuccucacccaccaugucuccugccuccguccacuccgucuguauccguauuucccgcucccuuuguucaucaaaccccuccucgcucuacccgaccccggucugucugucccccacccucucuccacgucccuccccgcugucccguaggcgugcgcgcuggaccccaugcuggacgacucggucaugcucgcgcggcgacugcgcaaccugggccagccggugacgcugcgcgugguggaggaccugccgcacggcuuccugacccuagcggcgcugugccgcgagacgcgccaggccgcagagcugugcguggagcgcauccgccucguccucacuccucccgccggagccgggccgagcggggagacgggggcugcggggguagacgggggcugcggggggcgacacuaaaagccuguuguucccaucugcgccggccuccgucaugaaugccuuccgggccgggcggaaggggacgcgggcugugccuuacuuaagucggggguggcaagggggcggggcgggggcccgaaagcugagacccucgccacggggagggggacgcgcacacacaccggucaccgagacggcuggaccugcacgccaccgcugccuuuugcugcugcugcugcggcgaccgccgcagggacggggacuggcccucccuugcaggucgguuugguuuguuguaaauaaaaguauuuaauuaguuuggccucucucaaauacggugggguguuugcccaccagggggcagcaucggacucaagcggcugggaaccaagaaaccuggaaugagggguaugggggacuggauuuuugggaccagaagggaguggacuccuugguaacccggacccaccuccccucggacuucauccagguacacugccaggagaugcuggguccucagcuccuccccuugaagaccuucgguuagcuggacucacccuggucccagggagaccaggcucagcauccaucagggggauauaaaaguuaaaaauaaucucucgggucucaaaggcuccagugacccaaacacccuacagaacuggagcaaaguuagcaggaaaucagaaacaaacuggcgcucaaaauacuguaaaugcagccgggcacggagguucacgccuguaaucccagcacuuugggaggcaagacaggaggauagcuugaguccagggguuugagaccagccugggcaacauagaccagucucuacaaaaacauuuaaaaauuagccgggcgugguggcacacuccugcaguccuaccuacucaggagggugaggcaggaggaucacuuaagcccaggaguucgagguugcagugagcuaugaucgcaccacugcacuccaacuugggcaagagugggacccuguuuccaaaaaaacaaaaacuggaaaugcaagcucuguccagcugugacaaucaacucuuggaccaacucucuggccccuugua

SEQ ID NO: 15065 - RNA, 1538 nt, Homo sapiens
ggggaccaggccacccuggaccuugcuacuuccugcuccuugcagccauagcucagagacgauggaacuguggaggcagcugaaucaggcuggacuggugccuccggggcugggcccacccccccaggcccugagggaggucuccccaguggaaaucccuggucagacccucaggacugcaggggcagacacuggaggugccugcgauagucugcuguggaucagggaggagcuggugagugagggguuuggaagggaaagagaaagagaggaaaugagaaugaauggaaaugaacaaaaauagagaaggccagagaucgaaaaacagaaucugagagauagaagcagagacaugagaggcauguacagacaccgagagacagacauagagugagggacgggaacagagguggggacagggagaucccaaaagagagggacagaggugggaagcagagacggagagcaggaacagagauggagagacagacugaauuugagaaaguuggggagggcagagagagggcaagcgagagaaagagagccaaaggcaggggcagagaaauggcaacacauaaagacagagagacaggggcauggaaagacaaaaaauaaauggggacagagacaaagggaaacagggacagauauagauaagagagggaggagacagagagagagaagucagggacaaugaaauggagagacaaagagaagaguuagagaucaagagacacucugagaagcaggaaggcaguuaggguccaugggcacagugaggacccugcccaggcgcuguggccaggacaugaguugggaccugcucucacccagguccuggagagaccccuugcucucugggguggcaucccugugacguccccuuccuacuggcaggggaaccugcgccgaguggauguccagcugcugggacagcugugcagccuggggcuggagaugggggcgcugcgggaggaacuggucaccauauuggaggaggaggaggagagcagcaaggaagaggaggaggaucaagagccccagaggaagcaggaggaggaacaccuggaggccugcccagccccacauccaccugacuuugagaugaugaucugaggcucugccaguggauuuagauugacauacaaaugagaugcaaauguauguaaaggagaagggagauuugcaggucaaagcagauguggaaucaaguauaccccuuuaguaagugcuuucucugaaggugccugcaaugauauuuaggcauuggccugugagcuauggguguguuugcagaugacaugaggauguguuuggaggugaugugggagguuguagagaaguugcaggugcuuucgcagaugagccucaggugugcugcugagauggggaucucugcaaauaugcuggugaugcauacagaugcgauuucagaucaacgcuguccaguaugguagccaccggacacacaugguuauuuagugcuugaaacauggggacugcaaauugagaugugcugugaguguaaaauacacacc

SEQ ID NO: 15066 - RNA, 8615 nt, Homo sapiens
aguaacuugaacagggaaaguuuaauauagagaauuacuggcuuuaacagugaacuggaauaaugagggcuucacugguaaaaugcuucugaauugacuggaaauccauuuggggugcuggggaacguuauucccagagaggugccucaguggaggcgcugugucuccuacgcaacuucugagggcuggagggugccaagggcagcugcugaccgccuggugcuucaggagcugggugcuggggaagccacaugcacugcggcguccagaggcagaagcacaaccaacaagaaccacgaaggaggcgccuuuccuccuauaaugccuguuuggugcccucuacugacaaagcuuauccccuuucaaaaaacagccaacugaaaaagcugaauuuggaacauaaagucaauaaauccauaaccagcaauacuauggggccuggggugcgcuggccuuuagugaguggaguggggcgaaggaugcugcauguccugcagugggcacagcggcccugcacgggggagaaccaucccuguaaagugucaguaguagccccugugucagucagggucccugcaagaaauggcagugcacucacauaaggacaguuugagaagagucuccugacaaggugaguguggcucucugcggcuacuaacagccugagccuuuaccuccccaggccugaacaggggcauggaaagggcugccugacagggugacaggagcugugaccuuuagccaagggcagccaggaauaaauacugggaacucacgcucucuccugugauuggccagcaccacucccccacccugacguugagugaagacaaauggaagccagaaguguggugagcuaccagacauuccaugcagcccgcugagaagccacgugaguggggacagggcuaaaggcuaggcagggacagggcuggcugugucccgaggcugcuccuccggcccugacuucaggcccucagcccagucgacucccacaaccucgcaauugggcagcaucuccuccaccaauaucugagugaggccaggguuggacacggcagggagguccgagauguccagccugcggagguuccugaaaaggggugagaaggacaggaagccaguguaaggacagcauguguguguguguagggagguacaggacagcgugugcguguguguguguguauaggcagguaagccaguguaaggacagcguguguguguauagggagguacaggacagugugugcguguguguguguguguguguauagggagguaagccaguguaaggacagcauguguguguguguguguagggagguacaggacagcguguguguguguguguguguguguauagggagauaagccaguauaaggacagcguguguguguguguguguguguguagggagguacagacagcgugugcguguguguagggagguacaggacagcgugcguguguguguguguguguguguguguguguguguagggagguacuggccccaaauuucaaccuuacaggacagugugugugcgugcgugugugugugugcgugcgugcaugcgugcauguguguguguauagggagguacuggccccaaauuucaaccuuagcuuccuaaaauaaaaucuuuauagcuguccaggcacaugaagcccacuguguuaauugcaaauaugcaacuccagcuccugcuguucugcaacagcgucgauaucacacaguuuugacuaaaacaaaaaggaagaaaaccaggagucauuuaauucuuccagagacucacugugacugcucaucuaccauaaauacucuagguuugugauggaugcagggggauaugagaacugccuaacauugccccuccccacuuccucuccugcaucuggguuaggugggagaggugccugggcauguggcccagccugagcugaggucucacuggaggugguggaggcaggcgaggccccguucggagaugcgggggcaaccggccagcgagagcuccugcaacgagucggccaguggguagaggcggcugagacaccagucguccacguggcagcagcgcugcagcgacaaggacuggagcuccuucaggcggacugcgguggggagagggugggauggcaccaggagccuuucuggagcccaucaccaaagggaaaacauagaggccugucccaucuccaccccaccgcacucacggagguuauccaggcccucguaguugaugucacagucaccggcauccacagcuucgacaggcacuucacagaaauuccagaacuccugagagaaauggccauacuuaucuggccugauccacuccuugucucgaaaccuggaaacgggaaagggagugucagcagggcaccugaaccugccccaggccuccagccucuucagaaccuuccccagcccuauauaauauguauaggucacccuugacauaacuaauuccaucuuagaaaaagacuccaucuggcugugcgcaguggcucacgccuguaaucccagcacuuugggaggcugaggcaggagaaucacuugaguucaggaguuugagaccagccugggcaacauagugagaccucgucccuaugaaaaaauacaaaaauuggccaggugcgguggcucacgccuguaaucccagcacuuugggagccgaggugggcggacuacgaggucaggagaucgaaaccauccuggcuaauacacggugaaaccccaucucuacuaaaaauacaaaaaaauuagcugagcaugguggcaggcgccuguacucccagcuucuugggaggcugaggcaggagaauuguuugaaccugggaggcggagcuugcagugagccgagaucgugccacugcacuccagccugggugacagagcgagacuccaucucaaaaaaaaaacaaaaaaacaaaaauuagcugggcuugguggcuugcaccuguggucucagcuacuugggaggcugaggugggaggauagcuugaacccaggaggucgaggcuguagugaguugugaucaugccacugugcuccagccugggagacccuaucucaaaaaaaaaaaaaaaaaaaaaggaauguuuugccaauuuuacauaccuagaaacugagggucagcgagauuacagauaacauaagagcaaagagguaaaaugcaagaauccuuguagaugggcagaaguuaagggacauuuucaaacauguauacuguuucuaaggaaguugccagaggaagugcucaaaccagauggagggguagaugaagucuaugugaacugucuuuuccaaaaaaagaaaaaaagcaaaggaaagagaaagggaaggagaaaggaggcggggaagaaggaaagaaagaaaaacauuauugagcacaggccaggcgccaccaguggcucacgccuguaauccccagcacuuugggaggccgagguggguggaucacuugaggucagggguuggagaccagccuggccaacaugguaaaacccugucucuaccaaaaauaaaaaaaauuagccgggcgugguagugugcaccuauaaucccagguacuugggaggcugaggcaggagaauugcuugaacccaggagauggagguugcagugagccgagauugugccacugcacucuagccugggcgacaagagcaagacucuugucucaaaaaaaaaaaaaaauuauugagcacauaugcauugcuaggcuucuuacauugcaaaaucacaguuaaucucucacucccccugacagggucccacuggguagcugggauuacaggcaugcaccaccaugccuggguaauuuuguauuuugguagagacgagguuucacuauguugccgaggcuggucuugaacuccugggcucaagugcuguaccugccuuggccucucaaagugcaaaggcaugagcuaccacgcccagccauuauuauuauuauuuugagacagagucuugcucugucacccaggcuggagugcaguggcgugaucuuggcucauugcaaccucugcaucccggcuucuaagggauucuccugccucagccuccuaaguagcuggcauuacaggcgugcgccaccaugccaagcuaauuuuguauuuuuaguggagacaggguuucaccacguuggcuaggcuggucucgaacuccugaccucagaugauccaccagccucggccucccaaagugcugcgauuacaggugugagccaccgcgcccggccuauuauuauuuuuugugaugaggucucccuguguugcccaggcuagaguucaguggugugacuacagcucacuguagccuccuggacugaagcgauucucccgccuuagccuccugaguggcugggaccacaggcaugugccaccauaccuggcuaauuuaaaacauuuuuuguagagacagggucucacaaagcugcugaggcuguucucaaacuccuggccuccagugaccuuccugucucggccucccaaagugcugggauuacagaaugagccagugugcccagcuccguucagucuuuuuuuuuuuuuuugacacuuuugagauggagucuugcccugucccccaggcuggagugcaguggugcaaucucagcucacugcaaccuccaccucccggguucaugcgauucuccugccucagccuccccaguagcugggauuacaggcgccugccaccacgcccagcuaaguuuuguauuuuuaguagagacaggguuucgccauuuuggccaagcugcucucgaacuccugaccucaggugauccgcccgccuuggccucccaaagcauugggauuacaggcgugagccaccgugcccggccccuguucacucuuuauagcaaaccuuguggguuagaaaugaccaccaucccauuuuacacgugacaaaacugaagcucaggaacaagucccaagccacacagccaggaggcggcagagaccaggggacucugaagccugugugacugcagaaccuggauguuagagagauaccccaccaccugccccagcccguucuaacaccuuagcggucauacuugacugcgccucccugcuucaggaugaaaaaggcaccugcgccguauggaccauguugcuucuccagccagguguaagaucugcagagaaaaugguagcuaagggugaggccuggggagcaccacagcccucacgaugccccagugcuguuaagaggggcagaguccagagaaccaggcacacagacagauucagucaggcugaaaauauuuauugcccaccuccuaagugcugggcacugggggcaaaguggugaccaaggcagauaacaucccugcccagucuggagauuacugcaguaauccaagcuauuauacagggagaaacagauaacaacccaggaaauaacagcaaacugcagagaaugucaauuccaugaccaaacaaagcagagaggcugacugugagggcuagggagcagaggaguggggaugguggaggcuaacugaguuuggguguuaauuggaggaggugacauuugagcagggauuugaguggugagaaggaacagaguauaaaggcucagagacuugaauuaggaugguugaauaaauaagaaauagggaugucaugcugaaggggccaguggaguccugauagggggucucaaagcucaguaggagcuauguuuuaggccuuggagauuggcucuuauuugaagguuuugagcuggugaugauaagauuccuucagcugcuuuguagauuauaaaaaacuaugggacaggccaggugugguggcucacgccuguaaucccagcacuuuggaaggccgaggcagguggaucaucugaggucaggauuucgagaccagccuggccaacauggugaaaccccaucucuacuaaaaauagaaaaauuaggugugguggcgccugccuguaaucucaccuacuugggaggcugaggcgggagaaucgcuugaacccaggagguggagauugcaaugagccaugaucacaccacuguacuccagcaugugcgacagagugagacucugucucaaacaaaacaaaacaaauuuuggcggggugugguggcucaugccuguaaucccagcacucugggagaccgaggcaggcggaucaccugaggucaggaguucgagagcagccucgcuaacauggugaaaacccaucucuacuaaaaauacaaaaauuagcugggccugguggcgggcgccuguaaucccagcuacuugggaggcggaggcaggagaauugcuugaaccugggagguggagguugcagugagcuuagauugcgccacuacacuccaggcugggagacagagcaagacuccaucucagaaaaaaaaaaaaaagaguaugggaacaaaaacccaguuagcuuauugagugauucaacuauaagggaucaggcuacgaauggugaaggcagugagaacuggucaaaucugagauauucuaguauuuuauugauggucuggauguggagggcagggaagcaaagagaggaauuagggaugacuccuuagaauuuggccugaacaacugggugggcagcaccaguguuuacugggaugggaaggcuugggagugagcagauguuuuuaggggagaaaucaggguuuggcuuuagccauguuagguuugagaugccaguuagacucugaguggagcugguggguggcaaacugccuaugugagcuggaguccuugagaaggguacagccuggagauggagcugcaagagacaucaaggcuggcacuggaagccacagugcugccugggaauggcaaggacaggaccugggcucuggugggccagggucuccacagggucuugcagaccagggauucucaccgauuuuucucaugcaccuuguacaucucccuuuggagcaaguaaucccucagagccuccacaucguagaaauaguuggucaggaacuggaguauuguccuuuucuucuucugauugcccucuggggccacugccgcacccaggcgauggaugccccugauacgcccauuccacaugggggcgaccaggcgcagggacuggggagggggagaggaaaggagcugagccuggagccuccugggagacacagagcuggaucccccaguucuugcuccaugaaccucaaucccucugcuucccaacucacccuaaguucuuccuucaaaacuucaaaacugucuuugagauuccaaaaauuuccccauguuuuuuccaaguuccuccuccccuuagugaacccuaaauuuucucgacuagccauauauuguugauuuuccuaaauucuuccucuaacuuucccccaaacccuuaucacucaaaaccugcauuauuugaccucuuaauuuuccacagauuugccccuuaauuacccaauucuucugcuggggucuucccaaaugacuucuuucuuuccccagaauauaaucuuaaaaacuuaucuccaaaccucaaggagagggugcucugagcaaucccuaaaaccaaccaagcuuguccaacccgccgccugcaugcagcccaacacaaacaugcaaacuuucuuaaaacauuaggaggauauuuuugugauuuuuuuuuuuuuuuuuuuggcucaucaguuaugguuaguguauuuuauguguggcccaagacaauucuucuucuucgaacagcguggcccagggaagccaaaagauuggacaccccugaaccgagaaggguauaaaaagcaugagcuuugaagaggagaguaagaaagucgagggguguggccaaugggaagaagcccccaaacucuucaauuuugcuuucaaggucuccucuuaaucuaccccaauuucucuuugcuuuaaccaaauucuuuuuuuuuuucaaauuaucucgauaauuuuacccaaacccuuauuuuccucaaaaguuuaaagcugccaaccucuuuaauuuucccuaaauucauuccuugauuuuaaauccucugaaagaauaucucaaauucuccucuuaauuucacccagaucaugcccuuagaaccuccaaauugaccucuugguucccccacccaucaugcuuuugaguuuucuguaaaaauucgucaaucucccacuaacuuuccuuacauucauccuucggucuucuaagaccaaaucccacauccucgaacaaucccuuccaagcucucuuauccuacaggccccacccuugccuguccauuagcuccuugugucaucccucccucugauugguuagucgcgucgcucuucggcagccacucccucauccccauuggauacucucagccaagucccugccuccucucgcucgcuaaagcgucuccuccgccugcgacccucacagauccuuccuggcccccacuagccacagguuugcacucccaguacggggcuugccaggcuuagccugcugccucacggcuuucugcucucguggccgccaacagaggcccugaaugcggaggcuguagagcggacuucaaauuuggggcucuaggaacuccggucacuuaccgcccagggagccgccaucuugcuaagguuucguaaccggaaggggccg

SEQ ID NO: 15067 - RNA, 9811 nt, Homo sapiens
cuguaagaauugcucuccuuuacugagcaccucccauguggcuaagcagccuccugucacucaacacccugcgaccccauacauuuacuguccccaauuuacagauagggaaacugggcccagagggaccccgagguccuagaaaggacagaagcggugccaugccuuagcuggggucagcucugacagucucuagagucugugcucuugaccacugugccauccucccccaucacuggguguccgggguguggaugguggugacguuggaggcagagucccucagcacuccacgccguagcggucgaaguugcggagcagcaggccgaucuccaggugcacggugccaccagcagcugugugcaggcgauagcggucggccccacuguagaugguguccccaugcagcagcugcggcccaccacccacgaaagcccgugccaacuguucucgccaacugcccaggggccgccacguggggcaggccagcuggugggugcccgggcuacugggcacauggcaaaauccauagccugcaagcuggcagcggccaaagcuguccugggaccacaccuggaaauggagccggggccagccugcaggaaaggagagagaggggaaaggagggauggguggggaccagacuccugcugauuccccacucccugauacucacuggagaccccaggcccagucuuuuccucucuggguuucugucccagaguuuccaacccagccuccuuucuaggcucccaccgucuuaucuauccccacacagcagccaaagugaucuuuccaaauccauguuacuccccugcuaaggauccuuccauagcuccccagugcccucaguauaaaguccaaccucuucaacauucaaggcccuucuaaucagaccucugcugaauuuccucucuguguuauccuccuccaugaccccaugucagggcagcccauugcuccuccaguccccagguaaccaucaugggccuugucagggacaccuccugccuucccucaugucccugcccugcucucuuugggcccagggccuucuuucuugccccucucuaauccaccuuccaccuggcaucuggaagcaucuuucucuccuuccauagcuuugcccauguccucagaacacaguucagcuccucagucugguagucaaagcccuuggagauccagccccaucucaucucaugcugaucccuucuccugugcuagacucuguucuagcuagcuggggacacggcagacaugaacauggauggcagacaaaaauuccugcccccgugaagcugauauccuagacaacgaauguaguaaauaagcaaauuauaggguagaucagauggugguaauugcugugagggaaaacagagcuggguagggugaggguggggauaccgcuuuagcaagaaggggaucaaggaagcuucauuaagaaggugacauuugagcaaaugcuaaaaggaaggaagggaguaggccauguggccaucuagaggaagagugcuccuagccagagggaacagcaagugccaaggcccuggggggggacugucugguggggacaguauggcuggagcccagacggagugugccugguggggacagcauggcuagagcagaaugagguggggagacgggaaggaggugccagccugguuguggagagccuugugaugcaugcuaagacuauggcuuucacccugagugagauggggaccauuggaggguucugagcagagcagagaugggaccugacuuagguguucacagggucccagcugcauguggggugcagaccagggggguuggggaaggggacuccagagacaagauucuugucauaguccaugugagagaagaacuuggacagaucaaggugcugggcgagaaaaggguaagaagugggauuuaggauguauuucaaaaguagaggcaguuuaagauuuccugauggacaaaaugggggcuugagaaaagagaaagcaaggcuggugccaccacugggggacuggaggccccaagagcugaaagguuagagcugcccaccucacccacacagcaccggaaagauuuuuuuuuuccccagcuccagcuuaaaagacagaaagauuauuuaaaagugaaaucucagccaggcgcgguggcucaugccuguaaucccagcacuuugggaggccgaggcagguggaucaccugaggucaggaguucgagaccagccugaccaccuuggugaaacgccaucucuauuaaaaaaaaaaaaggcaaaaauuagccagaugugguggcacguggcuguagucccagcuacucgugaggcugaggcaggagaauugcuugaaccugggaggcagagguugcagugagcugagaucuugccacuacacuccagccugggcaacagagugaaacucugucuccaaaaaaaaaaaggugaaaucucacuuguccauuaccugcucuggcucccaagugccuucaggagauggccucagcuccucagccuggcacucaaggcccugcauggccuguccccuucugccuuuccccucugccgucccgcucucccucaauccacuagaugcccuuggcucacuuuccccuuugagucuuccacguagcucccucugccuagaaccuucuucuaucccucugccuuauuagcuccgcuggcccuucacagcaaaguucagaagcccccuccuccaggaagcccucucugaccucccugacagagucagccacuuccucugggcucccacagccucuccaaaucaccuaucuuaguccugcccacucugaggugccacugucuggagagagguguguccccccauaggacggugaacccugugaggacaaggcuaagggacacugccuugauccucaaugucucccuggcaucacccaacacaggcuggacacagggcagguaccagguagacguucuuuauauuggugaaauauauggcacauuuaccuaggcaauuucucagaaucaacucaucuccaggaacccacauuuucuacuagaaaggcuuucugaugccgcuccucccccaguacugauuuccccuuugagcagcagcucuacuuucaagccgaggagcccuuccuggagaaacagcccuugccucucucagacccugccucccggcuuccucuuuauuggagacucucguuuugucucuuuacuugaaugccaccuccccucccacccugaccccccaccuucccaccuccugcuccacccuggccucugcccuaaucauacaaacuugggaucgccuauugagcaggccugggaaggccuuagcucagccucuccagggccagacuuggcugcaaaagggaccuacgugguauggggagcagggacaggucuugguguucccagccccagggaccucagaggcuacuggcccccuccccucagccuggacccggguccaggugugauacccaccuugaagaccuuugguggcgaagugcaggucgauggggugggaccaguaagccauguccccuaucugcgggguguccacuugcguuuggcccucccgcacgccugacaggagcuuccaugccgccccugcagugagagccgggacauagaggggugggaggcagccaucgggaaggggaugccgcuguggcuauaggacuguuucucuguggcaucuacugguagggguuacgaagcauggacucuggaaccaaguaucuggguucaaauccuggcacuaccucuuccugccucugcaaccuugggcaaguuagcuuucucugccuuggucuccccaucuauaaaaugagcugaguaauaaugcauuccucauugucuucauuuguuuucuguuacucuuaacauaauauccaaaacuggauaauuuauaaagaaaaggaauuucuaucucacaguuauaggagacugaccaagguggaggagccccaucuaguaagagccuucuugcuggaacucuucagagagucccaaggcuagugugcuaacaugccacucacgucucucucucucauuuuauaaagccaccacuuccucucccaugauaacccacuaauccauuaacccauuaauccaugaauggguaaugagcauagugagcacgggauaagucuucaauaucauuuuauuacgauucucaccccauauuuucaagccuaguccaaggauuaagauggggccaaggguacccuccaggagcgcauccugaaacacacauaacaauuucgauccuacugaggggugauaaugauagcuaaaaugcacugagugguaggauacaguggcucacaccuguaaucucagcacuuugggaggccaaggcagguagaucccuugaguccaggaguucaagaccagccugaccaacauggcaaaaccccaucucuacaaauaauauaaaaauuaaggcugagcgcaguggcucacaccucuaaucccagcacuuuaggaggcuuagggggggguggaucaucuaaggucaggaguucaagaccagccuggccaacauggcaaaaccucgucucuacuaaaaauacaaaaauuagucuggagugguggcaggugccuguaaucccagguacucgggaggcugaggcacgagaaucgcuggaaaagcugcagugagccgagauugcaccacugcacuccagcuggugugacacagugagacuccaucucaaaaaaugaacaaacaagccaggcgcagugacucacgccuguaaucucagcacuuugggaggcugaggcgggcugaucaccugaggucaggaguuugagaccagcccggccaacauggcgaaaucccaucucuacuaaaaauacaaaaauuaggaugggcgcaguggcucacaucuguaauccuagcacuuugggaagccaaggcagguggaucacuugaggucagggguucgagaccagccuggccaaaaugguaaaacucugucucuacuaaaaacacacacacacacacccacaaaauuagccacgucuguaaucccagcacuuugggagacuaaggcaggcagaucacaaggucaagagaucgagaccauccuggccaacauucugaaacccuaucucuacuaaaaaaauacaaaaauuagcugggugugguggcgcacgcccauagucccagcuacucaggaggcugaggcaggagaaucacuugaacccaggaggcggagguugcagugagccaagauggucccauugcacuccagccugggcaacaagagcgaaauuccaucuaaaaaaaaaaagaaaagaaaaaaagaaaaugcaccgaguacuaacuaaaucccagaugcuaugcuaaguacuuuaagcauccauucauuuaauccacccucuaggacucuuaauccccuccucaccccccaguuuacagacccuccaccauggcccacguggccuggcucuugcuccccucccugaguucaucucccaucacucucccccucccucaucacccucuggccucacugucccacuucugacuccccaccucagggccuuugcacuggcuguucccucugccuagaaagcucugcuccuggguguccccaucccuagcuuuuguuuucauccuucagggcccagcucaagugccacuuccacagagggguucucccugacccucuucaccaaacacuagucccugccacaucauuucuuuucauccuagcacuuaccacugucuggaaucacggugcuccuuucuuuuuuuggggggguggggggagacaagaucucccucugucacccaggcuggagugcaguggcacaaucacagcucacuacaaccuugaccucccaggaucaagcaauccucccaccucaaccucccaaguaguugggacgacaggcacacagcacuaugcuuugcuaauuuuuuauuuauuuguagagacgggggucucacuauguugcccaggcuggucucaaacuccugggcucaagugauccuccugcuccagucucccaaagugcuggcauuacaggggugagucaccacacccaacugcacucguuuaucuguuuauuuauuuuauuuuauuuauuuuuuuuugagacagacuuuugcucuuguugcccaagcuggagugcaauggcaccaucucggcucacugcaaccuccgccuccuggguucaagcgauucuccugccucagccucucgaguagcugggauuacaggcacacgccgccaugcccagcuaauuuuuuuuguauuuuuaguagaaaugggguuuuaccauguuagccaggcuggucucaaacuccugaccucaggugaucugcccgccucggacucccaaagugcugggauuacaggcaugagccaccgcgccuggccugcuuauuuauuuucugucuccccuacuguauggcccaggaaaacagggaccuugcacacugcuggauccccaagaccacaaacccagcucuugguauacagaaggugcucaauaaauguuucuuggacaaauaagugauccuaggaggugggagcuaauauaauccccauuuaacagguaaagaaacaggcucugagaaggugaguucaugaacauuuauucagcaccugcuaugugccaagcacuguuuuccaugcuggugacauagcagugacuauagcagaccaaggucccaucaugggacuggauucagacucagcucuaacugcagagcccaagccuuucauccaacugccucaguauucuuggcuggaucaacauccccagcaacucccugaaauaauaaaaaucagguuagucauuacucccuucugggcugaguugagggaagcaccaggcccugcgucaggcuccuuaaaagcaagauuucccaacagcccuaugaagaacaaaugaggaaacugaggcuccaagaggggacagccucugcccagggucacagagaaggugagugguccaaccuggaaaccaagucugacuccagagccugccccucauccaucagcuggaggguuccgauuuccugggaauuucaacuuccaccucacuuaccuguagaaucaaaaaggacccaggggccaggcgcaguggcucacaccuguaaucccagcacuuuggaaggccuacgcaggcggaucacuuaaggccaggaguucgagaccagccuggccgacauggugaaaccccaucucuacuaaaaauacaaaaauuagcuggguaugguagcgggugccuguagucccagccacucgggaggcugacauaggagaaucgcuugaacccaggaggcagagauugcagugagccgagaucgugccacugcacucuagcuuggcuacagagugagacucugucucaaaaaaaaaagggccaggcgcaguggcucacgccuguaaucccagcacuuuggaaggccuacgcaggcggaucacuuaaggccaggaguucaagaccagccuggccgacauggugaaaccccaucucuacuaaaaauacaaaaauuagcuggguaugguagcgggugccuguagucccagccacucgggaggcugacauaggagaaucgcuugaacccaggaggcagagauugcagugagccgagaucgugccacugcacucuagcuuggcuacagagugagacucugucucaaaaaaaaaaaaaaaaaaaaaagggccaggcgcaguggcucacgccuguaaucccagcacuuugggaggccgagaugggcagaucacaaggucaggagaucgagaccauccuggcuaacacagugaaaccccaucucuacuaaaaauacaaaaaaaaaaaaaauagccgggcaugguggcgagcgccuguagucccagcuaugcaggaggcugaggcaggagaauggcaugaaccuggaaggcugagcuagauugcaccacugcacuacagccugggaaacagaacgagucucaaaaaaaaaaaaaaaaaaaaaaaagggacuaggacucaggccugaagacaugauaaugccaaauggccacaucuguuucauagacauucaucugugccacgcaacaacauaccccaggcuuuacaaacaagaccccaucaaagucuuguauaagccaggcaaacacugaaugagcacuuccuauuccagcccuauuccuauucuaagugcuguugauacucguuuaguacucaugacaacuucaacagguaaauauuucuaugacucucauuguacaaacaaggaagucgaggugaagagaagugcccaaguucacauaaucagcccaagggugccuuaacaagcaauaacugguuuugaacccaggcagucugugcucuuaaccucaaaccugugcugcuucuuagcuacuauuagcuucacuuugaaacaaggaaacugaggcucaaaguggucgaguccaaaggucuccaauuaauaggugggggaguuaauauuuaaaugcagaucuggcagcccaugacccuaaccauuacacuauaccaugacucuauagggccucaguuggggaagcaugaacaaaauuacuuuccugggacguggcggcucacguuuuuaauccuagcacuuugagaggcugaaguggguggccuguuugagcgcaggaguucgagaccagccugggcaacauagcgagacccugucucuacaaaaaauaaaaaaaauuagccagauuugguggugcgugucuguagucccagcuucucaggaggcugaggcgggaggaucacuagagcccgagaguucgaggcugcacugagcuaugaucacaccaccuuacuccagcccgggcgcagagagagacccugucuguaucccaccccucacacacacaaagaugggagcuugagacucauguggacagggugugggcugggccuggaguacugagaacugauggaaaugagguuaagagucugcguuaagggguggaggaaggagcauguagccucuaggcuaggggucuugguguggaaaugaaccaggcuugggggaauaccugugugaaugccccacuugcagaagaggcuacuuuccgagaaaccgcuggccccuaugaucugcccgaucacgugcaccucagccauggcccugggaggggaaaaauauaaucacaacccugugagguaaguguauuaucuccauuugacgggggggaaacugaggcccagcaaguaaaggguaguacuaggauuccaagcuagcuucgucacaccccugaggcugaggucuugaccacagauccuaauugccaacccaugaaagccuggaaaaaauggggggacccuugucuggggaaccagcauuuaacucugggaaguccaaaauaaccuuuucggguucaggucggcggaaagccccgcccgaaggggcuauggcuccgcccacgagcgcaaaagacccgccuuccgcgucacgccagccaccccgcuucccucccccagcaagcuccauaaggcgcaugcguuaugaguucagguccgacuuaaccccgccucuaagcgcagcgcaugcgucauuccuaccuuagcgcacuuaacgguuaggagaggagaaagcggcaaccgggguuguaguucaugggcuugacugcuucuuuucuccgcgggcgccgaccaggccuggcucgcgccucucccaggacccgccuggcugcgagauauguaagccgcgauacuuccgcgaccgcgcucgucuugguuuccgugguuguugcuggggcaacagcaggcuccuccccuagcuuuguacucgcucugcgcgcuacuaauuggugcuagccgucugcggggggcg

SEQ ID NO: 15068 - RNA, 14705 nt, Homo sapiens
ggaacuucggugccugggcgcagcggugcacccggacccggaacauucucaggcgaaagugucucuugcgugcgugggccggagguuagugugcggggcccgccgggcgguugaaaaguccgagagaaucaggauggaggccguggcgacggcgacggcggcgaaggaacccgauaagggugagaucuuggucacgcgcaggcggcgggugggugcgguugcggugucucuaggaaaugauucccccaggaacgcgaaguaggacucguuuuagggggacacccaccccccucagcuuuaccgguccucuucacuacuuugcccagauuauucccucccuugucgcgggcugaccuucuuuuccuccauuccuuccccccgaaauuaaccucuucccaguuccagaccaauccuuuccaugucccuaauucauuuccuuaccaggcuaacucucaaauuaacagaaaccucucuaccccggccuaauuccugcauugccucagaccagcccuucucaaauuaccuccuucccuguaccaagcugagccuucccuugcucucuagacgaauccuccuaccuuuccaggcuaaacuucuaccugccucaugcaaacuuaucccaaucuaacgauuccuucauuucauuguaacucccguuucccccaaaguccgaaauccagccaggcuccuuucaaaguccuuacucaauuucugugcuuucccacaaccuucaaaguaauccgacgucgggugaggugugauuggaagcguggcuccaacaccacuggccaagaauugguaauuguggaagccagauggagaugauugguauauggagguagggggagaauugucguuguacuuucuacuuuuguguauguuugaaauuuucuaaaaauaaaaaauuuaaccuaaaaaaagucuuaaggccgggugcaguggcucccgcuuguaaucccaacacuuugggaggccaaggcaggagaguugcuugagcccaagaguuugagaccagccugggcaagagagagaaaccugaucucuauaaacauuuaaaaauuagccaggccugguggcuagggaguagcuaggacaagcuacucaggagacuaaggugggagugucacucgaauccuuugagauugcagugaccuaagauuauuacaccacugcacuccagccucugcagcagagugagacuugagcccaggaguuugagaccagcacuggcaacauagccagaccccaucucuacaaaaaauuuaaaaauuaaggccgggcccgguggcuuacaccuguaaucgcagcacuuuggaaggcggaggcaggaagaucaccucaggucaggaguuggagaccagccuagccaacauagcgaaaccccaucucuacuaaaaauacaaauauuagccaggcgucgugguaugugccuguaaucccagcuacucgggaggcugaggcaccaacuggaaucacuugaacccgggaggcggagguugcagugagcagagaucgcaccacuguacuccagucuggguaacagagcaaaacucugucucaaaaaaaaaaaaauuagccagguuugauggugcauuccuguggucccggcuacucaggagucugaggcgggaggaucacuugagcccaggaggucaaagcugcagugagcuguguuugcacuauugcauugcagucugagcaacagagcaagacccuguuucaaaaaaaagaaaaaaaauuugucucuuggccccaucugucuccuucagagagucauguauacuuggucuucauuuccucgucuccugcucacgacugucugacuuuucuccuaagaaacugcucugauuagggucugcacugacuucccccauguuguucaauucaguccccccauucagguuuuuguuuguuuguuuguuuuuugagagagucucacucuguugcccaggcuggagugcaguggcaugaucucagcucacugcaaccuccaccucccagguucaagugauucccgugccucagccucccaaguagcugggaucacaggugcccgccacuaugccugucuaauuuuguauauuuuuaguagagaugggguuucaccauguuggccaggcuggccucgaacuucugaccucaagagauccuccugccucagccucccauagugcugggauuacaggugugagccaccacacuuggcccauucagguuuuuuuucuuacuagacuggacuagaauuaaaugcuguugauccuuccauccuuuuugcauguuuuccuuuggcuucagcgacaccacagugccugauuuccugccugucucucaggcugcuccuucucagccugacuuuguuucccaggggugcuguaacaaaguacuacaaacugcauggcuucaaacaacagaacuuuauucucucauaguucucaaggccagaaggcugaagucaguguugcugaacugaaauccaggugucugcagggucgugcuuccccacaggcucugggagaaaacccauuucuugccucuuccagccaguggugguuucuggaauuccuuggcauguggcuacaucacuccaaucucugcuuccccuuuugacguugccuucuuuuuuuuuaagacggagucucgcucuguugaccaggcuggaguacgugaucucgguucacugcaaccucugccuccggaguucaaacaauucuccuaccucagccuccugaguaccugggacuacaggagugcgccaccacaccuggcuaauuuuuuguauuuuugguagagcgccauguuggccaagcuggucuugagcuccugaccugaagugauucucucaccuuggccucccaaagugcugggauuacaggggugagccauugcaaccggccucuuuuuuuuuaagauaacaguaaugggcuccagggauuacgauguagcuaucuuuugcacagccaguuuuuagcuucagaggcauguccuccccgcaucugugcagugcuuuuuccuggacccucuugucaucccucucccacuccccugugcccuccccagucccuaccucucauuucucuuggcuuugguucuugucuugauucugaugacacccacagcucugucuccagcccaacauuucucuccugaggagucuggaggcccguguagcagcagucggaccauuccccuggaugccucccuuacuuccagcacgucagcccuguggcuccuccacucagccuccugacaucuuucugauucgcucacucaugauccuguuccuuccuccacagccccugcccuuguccagcucagucuucagcugcaucagugauuuaaauccucccugauacacacaacacauguaugucaccugugacuucuuuccuccccaacccagccacgcugcuuaaaguugucucuauauucuguuuucacguauuuccugcuugccgcaggcuugcucccuccacucuugggaaacaagucucaccaagguuugcccagcgcuccgcuuuccuguuuucuuuccauuuuuuugagacagagucuucacucugucacccaggcuggagugcaauggcugaucucggcucacugcaaccucugccucauggguucaagcgauucuugugccucugcuuccugaguagcagggauuacaggugcccaccaccaugcccagcugauuuuuguauuuuuaauagagagaggguuucaccauguuggccaggcuggucuugaauuuguggccucaagugaucugcccaccucggccucccaaagugcuggauuacaggcaugagccauggugcccagccagcuuuccuguuuucuuugcccauauuauuguugauccugacugucucccacaucagacugggugcucccugagggcaggagcuggacuggauucauccuauggauccucagcauugccugacuuagggccucucagagauuuaguguuuuuuuuucuuuuuuuuuuuuuagaguuuugcucuuguugcccagacuggagugcaauggcacgaucuuggcucaccgcaaccucugccucccagguucaagcuauucuccugccucagccucccgaguagcugggauuacaggcaugugccacaauggcugauuuuguauuuuuaguagagacgggguuucucccaguuggucaggcuggucuugaaaucccgaccucaggugauccaccugccacagccucccaaagugcugggauuacaggcgcaagccaccgcgcccggccuaagauuuagaguuauuaaagagugguugggugaacgcaugaaugcaugagagagugaaugaaugaguaaacaaauuagcaaauguauuaacgauuuaaagaauugaguggaucaauaagucaggccucagggccuuugcaguaguuguugccucugccuggaauucucuuuuccaagagaccucauggcuuaaucccucaccaccugaggucucuaaucaaaugucacuuuuuuggcaaagccuucucugagccuuccauuuaaaauugcagccuuggccaggcauggugguuuacacuguaaucucagcacuuuggaagccugaggcaggaggaucacuugaggccaggaguucaagaccagccugggcaacacagcaagacccugucucuaccaaaaaaaauuaaaauuaggccggguccaguggugcacgccuguaauuccagcacuuuggaagaucgaggugggaggauugccugagcucaagagauugagaccacccugggcaaccuagugagaccuugucuuuacugaaacuuuuuuuuuuuuuuuuuaauuuaaagauuggcagggugcaggccaggcgcaguggcucacgccuguaaucccagcacuuugggaggccgaggcggguggaucacgaggucaggaguucgagaccagcacagccaagauggugaaacccugucuguacuaaaaauacaaaaauuagccgggcaugguggcagguaccuguaaucccagcugcucgggaggcugaggcagagaauugcuugaaccugaggcggagguugcagugaaucaagauugcuccacugcacuccagccugggcgaaagagcgagacuccgucucaaaaaaaaaaaaaaaaaaaaaaagauuggcagggugcaguggcacacaccuguaaucccagcacuuugggaggccgaaggggaguggaucaccugaggucaggaguuggagaccagccuagccaacauagcgaaacccugucucuacuaaaaauacaaaaauuaaccaggcauuuggcuuguaccuguaaucccagcuaguugggaggcugaggcaccaaccacaauaacuugaacccaggaggcggcaguugcagugggcagaucucacgccauugcacuccagccugggcaacaagagcaaaacuccaucucaaaaaaaaaaaagaaaaaaaaauuuaaagauuaacugaguaugguugugcaugccuguaguccuggcugcucaggaggcugaggugggaggauugcuugagcccaggaguucaggguuacagugaaccaugguugugccauugcacuccagccuggcaauggagcaaggccuuaucucuuaaaaaauaaaaauaaaaauaggccagucacaguggcuuacaccuuuaaugcccagcacuuugggaggccaaggcaggaggauugcuggagcccuggaguucgagaccagccugaguaacaugucaauacccugucucuacaaaaaauuuaaaaauuacacaggcauggugguauaugccugugguccuagcuacacgggaggcugagaugggaggaucgcucaagcccaggcggucaaggcugcagugagcugugauugcgcccugcacuccagccugggugaccgagcaagacccugucucgaaaauaaaauaaaauugcagccuccuccaccucuucccuccuccuucccuguuuauuuuuccgcauaacuccaggaaacaccuaacacauuauguuuucgguaauuauguugcuaauuguuuguguccccuacugaaaugucaacuuuugcucacugugguuucucuagugcccagaacagugcccagaauauagucagugcccaguaaaugugagcugagugagugacuaagcccccagucccuucccacacucccaucucugaacuaaccaaucucuccuuuccucaggcugcauagagccuggaccugggcacuggggugagcugagccggacaccagucccaucuaaaccccaggacaaaguggaagcagcugaggcaacaccaguggcccuggacagugacaccuccggggcugaaaaugcagcagugagugcuaugcugcacgcuguagccgccagccgccugccuguuugcagccagcagcagggugaacccgacuugacagagcaugagaaaguggccauccuggcccagcuguaccacgagaagccacugguguuccuggagcgcuuccgcacaggccuccgugaggagcaucuggccugcuuuggccacgugcguggcgaccaccgugcagacuucuacugugcugagguggcccggcagggcacugcccggccccgcacccugcguacccgccugcguaaccggcgcuaugcugcccugcgagagcugauccaaggugugggggccagaugggcgacagugggcacauauggggagggaggggagacugaggcagagggaauuagagaaaagaauacaagagcagagacagagauccugggagagaaguucugagacagagacagggacacaggaagagacugagacagaaauguaaaguaagggggagagauagacagggguccagggaagagaaugggacagacaaugagaauagaucagaauuuaguagauguuagaaguggcauuucagauugguaggcugaggacacaguacacagugcugugauaauuggucauaccuaaggaacaaaacaugagaucccuaccucauaccauauacagaggcaucaggggaaaccaaaaggaguauguacaugaccuuggggacacagaagccuucugaacaagacacacggugaaaaccaugaaggaaaaaaaagauagcuuuuugaccaugacauaauuaaaagcauccuugugaccacaacaccagaaccaaaguuaaaagaugagagugaaugaagcagagugaguuaaguugccguuagggagaaggcacaaguuauagagagguucacagagaaagagagagaggcugggcaugauggcuuaugccuguaaucccagcacuuugggaggucaagguggguagauuacuugagcucaugaguucaagaccagccugggcaacauggcgaaaugcugucucuacaaaaaauacaaaaauuagcugggugugguggcgcccuagcuacucagaaggcugaggugggagaauugcuugagccugggagguggaaguugugugagcugagaucccaccacuaagcucuagccugggcgauaaagccagaucuugucucaaaaaaaaaaaaaaaaaacacagauguggaaaugaggaugaaaacagaaggaagaugggccgggcacagucacucaagccggugaucccagcacuuugggagggcgagguggggguggaccugaggucaggaguuccagagcagccuggccaacauggugaaaccccaucucuacuaaaaauacaaaaaaauuagccacaugugguggcaggcaacuguaaucucaguuacuugggaggcugagggaggagaauuacaugaaucugggagguggagguugccaaaaaaaaaaaaaaaagaagaaagaugaaugagguggggguaggugacagaaacugaaaaaagcaggaaagauagaaagauggagauaaaggaagagauggagagagauccagagccggggugggugauaauccaaguuggggagaaggagggauagaaacugaaucugcuagaggcugggcacaguggcucagaccuguaaucccagcacuuugggaggccgaggcaggcaaaucacuugagauaaggaguucaagaccagccuggccaacauggugaaaccccggcucuacuaaaaauacaaaaaaaauuagccaggcacuguggcaggugccuauaaucccagcuacucaggaggcugaggcaggagaaucacuugaacccgggaggcggagguugcaguuagaguuaaucgagaucacaccacuacacuccagccugggcaacagagcgagacuccaucucaaaaaacugagucugcuagaggaugccacaaacagcuggggguaagauugcuggcaggaguggggaagcugagcaggacagggacagucacagccuauggugcugcagaggccaggaguccgagcaguuucuuugcccuggacucugaagacacggcuaggaccaguggaggggagggaccagggcagguuuaacuguuauuugagggacagagucacucgugcagaaacaggcagccaggggugaugcagggaacucaaguuuugggguaguggggaagccaggcccaccugagggguugcugcauagaggagcacucgagagaggauggaucuagggccuuccaccaccaggaggcuuucccagggauacacgggcagaugccccaccugaccugaucccuugcacacacaugccaaauccacguggauguacacacauacacgccccacagugaaggcguguccacugccagccagacuagggccccacaaacaggcacacaaccuagagacacacaacuucugcugcauuguccugcaugcugacacccagacagacaggugucugugggcauaugcugggccucacaggacauguguguguacauaggccauguacacguccaugggcaggagcuugugcaucgugccuggacacaguuguacacgagcuccagaccgucagagccucagaggccaggauguagccaggucugcccaugcacacacaugcuuggaugcaugaauacaugaauacacaggaagauagaggccgggccacauacacacacucaggugccugcacgaguaaucacaugcacaugaccucaggugccugcaugagugcuugcgcacacagcuucaggcaccugcaugaguauucacgugcaugccucaggcgccugcauuauucacacgcacgccucaggcgccugcaugaguacucacgcgcaccucaggugccugcauguuuuccuguguuuuugaaugugugcauacacacacuuggacuguguaugcacaucaucccacaagcaugaucacacacauacccacauggacacuaucugcucagucgcucaccccaugcccacccugucucuccucugugcagggggcgaguacuucagugaugagcagaugcgguuccgggccccccugcuauaugagcaguacaucgggcaguaucucacccaggaggagcucagugcccgcaccccaacccaccagccccccaagcccgggucccccgggagaccugcuugcccgcucuccaacuugcugcuccaguccuacgaggagcgggagcuacagcagcgucugcuccaacagcaggaggaggaggaggccugcuuggaggaagaggaagaggaggaggacagugacgaggaaggugagggccaguagcaggaagaccccagauuccagacaccccagcccuaggccugucugucuccacuucauggcagcaggcugggcccccaaccugcaaaagccgacauugcgucccuccccugcccagccugacucucuguguaugcccuuccaaccgcugcagcauccccaucccccacucugaggcaccaaaugaacccucgccuccaggucuggacaggcuguucccuccgccaggaaugccucuccucccacccuucaggucucagauccugacccgaggauacagucuccagagcacuauauggucauguguuuuaugcgugucccuggagggcagggaccagggccaucucugucacuaguguguucccagagccacccagcgcaaggcugggcacaggagcagcagcucucuguggacucugugcucagugccugcccgagugcacccgcauucacacccccucuccucucccucugcagaccagaggucaggcaaggacucggaggccuggguucccgacucggaggagaggcugauccugcgagaggaguucaccagccgcaugcaccagcgcuuccuagauggcaaggacggggacuuugacuacaggugcuccugugccuccaccuccccaucccccagcccagcaucccacggccuuuggucacaugcagagcccuuaacaagcugugggggucucccuuuguggagcuacaaggccccaaaacaguuccaggaugugggguugaacagccaaaggaagaggcugggugaccucggacuagccuuguccaucucagacccucagucuccucaccucuaaggcaggggauggacagggaugacauauagcucaguaucaaugaaacccugaaacacuucccuccuggcaauggcagaggcuacuaccccaagccccccaagucucccuaggaagcccaaccucuuccgcuucaccuuggaccuccucaugcugcaggaaguaaccccuggcaaaguucaugcccggcauggaggggccugcacuggcugcccccacaguuacaguuguucauuucuccaguagcaccccagggcugagacacgugggccaccugcuuuggaaaaggacccaggagagugaugugucagucaaagauugguuuugucauuuaagguagcuuugccuuguggucccaaacacugggcccagcagcagaggacccuccuugguuucacauccagccccgaugacaugugaaaugugugaccacacauaagcggacccuacguccguccugaggugggcucaucaggaaagugggaauugugauugccccugccguggggcccagccauggucaccagagccuccucccauucugggaucccuggcucuugaauggaaucuggcugcuccacuuccagccaggcaggccugcucagagccccaguuccugcacgcaaaguggugagcagagggccuggaccauggggacccucauucagcaggcaucacugcuguucccaagccagggcccaggaggaaauuggggguggcagggaccacaguguguugccucgggagggcagcaguggccccgacgugucccccauccgugcauucaguuggcaugugcugagcaucugugauguccacaggcucuggggauaaggcggggaccaaaaccaacgaaaggcuucccugccugaaaaggggucccacucuagugaggaagaucuagaauuuucuagcacuucauggugauggggccaugaggaaaagugaagcagugggaggggagugacaggguggcuagggaaggccucucugaggggcugacagcaaaggccugcaggaagugggaggagcauuccuggcagaggccauaguaggugccagagcccccagcagcaccaaggggcagaaggggcuggagcagucgcaaggggucgcaaggggguaggagaucucugaguggccaaaucaagcuaggcuuggcaacccaagugcgugcugcuggguuuacuugcugccuuagggcaugggcagcuguccugccuguggucagcucuggcuaaucccggccucuauccacuggagggcaguagcaagcccccagugaugacgucaaaaugucaaaaugccgugggggcaaaauuacccccaagugguucuuuguugagagccacugccugcuugagaauguaagcccaugugucgccacauuuuacagcuuuuuaagaaaaacuagagcuuugggguuuuuuuuagacagggucuccuuugucacccaggcuggaauguggugguuugaucauagcucaccgcagccuugaccuccuggccugaagugagccucccgccucagccaacugaguaagcugggacuacaggugcucaccaccacgccuggcuacuuuuucaauuuuuuuguagagacagggucucccuuuguugcccagggcuccaacugcugggcucaagccaucuuccugccuuggccucccauagugcugggauugcaggcaugagccaccaugcccagcccagaguuuuugugcaaacucugauuuggaaaauguucccuugaguuuuaaacccugagaguuuuaaacacuaucucccuugggagggucagcucugacggcugccagcacauggccuuugacaucagggugccccaggccuuugaccugggcauccgagggucccagggagacccaguccuugacagccuccuccuccugcagcacaguagacgacaaccccgacuucgacaaccucgacaucguggcacgggaugaggaggagagguacuuugaugaggaagaaccugaggaugcgcccagcccagagcuggauggggacugauggccgccacccuucccaccgccugccccauccccauccccaacaaggcagcugauuccaggccugcucagugacccuuucucuagggggacaucagggcagugccccacaacccacacacaccaccaucucacugggucuagucucaucucagacaacccccacccccacuguuucugggguucccuuucucaucucucccacccugucuccugccucugucuuucuuggugucugucugggcuucuuucugucucuuucugucuuucugucucucucccuacccccgcucccucuuuccagugcucuggcuggcugucucucccuuucucccccucucucucugccuuaggcucugucuccaccgcagggcccaaggugaaaguccuccccuugccggaggccagcuggcagggccuuucguggcuggaaguggccaguuugguuccggugcugaccccuaggccccagcgcagcugccucccgugcugucugucucccccucucuguuuaugucugcgcugugucucacacucagagccuccuugcuucuguuagguucccaucucuccuucugccucacucugggccucuucuuucuacuuguacauuuccaccucucuaggccucugcucucacugucccucucugucugucucucagccuuuaucucuggguuuugaucccccacuccaggcucugggccccuucuucccccuucccucaaaccuggcugcuauaggcagcagaacccugaccacugaguaauacagccccaggggagggaggagaccccaggcagggaggaugggggcagcucucuucucuccccaggacccaggcuguggaucacggggccugccagcuugaguguagagggaggggggacucuacccuucucagccccaccagccccccucugcccaaccacaauuuucccuuccuccgccuuccucucccucuccuguuuacacuccccaaaugcgcacaggcuguuaucauggguccugagucaucccacacacagccugccccagcgucccugcccccagcuggccgcagggcccgccccauggagcccccugccgcccugggcuaaugggagccagauggccgccuggugacucagccaccgggccugugggaacccaggcgucccgccuucccaugcccccacacccggcuccugcucccccagcagacacacacaggagggccuggccacuguugagggggcacacagggcaagggucaccaagucggggccuagggacuccucaugccucugagauggaauggugguauccugccguggccaagccugaaggacccucaaaacugccuccuggaguccacgguuccugaccuccgagccucagcuaugcccucugggucaaccagaauuagagccagacagggaaagugagagcuggauggaggcagacaagaugcucagagcgacuauuaaagaacgaaagccucugcuacggagcgcuucuguccucugucaggcccgagcgaagugccugacaccggguuggauccucagauggccccaugaacuagugaagugggucaaaggaggccuggaaagauguugcuuccucaaggccacucggccaucagaggcagaaaugaaacaggaacccaggccuagaaucacaaagguccuagaaaccacuuggcugucuggccucucaggugucagggccauccagagugagacagcauuggagggacaagugugcaugcagauguccucagacgggaagguuugagaagggucagaugguaggcgggccuaacaagggcuccgugcuagccacugucccgcacacagacaggaucaggucaucuugauauggagaucaguccccaaaucacugaauugucccagcagugcuaugcccuagguacuaccaauaucacuccucuauuucccagaggaggaagcagcagcuagacuccaggaccuuggggucauaucucucagaaagccaagagugcaggaugagagcugucugucucuuaccugccuguauuugugccccauuuuuaaagagcagagggccugggccacaggaaagguaucagcccuuggugauaggcacauuuuuuaccagucuaucauuuggucauuaaauuuguuuacaauauacuuugcuau

SEQ ID NO: 15069 - RNA, 43107 nt, Homo sapiens
ucuugaguauuugugucacuugacucuaggucugugucucuuccuauucguggcggguaucugccugagcauguuuguaaauaugcuugugucuguguaauucugugugucuguguuacucuaugcgucugaguuucagucucuguauuugugaccagguccuccuggguguguccauuaauucaugugucuguuaguuugcggcggaacaggugugugugugugugugugugucugugauccuggaucuguaugccaguuccucacuggggguuucugagaaccugcaucucuuugcuuguaugucuuuuugucuaucuguguguucauuucuacccucucuagugaggacagaauuccaagacccuaccaagcccuucuuuuuucugaugggggaacugaauugccagggaauggggccacaucacagcuaaaaggagacaagaggagacagaagcucguugauauacaaaguuuuaugugaccugagccccucuggaggcaccagaguccacacucuguacucagaaggugagggauuggcucacgggggcaacauggcccgaaaggugggagaucguccauccccugcgggaaaggaggcaucccuaaugcauugcacaggcuugaagggggcacacccccacaguuggggaggaggaagcaaugauagcuaagaaggagaggggcaccccaaagaauacuacaguauaggguuagaaccuugaaauugcaccuaauagucuagaccuguggaccuuuagaaucuuagaaacuuagaacauuugagucuuagaacuacagugccuagaacuauaagauuuuagaaauguggauucuuggacucuuaaccaugguccuagagaggcagaaugcagcaaagaaccuaaagguguccaacauuagaaauuauuagaacuuuggugucuaguuagucacaacugagugugagagucuuauaacuuagaugcuuaggauccggaaucuuggaccaauggaaucuagagugccuugaaacagaacagaccguuagaaucuuauuuaaucaucuagaaucuuggagcaucugaucuagaaucuuagacacagagaaucuaagaucuuagaguaagucuuagaauaucacaucuuagaacaccggaccuuagaaacuccaucuuuagacucuuggaacuuuugaauugcagauucuagagcuuucgacccuuaggaucuaggaucuuauacaagagaaucuauuaucauaaagccucagaaacuauaauugaucaucauuagaaucuuagaacuugagaagauaacauuuugaagccuuaugaucuagagccuuacagccagagaaucuagacucucagagccuuagaacaucacauuuuagaauccuaggccuuagaaccuccaugucuagaacuauagaaucuuuagaaucuauaaucuuacauuuuaaggacucugaacucuagaagaauaaacaucuagacucauagagccuuagcuccuaaaaucagaaucuuagaacuuuagaaccuaaaaccuugaggcuuuaucaaaaauguuagaaccagaaaaucuaaaaccacauaaugucagagcuuuagaacaguaggucuuaagguugagugcaguggcucaugccuguaaucucagcacuuugggaggcugaggugggcagaucacuugaggucaggaguuuuagaccagccuggccaacauggugaaacccugucucuacuaaaaauauaaaaauuagccgggugugguggcacacaccuguaaucccagcuacuugggaggccaaggcaggaaaaucacuugaacucgguaggugaagguugcagugaggcgagauugcaccacugcacuccagccugggugacacagugagacucuaucgcaaaaaaaaaaaaaaaaaaaaaaaaaaaaaaaguaggccuuagaaccuuagcacuuuaauagaauuagagacuuuggaauuucagguccuuagaaccaaagacucacagcaucuuugaaaccuagaaccuuugaaucuagacucuuuaaaccuuggacucuagagucuuggaauguuaacaccugggagggcuucagauauugcaauccaaccccuuccuuuuacagauggugaugcuacugcuuucaaggugaugcuacugcacagagaaggggagggaccugucugggauggaggugggauagguaggaagacagggcugcaaguggggauaaggcguggggugggaaagugggaagguggaguuuuccccaguggcagugcuuagcuuggauccugagagggaguaccagguggaggguugucucaggcaccauccuccugcccuggggcugcuggggagccccuaucagcaggcugagcggggcuagggguuguggaagggcagaggacauagcguccagcaggauggaccucagccgcagugaggcagcuacaggaauccuuagggucuggcuggguuggggggucagcuccuccugcagcuccaggggguucaggauaaccuccacccucauccauguugacauagaggauuucgucaggcuccugggcaggaggcaaggccuucaguguguucuccaaaucuucccgcagcucuguaaaacuuggccgguccuggggauuuagcucccagcaccgcgacaucaaggcauaccuagggcagcaaaaugaggggugggagauugagcagggacucagaaggggugcauucuggaagccuggggacauuuuaggacacucaggggacugggggcauuuuagaggguuauagggagccucagcaguuugaggccaucuauggggauuugggaauucccaagaauuucugaguuggguccugggagacucaggagcugggaagggucucgggaaaccugucuguauauggaguaguauucugaugaggguuugcuagaacagaccuuccagcuccccagaacagacuugcaucaaagccuggcuaugccacuuacaagcugugcugguuuaaaauagguccauaaauucuuugacccuccucccugcaaaagacggagaauaaauccucuccucuugagcaugggcaggacuuagugacuugcuucugauuuggcagaagugauggugugugugacuucugagacuaggucauaaaaggcauguggcuuccucgcacuuucuccuggguugccauguugugaguaagcucaagcagugccacaaagggguccacauggcaacgaacugaagccuccugcuacagccaugugaguaagccaccuugaaagcaauccuccagucccaaccuucagaugacugcagcccccagugauaucuuuguaacuucauuagagauccugaaccaaaaucacccugcuaagcuguucccaguauccaacuuucagaaauugugugagauaauaaacguuuguuguuuuaaacuacuugauuuggggauauagauaacaaacacaccagcugugcaaucuuuggcaaauaaaucacccucccagacugggcguggaggcucaugccuauaaucccagcacuuugggaggcugggacggguggaucaugaggucacgauaucaagaccauccuggcuaagguggugaaaccccaucucuacuaaaaauacaaaaaaaauuagcugggcaugguggcacacgccuguagucccagcuacuugggaggcugaggcaagagaaucgcuagaaccugggagguugcagugagccgagauggagccauugugcuccagccugggcgacagagcgagacucaagucaauaaauaaaaauaaauuacccucccuguaggacuggguuuucuuaucugcagaaugggaaucauaaugauaccuaucuacaucacauggcugugguaaggaccaaaugauuugacacaugccaggcaccuaaaacagugccuucuagucaguuauaugaaaauguuagcuguuauuuuuacucgucucagcucuuggaguacccaagguggacugaggagucugacgccccaggcugucuccuccugacccaaagucauccucucuuuacccucaaagugcuagcuaaaugucacggccuucuccgcauacuccaauauugcaaaguuugguaagcauucccugaaggauccugcaaauaucucagaggagaccugagucuggagaaggccaauaaaacaaacugaaggguuuugcagagagucucagguguugaggagcaugucggggaagcauggugugcucaggagucuggaaugagaagucucugggagugcaugucccaaaggcagggccgccagguaagacugugcuguuauucacuacccaaggauaccuggcuuggggguggggagccagggggcugauucagcccacacagacaaaggaggaaagggugccuuuagcugauuugcaccccacugguuagugauggcccuacucagagcauuggugaggggcaagugggucacucagcauucucagggauucugucuggguuauagagaguccuggaccugugagggccaucuggggguagucagggguuuggaaugaauucuggguugggggagaccuaaggguccucacaguccauccagacaguccgcaggcugcuucaggcgauuucccuggcgcagauagucauaaaucucgcuguucuccacgcccggauaugggguuuggccucuuguggcaaucucccacauugucaccccgaaggaccacugugaggggcagagggaauuagacagucucuccugcacagaaucacccgcaccaauacccagguucauggguacacccacacuuauguacacauguucacaaccauccucugggagcaucacaaguauucauagaaacauaauacuuuagccgggugcgguggcugaugccuguaaucccagcacuuugggaggcugaggugggcggacugccugaggucaggaguuugagaccagccuggccaauauagugaaaccccgucucuacuaaaaauacaaaaauuagcuaggcaugguggugggcgccuguaaucccagcuacucgggagacugaggcaggagaauugcuugaacccgggaggcagagucugcagugagcugagaucaugccauugcacugcagccugggugacagugcgagacuccaucucaaaaaaagaaaaauauauauauauaaaaaauacuugacacggguauacacaugaauaaguaacuuuuguggaugcauacacaugcucaccaucacacacauauacacacuucauggacacaugagcucaugugccacucugcacacccuggcuguccacauucuaugagugugcgcacaugcacgcauaaucacugcagcuucuucuaaccuaaacugucuacauugcuaccaugcacacgugggccuguauuuauccugggcauguacacaccacuauucagagaugcccaccauaccccaagacaugcccagcccauguggacaagccccugcaaagggaagcccacaugucccugugacccuugcauccacagccacccaggcauagugugugauggucaggccaugcccucccaugguuccccacucuuggcgggagugcaccuaccacaucgcucuugcugguguagacacggucagcuagacucucaauggcaauccacuugacuggcaucuuggcgauacgucccuggcgguaguaguccccauuguagaucuucuuggagagcccgaaguccgccacacacacggacauguucucauucagccuguuuggauuggggaaaggaacagggucagggcaucagucaccuccaccaggaagccugcccuggcucucagacacaucugcaccuccuccccucacuguccuggcugcggguggggaucugucuccuaaaccuucaucccaguccagaagggaacugcuuuacuucuuguucacucugucaagugaggaugggacaaagggcuuccucaggacuucccaauuuuggcucuuugcuagauucuaagguccuuccuuggguuugauuccuugaugaaauuuuuuuuucuugaaguauacuguacauauggaaaugugcacaagucauaaguaagcagcucacugaauuuucacacacacacacacacacacccauguaaccagcacccagauuaagaaacagaacauggcugggcaugguggcuggcgccuguaaucccagcacucugggaggccaaggcagguggaucacuugaggucaggaguuugagaccagccuggccaauguggugaaacucugucucuacuaaaaguacaaaaauuagccagguguguuggugcacaucugaaaucccagcuaccugggaggcugaagcaagagaaucaguugaacccaguaggcggagguugcagugagcugagaucacgccacugcacuccagccugggcaacagagugagugagacuccgucucaaaaacaaacaaaaaaaaaaacaggcacaguggcucaagccuguaauuucagcaccuugggaggccaaggugggaggaucacuugaggcuaggaguucaagaccagccuggaaaacaaagcaagacccugucucuacaaaaaaauuuaaaaauuagcuggacaugguggcacaugucuguaguuccagcuacuuaggaggcugaggcagaaggauagcuugagccaggaguuggaggcuacagugagcuaugaucaugccacugcaccccacccuaaaggacagaguaagacucugucaaaacaaaaaagaaaagaaagaaaaaaagggaaagaaagggaaagagagagggagggagggaaggaaggaaggaaggagauaaagagagagaaagagaaagaaaagaaagaagaaaggacagagagaaaaagaaagaaaagaaagaaaaagaaagaaagagaaaaaaagaaaagaaaauccacaggacauucauaugauggaauaccauaccacacagcaaagaaaaagagcaaacuaccccuacacagauccaucucaaaaacaucaugcugagccauagaagccagacacaaagcaguacaaacugcaugaucccauuuguaugacuuuucagaacaggcuaaacuagcacugagaagucaggauaguggguaccacuuggcgguagugauugggaagacgaagaggcaugaaggagccugcuggggcuaagaaauauucuuuaccuucaucuagugguuacaugggucuauacccauaaaaauucaucgagcugagcugcauguguauauuuuaguguauguaaaauauacaucaauuuuuuuuuagaugggaucuugcccuguugcccaggcaguagugaagugauaccaucauggcugacuucagccucaaccuccugggcucuagcaauccuuccaccucagccucccaaguagcuggaaccacagguauacaccaccaugcccagcuaauuuauuuuuuguaaagacaggauucacuauguugcccaggcuggucuugaacuccuggguacaagugauccuccugccucagccucccaaagggcugggauuauagaugugagccacugcgccuggccaagacuaauauucuaacucugugguuccauucccuccaccuucuacccuccccuuacccucuauucuggcuuuugggggauuuuuuguucuuucuuuucuuuuuuucuuuuuuuuugagauggugucucguuguuguuacccaggcuggucucgaggcucaagcaauccucucaccuaagccuugggaauggcugggacuacagguuacuauuuucuuuuuucuuucuuucuuucuuucuuucuuuuuuuuuuuuuuuuugagacagagucuugcucugucgcccaggcuggagugcagugaugcgaucucggcucauugcaaccuccgccuccuggguucaagcaauucucguguugggauuacaggcgcacaccaccgcaccaggcugaauuuuguacuuuuaguagacaggggguuucaccaaggcuggucucgaacuccuggccucaagugauccacccgccucggacucccaaagugcugggauuacaggcgugagccacugcaccccaucuggcauauuuucugcuuguccauugguggggaguuugauuuucuuauccaguguggccgcuuccaaagggcagccccaggcaagacacccagcauggagugggacagagaugcagcucacguguccccacccccaucggucaccucagccccuuugcucaccucaugcugugcacugagcccaccuucuggucucuucccucuccgcauccaaaugcuccuuccagaucucaguucaggacucaccuccuccaggaagccuucccagacccccuuacugacuuuccugguccugaguucugaccugcccucagcgggugucuagcccugcuuccauccuaagaaggagggagggaacucccucagggagugcaggagcaguuggggggggggggucccugaaaggcacucacaugcaguuccuggccgccaggucccgguguaugaaucucuugguacucagauacuccaugccacuggcgaugucugccaugaacuucacuagcaucugagugggcagguacuggggagccaaggcaggugggaggagaggucaacagaguccuugaugcgaucccuccucccuccaucccucugugcaagccuagcucugcccgcagugguuucccauggcccugacaauucaacccaaccccucuccauggccugcaagguccuauaaacuugcuccagccuuccucuuggacuugauugccuauguucuugcccuugacugacacucccaccagacuccugucuggucuucagacaaacgaugaucauucccaccuccgagccuuugccuaugcugugcgcucuguuggggucgcuuccugcccagaucuccagacaucuccccagccccaacuccuucacggucaccuccucggcaagaucuuccacguccacccaaauucacugccuggccuccuuaucuuccauccuacuguauuuccuuccuagcacuuaaacauuuaaaucaucucgcuuagguauuuauuagcuuguuuaucauccgccccuccccugcuggaagaaaugcuccaggagagcaagcuccuggucaccguggucuucccagggucugagcagcacuggguaccugauagaugcucaguuaauauuuguagacugaaugauuaaacgccccuuaccacuggcugguccccgagccgggaauagaggaggaagcuguguaggucuccauguuucaugaaagguaagaugaccacaggugcugggaagcucucucguucagaacccuggaaacagacaccugagccccccagguagcccugucacuccugcugggcagaaggggaagccaagccccccaccagccagccuccagccucuccuucucacuacccauccaaucuggccaccauauuguuuggggguaguggcaguggcaaggaccaagcugcagagaagcuguuuccagcagaguucccagggacguuuccggagcccuccuggggaccucagcuauuucugggaaugaucagaggucacauuccaagcugagggagacuaggagggggaagccugcugacccugaaggagcggggagcaggaagccuggaaguuugaucuucccagggccagaagcagggcucuucccucugcuauggcccccauggggcuuguagaccccuugaaucugccccucucucaccgaugagccucaugacguugggauggucaaauuccuucaugcagaccgcuucacucaggaaauccuccagcucugaccucgugcagauggcaacuugagggagagagaaaggucgugaggaggaggggaggagagggaggacucucccuccaccuccacuccaucaucaucaucaucaucaucaucacucaucuucaucaaacaugauuaguaaguaccaggcaccauacucagcacuuuauaugugauauguguaugugugugugucuguguguguguauauaauauauauauauauauaaaauauauauuuucuuuuuuuuuuuuuuuuuagauggagucucacucuguuguccaggcuggagugcagugguuugaucucgggucacugcaaccuccgccucucggguucaagcaauucuccugccucagccuccugaguagcugggacuacaggcgugugccaccacacccggcuaauuuuuuguauuuuuaguagagacgggguuucaccuuguuagccaggaugguuucgaucuccugaccucacgaucugcccgccucggccucccaaagugcuaggauuacaggcgucagccacugcgcuuggccaacuuuauauauauuaacucauuuaaucuucucaggugcuacuauuaucauucccauuuuauugguuuuuuguuuuguuuuguuuuguuuuuguuuuuguuuuuuauuuuuauuuuuugagacagggucuugcgcugucacccaggauggaugcaaucacagcaaacauagcucacuggagguuaggcucgaacuccuaggcuugccuuccugaguagcugggaccacaggcacgcaccaccaucccggauaauuuuuuuuuuuuuuuugagauggaguuucgcccuugucccccaggcuugagugcaauggcgcaaucuuggcucacugcaaccucugccuccccaguucaagagauucucguaccucagccucccgaguagcugggauuacaggcaugcaccaccaugcccagcuaauuuuuguauuuuuaguagaaacgggguuucaccauguuggccaggcuggucucaaacuccccaccucaagugaucugccugccuuggccucccaaagugcuaggauuucaagugugagccaccaugcccagccaauuuuuugagagggagucuugcuauguuguccaggcuggucucaaacucccagccucaagugauccucccaccucggccucccaaagcacugggauuacaggcaugagccacugucccuggccuaucucuauuuuaaagaugaagaaagcaaggcacaaaaagguuaggagucugccuaagggaacacacagcuuggagguggaagaggcagaucucaaacccgggcagucuggcuccaggguccaccugcucacaacugcccaggcugcuucccagcacuucccuaccugcccuggggacccaaacaaguaucaucccauuuaacaguucaggacacuguggcucacagaggcaaaaugacuugcccaagguugcacggcugagauucagacccaggccaagacuauaaccagugggaggcugaguggggaggaucgcuugagccucagagguugagacuacagugagcugugauccugccacugcucuccagcaugggcaacgagcaagacucugucucaaaaaacaaaaaacguaggcugggugugguggcucacaccuguaaucccagcacuuugggaugccgaggcagguggaucaugaggucaagagauagagaccauccuggccaacauggugaaaccccgucucuacuaaaaacacaaaaauuagcugggcgugguggcgcacaccuguagucccaguuacucaggaggcugaggcagaagaaucgcuugaaccugggaggcagagguaguaguuagcugaggucaugccacugcacuccagccuggacagcagagugagacuccuccucaaaacaaaacaaaacagagcaaaacaaacaaaauaaccugguacacaggaggugcuccauaaugaacgaaugaguggguaaugacuucauagcccaagcuuuuaagcccuguaauucagaaaggaucauucucuauucaccaccagccccaaucugaaugcccuaugcuucuccuucccugugugugaagaacuuagcccuggacuuccugugcuguguaacccugaaauggcuccugcccucucugauaauggaaauaauauaguccuacuccacauuaacaagcauguccuacuugccacccucagcaugaagugcuuugccucaaaacagcuuuggaagguggggacauuaggguccuuuuuuccagaugacaggugggaggcucagagagggaaagucauuugccugagaucgcauagcugguaaaugauucagccagguaugccucauucuagagcuucuccugcuccacuauguaucacagugggccggccccugaaaacuacauuucccaggcucccuuuccuagugguuuccucuugggauuugccaaugggagguaggcccuuaugggagacuggcagguagcggggagaaagggagaagccaggguauuucacccucucucugcuucugguauucccuugguggugguugugucgcccaugugugcguguguguguuuuaauuuuuuuuuuuuuucagacggagucuugcucugucgcccaggcuggagggcaguggcacgaucucggcucacugcaaucuccgccugugagguucaagcgauucuccugccucagccucccgaguagcugggauuacaggugccugccaccacgccuggcuaauuuuuguauuuuuaguagaggugggguuucgcuaugcagaucaggccagucucgaacuccugaccucaugugauccacccgccuuggccucccaaagugcugggauuacagacgugagccaccacgcccagccauguguguuuuauuuuuuuaagacaaagucucacucugucacccagauuggagugcaguggcaugaucauagcugacugcaaccucugccgcacagacucaagugauucucccaccucagugucccaaguagcugggacuacaggcgugugccaccaugcccagcuaauuuuuuguuacuauuauuauuuuuuuuuucauagacaugugguuucaccauauugccuaggcuggucucaaacuccuggacucaagcgaucugcugccucggccucccaaagugcuauucuggguuuuuagcucccacagagcagccucuaacucugugauaccagcuccugccuggugucccuagcuguggauucugguaacaccacuugcucccucuacccuucaggccuagcgggggaagugacuuccugcugcugcucaucucugguuucccucccugcccccaguuguuccuucaacccgucucccaccuuuguacuaaucuccccauauucaauuccuucuauugagguaccuggcaggggcuccauugccuaucuggaaacaccagaaguucuaagcuauggcuaacuugcuugcucucuucugucucaggggcauagggaaggagcuggggguccuacacaugugcacguaacucacucuucaucgucuucacagccaccuugaggauggagucguccugguugagcuggccuuccaucacagcuccaaacucuccuguggggggccagagggagacacugaccucagagggcccguggggacuguauuuccuauaguugggugggaguguggaagugcaggaucucagaaguucagaaggauguguguaugcugccgggggacucacccucucccagagucuuccccagggccaccuugugccgguccaccaucacaucccgcagcuucuccuucagcucuucacugaugcccaggcuguucacugcaugcaagguugggguggacagagucauggagcagggcugacauucaggugacauucacccaccaguagggauagauccauuguugaaacacugacauacuucugcacugauuuaaaauuagcaacugcccugagcaccccucuacuuccaccccagcuccuccucuggacccccugaaccuucccucaaagggaacucaagggguaaagccuggccacgcucuugcuccagugggcacccugaugggucagugcccugcuguaccaguuguuaaaaauauuucuuuugcugggcacaguggcuuacgccuguaaucccagcacucugggaggcagaggcagguggaucacuugaguccaggaguucaagaccagccugggcaacauggcgaaucucugucucuacaaaaaaauacaaaaauuagccgugugugguggcacaugccuguagucccagcuacuggggaggcugaggcaggaaaaucacuugaacccaagagacagagguugcaaugagcugagaucgcaccacuucacuccagccugggugacagggcaagacuccgucucaaaaauaaaauaaaauaaaauaaaauaaaauaaaauaaaauaaaaauauuucuuuuugcuggaugcaguggcucaugccuguaaucgcagcacuuugggaggcagaggccgguggaucacuugaguccaggaauucaaaaccagccugggcaacauggcgaauccccgucucuacaaaaaaauacaaaagcuagccauguguggugguacgcgccuauagucccagcuacucaggaggcugagguuggaggaucacuugagcccagggguggaggcugcaguaagcugagcucaugccacugcaccccagccugggugacagagcaagaccccaucucaaacaaaacacacacacaaaaauauuucuuuuuauugaaguauaaucugcacaaaucauaaguaagcaacucaguggauuuucuuuucuuuuuuuuuuugagauggaguuucguuccuguugcccaggcuggagugcgauggcgcaaucucggcucaccgcaaccuccgccucucagguucaagcgauucuccugccucagccucccaaguacaggcaugugccacuacgcccagcuaauuuuguauuuuuaguagagacgggguuucuccauguuggucaggcuggucuggaacucccgaccucaggugaucugcccaccuuggccucccaaaguguugggauuacaagcgugagccaccacgccuggccaacucaguggauuuucacaaaucaaacacaaauguguaacuagcacucaggccaagaacagaacaugaccugcccuccugggguagccacuuucuugauuucuguuacaaucgauuaguuuugaaauauuauaaaaauggaaucacauaguauauucucuuuugugucuggcuucuuucacucaacaugaugucuaugaaauaguuuuaauuuaguuguugaguguaauuguaauuuauccauuuucuuuguuauauaaucauucucaaacaaauugacaucaggacaccuuuacauuguuagaauuauugaggacuagaaagagcuuuuguuuauguuacauauauaucaauauuucuguauucaaaaauaaaacuagcugggcacagugguucacagugguucacccagcaacuugggaggccaaggaaggaggaccaguugaggccuggaguuggagaucagccugggcaacauagccagaccccaucucuaaaaaaauaaaaaaauuuuuuuugaaaccgagucucgcucuguugccuaggcuagagugcaguagcauaaucucagcucacugcaacuuccgccucccagguucaagugauuccccugccucacccuccugagcagcuggaauuauagguguacaccaccacaccuggcaaauuuuuguguuucuuuuuuuuuuuuuaaauagagaugggguuuugccauguugcccacacugguuucaaacuccuggccucaaaagaaaaccuaucagguuuauuuaauuuuuuuuuuuuuugagacagucucacucuguugcccaggcugaaguccagugguacaaccucagcuugcugcaacauccgccucccggguucaagcgauucucuuuccucagccucccaaguagcuaggauuacaggcaugcaccaccacacccagcuaauuuuuguauuuuaguagaaaugggguuucaccauguuggucaggcuggucucaaacuccugaccucaagcaauuugcccaccuuggccucccaaaguggugggauuacaggcaugugccacuaugcccagccugauaaauuuuuaaaacaagaauauacaagcacaagguccaucagcugucagaguguuggaugacaucaucccacgucagggagccucuggaaaacugcgcugaaugcuaaugagagaaugagaaagcaaaagggcaaauaaugucuugguaauaguaugaaaauagauuugaccuuaugggcccccugcaaaggucucagggaccacaggggaccaggcucacacccugagaauggaugcuguauguuacucaguuaaaucacugggacaucguugcuucuuccuucucuucuuaaauaaaugucuuucccagcccuuuccaaacaucccccuggggcccuggcggcuuucucgcuguaugcuaggaagagaccuagcucuuccauuuucuuucuggauuucaguuucccuaacuggaaagaugagauuccuuuuuuuuuuuuuuuuuuuugagacggugucuugcucuaucacccaggcugaagugcaguggcacgaucucggcucacugcaaccuccgccucccagguucaagagauucuccugccucagccucccaaguagcugggauuacagauuacaucuggcuaauuuuuguauuuuuaguagagacagggucucgccauguuggccaggcuggucucgaacuccugaccucaagugucugcccgccugggccucccaaaguguugagauuacaggcgugagccacugcacccagccgaaagaacagauuugacugggccucugagauccccuccucggcugagaccuugcauggcuuuccagccuucuaauggagagucuauaguucuaagauuuuaugauuucaaaaguauaaggguguagaguacaugcauauaauuuuucaggccaagaucgauucuaucucucuaccaauuuauaauuccaagagguaguagaguguggcaguucagaguauagacuucaggccaggcgugguggcucacaccuguaaucccagcacuuugggaggcacggguucaggaggucgagaccagccuggccaauauggugaaaccuugucucuauuaaaacuacaaaaauuagccaggcguuguggcaugugccuguagucccagcuacuugagaggcugaagcaggagagucgcuugaauccaggaggcggagguugcagugagccaagaucaagccacugcacuccauccugggugacagagcaagauucuaucaaaaaaaaaaaaaaaauaguauagacuucagagcaaaaguaccuggguucaaaucccagcuauccaauuuacaagcuguguggccuugggcaagugacuuaaccacucuaugccacagcuuccucaucugugaagugaaggugauaagaaacccaccucuggcugggcgugguggcucacgccuguuaucccagcacuuugggaggccaaggcagguugaucacuugaggccaggaguuccaagaccagccuggcuaacaaagacaggguuaguaaaaccccaucuuuacuaaaaaugcaaaaauuagccagauguggugccaugcacuuguaaucccagcuauucgggaggccgaggcauaagaaucacuugaaccugggaggugaagguugcagugagcugagauugugccacugugcuccagccugggcaacagagcgagacucugucucaaaaaaaaaaagaaaaaaaaagaaaaaagaaacccguguccuuggguugcucugaggguuaaacgaggagauacauguagaaugcuuagaacagagccugccacauagguagugcuaggguugccugugauuuuuaucacaucaucaccaucuaaucucaacauuauuucaucaucaucaucauuuucuucuugucauuaucuucaucauuaucaucaucauuacaucuucuaagauccaauggcucugagguuugguguuucuuuucuuucuuuuauuuuuuuuucuuuuuugagacagggucuugcucugucacccaggcuggagugcaguggugugaucacggcuuacugcagccuugaccucccugggcucaggugauccuccuaccucagccucccgaguagcagggaguacaggggcacaccaccauaccuggcuaauuuuuuuuuuuuguagagacaggguuucaccaugcugcccaggcuguucucgaacuccugggcucaagugauccucccaccucggccccccgaagcgcuaggauuacaggcaugagccaccacacccagccuugguguuucuaagauuuacugugucuaagauucuauuccuugaaaguucuuugugguuccacaaaucuguuauuucuagggucugugguucugacauucuaguaucccaaggccuuuagaaacuuuuggcucacacauguacagaagcccagcaggccagauucucuacagccuuuagauccaggccagggcaguggggcauaggguucacuuacagguagcuucagugguccgacgacuguaggacuugcgcacgcgguaccugacuaccaguucaccucuuuccacuguugguucaaacacuucucugggggggagggggaguaggugagggcagggaaaaaccauguggaacccccuacucaaccagcaguugagcaagcaccaucucagccucaagcccugccugcccucugugcuaacauuugcugagcaugccuugggcagcuaccuucugccuuccauucauuccacacacccccuugcccucauucuuuuuuuugaaaacaggaucucacucugucacccaggcuggagugcagugaugcgaucucagcucacuguagccuccaucucccggguucaagugauuaucgugccucagccucccaaguagcugggaccacaggcgugugccuacacuucccgcuaauuuuugcauuuuucaguagagacaggguuucgccauguuggccaggcuggucucaaacuccugaccucaagugauccaccugcuucagccucccaaagugcugggauuacaggcgugagccaccacgccuggcuucccuugcccucauucugauucuuagucaucacuccuccugcaccagccuccucacuggccucccugccuccagccucuccaucccaggccacacagccuccccaugugguuccaacucacccauaacgggucuccuucuuucgccgguggacaaggaagagagccaagaugaggacacaggcagcggccacgacugcuccuagcaguacauaccaccagggccacgagaaggcaggaguugaagguuccuucacuaucaggggguaugaggaacaggucauggaugaagccuuggauccagcucucugggacccaaaggggugaugugggagggaggcagaaggccucggcaaagaugugcacauacuugaugaggugugugauggaugcauucacauaucugaaugggcugggcuggacagggcaugcaauggaugugauacaagugcagguuaaagcagaagugugugaaaguuguaggaugggugaguuaagagugggauggaggccaggugugguggcucaugccuguuaucccagcacuuugggaggccaaggcggguggguuacuugaggcaaggaguucaagaccagcccggccgacaugaugaaacccugucucuacuuaaacaaaauauauacaaaaauuagcuggggugguggugcacaccugcaaucccagcuacucgggagcugaggcaggagaauugcuugaaccugggagguggagguuucagugagccgagacugggccacugcacuccauccugggugacagagcaagacuccaucucaaaaaaaaaaaaaaaaaaaaaaaaaagagagugccaggauaguucaggugguagagcaucagacuuuuaaccugaggguucaggguucaagucucuguuugggcguuugcaguuuuccuuacuuuaagcuaccaaauauuaugccaccaagauccaaaaaaacagaagaguggaauggauauuugaggagugugcagugaguguggaaugggagggagagauguguggaacgcguuaugagugugccaagagggcuagaugaacaugagauggguguggagaaaucucaagcagcauagguuagugugagaaaugugaugauugugcaagaaggguggacuagaguguagauaagcaggugaguggggaagaagauccuugcaguguaggauggugcaugaagcgugugcaaggagggcggacuaaggaacaucuuuugaagagaaugcaaugacuacaaaaggguuuucuuugucucuuuuuuuguuuguuuguuuuuugagacagggucucacucuuucacccaggcuggagugcaguggcccggucucagcucauugcaaccucugccucccaguuucaagcaaaucuccugccucagcuucuaaguagcugggauuacaggugugcaccaccaugcccagcuaauuuuuguauucuuuuuuugguagagacaggguuucaccaugucuccugaguagcugggacugcaggucugugccaccuggcuaauuuuuuuuucuuuucuuuuucuuuucuuucuuuuuuucuuucuuucuuucuuuuuuuuuuuuuuuugagacagagucuugcuguguugcccaggcuggaguauaguggcaugaucuuggcucacuguaaccuccgccucccagguucaagcaauucuugugccucagccucccgagcagcugggauuacaggcucgcaccaccaggcccagcuaauuuuuguauuuuuaguagagauggguuuucgccaauguuggccaggcuggucuugaacuccugaccucaggugauccaccugucucaggccucccaaaguacugggauuacaggcgugagccauugcacccggccacaaugguuuccauaaagccaggaaugagggugaaauaaauauccaaaggggcaugguaagcauauacaggguuggauggcugcuggaaaaguugggggugugugaagugggaagaguauucgugaagucuuagauacaaggagugagcaaggaauuuuaaggauguaauugcagugugagagaagugugcagugagcaugcaaaagauguuagaagggcagaugagaaguauggggugcacagaaaggggguguaaaaagggcagggguggaauggaguguguaagaaauaaagaucauuaugugcugaguaugcaagggguucagggugagugugcagagugagauggguugggauuagugaagggugagggaaugaugucuauggagugugcaguaagcaugcaaggagaaucaggugugggaaaguuguggacaauguuuuucaguguuugcaauguggaagguaugguaagugcauacaaggugugcagaguuugugaaugagaaguguguugugcaaugggccuuuggggucaugugggaggaacggauuauaaugggauauaugugaaaggaggguggaauaagcguggaaagcguaugugaagaaauguaggaagggaugugaggaguauugaaggcuaguggguugaguuacaagagugaaccauaauagugcccagaggggacaauggguguaggaggaauguuugagaauuguuagagaaauauuugagagggauggaugugaggaggauaccucauucauccauccauccaccuuucuacccauccauucauccacucacaaauccauccaucuguccauccauccauuuauccaaccauccauucauccauccauccauccauccauccacccaucuacccauccauauauccacucaccacccagucaucuuuuguucauccaccuauccacccaucuauuaauccauugacccacccacccauccacccuccauauauccaaccauccauccauccacccuccauauauccacccacccauccauccacccauccaucuacccauccauuuauccacucaccauccagucauuuaucuguucacccaccuauccacccucuauucauccauuggcccacacacccauccauucuccauauauccacccauccauccauccacccauccaucuacccauccauuuauccacucgacauccagucauuuaucuguucacccgccuauccauccucuauucauccauugacccacccacccauccacccuccauauaucuauccauccauccauccaucuauuuguucauccauccacccacucaucugucauugccugaauaccuacaaugugcuaugcuaggccauuauaggcaccuccaucaaggaccacacaaacucaagaaguagguuagagugaugaguuagagaaacaugaaagggaugugcaaugaguaugcauggugacagugcccccacuagguguugaggguagggaaggaggagaugggguguggaagcccuuacccagcugguggacuggcugugcuugcccugugagaagaaaggacagagaggagaugugcucagagaggacaagacuggcguggcacggguaagggaguaaggguguggcacggguaagggagugaggguguggcacgaguaagggagugaagguuuggcacggguaagggagugaggguguggcacggguaagggagugaggguguggcacggguaaaggagugaggccguggcacagguaagggagugagggguuggcauggguaagggagugagggcagcucucaguaaggcucaggguaggaacagggccuaaguugcgguaacacugaaagguacaaggaguaagucagggcugucagggagagacaggguugaagcagguugggcauggcuuuggacuuaccugggcgccaggccuccagggguacugggaggcuccaggguccauccccagcagcaguguaggcugccacacacacugucagauuggacacagacccgucccccugcagcuccagggucaccucuugccuuagcccuauguccauuagcaccuaggagguccagaaguggcaucaggguagaaccuuaccccccagcuguuaagccuucacucucgggcucaaugccccaucucuuucucaaaacgcucuccccauccuccaacuccucauccuuccucguccuccccuucaucucucauccucauccuuuaaccuguaucccuccauccccuucuagcuucccuuuccauccucccucccuaugucaggguauugcuagcccugauaggagugccuuugugaaaaucaggaaaagguaccccuuccccaaggugcuauauaacuaucugcuguaaaaucguuauauaguaaauaugagucugcugaaaugcuuuugcagugguucaaaaacagccauuccccaugcccucccuuagacccccuuauucuccccagaaugugaaugugaaccuucccugaaugugcccccuaggcauagagcaauuguguacuacccaaccuucacaaccaucuaugucugcccugauauguucuccucccuccuccccaagccacuccacuccaaucccaccagcagcacccaccucugggguguccuggccuugauacgccagccgguacccuaacaggguacccugcaggggcgcccggggcucuugccaaugcacgaaggccuggcucccauuccgcguagcacuaauguucucaggggggcccaggggcacuggaggacagggaagaggggaagcuggcacccccaccucuuccugacccccuccccuguucccaggaagugggugcagggugccaagggcacacacgugggcaacucgugcaggccucccaugagaggaagcacaggggagagaagggcugggagagaggccagcgggcagugcugcugaggggucagagauuggaugggaaggagauugaggccaugagggguaaaggagugaaaggggacaauggggguggcacugauauaagcaagguccgguggggcaguggugacgugucccuccccaacccuucuuaccucccuccggcgucuccacaggaagccaguggguccaggaugaggggcccuggcugcuggugcaugccacgcggaugugauaaggggugugaggauggaggcugccuagccgaagcugaugggggggcacggaugcuugcgaggugaggggcuccucuggggggucugguucucccgccuggaugcccaucccaucguuugacagcacagccugaggagaggcaagggugugaggacgggacagccaagcaaucacacgagauggucacacagcucccaguggugguggucuggugugacuacacaacuuuucaagggugcguguguguugcagugccaugcuaggauaacacgggcaccuggauuugcaaagcaaggagaucauuuggcuguauacaaugugguucugucaccacuuccaaaagccaccucuggcaagacucuucccucucugagccucaguuuuuuccuugggcacacggggccuuagaggaucaagugccuuacaggauuguuuaaagauuaaguguaguuaugcccaaaggaugccacagugcauggcggguggucagcaccgauaauaauagugugaugacaauaauaacgcaaauagacugggcacgguggcucccgccuguaaucccagcacuuugggaggccaaggugggcgaucacuugagguuaggaguucaagaccagccuggccaacguggugaaaccccaucucuuccaaaaauguaaaaaauuagcuggaugugguggcgcucgccuguaaucccagcuacucgggaggcugcgauaggagaaccacuugaaccugggaggcagagguuacagugagcuaagaucacaccacugcacuccagccuggguaacagagcaagacucugucucaaauaauaguaaugaucaucauaauaauagcacgauacugugaggccccauuuauaugacauuauacuacaggcaaaagcaauguucuagaagcagaaggguggccaucucuggggccugagggagacuucuuggggacuggaagggucugugucuugauuuggauggugguuacauggugaauauguguguuaaacaaucucaaagguguccaaucuuuugacuuucuuggaccacaguggaagaagaauugucuugggccacacauaaaauacgcuaacacuaacgauagcugaugcguuaaaaaaaaaaaucacaaacaaaucucauaauguuuuaagaaaguuuacgaacuuauguugggccgcauucaaagccauccugggccacauguguuagacgagcuugaucuagagguacacugaagauuaugcauguuauacaucucauuucuuuuucuuuuuuuuuuuuuuuccuuuuuuuggagagggagucuugcucugucgcccaggcuauagugcaguggugagaucuuggcucacugcaaccuccgucuccuagguucaagcaauucuucugccucagccucccaaguagcugggacuacgcguaccaccacgcccgacuaauugccguauuuucaguagagacagcguuucaccauguuagucaggcuggucucaaacucuugaccucaggcaauccgcccgccucagccucucaaagugcugggauuacaggugugagccaccgugcccggccuaugagucucauuucaucaccugagcuggagugcaguggcgugauuucggcucacugcaaucuccgccucccagguucaggcaauucucaugccucggccucccaaguagaugggauuacaggcgugagcaaccaugcuugacuaauuuuuuuuuuuuuuuuuuuuuagacagagucuugcucugucacucagguuggagugcagugguacaaucucggcucacugcaaccuccgccuccugggcucaaguaauucuucugcuucagccucucgaguagcuggggcuacagucaugugccaccaugccuggcuaacuuuuuuguauuuuuaguagagacgagguuucaucauguuggucaggcuggucuugaacuccugaucucaagugauccgccccccucggccucccaaagugcugggauuacaggugugagcuaccacacccggcuuuuuuuuuauucuguguagagaaaggguuucaccauguugcccaggcuggucucaaacuccugaccucagguaauccaccugccucggccucccaaagugcugggauuacaggcgugagccaccucaccugacuauguuauauauuaucuuaauaaaaaaagauaaaacacguccaacauguacugagugccuuucuuagcccuugacaaaucugaauucauuuggcccucacaucaauccuguuguccugugguaagcauuaugcuuauucccacuguacagaugacaacacugaggcccagagagacggaaucacuuguucaaggucaucaguuugucacugaugaagcugggaccuaaaccccauccuguccccagagucuuugcucuacuggcgguaagaauaucaguaaugguaacaauaccucuugucugugcacagaggcaguuuagccuagugcugaggagcacggaugcuggaucuggggcucaaauccaggcucuaucauucccuagcugugugccucagucuucucaccuguaaaaugggaugacaguggcuccccacuucacaggguugacugaauuggggcauguaagcauuuagaagacugcuugugcauacugucauuuauuaucuaucuaucuaucuaucuaucuaucuaucuaucuaucuauuuauuuauuuauuuauuugagauggaguuucgcucuuguugcccaggcuggaguacaauggcaugaucucggcucacugcaaccuccgccucccagguucaagugauucucuugccucaaccuccugaguagcuaggauuacaggcaugcaccaccacacccggcuaauucuguauuuuuaguagagacaggguuacuccauguuggucaggcuggucucaaacucccuaccucaggugaucugcccgcucagccucccaaagugcugggaucacaggcacgagccaccgugcccggccugucacuuauuauuuuauguguguuuccuggcaacaagugucaagcucugcauagcggcacagguucccauaccuauuccacccgaggaauggcacacucagaguggagggggccaccacugguguacacaucuguauagcccugccacauggaaccacaaaacccccauaaccacacaauucacagccacgccucaggaauggugcagccaagggcuuccccuucacccuggagacuccagccauacagccacacaguaugucaggaaggaguuuacugccacagggugugggcucuaaagccagauuccuuggaucuaaguccuguguuggauguuguuugcugugugaccuagagugagugucuuaacuucucugagucucaguuucugucucuggaaaaugggcaucacaguucuuacuugucaggguauaagguuuaaugacaugaugcauauaaacugcuuugcacauuauaauuaucaacagcuaacguuuguuuucuuucuuucuuucuuuuucuuuuuucuuuuuuuuaggcagggucucacucugucacacaagcuggagugcagugguguaaugacagccccaccuaauuuuuuaauuauuuggagagauggcguuucaccauguuggccaggcaggucucaaacuccugggcucaagcgauccaccugccucggccucccaaaggucuaguauuacaggugugagccauggcacccggccuagcaaauauuucuugagugccaaauauguaccaagcucucugucaagcacauuacuggaugaacucauugacuucgcacuaccacccuauggggucaauuucuuuucucauccccauuuuacagacagggaagccaaggcccagagagguucagcaacuugcccaaagucacacagcccccauggagggagaugacaccaccaugagaccuggggaggagugggggcagaugguggguacgaggagggggugaggcugucaccaugccugcucucugaccugcagugacagacaggaagaggaaccucuaccaggacagagaggagauggguacagacaguuggucuccccaugccugcucccacuucucuuuucccugggacggcugugacccucccacuggaacucuucagcccuagcccaugugcagcaggaagugagaccuggaaagggaagaggacacacuucugcuuuccuggggacacuuggugauguggguagagugcaacuuaugccugaccuggcauuugaggucucccaaauccagcuggccucugggauugaaucucagcuucggcuuucuagccccggggaggggaggaggaugggaggaacugaggcccagagagggggccccucucugggccucaguuccucaccuugaaaacgggaagauuaauagccacuguuuuuuguuuuuuuuuuucucagacagagucuuacucugucacccaagcuggagagcagagguucaauccugccucacuguagccuugacugccaggcucaggugauugucccacuucagccucccgaguaucugggacuacaggugugugccaccacacugagcuaauuuuuuugaauuuuuuguacagaccugccucagccccccgaagugcugggauuacaggcgugagcuaucaugcccagccaauagccacuauuuucuagguuuaaaacgacaagcagaugggguugugcucagagcauguaaguauaagacaauuccuguuuaaucaagcacugacucuaaacauuuucucagggcccagcgcggugccucacgccuguaaucccagcacuuugggaggccgaggugggcgggucacuugaggucaagaguucgagaccagccugaccaacauggugaaacccugucucuacuaaaaauacaaaaauuagcugggcgugguggugggcgccuguaauaccagcuacucaggaggcugaggcaagagaauugcuugaaccuaggaggcggagguugcaauaagccgugaucacgccacagcacuccagucuggguaacagagcgagacucugucucaaaaaaaaaagaaaagaaaaaacaaaaaacaguuucuaaggagguuaggagcaugacauggguuugaugugaccuuggacaaucugguuaaccacucugagccuuaguuucuucaucuggaaaauggguguauccauagacccuccuucacaaacacacgagcaggugugcguuaaugcaagacccggugcacagcggacacucaguagaaauuggucauucuucauuacugucaucuaccaucauaggcacuguccaccccccaucuccaacuuucuaaucucagagaacuucagaccagaauuaggccuuauauuuacagaucugugaguuuuguuuugguuuugguuuucuucuuucuuucuuucuuuuuuuuuuuuucuugagacggaaguucgcucguguuacccaagcuggagugcaauggcacgaucucggcucacugcaaccucugccuccaggguucaagggauucuccugccucagccuccugaguagcugggauuacaggugugugccaccacacccggcuaauuuuuuguauuuuuaguagaaaugggguuucaccauguuagccaggcuggucucgaacuccugaccucaggugauccaccagccuuggccucccaaagugcugggguuacagguguaagccaccacaccuggccugguuuugguuuucuuauucuaggagcaacuugagggcagaggcugggucuagcucaucuggguuguaauauauccuucuagcgaauauucccuacucuaugucugguccugugcugggcaagaaugaggagccaguggugacugggacagcuccagcccugcccugucagagcucacauuccaguaggggacagacccauccccagacagugaccacacagaguggccagggcugggaugggagaaguggaggguucuggguauccaguggugacagaaauggcuccagacucugcugucucagggcucccacucuggcuagaguuaacaucacuaauacugaaaauaauuaaaacagcugaucauuuucauuuuguuaaauuuuuuuuguuguuguuucuuuuuuuuuuuugagacagagucucgcucugucacccaggcuggagagcaguggcacgaucuuggcucacugcaaccuccgccucccagguucaagcaauucuccugccucagccuccccaguagcugggacuacaagugcgucccaccaggcccaguuaauuuuuguauuuuuaguagaaaugugguuucacuauguuggccaggcuggucucgaacuccugaccucaagugauccgcccaccucggccucccaaagugcugggauuacaggugugagccaccgcgccuggccaauuuuguuaaauuuguuuccuauguucuauauaccauuuuaaguugguaauuugcauucacucauugaauuuucacacuaagcauaccagguaggcacuaccauuauguccauuuuguagacaagagagcugagccccggacagauuaagccaccuacccaaggucacacagccagaaggugguggagcuaggauucgaacccaggacaucuggcuuaaccccccaggcucuacugcuucucaacaguggccgagaagugguggguucccagggagaggauggggguuguggauguggguggaaggaggccugagacugaaaugaaccaaguuugggagucucaccugcagggugcagugggucaggggguagaugccgcucaggccuggaguccaagccaccuccagcuccguggguuggcgggagaccagguggagguuacggggcugcugggggagcacuguggacaaacgggagagauugacccuggggagccuuugcucaaagcucccuacccugcucucugcccccacucugaccccggacccaaaccccacccucugacgcccagcuccccaccucccaacucugucaccugugaugguggcugugcgggauguggugacccccuuggcguuaugggcuucgcaggagaaagaggaugucuuguucagcccuagggagucauaugagggaaggguccaauaucagagaggggcaggaagggcuccggggccaugccgggccacuccuaccauggccugccugaccaggggcagugcagcccacacaggcacuugccugaagggaggguuagcagaguugagggcaaugaguuaggaacacagccuccauccccaaacacaaggauggcuugguuucagcccuaaccucccgccacacagacacacauaguacagacacacacagacacacacaggcacaggcacaggcacacacacugucucacacacacauucuuacaccccagagacagacacacucauacacacacauagacacacauacucacacagaaacacacaaagacacacacagccacacacaggcacaggcacacacacucauacacacagacacacagacacagacacacacaaagacacacagccacacacaggcacaggcauacacacacaaaaacacacauacacaaacacacaugaagacacacaaccacacacagucacaggcacacucacucuuacaccccagauagagacacacacucauacacacacauagacacauaugcucagacacacacacaggcacaggcgcauacacacacacacacacauucuuacaccccagagagagauacauacucauacacacacaugcucacacagacucacacacagucacacacaggcacacacacacauucuuacaccccagagacacauacucauacacacacauauaaacacauaugcucacacacagacacagacacagacacagaaacagacacagccacacacacacacugugucucacacacacagauucguacaccuagauacucacauacucauauacacauauauagacacacacagaaauacacgugcucauauauauggacauagacacauauauacauacucacacauagacacacaaaagcauacacagacacacacacacaaggagacacacaaacaugcacacacucacaugcacaaacacaggcacccucacuaacucacaaggacacaaguaugagcacacacaccugcuagacacacuuagggaaacuggcccauggcuguacaucaauggagacaugucuguucaucucuaagcucgccuccuaccaaccccucucccacucucccugucacacgcucuucuccggccacacuggccuccagugucucuggaacacauacaugaagcauguuuccacuccaagaacugugcacuguucccugugcucaaaacagucuuccacaaaugucuacaugacucgcacccucuucuuucauuuuuguuccucaacaacaccucucaguccgcuaggccuggccacccuguuaauauuggagcuuggccaggcauagugacucaugacuguaaucccagcacuuugggaggcugagucaggaggaucgcuugaggccaggaguuagagaccagccugggcaacguggugagaccccaucucuacaaaaaagagaaaaauuagcugggugugguggugcacaccuguagucccagcuacuugggaggcugaggugggaggacuaccugugcccggggagguggaggcugcagugagcugugaucacaccacugcacuccaaccugggugacagagugagacccugucucaaaaaaacuaaaaauaauaaaaugaaaaauaaaggcugggcacggugguucaugcccguaaucccagccuuaggaggccgagguggguggaucaccugagguccgaaguucgagaccagccuggccaacauagugaaaccucgucucuacuaaaaauacaaaaaauuagcugggcauaguggcaggccccuuuaaucccagcuacucaggaggcugaggcaggagaauagcuugaacccgggaggcagaggcugcagugagcugagaucacgccauugcacuccagccugggcaacaagagugaaacucugucucaaaaaaaaaagaaagaaaagaaaagacaaagaaagaaagaaaaaauacaauaaaauuggagcuaauuggagcuuccucuccaaaucuauccccuucccgcuuuacuuuuccucuuugguucuucucaucacccaacauacuuuaccuguuacccaaguaccuugcccauugucaguuucucccacuagaaugucagcucuaggagggcagggguugugucuguuucguccccugcugugucaggauggccuggcacacaauaggugugccauaaaugcuuguugaaugagugagugaaauuguguucagcuauguacuuaugagcauuccugggcauagguguagaaauaugagcauguguaauuccauaggggaguucacguauugugucuugacuguuuuuuucuuuuguuuuuugagagucuugcucuguugcccaggcuaaagugcaguggcaugaucuuggcucacugcaaccucugccuccuggguucaagccauucuccugccucagccuucugaguagcugggauuacaggagcgcgccaccaugcccggcuaauuuuuguaauuuuuaguagagauaggguuucaccauguuggccaggcuggucucgaacuccugaccucaagugaucugcccaucucagccucccaaagugcugggaucacaggugugagccaccgugcccggccuugaguaacuguuuucgagugaagguggauugccuucccucccuaacguggugguguugguguugguaugaccagcgugcacacacagaagcacguacaauuacagagacaaacacgagagacacagaccugcaagcacacagagauacccaacacaaaccgcuauacaacguacaucagucccccuuuauccgagguuucacuuuuugagguuucaguuacacuuggucuaaaaauauuucaauggaaaauuccagauauaacuccuaaguuuuaaauugcaugccguucugaguacugugaugaaaccucaugccaucccacucugguuggccuagaacgugaauccccccuuuguccagcaucucagugcuguaucugauaccugucuguaagucacuuagcuaucagaucaacuguccugguacugcagugcucaagugcagaguucaagaaacucuuauuuaucuaaauaaucgccuggccgggugcuauggcucacaucuguaaucccagcacuuugggaggccgaggcggguggaucacuugagauuaggaguuuaagacaagccugggcaacacagugaaacccccgucucuacuaaaaauacaaaaaaaucagccgggcaugguggcgcgugccuguaaucccagcuacucgggaggcugaggcacgauaacugcuagaacccgggcugcggagguugcagugagccaaggucgccacacugcacuccagccugggcgacagagagagacucugucuaaaaaaaaaaaaaaaaggccccagggugcaaaauagugauggcugcaauucggauaggccaaagagaagccuuaaagugcuuccuuuuaagugaaaaggugaaaauucuccacuuagaaaaagauaaucauauauauauguacugagguugcuaagaucuauaguaagaaaacaaucuaucugcgaaauugugaaggaaaaagaaaguuauguguaguauauacaggguuuaguauuauucauuguuucaggcuuuugugggggcucuuagagaacguauccuggugaauaaggggaaucccccaacacagauacacguagaaacauagacaccccccucccccagcacacacacacaaugucugcgcuaggauguaagaaggaccaaguuuuucguuuuguuuuuugagacagguucuugcucuaucucccaggcugcaguacaguggcacaaucacggcucacugcugccuugaccuccagggcucaagcgauccuccugucucauccucccaagcagcugggacuacaggcggccaccacacuuggcuaacuuuucaauuuuuuuuuguagagaagaggagagucucaccacguugcccaggcugcucucaaacuucuggccccaagcgauccucccgccucggccucccaaagugcuggaucgcaggcagagccacucggugcccggcccugggaccaagucuuguaagugcgacugcaguucugcguguuguuuacgcgugugcuugugcaucuguguuuguguuucugagcugguauguuugugacccugcguguaucuguggaugguguguacgugcauguguugaguaucuguguacgugucucucguguuugcuccgugcguguacgccucuguucccaccgcguuggcaagggaggcucuccauccgcagacacaaaguuuccuuuucuccgucagcggagggaguggaauggugcaaagucugcagaggccggaaaggggaggguaggggagcuccucagucgcggcuuccuagguggccguucccagacaaggucaggugcccgcucccgcagccuccgcgcccugaaggccccgcgcccgcagcccccgcgccgcccggaggagaaacaguacagucccgggcgggcggcccgagugggggcggggagccugggucggguccagccaccuggcacguggggccccgccagggucagcgcgcgggagcuggcgccgccggccggagaagcccuggggcuggagguggguucuggagccgggucccguuccgaccgcagcauuccugcccccgcgugagucaccgggggcaccuccccaccccagcgcuuccggccggcuucgggggcgcggagccagagccgggaucccccuucccaggccccaacggccgcaccuugagugaaggggacaggaggaacugggaccccuuccccuccagaagguucuugcuuuaccgcaagacgacaggagcaggccgauuccagaugugcuuuccagauguccugaccauccccccacaaccccugcucuccgccccagcuuuuccagagaaugagagggauggaaggaggaggggcacgcccugagucagauagagggacagacgcacacaaacggacgaaauuccuucacacagcaaacccccccacacacacacucacaaugaaucacacuuaaacacacaggggcuguuauuagcacagaagacgcagcgcuugguaaguuaacggcacacagauaugcaagggcugaugucacaaacacagugacacaaaaacaccgugacucacacauauacacgcgggcugacacugauguacauucauaaagagacauguaugcauacaagccaacgugggacaaacacauaaacacacagucacacauguacacauugauuacaaacaccuagcgacgcaauguacaucuaggcugaugccaacacacacagaaacuuaaaugucccuguauauucagagacacacaccacguaacagcguacauggaguugagguggacagauagauacacaccaggacacaaugaagggucauuuugaccugcucagacacagacacaccgacgcguacaccucacagccaagccuccaucuacgccauaagauggagcuggaugcgcccagguuucauguucacccagacacagacugauacaaaaacacauuugcgcugggugcgguggcucacgccuguaaucccaguacuuugggaggccgaggccgguggaucacuugaggucaggaguuugagaccagccuggccaacaugacaaaccugucaugaaacccugucuuuacuaaaaauacaaaaauaagccaggcgugccuguaaucgcagcuccucaggaggcugaggcaggagaaucccuugaaccccggaggcggaaguuacaguaagccaagaucgugccacugcacuccagcuugggugacagagugagacuccgucucaaaacaaaaaccccaaaaaacaaaaaaacacaguuucguagaugcgcaggccugaugcagacacacaaggauggagacacugccauggacacauagauugacacagagacacaucuauacgcugacugguaagcauccuuaggucauguacucagaggcagcaggggccagugcacacacagggagaccagagagaagcagagggugcuguuacacacacacacacacacacaggucugugacuacagucauacaccaacaugcuuacccugugacauauacacacacgccacagagacaucuauggacacacacagaaagcugguaagaggcugaggguugagagcaguggcucacgccuguaaaucccaacacuuugggaggccgaggcgggaggaucacuugaggccaggaguucaagagcagccugggcaacauggcgagacucugucucuaccaaaaaauucaaaaacuaucuggguaugguggcacaugccuauagucccagcugcuugaggggugggagggugcugagguaggaggauugcuugagcccaggagguggaggcuacagugagccaugaucacaguacugcacuccagccuggguuacacagcgggagcuuaucuugaaaaaaaauaagggggaaaaaaggugguaagaaacacaaguuauccauggacacguucugauucugcaagggaacacaagcucucacuaggacacucucacacccauagcugcacaccugugggcugacacuaccaccuccauacagagaggugugcaccauagccccaaacccacuacccuccaggcacacuuuacuuucauacagugagucccagcugugaacacacaaacacaaaaaagagggacagacacaggcugacacugguacacuccaucaugcgcacacacacagacacccacacacgggcaaccccuaagaaacguagagagagagacaugcuauaaagauccaaacacauauugggacagaauccaagcugaaggaaauauauuuagucacacacacacacacacacaccacacaugggacauccacagaaguccacccucgccaaggcacacccucacacagagguugugcugacggauacacuaacacucagauccagaacacacagauauccagacaccccaccaccaccacacagacaugcacagauccucacaccugugcagcccccauuucucucccuccccuccccuucucaugggaccugccaggcugacucaugcccgauccccaacccuggucccuacucagccacucgagccaugggccugagucacuccucuggggucagcaugcucaccaggucuuccuugcaacucagggucccaggaaugcugagaaugugagcuccucccuccacccuggagacccccagucagaaggccccuccucauuccagcagagagaggcagcagguugggagugcgggaagcugaugcccuccaggcugcagccuccuuccuuuacagagccucugccaucugcuccucugucuuuccuccuucaguagggagaacccccugaauccagggucccccagugaugccccugaccacugcauaacccugagcucgguccuuccucgucugcauggugcagaagggaaugguccccaagaaggagaggguuucugucacuccaacuucccuguccugucuuucauuuuguuuuguuuuucguuuugagacagagucuugcucugucacccaggcuggagugcaguggugugaucucggcucacugcaaccuccaucucccggguucaagcgauucuccugccucagccucccaaguagcugggacuacagaugcccgucaccacgccuggcuaauuuuuguauuuuugguaaagauggaguuuugucauguuggccaggcuggucucgaacucccagccucaagugauccaccugccucagccucccaaagugcugggauuacaggcgugagccaccaugcccggccucucuguccugucuauguucaucuugggucacuguggccugucccuuccaguguaugucauucuaucucucucugucucccacuuucuuuuuuuuuuuuuuucuuuugagauggagucucgcccugucgcccaggcuggagugcaguggcgcaaucucggcucacugcaagcuccgccucucggguuccugccauucuccugccucagccucccgaguagcugggacuacaggcgcccgccaccacgcccggcuaauuuuuuguauuuuuaguagagaugggguuucaccguguuagccaggauggucuugaucuccugaccucgugauccgcccgccucagccucccaaagugcugggauuacaggcgugagccaccacgcccagccucugucuccuacuuucuuccugcucucucuucuuuggguuccaucuccccaguggggaccgggcuggacauccucccuuugacugaggccagcaggcuuguuagggcaggaggugggccgguuguggagggaggcggaggagaggagggcacgguugauuccggugcccugcuugggucaagggcugacaaaggggcaccaggcccacacgcacucgagccauggaacagcucagaggaaacccaggacaaagaauucuauucagagagaggccggggugaauggagggagagagaagcagagagacagagagagagacacauacaaagagagacagaaagacacacacaccaagagacagaaagagacagaaaaaggcauacggagagaaauaagauagguagagacagagaggcagagacagacucagagggagaaacgagagagacagacagugagggacagaaggacagucagacacucacgcagagguagcaauguucccuugcuccugacuucagcccugcccggcccccuauucggagcugacccacauccccggacucaccuggaacaugcaggcugcgcugggggccgugaccuggagccguggccagggggacagcauccuggagccagaguagguccacgggcucugggggucccugagcuuggcagcucagguugaaggggguguuggcggccacaguccugucuucgggcuccuccaggaaguaaggcaagccuagcggggugggcagugguagaggcuggggucccucugaggccccaagaugccugacucaccacuaggaugcuguaggcuuugggcagcaaacccacccugcagggucauugacuugccuuaucugauccccgagggcaccugagccauacccaacacacacgugaccccaauaucugauuccucccaugucagaccccccacgauagcugagcuccucaugucucucuuccagaaugucugacagcucauccucaucucauucuauggaugagaaaaaagagaccgcuggggucguggggacagggguacguugcgugccucugacgccuuaucugaagaccagaauggccuccugugaccugauggugucugaugccuaggacauccaacuacccccaagaagucuuuucacccagaacauauaaucccccagccuuggcaccauaacuuauauggacucccagcuucuugaccacccaaaacucugacauucuuaggcuguaugacgcuagguucauccugaauccuccagcacccuuugaccuugaccccucaggauuccugacuucccacaaccuaugagcgccacauguccucugaccccucaggaccccugaccccagagcucacccuccagcccaacauagccaggcugggacacgaaggucugaugucccagaaacaccaaacacugguacugucccgugucggaaagcugcagggaggugauucugacagggcaagaggagagacagagagguucagggucagagcuggacacugggagggggucugucagaacggaaagaggguguccagucuggaagcucaugacaaccacgaaguauguccuauuauuaacucauuuugcagaagaggaaaacgaaaccuagagguuccaucacaugcucaaagccgcacggcugacaaguggucaaacugggguucccacccaggugggcuuucugcccucugugugacggaggugggagugggauucggggauguggccacacaccugagcuggcugaccacuauccagucauccuguucauccucacccaggggcaccugggucugggugcuguccgcgagcuccaggaucuguccaucccgaagccaauguaccucggggggcucucccugaaccuggagcugacaccgaagggugcccgugaguccccgggcaccugugauauucccuggguugcccacgaagggacuuucuucagccugcgugccuggaggggagaugggaagaguuagcuuaggaaccccccagcuccuuccggcccucaguuccacccuguccuugccugcccaccggcggccaggaccccgccaggcccuuaggccgacauaguugcagagugaccucagagugggguggagggcggaggcucugagaggaggacgggagcccucccaagggacugggaucuagcguccaucccgucgggaaggaggcucgggaucuggcagccucccacgcccugcacugccuggcagggccagccccugcccccuccguccucucuuaggucucuagagacuuaacaggucgcgcuggugcugguggauggaggggaagaaucagggguugggggagagagauaaggguggugguggggggagauaagggugguggcggagggagaagccagagaaaggcaggggagaugagacagagaggagcacagauacaaggcaagacagaaaaaaugaagaaacagcccucaagagagaagaaaaggugggggcggaggggggauacagucacagagggaggcugagaagagagagagagacucagagagcagggagagauaaaggcagagacugugaaagagagagaaacagagacccacagagauagcagagcuggaggcagagacagagagacaaagugagagccuccuccccagagauggaguggacuggugggguagggacaaguggcgggucaggggggugguguuggcagggagaagcguuuucccccagggcuccagagcccuccucaucccacugccugacucggugccccuucggaaagauuucuuccuuccuggcgacccucagcucagccccucuccccauggcccccuucucagguccagcccccaccccugcccucagcuucuccuugucugucugucucuccggguccucucuucuguccccccugcccuucaguuccucucucagucuuucucucccucugccgcacuuggugucucugagucugugucucccucccuugaagucccuuuucuguggucccaaggaaacucccuaagccagcccaggccccccacaccugccaucaucccccaccuccuaccccugccccagccccuccgaggggaucccugccccaaggagcccccaucacucaccccugggggccaugcacgcccagccgcacagcgccaagcaccaggccagcgggacccugcccauccuggggcaccgccacgccaugggugccaaacuuuccucagaaguuguugggcucccagcgggggagggggcagggccgggcuguccccggcccuccccccagcuccaggcuccccggauuuggcacugccugccuggcacagcggcaggggaggcccuugccaccggcucugcccagcagccgccuucucagcaccccugccuccuucccucacucccagacuugggcaacccuuucuccgccccuggcucccccuuugccuccgcccaccagggccagagcccaggggccaccu

SEQ ID NO: 15070 - RNA, 364 nt, Homo sapiens
acauacauuaacccauuuauuauaggccaaugaugucucaaagaguagaagagcgucuaccggucuuugaauuccuucagucuucugauggcgacuuuaccgugacagcagaagugguauuguagguccaggcacugccagccacugucuucaugcagaaaccacagugccagauccccguagcucaucucuucaucuugguuuugccacagaaagagcaaauguacuuggugugcugggugauuucaauucuucuucaccauuuuccggagggaggccccauagcgggucccauauuuacugaugauucugacuuucuuggugcauuuggccaugucaccgcaaacuaagucuaagcccagag

SEQ ID NO: 15071 - RNA, 2960 nt, Homo sapiens
agacugacaucaagaccaucacagucaggcaggccagcaaggucaccagaagcagcccugaggccagcaugguggcagugggaugauagauggugauggcuggggugguuugccuuuauacugccugaaaaagagggauggacuuugguugauuauauaaucaccucauuucaccucccaacuacaccccaacccugaaucccacacagcuuaggacacagccagcaagggaggaggagagggaccccagggaagcugaacagggaggggaacuccagacuaaaucugguacuucaggaggguugcugcagggcuguggauuuaggagcgggcaacagauaaacuguggaacugaggaguuuggaauauuugcacaggggagcaccuggacuuuggauuugggaucugggagugagaaugcaccccaaaguuguggauuugggcauuccacgggagaggaauccaaaggucuggguuuuacuagggugagauggaaguguggcugugcaucugggggucuucuguuguggaggaugcaggguuaagggucucaggacgggggauuccaggcauauggacuugaaagucuuggggcuaggaagacccagggcuguggguguggaguuucugggagguggaguguguagcaagcccagcaggugcucccagaaagcccagcagcccagcacugggcccagggacugacuugauuuugcuuugacccagagcugucucuugaugcccagaauccucauuggaaccucagagugaggccaggaugggugccauagaaccuccgcugcccaucucuggcugggaaaggggcagaagacgagagccauauuucagaggaacuuuccccacacguggagaagaguaccucauguuaccaguuggcagaggggauuggcuaggucuggagaaauaguaauaacaacccucaaaugcuggaaaaaucucaagugucccaaggguuguaauuuacgaagaacuccacugguuuccaacccagauucuuagggaaacccacuagauugauuguaucaucccuauuaauacuaugauuguuauuuauguuucucauuuuauauaaagaucuacagaggacagaaaacagacagugggcaggggacaugugugaguggcccugaacucccaucucucuugcucugcgucuuuaguuccacuuucuggauuugguuuuccugccaguggaaagggaguguuugggaagagaagaccacguuugagggugaguuaagucuccuuuaagggcgauuccugcuuugucaggggcuacuacuauuaguaggcagagggaacaaucgcagaagagauugggguaaacuccaguauuaggcacagaggcagauccuggggugggugugaguggagaagggaugaguagcccuccuguccuucccucaaggaaauucuuccuuaguaaacaggacaguuacccuuuggugagcauggucauauaugggaagauuaagucuagguguguaugaucugguugaaucuuuguaacagugagguugguucaucaugaucauccucauuuugaagaugagcagaucuagacuccauaaauccucuugagugaggucacacagggaguaagugagggagcugggaugugaacuuucuccucgccccccuucauugacuggccuagaucacccugggagucaagugcaggccaggcuuagcaggaggugagugcugggacuggcaucagcaguggacacacugaugacauuggcggguucugauaucagcaucagguguguccagggagggaaaggcaucguguuggcuuugggacugcccccagguguaugcgaggaugggaaacaaguuggcacugaacuugacaccaggagaauauugaagucauguuuggugccaagagggcucuguguguugucucaggugucauugagggcauaagagaguccugcuucaggagggcauaagaguggcaccauauagggucugagguuggucccagugggcucugacaugagcaugaggcagguguugauauugguccuaugugggucugagaugagccucagccagacccugagaggggcuccagaugggcacaggacaggcucugauguuuggaccuuccacuguugcaccucuccucugggucaccaacuguggacaaguggaggugggugagguuggcccccccaggacugacaucuugcucaaaguguucuaggaugcugagcucugagaccuguguggagggaacaaagaucagagaacaaaggggacagaggaaaguuguuuguugauuuuggaggggaagaggugggaaggaggauuagcaccagcuuggcagauaucaaucccucuaauccuggucaccagccugcaccugggcuggcccuaagccugggcuccuccuuuuccuucuaguuccuuaaaaaggugggagauagaaauucgggaacuuuguuucucagugagguuggcacuaggaagugcacugagugaucagcagguugccaugaucuggccagggaggggguggggagagacagguuuggagaacucuaguguuuguggacauagaggucaaucaauuuuggacuuguugauuacccuggagcauggagugagagaauggugucugaaaucaugugggagggacuugucccagugggcagugucuuggguacagccuuucagagugaguuaguggaaaacccaggaagaucccuuuccuuugcuuggccucaguuuccuuuucuggauggauggugcaaugauuaaggccuggauuggaauccuaaccuuaucccuucuuuguuguguggccuugaauagcugacuuuaucucugagccuuauggagccaagaacagcucuuaccucuucagcuauuuaggggagaaguauauguguuaaugcaggugagguacauggcaguaagugcucaau

SEQ ID NO: 15072 - RNA, 2938 nt, Homo sapiens
agacugacaucaagaccaucacagucaggcuggccagcaaggccaccagaagcagcccugaggccagcaugguggcaguggaaugauagauggugacggcuggggugguuugccuuuauacugccugaaaaaaagggguggacuuuggcugguuauaaaaucaccucauuucaccucccaacuacauccucuccgugaaccccaccuagcuuuggacacaaccagcaaaggaggaggagggggaccccagggaagcugaacagagaggguaccucccgacuaaaucugugguaccucaggaggggugccccagggcuguggauuuaggagcgggcaacagauaagcuguagaacaaaggaguugggaauauuugcauaggggagcacuugggcuuuggauuugggaucugggagugagaaugcaccccaaaauuguggauuuggggguuccgaggagaagaaugcaaaggucuggguuuuauuagggugagauggaaguguggcugugcaucugggggucuucuguuguggaggaugcaggguuaagggucucaggaggggggauuccaggcauauggacuugagagucuuggggcuaggaagacccagggcuguggguguggaguuucugggaggaggaguguguagcaagcccaguaggucgucccagaaagcccagcagcccagcacugggcccaggggcugacuugauuuugcuuuugcccagagcugucucuugaugcccggaauccucacuggaaccucagagugaggccaggaugggugccauggaaacuccacugaccaucucugguuggcaaagggguggaagaccagagccauauuucaagggaaauuuccacacaccuggagaagaguaccuuguguuaucaguuggcagagggauuggccaggucuggagaaauaguaacaacaacccccaaaugguggaaaaagcucaagugucccaaggguuguaauuuacaaagaccuccacugguuuccaacccagauccuuagggaaacccacuagauugauuguaucaucccuauuaauauuaugauuguuguuuaucuuucucauuuuauauaagggucuacagaggacagaaaacagacaguaggcaggggacaugcaugaguggcccugaacucccaucucuccugcucugaguacuuaguuccccuuucuggauuugguuuucccaccaguagaaagggaguauuuaggaaaagaucauauuugagggugaguuaagucuccuuuaagggcgauuccugcuuugucaggggcuacuacuauuagcaggcagagggaacaaucgcagaagagauugggguaaacuccaguguuaggcacagagguagauccuggggugggugugaguggagaagggaugaguagcccuccuguccuucccucagggaaauucuuccuuaguaaacggggcaguuacccuuuggugagcauggucguauaugggaagauuaagucuagguguguaugaucuggucgaaucuuuguaacagugagguuuguucaucaugaucauccucauuuugaagaugagcagaucuagacuccauaaauccucuugagugaggucacacagggaauaagugagggagcugggaugugaacuuucuucucaucccccgucauugacuggccuagaucacccugggagucaagugcaggccaggcuuagcaggaggugagugcugagacuggcaucagcaguggacacacugaugacauuggcggguucugauaucagcaucagguguguucagggagggaaaggcaucguguuggcuuugggacugcccccagguguaugcgaggaugggaaacaaguugguacugaacuugauaccaggagaauauugaagucauguuuggugccaagagggcucuguguguuguuucagguuucauugagggcauaaguguguccugcuucaggagggcguaagaauggcaccauauagggucugagguuggucccagugggcugugacaugagcaugaggcaggugcugauauugguccuaugugggucugagaugagccucagccagauccugagaggggccccagauggccacaggacaggcucugaugguugguccuuccaggguugcaccucuccucuaggucaccaaauuuggacaaguggaugugggugagguugacacucccaggacuggcucuaacuggcucaaauuggcuguugagcucugagaccuguguggaggaaucaaagagcagagaacaaagcagagagaggaaagcuguuuauugauuuugugggggaagaggugggaaggaggauuagcaccagcugggcagacaucaauccaucuaauccuggucaccagccugcacuugggcuggccacaagccuggguccuuccucuucucccuuguuucuuaaaaaggagagagguagaaauuuggagaguuuguuucucagugaguuuggcacuaggaagggcacugaguguucagacaggcugccaugaccuggccaggguggggguggggagagucagguugggagaacucuaguauuuggggacauagaguucaagcaauuuuggccuuguugauuacucugaaguguggaguaagagaacggugucugaaauuaagugggagggacuugucccaguggcggugcggguacaggcuuucagagugaguuaguggugaacccaggaaaaucccuuuccauugcugggccucuguuugccuuucuggauggaugguacagugguuaagagcaagguuaaggcauggauuggaauccaaaccuuaucccgucuuuguugugugaccuugaacagcugacuucgucucucugaaccuuauggagccaaaaacagcuccuagcucuucagcuauuuaggugagaaguauaugggucaaagcagg

SEQ ID NO: 15073 - RNA, 6891 nt, Homo sapiens
gcuauuauuacuacucuucauagcauaauguaaggguuuccuuccucucaucccagcucggaagcaccuuaucaaggugaacugagccgcuucuguuucuucucuucccucuagccaccacgccccuuccuuuccgccauccugcccccagucuuagcugcgccccucucccaagcccggucuuggcccugcccuuucccuggccccgcccaccagaccugcaccggcacagcccucgcucagcggggcaggaagcucaugguguaguuucgugggaucguggcaaagcccacguguuugggggacacgucaauguccuuaggugacugggaggacuugaggcggaaguucugcaugacgguggugaagaagagaaagagcuccauucuggccaggccuucuccgaaacaguuccgcuuuccugaggaggagaggcgggagggguggaggugaagcccacucucagugcagccucgccccaguaccgaccuccagcugcggcucucccagggaggaaggguggaauauuauggccugagagaguuucagaggaggcucugauccucccugagccucaauuucuuucuauaagagauguaacaauggugaaccaauauugauauauuauuacuaacaaaguccauaguuuacauuaggguuuacucuguguuauacaguucuauggguuuugaaaaaggcauaaugucacacauccaucauagauggggugauccaugccagguguagcaaugggagguuuagauguccuuuccugccagguacacuugcaaauaugacugcugugccgucaucuccuuuuuagggaucugaggaaucugcugugugacccuagagaaauacaucuacggggaaagauguuuccuuucauuuuaccugggcgcagguacugggugcuugguaguuaaggaaguaucagcugcuggcucaaggguagauucuaacaggaacuuccaagcuggagaaauaccaggcuacaccgcagagaggggaggagggugagggaggccccugcuggugugagccguggccuggcagcaaacaguggucucuuaccgauggaaaagggcacaaaagcaucacucuucuuaaacugccccuucucauucaggaagugcuggggauugaaguccuggggguuggagaagaaacuggggucucucagcacagagcccagcauagggaacacuucggugcccugguagggaggaggaaguugugugugaugaggagggucgggggauuggugaaaguacacaggggcuggagggggaacuagugugccccagguaaggggaaguggcaggcauggaggaguugggguccucugauggaggagcuuugggggauagaagguucacaucucugaaacaggaaguuugggagacaugggguccauguccuucuaggcaggaguuugggggaccugagauuucugucccuaugacaaaaggccgaauggaaagggggcuucuguuucuuaagauaggaaguuugggaacauguguuugauucuccugacacaaagagucuggagagaugcaggacucaggagugucuaaguggaaagguggaacggauguggugguuggggaagucuuuuuugacugauugagggagugggacagggucuagaaagcuucuaaugugggugggaugcuggggacacagagaggggcuggaaguccccguagucuggggggugggggcggauagcaccuuagggaggaagaaaucccgaaacuugguguccuuuuugacucugcgggccaaacucauggggaucacgucuccaaaucuuuggaucucguggaucacugccuccauguagggcaucuuggcccgguccucaaacuugggcugccgguucuugccgaucacucugucaaucuccucauggaccuuggcugggggaggagggggaauguguuuagguaucuaggggucucagagcaggaaaugauaguccgaauaggcaaaaugggguggaugauauggcuccgccuaugagacggaaguagagcauucauaacagaacagacaucagccauucgcauuguuggaguaggauccuguuaaccagguugugccagaaucacaggggaggcacagggaggaacuuaggggaugacccgguggaacgggcagugggcacucagugggcuugggacagaagugacugaccaaucagugcagacauuuucaauauuuuaauaucuaaugagacucagcugaugccuaccagcugaauguugcccugucucuggacagcaagucacgucucagggucccgggaucugggacagguggggacauugcaccagucgaaggggaauuuugagggucuggggcccuccacuuccgucccccuccagccuuacccuccaccucugggugcuucaugagcagcaagaagccauagcgcaggguggugcugacggucucggugcccccaaugaagagguucaacguggucaucaccagguuuuucaaguagaacuccguguugggguucuucuccuccugcagggagagggggcuuuaggccaaccucacuccucuugcccucagggcccuucuagggcuuuuccuuuggaucuaccucucuuugguucagaccaaagguggaaagagggacccuagaucuaccagacucgcucuagguuccagcccuugcccuggcugcuggcuuugcccaaaaugcucuuccuucucaccuucuuuaccuugcugaccaucuguccuucaauuaucaacuuagcugucaguuuuuuuuuguuuuuuuuuuucuuauacugacuuggucuugcuaaguugcacaggccggacuccaacuccugagcucaagcaauccuccagccucagccuccugaguagcuggaacugcacaugcgcaugaccaugcaggcucacuuacuuuuuaaacaauuaauuaauuuuuuuugacacagggccucauucugucacccagacuggagugcaaugccgugaucuuggcucauugcaaccucugccccccuucgcgccaccaugcccaacuaauuuuuggauuuuuaguagagacgggguuugaccauguuggccaggcuggucucgaacuccugaccucaggugauccaccugccucggccucccaaagugcugggauuacaggcuguuagccacggcacccagccaauugugaggauuauuaugaugaggguuaauuugaaugggccugugucaucugccugccccacucccagacugauuucccucugccuggcuuugcaucuccccgcaguggcugcugggguguaccuccugcaugcggaugagaaaggagucaaugaagucccguggggaauugggauccagcgugcgcugguugugcuccaccuucuuggcuaugaaguccuccagcccuugcagcaacugaaaggccuguugcugugguccuggcagguguuucaucaccgaagagaacaucucauagagcugggguugcagagagaggaugggaagggaaggacagcugucacggggcaggagcugaugggaaugggauuuguuucauagcaaggaaggaacugaguuaaaggcaucugucucguuguuuagguauuucaguggggccggauaggaacuuauaucuaaguuuucaggaagguuagguaccagggccacggucuaguaauuuaggugagaagaacugagacauauauccagguuucagguauuuaaacgaggcuggauuggagcacacaucuagguguucagauauucaagugaaguugaguuggaagacaccuguccagguguuuagcucuucagguggggcugguaugaggugagugucaccugucuagguauuuaggcauucaaguaggcuugguuggagacagcuguccagauacuuacugggucuggauugggggcuuuuguucaggugcucagguauuaaaguggggcuggugaagauguugaaguggaggggauaccuguugagguguuuaccuauccaagugggaugcacugggagcaccucuguaaggugugugauuggaaaggguuggggaacacuuauuugugugucagggaacaaucugucuagauauuuauguguuuaagguguugguuagggcagcuguccauguuuucagguauuuaagugggugaaguagagggcgcuuggccagauauuccagugggcuaaucugggacauuuguguagaugugaaaugauuaugaugggcuggauuuugcagcaccagguguucagguaugcaggaggccgguugacgcagucacuuguccagguguuaaaauauucagaagaacuggguagggagcaucuguuagaaauuacgguaaguuggggaugggaacacgugcccaggugagagagcugagcugaggguaugcauccugccagcaggcucuguuuuggggagcaucuguugagcuauccagguguccuuggagacaggguauuggacauccauccuggguucuggugcaacuguccaguuguccaauaucggggacugauuuugaggggacacugucuggagggcggugggaguuuggggcaccugucuccagguaggggagcaguuggcagguugugguaggggcgucacgggccgggcugcagccaguuaccugccccguggagguugacgugaacuggaagauuccuagcaucaugcgcaacagugacaggaacucuuuguccuuauagucaaagcgguccccaaagacaauggagcugaugacauuggagacugugcggcucaggaagaaggugggaucgauauuggcgccugcggguauggcgggagaaggggguuggggagagagucaacucagaggucugaggagagucagaauuccaggaggcagggccuuguugagccaaauucccagcgccagacuccagggcuggaagugcgggcgccuuuccccaccuaguccccauccccaggcagaacgcgcgcggguuccucguccuggguguuuuccuucuccugcccccgcacucgggguccccugcucaccgccagugccccggagggcgucgaugaggaagcccgccuccuccuggaugcgcuccucgaugccucgcuugcccaccccgaagucccgcaggguggcgauggagaagcgccggagcugcuuggcgcgcuccccguugcugaauaccacgccuggggaggugaacgcgggaauggagacaggccagggggcggcaggggcaggagcggagcagcuccaaggggcuccccaaggguggaggagagagggaguagggugggagagagauggauucagcgccauugcccagcagagcugcaaacucagucagagaaacacgaugucgagguagagagagagagagagagagagagagagagagagagaagagagagaggagagagagagagagagagagagaagagagagaggagagagagagagaagagagagaggagagagagagagagagagagagagagagagagagagagagagaccagguuuaaagaauaagacaaucagaaaagaaacagaaaggccagacagagagaugcacauagaaacagagggauaaggggacacuccauggaggaagggaaggaaguggggagagaaagagagugauggaggaagaggauggagggaggggaagugagauauggggagaucugggaggaggaaauaaaaauggugaaagauucuuaagcugagcuggagaagagagaaaaauauugagauagaaacagagagggucuggaaggaagagagacuguuaccaggagauggaggcugaagauguggaaguaggaauacccugaaauccuaagacagaggaagaagugagaaagggaugcggagagaugagaaacacagagaagcccagaagcuaagagggacaaaaagacaaaugaagacagagaaccagggcuggaaaacagaaacccaggauguccuuagagauggagagagaggggaaagaggagacuccagugagagagaauaaggagguggggcagagagaggcagggaggaaucaggacagggacgcuggagacaggugagggauacacauggagaggccacaaugaagggagauggggagggaagaccagacuggggacucugccuuagccuccaguuggcaggagagucagggagaaggcugggaacacugagaccuucguguccaccuggccaccuucccccucuugggcacccccucaccauagccuuugaagacccagucgaagguggcuugcucgccucgcccgcugaacuccucagccugguccaccagagccucccugacggcaucauguccacacagcaccacgacccgccggggccccaagugaauggugaacacggggccauagcgcucacugaucugauggaggugggugggagugguuagagggagaagccuccacucugaauggggcccagcaccgagaugucaugugcugggaugcuucgcacccagguucucacagucagggagcuggacaucccaagauccugucuuucugaugcugaaacuccaaaacuccauuuccuaagacucugguccacacuggucaacccccugccacaaagccccagccaacuaggcagcccccaccccgugccacccaucucccugccuugggacaccuucaugagggaguuguacaucugcucuguguucagcugcagguaguuuccaaugaagggcaauggggugggucccggaggcagcuuccccuugcucuuccucugcugccaaacagacaucaagaccauuacagucaggcagaccagcaaggccaccagaagcaucccugaggccagcauggugguagugggaugauagau

SEQ ID NO: 15074 - RNA, 3534 nt, Homo sapiens
ggucgcuaaggguaguuaggagucuggagucgugagccggagucagaacugcgucucgcgacccaggcgcggguuuccagaggacagccaacaagcgaugcugccgccgccguuuccugauugguuguggguggcuaccucuucguucugauuggccgcuagugagcaagguauguaaaugaaggggccugggaacagaagggcuaccagcggccggguccuucacagaguucgaucccuggguccgacaggugcccgccggggcugcccgggaucgagacgcacggaccucuacgugcugucugccccggccgggccgggugaaucacgccgcaguccgagaagggggcggaggcgccggcuucuuggcuccggcugcgugacucacccgcccccgccgccgccgcuucgggaggagccgccuccacugccggaagcgagcggaggccgggcgcagagaacagcccgccaggggucccggcucgcacggcgccgggaggccggcaggaaucacagccgggaaucggggcaguagaagggguccuggggucagaggggccagaauccccgggggaaagccggccugggcaccgcuagggggcgccgggacccgggggcggagucgggggugggggcggaauuccugcgguuccggacuccccggacugcggggaaggggacgaagacccuguuuugaguaguguggugggccauucuuaaaaucuugcuaggcaggguuccgaaacuggacucuacagucuuccuggcccaaaaaaguagguagcgccaggaguccaaaacuccagcccuacccccgccacuccaagaacaguggacccucaaacuuaucucagugacugaacccggugccgaucacgauuucccgacaagcccugucuauucugccucccaaauaaguccugacucgaccgacuuccuuccaugccacuaccagcuccuacuccaggccaucaccaucguccgucccaaacgaguacagccuaccagugggucucagauccccccucuuuuugccccccacagucuuccucgaagcagccaugggggggaucuuccggaaaccuaaucagcucacagcaccauucccucccugcucaaauuccuuuaaugacugcccaccacacucaggauaaaauccaaacucccuacuucugcauauguggcuuucugugaccuggcuugugcccguuccccuagcugcuccccaaucuggucuccuaccaugucacucucugugugccacccaugcuggucucuuuccaguucaagcccauccagccucugggcuuuucucugccuuuuuuuguuguucccuccucccggaaugcuuuucccagggucucccauggcugacuucucuggccugagggcuccauucaaaugucaccuccuuacaggagccuucucugaugaucuaaaaggucucuaggaacuuuuagugucuuccuguaauucucuguacauuuccuguguuuccuuauuuauuuacuguuugaaacauagucauaguagacaauaaauauuaaacuacgugaaacuaguuuaguauuuauaauauuauaacuuauuuagauauaauuauguuauuauaauaaaauaugugaaacagcugcuuuuguaggggaaaaaguugaauauuggccauuccacaugguucacugaagaaauaauaauguuaucauuaaguguacuuauuggcagggugaggcagcucacacuuguaaucucaguacuuugggaggcugaggaaggaggauggcuugaggcaaggaguuugagaccacccugggcaacauagugagaccaugucucuacaaaaaaauaaaagggaaaaaaaaaaguacuuauugacugaggggggaggaucgcuucaggccaggaguuugagaccagccugggcaauauagugagaccccaucuuuauuuuuucagauaaaaaagucuauaaauauacuuaaauauaaaauuuaaaauuuaagaagucuauaggccaggcgcgguggcucacgcauguaaucccagcacuuugugaggcagaggugggcggaucacuugagguccaggaggucgagaccagccuggccaacauggugaaaccaugcuucuucuaaaaauauaaaaauuagccgggugugguggcaugugccuguaauccuagcuuuuggggaggcugaggcacgagaaucauuugaaccugugaggcagagguugcaaugagcugagaucacggcauuacacuccagccugggcaacagagcgagacuccaucucaaaaaaaaucuauaaauauacauauacaguuaaauaaaaauugucuauaucuuuaaaguucccuaagaaaagcuaggcacagagagguuaagugacuuccccaagauccuaccugcagcaacugucagauccaggcuuugaacuuaacauuuguuuucuauaacugacuauaacuccauaacucccugcccucugcagaugcugagcaagggucugaagcggaaacgggaggaggaggaggagaaggaaccucuggcagucgacuccugguggcuagauccuggccacacagcgguggcacaggcacccccggccguggccucuagcucccucuuugaccucucagugcucaagcuccaccacagccugcagcagagugagccggaccugcggcaccuggugcuggucgugaacacucugcggcgcauccaggcguccauggcacccgcggcugcccugccaccugugccuagcccaccugcagcccccaguguggcugacaacuuacuggcaagcucggacgcugcccuuucagccuccauggccagccuccuggaggaccucagccacauugagggccugagucaggcuccccaacccuuggcagacgaggggccaccaggccguagcaucgggggagcagcgcccagccugggugccuuggaccugcugggcccagccacuggcugucuacuggacgaugggcuugagggccuguuugaggauauugacaccucuauguaugacaaugaacuuugggcaccagccucugagggccucaaaccaggcccugaggaugggccgggcaaggaggaagcuccggagcuggacgaggccgaauuggacuaccucauggaugugcuggugggcacacaggcacuggagcgaccgccggggccagggcgcugagcccucgugcuggaaugguugucugguaucugaacugagccugcuggcuggaccaacuguccucgaaaagacacagcuggcuucccuaguacagagaacagggcuugggccacuuuggagagacagaaucuaguccugggcaacuucacauccguccuccugucucagggcuggcagggggagccuggaauuacccccuagugauggaaugacagggucugguggggacugaauucccuggcccuggggucauagcuugggcuguuccuucucugauacgggaagagaccccaaucagauuuuucaaauuaaagccaguccugggaaaucuca

SEQ ID NO: 15075 - RNA, 1707 nt, Homo sapiens
acaucaaaagaggauugauauacucaaaaccuucaaauucagacugaucaaucuuucucacaaugucaucgacaucuggagugagcuagacagguucauuaguaaacugagaaucaaaguuguccaaaccaaauuccccagaaauacuugguuuaaagggagauaccaccuguuuuugcuccaucauaucccaaucaacauuuuggaagaacgggugucccugaauaucagcaaauccuguuugaggaugacaacccagucguuucuuaggguccuuguuaagaaaacucuucagaacacuugcagcuuuuccagacagagaacgugguaugugaauuuguuuuuccacaauaacuuggaagagagaauccucuguguucuggucaggguuaucggagcucccaacaguaucaaauggaguccuuccugccaucgucucaaacauuagcacuccaagagcccaccagucaacacugaaaccauaaucuccuccucuuaaaauuucaggagcaauguaauuaggaguaccacagaaagugcugguuguaucuccuggccguaauccuuccuuaacacaugccguagucagugaguuuaauguggccuucagaguccaguaauacauuguccaguuucaaaucucuauaaauuaucccucacucaugaagauaauugaaugcuagacugauuucugcagaguaaaaucuggcauguucuucaggaaguuuucuuugucgcugcauaugaaacauuaggucuccuccauuuacauacucuauaacaaagaacaaucugcuuucugucugaaagcaagacugcagcccaacaaggaaaggaugauuggaugccugcucaaacacauguuucucugucugcacccaaucaauauccucaucaucauuaacaagcucuuuuuucacaacuuucauugcauaaauacgaucuguuuuuuuuuuuuuuuuaauggaaccaacaguacuuuggcuuaacuuccucuuccuauuaccuggagcaaaucaaaauccugaagaccuagacuggaugaagcuuugccacuuucucugguguucauugccucuuuuucuucaccaacuugauccaaacucucaugacuugaaggauuauauggaauuacugucugugcauggucagaaugcauggaugacugauccaugggcaucauugguuccaguggcaaagaaugccgcccacauucaauugugaggaguuuauggcacuucuuaugaaccaagaguuugcaguugauacacuuauauccuuggcauccaaguccccauauucagucugugcagauggcacagucagcacgccuguugaagcacuuggcuugaaaaguguguccauuggcacaauaaagcuuucuccaguggcgugcaccucuacgguagauggauuuaucuucucuuggacaaggcaucccgggacguucugguacacaagggaacacaugaaucaagaguucagaguccuuguuuagcucauaaaguguaaaggcuucuucuaacuccaacugagaugauacuguacacgggucuccuuccucgucuauccauuucauggugaagagcuguucguugucaaaagaacaugucucgaaccacauuguaaaggcccucaaaggagacagaagguucaaaauguguuaucaugauauccccgcgguaguaggcuuucacccagaccugg

SEQ ID NO: 15076 - RNA, 1707 nt, Homo sapiens
ccaggucugggugaaagccuacuaccgcggggauaucaugauaacacauuuugaaccuucugucuccuuugagggccuuuacaaugugguucgagacauguucuuuugacaacgaacagcucuucaccaugaaauggauagacgaggaaggagacccguguacaguaucaucucaguuggaguuagaagaagccuuuacacuuuaugagcuaaacaaggacucugaacucuugauucauguguucccuuguguaccagaacgucccgggaugccuuguccaagagaagauaaauccaucuaccguagaggugcacgccacuggagaaagcuuuauugugccaauggacacacuuuucaagccaagugcuucaacaggcgugcugacugugccaucugcacagacugaauauggggacuuggaugccaaggauauaaguguaucaacugcaaacucuugguucauaagaagugccauaaacuccucacaauugaaugugggcggcauucuuugccacuggaaccaaugaugcccauggaucagucauccaugcauucugaccaugcacagacaguaauuccauauaauccuucaagucaugagaguuuggaucaaguuggugaagaaaaagaggcaaugaacaccagagaaaguggcaaagcuucauccagucuaggucuucaggauuuugauuugcuccagguaauaggaagaggaaguuaagccaaaguacuguugguuccauuaaaaaaaaaaaaaaaacagaucguauuuaugcaaugaaaguugugaaaaaagagcuuguuaaugaugaugaggauauugauugggugcagacagagaaacauguguuugagcaggcauccaaucauccuuuccuuguugggcugcagucuugcuuucagacagaaagcagauuguucuuuguuauagaguauguaaauggaggagaccuaauguuucauaugcagcgacaaagaaaacuuccugaagaacaugccagauuuuacucugcagaaaucagucuagcauucaauuaucuucaugagugagggauaauuuauagagauuugaaacuggacaauguauuacuggacucugaaggccacauuaaacucacugacuacggcauguguuaaggaaggauuacggccaggagauacaaccagcacuuucugugguacuccuaauuacauugcuccugaaauuuuaagaggaggagauuaugguuucaguguugacuggugggcucuuggagugcuaauguuugagacgauggcaggaaggacuccauuugauacuguugggagcuccgauaacccugaccagaacacagaggauucucucuuccaaguuauuguggaaaaacaaauucacauaccacguucucugucuggaaaagcugcaaguguucugaagaguuuucuuaacaaggacccuaagaaacgacuggguugucauccucaaacaggauuugcugauauucagggacacccguucuuccaaaauguugauugggauaugauggagcaaaaacaggugguaucucccuuuaaaccaaguauuucuggggaauuugguuuggacaacuuugauucucaguuuacuaaugaaccugucuagcucacuccagaugucgaugacauugugagaaagauugaucagucugaauuugaagguuuugaguauaucaauccucuuuugaugu

SEQ ID NO: 15077 - RNA, 10575 nt, Homo sapiens
ccagaagccuccucagccagggacuuccguugucgucagcggaagcggugacagaucaucccaggccacacagaggccggcuuggucacuauggaggagauaggcaucuugguggagaaggcucagguacaguggggacuugggcuuuuuaguccgggccgggcucgcggggagagggugaagccagaccugaguggggggaggaauggcuuccaggaccccggcccagguugggguuauuuuagaggccucgguggagagcuuugugccauucgaaggccugucuggguggccgagugaugguaggagguaaggcucagaaagcggggcugggggagugagugacguuagugggucuuugagacggauugauuucgaacccuggccgguagugcuuagugaggucgguggcccggcguugggauugggucaggcggugagugauauaugggaucccgccgugcggccgagugauccccgggucugggcugcggggcugacugauguucagggcuuugcugauggggguaauggggcggguaguuaaguauuaucuguggcuugccugagugauauuuaggucuaaggugaguuaggagacugugacauaagggaucuuugaggggaaacuggggaauguugggacucguugaaggcgcagucacuuuaacagccuaucuaggagagccaugugacauuaggaaccucuugaaggggauuggguggcauuugggucugauaaggaguugaugugacguuuagauccuaguuggggguugugugacacuggggacauguuaugagugguauaugauaacauaagaucuguuugaggggcaaguugacauaaagagcuuguuuagguggccaaaagguuuccaggaucuauuuagagggucuuaagauaucaggggucuguuaggggcuaagugacaucagggugaaguggggaggggaacaaacauuagugaaguugggaagcuuucaugagaggacugucuucuuccaaugugaguuauccccuuucgucuaggaugagaucccagcacuguccgugucccggccccagaccggccuguccuuccugggcccugagccugaggaccuggaggaccuguacagccgcuacaagguacauucgacccccaacccagaccuugcacaggaccugacaucucauacucuuccccacuuuccaccacucucuggaucagcaagucuggagccauccccuucuguccccucucugcucgcagaagcugcagcaagagcuggaguuccuggaggugcaggaggaauacaucaaagaugagcaaaagaaccugaaaaaggaauuucuccaugcccaggaggaggugaagcgaauccaaagcaucccgcuggucaucggacaauuucuggaggcuguggaucagaauacagccaucgugggcucuaccacaggugugcuaaggacaccucauucauucaucuguccacuuaacaacuauuuccuaccaugugcuaggcagcagcaaacaaggcagggcagugcagugcaauguucuucagaguauuuugacugaucgaaagguagaaauacauacauauauauauauauacacauauauauauguauaucuauguuuuuuuuguuuguuuguuuuuuguuuugagacagaguuuugcucuuguccaggcuggagugcaauggcaugaucucggcucacugcaaccuccaccucccagguucacacgauucuccugucucagccucccaaguagcugggauuacaggcauggaccaccaagucuggcuaauuuuuguauuauuaguagagacaggguuucaccauguuggccagucuggucuugaacuccugaccucaggcgauccacccgccucacccuccgaaaguguugggauuacaggccugagccccacugcaccuggccagaaauguauuuuacauugugauuaucuguaucugucucuuacuuuuuagauagauguguaaaacauaaguuucaccaugaaauauuuagccuuacuaggugugguauaugcugauguuuucuauccuauucuagucuguuuugcuuuaaacacaguucuggucaugaccuuccaaauugauuucacaacuacuacugguuuggggccugcaguuugaaacgaugaguaggaguguuaagagauugggcucugaggccaggcauggugccucacacguauaaucccaguacuuugggagacucaggugggcagaucacuugaggccagaaguuugagaccaggcugggcaacauggcaaaaccccgucucuacugaaaauauaaaaauuagcugggugugguggcacacacuugccaucccagcuacgcaggugguugaggcacaggaucuguugaacccaggagguggagguugcagugagccgagaucgugacacuguacuacagccugggugacagagcaacacucugucuaaaaaaaaaaaaaaaaaaaaaaauacugggcccugauagggacucagaguccuuaucagaguauauuguagcugcugcuguuuauauaggucuaggccuugcccucuugauagucauugucacuggcaucuuaucuguuuuuucuuguuucugggcucugcuccucuggaccaagccauguucuuguaaagguuuuggagaaaggugugcgauugugccuggaauuggacuggugggcuaugaggaagugaggagagggugguauccaggaugaggccuuucucuuugaccugugggaguugggauaguguggcuuucccugagauggcaccauggguagaggaguagguuugugggaagacagggagggcaguccagagcacaugggagguguccaggaggcugcuggucagccaggucugacaaucaggagagagacugagccuggaaacagaagugugccucacuaguaugagaugcagggggaggccugcuggacagccagggcuggaugucaagagagaaucagggcgguagacaaggaguucgugugaauacuggggacggacagcaggagggaaggcuggaggccgagaggggaccccucagggucugaaccagagauguugggguguggagauuaggagggaggaagggggaaggggcaguuuccaggcugacacuucucguuuuccucucucccuucucgcaggcuccaacuauuaugugcgcauccugagcaccaucgaucgggagcugcucaagcccaacgccucaguggcccuccacaagcacagcaaugcacugguggacgugcugccccccgaagccgacagcagcaucaugaugcucaccucagguaaagggggagccugcagcugggagggccccauggggaccuugaggaccuggccaggagccccagcucugcucucccaccagaccagaagccagaugugauguacgcggacaucggaggcauggacauccagaagcaggaggugcgggaggccguggagcucccgcucacgcauuucgagcucuacaagcaggugaggcggugcagguggcagggaagggagaggccccauugggucugggguuggagguggaaccccugacucccacuucucuuccuuccucuggguuucagaucggcaucgaucccccccgaggcguccucauguauggcccaccuggcugugggaagaccauguuggcaaaggcgguggcacaucacacaacaggugagcccuuucgccccugccccgagcucucaucuucuggccucuucgccuugcucccugcucgcucacuggcacugcacaguaauuagaaacagacucuggggucauagcccacgugugcauguuacuggcugugcugacuucaccuccuugggccucuccuaguaguugaagacucauuucacccggugauagugagcaguuaaugaaauaaugcaguguuuuccuacaauggguugugaccuauuaguaauuaugaauuucaauuuguggguugcagccaguauuuugaaacaugaaauagaacagaaagcgccagagaacauccacaugguauuuauaccaugguacaaguauauauggugcaaguucaucuguuucgugaaacuuguuucauacagaugugcacacucauguauacuugugguucuucaaaaauauauauauauauuuuaauucuuaaauuuuuuuguagagauagggucucacucuguugcccaggcuggucuugaacuccugggcucaagggauccucccacagugcugggauuacaggcgugagccaugugccuggccccaaaaauguauuucuuauuguaggugccagacaaaaaugucugaaagucacucacucuauaacuuuuuuuuuuuuaaagcccuaaaaucuuaagcauauguucagaucuuaacacaugugagccagggagcaguaggagguaguaguuaagcaguauguuuucuggggcuagacugccuggcuuugaaaucuuacucccccagcaacuucuuaugugauccuggguaaauuaaccucucugugacucaguuuccucaccugucagauggaaacaaucauaguaccuauuuuucuaggguggguguucagaagagcaaauugauacaaagcaucuggaaugggcaauaaauguuagcuguugucauuguuacucauuugcuugguacuuuauugaacuuuuacucuguaccaagccuugugcuggaaugcaaagaugacaaucagagaugucccuugccuugacugggaaaaaagaaaaagacaccuagaacucagucauucagugacuguuuauugaacacccacuaugugccaggauguguuguagaugcuagagacaugggccaggcgcgguggcucacgccuguaaucccagcacuuugggaggccgaggugggaggaucacgagaucaggagaucgagaccacagugaaaccccgucucuauuaaaaauacaaaaaaauuagccaggugugguggcggucgccuguagucccagcuacuugggaggcugaggcaggagaauggugugaacccaggaggcggagcuugcagugagcccagaucacgccacuguacuccagccugggcgacaaagcaagacuccaucuccaaaaaaaauauauauauauauauauauauauauuaauuagcugggcgugguggccagcgccuguagucccagcuacucagcgugaacccgggaggcggagcuugcagugagccgagauggcgccacugcacuucagccugggugacagagugagacuccgucucaaaaaaaaaaaaaaaaaaaaaagaauagagacguggcaguaaacagaacaccuccuuauggaggugaugucuuaguuggaaauguggcccgacacagauucguaaaguuucuuuuuuuuuuuuuugagauggagucuugcucugucauccaggcuggagugcaguggugcgaucucggcuuacugcacgcucugccucccagguucacaccauucuccugccucagccuccugaguagcugagacuacaggcacccgccaccacgcccggcuaauuuuuuguauuuuuuaguagagacgggguuucaccguguuagccaggauggucuagaucuccugaccucaugauccgcccgccugggccuuccaaagugcugugauuacaggcgugagccaccgcacccagcccguaaaccuucuuaaaacaugagauuuuuugugugugauuuuuuuuuuuuuuuuuuuuugagacagagucucacucuguagcccaggcuggagugcaguggugcuaucuugguucacugcaaccucugccuucuggguucaagcgauucuccuaccucagccucccgaguggcuggaauuacagguacaugccaccacaucuggcuaauuuuuuuuguacuuuugguagaaaugggguugcaccauguuggccaggcaggucucgaacuccuggccucaggugauccacccaccuuggccucccaaaauucugggauuacaggcgugagccacugcacccggcugugauuuuuuuuuuuaagcucaucaccuaucauuaguguuaguguauuuuauguguggcccaagacagaucuuccaguguggcccuguguacccuucacccagauucccuaauguuacuaucuuauguaaccauaguauaauuaggaaaaccaggaaauuaacagugguacaauacaaugaacuaaaguuuagaccuccuucaaaguuuaccagcuuuucccacuagagacccucacuucagguucugucguuuuucugagugaauuggggugguuugucacuggcagagggagggaagagagaagguguagaagggauguagaaaugggaaaagcugcugacugggguugaguuuuguuuuguuuucuagagacagggucaugucuggcaaggcgcgguggcucacggcuauaaucucagcacuucaggaggccgaggugggcagaucacgaggucaggaguucgagaccagccuggcaaacauagugaaaccccaucucuacuaaaaauacaaaaaaauuagccaggcaugguggugggcgccuguaaucccagcuacucgggaggcugaggcaggagaauugcuugaacccaggaggccaagguugcagugagcgaagaucgcaccauugcacuccagcccggccaauagugcgagauucuguuuccaaaaaaaaaaagagagauagggucuuguucugucacccaggcuggagugcaguggugugaucauagcccacugcaaccuuaaucuccugggcucaagcaauccuccccaccugucucuccuaaguaggugggacuacaggcgugugccaccaugcccaacuaauuuuuguaucuucauuuucaguagagacagggucuugcuauguugcccaggcuggucuugaacuccugggcucaagccauccuccugccucagcuccccaaaguguugggaucacaggugugagccuuuuuuuccucuuguuuuucggggggaauucaucuauuuguuccggugacagcacagcuuacuaagagugaguaacugaagcaggagcccauuccaggauagguggaaggaguaguagagcccagggggagcugagagauugggaggacagggaagguugggguaggaaggggacuguagugauugaguaggaaaggcugacggacaggcucggucagauaaggcaauuccagggauggggguuucauguggaacugguuggacauuugcagaacagccaaguaaauggccaaagucagguggucaagguguguuuucuguuuagagcagaaaaagucagaaaucuugagguuaggaugcugaaugagcccccagcugaugcaaguaucaagaaagagggaccccuugagccagguguaaagucuggaucuuagggagugaacagggcagggcugaagccuugaacaguuccuagcuuaugacauaaaaccacucagucuaucuauggacugcaugucucccuucucugguggcuggaaggagaguccuggggguaugcuucauacaacacaaagcaucugauccuuaagaaacaaguguaacuuuaagaaacaaggccagggucaagcaugggguggcucaugucuauaaucccagcacuuuggaaggcuaagccaggaggaucgcuugaggccaggaguuugagaccagccugagcaauauagcaagaccccaucuccucaaaaauuuuaaaaagcuagguguggggacaugccuauaguccuagcuacucgggaggcugaagagggaggauugcuugagcccaggagauugaggcugcaguaagcuaugaugauaccacuguacuccaaguccaaagggagggcccagaacaaaucugucuucaaccccauugccaauugucaguuauaucagaacaugcccguggucccugaucuuuuucaggaaauuaaaaagcugguccuuauagcaaacaggaacucagagcucuuggcgaggcaguaugaugucuuaguguaugggcagcaugccuguuuucuugcugauuuugcaagugcuccagaaauguagacugguuuuuuucuuucuuauuuuaguauuucauauccugauuuuuaaauguugggccaaaaaaaugacacaucuggcuggacaugguggcucaugccuguaaucccagaacuuugggaggcuaaggcgggcagaucacuugaggucaagaguucaagaccagcuuggccaacauggugaaaccucgucucuacuaaaaauacaaaaauuagcuuggcauggcagugcacgccuguaauuccagcuacucgggaggcugaagcaggagaaucacuugaacccugaaggcagaaguuguggugagccgagauugugcuacugcacuccagccugggcgacagagcaagacucugucuccaaaaaaaaaaaaaaagugacacauuuguaaggaugauucaugauuuaggccacugggucacugugggguacaaguagauggcuauuccucagggcuggauguggggcucacccuugggcaugagggaaugacacaacuacuagguauggguauccaaggaaaaggaugucuucaaggaauucgcaguuucuguuaaagcagaaugggccccucaggaggcucauucccgccuaacuguugucauccugucaucagcugcauucauccgggucgugggcucggaguuuguacagaaguaucugggugagggcccccgcaugguccgggauguguuccgccuggccaaggagaaugcaccugccaucaucuucauagacgagauugaugccaucgccaccaagagauucgaugcucagacaggggguaagugaugcugaaacaaggcccggggucuuggacaggcuugucgcaugggaugccugggacugacugugcugugcacucucagccgacagggagguucagaggauccugcuggagcugcugaaucagauggauggauuugaucagaaugucaaugucaagguuugggguuugggauggacaaggggaggugugguguaggaacuggggaaaguugggggcuggcaccuaaggggugguuaucgugacaggaaggagguaggagugcagagaucugagcuggccugccccccaaugucagguaaucauggccacaaacagagcagacacccuggauccggcccugcuacggccaggacggcuggaccguaaaauugaauuuccacuuccugaccgccgccagaagagauugauuuucuccacuaucacuagcaagaugaaccucucugaggagguugacuuggaagacuguauccugcuccagaagucagggaggggcccuaguugggaacggggauuagaucuucagcucaacuucugccagcaccacagcccagacugugcaggugggaccaagguccagggaggaggggaggugacagagauggccaaagaugacuuccagccccaggcauuuaccccaucacacagggaauaguuuccuuaacucgcugcagauguggcccggccagauaagauuucaggagcugauauuaacuccaucugucaggagguaaguggugguuucucucuggauccaggcagcgggugugugaggacccuucuucucugaaccacucugcugcaguccuguccccucauggcugcccugggucgugggcgccaucucucucuuccucuaccaucacuagggguggauaguacagggguaguguuuuuguguuuugcuuugagacagggacucacucugucgcccaggcuggagugcaguggggcaaucaugacucacugcagugauccucccaccucagccucccaaguagcugggauuacaggcgcccaccaccagucuggcuaauuuuuguauuuuuuguagagacaggguuucaccauguugcccaggcuggucucgaacucuugggcucaagugaucuguauaccucagccucccaaagugucgggauuacaggugugagccacugugcccugccacaggaaguagauuuuaacucucauccuucaacagaguggaauguuggcuguccgugaaaaccgcuacauuguccuggccaaggacuucgagaaagcauacaagacugucaucaagaaggacgagcaggagcaugaguuuuacaagugacccuucccuucccuccaccacaccacucaggggcuggggcuucucucgcacccccagcaccucugucccaaaaccucauucccuuuuuucuuuacccaggauugguuucuucaauaaauagauaagaucgaauccauuuaauuucuucuuagaaguuuaacuccuuuggagaaugugggccuugaauaggauccucugggucccucuuaaucugacagaugagcagacgaggugcauggccuggguugcagcuugagagaaccaaaauauucaaaccagaugacuuccaaaauguggggaaagggauggaaaaugaaccugagauggaguccuuaaucacgggauaaagcccugugcaucucccucauuuccuacagguaaa

SEQ ID NO: 15078 - RNA, 5457 nt, Homo sapiens
aaaaacgaauucugaccuucguugugcuacauuuugugggaaaccauuggcccugccucuggccuguguuucuaagccucaagccaagauccuugagcaccuggggguugcgggagguaugugcugggcugaaugacaucauaggggcugggaggggaaguaaagagaaguugacuuuauuaacagcaaagguuuggggguggggaacaaacaagugaaaggcucacaaacagaccacuagaaaagugcuuugcugcucacaauaauggugucugaaccagcccugaaugcccugggacucagucacugucacuaucagcuucacuggaaucagaagcugcagcuucacugccauccuccugggccgagugcucgcugccacuggggaagggacuggcgcugcggcuguggcuccggcuccgcuggccacccccauugcugccgcugucugaaucauugucacugccaccuugggccuguccucuguccucaucaucagagucggcaucguccucagaaucagcaucacugccaaagaucuccucuuugucacgggcagcccgggccucauccucgcugcucucguccucaccacugccacucuugucacuggccucgucccugucaccuuccucccguucacucucgcugcccgagugcucaucuucacugcccuccuucucacugcugcugcccuucuccugcuccucaucuggaagggaguggagagagaugaaacccacuuuuccacccucccagggcucccagagucuggccuguccagauuuaccugagcccccagcuucuuucucuucugucuccaucuccucuuccucuuccuccuccgguucgugguuuucuagcugggccuuccgugccuccuggaagcagcaagauuggaaugaggggaaggaggguguucugcuggguuuuugucccccuccucaccuacaaccaccacccucccugccaugggugcccugagccaguggugcuuguuaccugagcuuccaguuccuucucauucaugucccgauguuugaccacaagcagggcguuggugccugacugaaccccagccuuggcccggcgcuuacuaaggcggacccugcagggggugaauuugggagagagaaguggaagaugcaguuaaagacacaccucccacuuccccgccccccagugaggggucuggucugacuugguuccccaucaauacuuagaguaaaugggaauaaauacagauugaauaagggcagcuaagcucaagguauugagggcaggggaaaggaaggauggcucccauggcaccaguuugguugcccuacacuguguguguguguuauacgguguauuuacauaaauacgggcaugggccauuuaacagggacacauucugagauauacaucaugugaacaucauacaguacucuuacacaaacguacauaguauagccuacuacauaccuaggcuguaaugguguagccuauugcuccuaggcuacaagguuguacagcaugugacuguacugaauacugcaggcaauuguaauacaauaguaaguauuuguguaucuaaacauagaaaagguauaguaaagauacgguauucuaucuuaagggaccaccauaagcaguccauuguugacugaaacaugcagugcauuacuguaugugucaguuaguuaccaacacuuugagaaaccaggagaugucaaaucauuuggauuuggggcuuuuggaagauaggaauuucuggccccacagcacagcaacagugggcuggaagugaauagugcccuccaugguugcccagaacuccaggucacucagaugcuaccagccacugcucuuuuacauuuccugccuggccuauggggucacaguucuuguaaucucugcuuuaaacagaaacucaagacuucccaacucuacaccagaggugcuggcauagcaguaaacuuugagccauaagggaagaguuuuggagucacauuuuugaacauggguuuaagcauuucauuuaaaacauucaugcuaauuuuauauauuacuccauacuuuggcaauguuuacuuucacaugaagucuguuacuaauacugggaaacuuggcccucugccuugcgcaaaggcucuaaaugucuccugcauuaagauauucuggcugggcgugguggcucacaccuguaaucccagcacuuugggaggccgaggcaggcagaucaccugaggucaggaguucaagaccagccuggccagcauggugaaaccccaucucuauuaaaaauacaaaaaaaauuagcuggccaugcuggcacacgccugugaugccagcuacucaggaggcugaggcaggagaaucacuugaacccaggaagcggagguugcagugggcugagaucacaccacugcacucuggccugggcaacagagcgagacuccaucucaaaaaaaaagauuuuuuuucuggcuccuccuguuagaaccaaguccagcucaugugcaugaccagacaucugcugcucuuguuuaccaaugcauaugacaaauucuuagguacaaaugaccuccaagguggcucuugcaugccccagggucuuaagaagcacagauccaggcuaaucagauaggagugugcugaguaccugguuuccaacucauuguaguaaaccccgucacccucucggaagaugaagaaguaguuuuccucauagcccuugcuagcuuuguucuucacguuccaguuguacucccgagcaauuuuguagucauaccugaagaugagggcacagguucagccccauuucuucccuaucccaauccccaaaacuucccaauccccaaaacuuaaccgcaacccacgcacacaucaucuggugcauaguccaucuccuccuccuggucccgcuuucguuucuucaacgucucuucuacaggcaggaaauaggccacaaacugguucccuuccucauccaucaugccccugguugggggaaaaggaguagcaaugaagugugaggacaagaggcagcaaggagcaggccaagguggacagcaggaccaccuaccuaaucauggccugagacaucaucuccaacgcagcugcaccacucguguccuugggggcugggucugagucaaagaucaccugagcacauggauugauccacaucuagggagauggaggcacugggguuagaugggaacaggcacaaauaggcugucccuuucuaccucccaccuugggccugaccuuaaagucugggaagacaggcaugaccuccaccggugugacucgggguuugcuguaaugcugugagaucugguggaacaaaaacaaggugaggaggagcucugcagccgcacccuugccucuccccaucccagucccucaauuacugauuucugggcauccucaaaagucuucucaauggcugugaucuggcuaucccugucuuuguauauuucuuccucgguaaacugcugcuucacagaaaccccaauccuaggaaugaagaaaaagguccuuaggggccacuggacacaccuaauaucuccaccuucccucucuuccuguuaguaacuuacuugaccucaggcuucucauuggagaugccauaacgguugaacucaguggagauguacucugucuuucgcauccauggcaccaccuucgcgugcugcugggaucuggggugggaaaucagguaucucaggaccccacugcccuccugcuuguagggcccaccugagccagucuccaguacccauuugcuacccacucaccucuuggagcuggugggggccugaaucuccucuuccaaaaguuucucaucagcuggaucuagaagaacuagaggagagcggggggcaggaggaccaugagggaggcccaggccugagccuuugcugaccuagagcagacccucccugucuccccacacaccauuggggucgaugcgguaggugucaggauugaugagaucgauggugacccccaggucuggcucagucaggaggucauguuugugcuguuucuccaaggaaguggcuuuguacuggacgaaccuggguggggaaacaccuauugugguguuuggauuccagcuucaccccucacagcccugcuucccagaggcggagcuucucuggggaggaacucagaaugaagugucccccauggcagagucugaaagcuggcuccccagugggaagggacuuggacacugcuugcuccauuaacaauugagcagcuacuacuaugugcuaggguagguacugugcuaggcccugagcagacagcagccaacgagacaagcagucccugccuucaaggaacucauaccugaguaguuuucccauuccuuagucucaccuguucuggucgaagggguaggugaugaacuuggggucgaaggggauaucagggaggcuauugcaguacuugacucggcagaccacuccagaccuaggaacauuaguggcucaaaagugggcccccgcugccccaccucugcucccagccccacugccccaccgcuccugggaaagcacaguggggcucaccucucaggcagaguccggugggaauugggccuaguggagaagaaagaaacagugauagguggagaggacgggauugacaggagaaugaaaaaggcuuccccaaccuuucaaaagguaggaggggugacaaaugcugguuucuuuggguggugguguggggaguguccaaaugcuuuaauggaaggagacaaauguucaauuuauuuaggaagaaaugcccccaaaagcuuuaaugaacaaggccaagugcucaaucccuuuugcaggagauggcuucaagugcuuuaauaaagaaccauguacucaaucgucuucggaagaggggucuccaaacgguugacuggagggaucccuucuggagggagucuccaaaagccuaaucccugaacugcacggcggggaggaggggaacaccugaaucucagaaggaacccgcccccuucgucaaaggugagcgcuucaugacgucacgggcagaccugggggcuggugacguuguucagcagaaacccucucccgaucccccgccuugcugcaacagaaaagcguggcgccuaccuguggccauccucccgcugggccugggucuggauggugggcgccauagcgacgaggcgacggcagcccggacgggguccuagcgggaccgaagggggacgcagaggggcgugccgacuucaggggacgccugauccgaggaaggcccagcuuggcgccgcuccccgcggaaaguggguugagaugaggugggcgggcgagaagagcuccagcgagacucaggugaacgcgcaggcagcaccggggacggacucgaagcuccgguuccaccaacugccgccaagacgcugaggacccaacgggucuccucaggccgcgacgccuucgggga

SEQ ID NO: 15079 - RNA, 2775 nt, Homo sapiens
gaugucagaaguggaaucugagggaaaguucugaggaagucucaggaagcgcugggaguggguggcugauggagggcaauuugggagaaaauucucuaaaaagugucugaggaagguguggucuucugagacugguccuggagugggaugacagagggauguuuuuaggaaaaacucuucagagaucucaguugaggagaaagcugaguaaagucuccaaaagaguauauggggaaggcggggucuucugagagagugucagaggagaggguuuuucagaaagaauuauaggacuuucucagagcaagagcucggguuauuuugggggaaaauuaggugugugugagggucuucuucaagggauucuagaggauuuaggggaccugugugagcaaguucagggagggauaucucuagaaaagucccuuaguaaggcagaaguauugauucaagggguucugguggugucaggaaggucuuggagggauuucaagaacauacgucaggagggcuccagggggucgcuggggucucuaagcugugugugugugugggggggggggguccugaaaaccugcauaucagaggggucaccaagagaaucuuacggucuuacagggguugugaggaggaucuucagaaaauuccucuaaaaccggucugcaaggggggauucugagguguuagugaaggggaguucuacgggaucugagagaaaaaccaugaggaaaguuuucaggauccuuaaacaauuuuuggagcgugugaugugggggacuggaaaagauguggaguauguaaaagggauuuuggaagaagcuuuuggaauaugaugcugagaguccucuggagauuucaggcaauugcuggagauuuuuagaaugaguggggguggggaaggggaucccggugaagaucacugggcuacaugagggugaucucuagggcauuuuaggguggugagaccagggggagacaggaggccucugggggagacuuuugggaucuguggaaagguccagagggauacgugaagggggaguguguaugagagaugguugcaauacgguggggagggggauggagucuucuaggugaguuuuugggaucugggggcauuucacaaagucugugaggaagauuuauuuuggggauaugggaaggagaucuucagggaagaugaucacgguccgucgggggcauucugaaggacuucugggagggggaaucagaaaugcaggggguaugagcggaaaaucuccaaggagguuucuggaaugggguaagugggagggaaaauucuuaggauccgggagggggaagucgggugagccuguugggcugugagaggcagggcuccgggggagaguucuggaauggacagggguccggagggagccuuggggaggugugcagggcucgugagggaggcuccuggagcagcuaugagagccacgcuguggaauggacgaggaguggccuccgaggacuauuucuggagacaggaggaggacgggggcuucggggccaaagggcgggggucugcgaggaaagcugcugggacccaugaagggcucgaggaggcgacuccacgggagggguggguuuugcggggaccuuucagggcgcacacgggggaucggcaggcuuuccggggcucuccgagggggaugugcgggggguccugaggagaggcccccggcccggccccucggcaaucccgagggcaugagaaagauuucggagggaagcuucggccagggcccaggagggagacuggggacgggcgcggggcuucucccguggggcccggccccccgaggcccgcguuccgcacccgcccgccgccgccgcccgcgguucggggucccugagggggcggggccgcccgcgcggccugggucgcccugaggggagccccgcgcgccccgacucgccgccgccccgcgccggcccggcccgagacucaccgccucggccuucgccgccaccgccgccgcucgggccuccucaggccaccgccgccgccgucgcccccucucgggcccgcaagcuccccucccuccucccgcaccgaccaccgccgccgccgccgccgccgccgucgcgcugcgucaccgcgccgugcgucaccgccccuggccccgccccgacgggggccgccgcgcgccggcauuagcucacgcccgggugacgaacggcgcgccagccaacgggcggcgagggcagcccgaagggcgggaggugugagccgaguaaggcggggucgcggcgaggggggagcgacggugguggaacggggcccaagaggcccgcccccuccucggcgggauuggucggacgugggggugacgggcagucggccaggccugggguuuggggcuggggggcggggaaggggcggggcgcgcggggcguugcccagggcaacgggcccggcggagucugagguugggccuccaggcccgcagggggcaggcucgcgcgcguccaccccagcugccccgagcgaagucacaguuccugauucaggcguuccaggccuccucuuccccgccccuuggguggcccgccucacccaaggcuguccucagugggcgucugcacucgggcuucugggcgcucggcuuucucaucgcgcuguucucagccuugccgcuugcucucuccgaugggaauggcgaggcgagaucuagccuuuagggugggaagagaaugcacagaaagcgcuaaggaucaaggaggcugucaauaaacgggaguuguugcugugac

SEQ ID NO: 15080 - RNA, 3243 nt, Homo sapiens
ccccgcguggguuauaaggcgcugcaacccuggcccgcacagcgccuuggacccguuggacgcccaccaugccgccccgagggccagccucugagcugcugcugcugcggcugcuccugcugggggcgggugagugcgggaccugccgagugcgggaccugccaggggccggggagcggggacuccagugggagggggcaggcagugcacccaguggagaggcuucaggggccgagccuccagcgggggacaguacacccgccgggugggauggggaggggauguguggggaccgggacgcccauggagcuggggucgguaccggggacagcagccagggcggcaaagcccagugccaucuccuuucuccacagccaccgcugcucccuuggcaccgagacccuccaaggaggaggugaggaguguggaggccuugcccugccucaccuagcuggggcccugcccucccugcacagccugccccaugauccucauugcccucaaaccagcugcucuccuccccaucuccccugcccucaaccuccccucugacccggcaccccugccccccagcugacccgcugucuggcagagguggucacagaggugcugaccgugggccagguccagagaggacccugcacugcucuucuccacaaggguaaggaggccccgggccccacuugcccuccacaaccccaugggacccuacccuaccccacccaggguccugcccaggugcccacaugcucucccacccaggcuaccuggaggaagagguccucauucccagagcccuguugccuggaccagcggggcacugcccagcauucacaccugacagagccuggccaccagcaacacccuugugguucccugcagaggggccagauggggcagggaacauccccucccaggugggaugaaauaggacccucccccuguagucugggcagccccccugugagaccuucggcagggcccagaacuccucaaggccucaguuucccaauucaaacuccugaccucaggugaucggccgccacggccucccaaagugcugagauuacaggcgugagccuccauacucggccucaguuucccaauuggaugcuuagagaguguccuuucccuuucugccagaguugugcgggacagagccccacggcugugcguccaccgaggagaaaggccugcugcuuggggauuucaagaagcaggaggcugggaagaugagguccagccaggaggugagggaugaggaagaggaggagguagcagagaggacccacaagucugagguccaggaacaagccauccgcaugcaagggcaucgccagcuccaccaggaggaggacgaggaggaggagaaggaggagaggaagagggggcccauggagaccuuugaggaccuguggcagcggcaucuagagaauggaggggaccuccagaagcggguggcagagaaggccagugacaaagagacggcccaguuccaggcagaggagaagggggugcgggugcugggcggggaccgcagccuguggcagggggccgagagaggcggaggagagaggcgcgaggacuugccccaccaccaccaccaccaccaccagccagaggcugagcccaggcaggagaaggaggaggcuucggagagggaggugaguagggggaugaaggaggaacaccaacacaguuuggaggcaggguugaugauggucaguggagucacaacucacagccaccgguguuggcccugcaccaccagauccaucacuaguggaucacaguggccaagacugacaccacgacuggcuaacaacuuccgugcaaggccuuuaccuuauacuuccacacuacuguauggacuacagcaaccaagauggcaccauugcacagaagcaagccaccaucacuagcaaguuggccacugugaaaaguggcugcugugccuacuucacuaggugacagacagacaccauugcugggucauggaaaacaagaugucaccaugauugguggcaccaaaagugccguaacagggugggcaugguggcucacaccuguaauccuagggaggguuaauccuuucagaggccaaggugggagaaucccuugaggccaggaguuugagaccagcgugggcaacauagugaaaccgugacucuacaaauaauuuaaaaaauuagccagcaaugguggcgcacgccuguggucccagcucucaggaggcugagguggugggauugcuugaacccgggaguuugaggcugcauugagucaugauugugccacagcagucccgccugggccacagagcaaaaccaucuuaaaaaaaaaaaaaaaaaauggcugggcauggugguucgugccuguaaucccagcacuuugggaggcugaggcgggaggauuaccugaggucaggaguucgagaccagccuggccaacauggugaaacccugucucuacuaaaaauacaaaaaaucagccaggcaugguguugcaugccuguaaucccagcuacucgggaggcugaagcaggagaaucacuugaacucgggagguggagguuacagugagccgagaucgugccacuguaccccagccugggugacagagcgagacuccaucuuaaaaauaaaaauaaagcgccaucacgaggugcucaucccaggcaccuuugccagugccaagcuacugcuguuggcuguggucgcguuagccagcaccacucuuccgggguuauggcaaucagcauggucaccaucgcgguccacgacgaucagaacgaccgcugcuggaugccacuaugagaaccgacauggcccacaaucacagugaccgagguggccugccuuugaaggugggugcugacuaccccguuucugaccccaccaggaaaaggagguggagcagcuggagcacuugagagacgaacugaagaaggugacagagacgcugggggagcagcucaggagggagggcugaccccuaccucagucccuccuuccuccugacacacccuguggcuuaggacuguugaccccgaagccuccaccucaccuagcaccccacgccaccccuacccaaacaggggaggaggcggacgugccuuggaaccacacccaaggaggugagucugagcugggccgggggcugggcucagcccugacacaggaagcacccccacaccuaugcacucccacuccaacccuucugagugaauaaagcacaaagaaa

SEQ ID NO: 15081 - RNA, 10963 nt, Homo sapiens
ggucgcguuagccagcaccacucuuccgggguuauggcaaucagcauggucaccaucgcgguccacgacgaucagaacgaccgcugcuggaugccacuaugagaaccgacauggcccacaaucacagugaccgagguggccugccuuugaaggugggugcugacuaccccguuucugaccccaccaggaaaaggagguggagcagcuggagcacuugagagacgaacugaagaaggugacagagacgcugggggagcagcucaggagggagggcugaccccuaccucagucccuccuuccuccugacacacccuguggcuuaggacuguugaccccgaagccuccaccucaccuagcaccccacgccaccccuacccaaacaggggaggaggcggacgugccuuggaaccacacccaaggaggugagucugagcugggccgggggcugggcucagcccugacacaggaagcacccccacaccuaugcacucccacuccaacccuucugagugaauaaagcacaaagaaacgcacccugccuccgugagcagcacuugaugugacagggaugggccccagaaggacccggaggacugggaagacaagaucagucuggucucugguugucagaacuaggguuuuguuuauuaaacuggaaauuauauuaacaaugaaacaaaucacacggggcgggggucgucaggaagagguuuugaggcuggggugggaggcagccggguuuggcugcggcugcugugaaccacaaugucgucguauucauccugggggcaaaggggaccaggcagaggggcucaggcggcugucacuuugcccaccacccauguccucauagagcacccuaagaauuaggucucgccucaaagcccaaguuccccugcuccuggcucaaccucccaguuuccuagcucucagaacuccauuuucuuuucuuucuuuuuuuuuuuuuuuuuuuuaagauggagucucgcucuguugcccaggcuggaaugcaguggcgugaucuagguucacugcaaccuccaccucccagguucaagcaauucuccuaccucagccucccaaguagcugggauuauaggcaugcgccaccacgcccagcuaauuuuuguauuuuuaguagagacagggucuugccauguuggccaggcuggucucgaacuccugaccucgugaucugccugccucggccucccaaagugcugggauuacaggcgugagccaccgcaccuggccagaacuccauuuucaaggucauuucuacagaccaauuucuagccagccgccacuccagaguuucggcaacugagcuggcccuccuccaccccuucccucugccuuuacccaaauuccuccgcacccaucauccagcaccgcgccuugcccaaggacggaucuguauugcuggguucucugacuauaucucuccccaccgcuggcucggguccugccccagcacugccgguguucaaaucacugccacccaagguuuucuuuucgcagugugaguucuccaauucuugcugccuaaaaucacccccagcgcuaccacccacccccgcuguguucaccaaucacugcgaccaacgccuuuucuccaccccugccugaguucuaccuuugccacugccuuaguuuuucagccacuucugcccaagcucuucccaccaccccuguccaggucucuccugacuagugccccgugucacuggcgcugcugccugaguucucuaacagcagcccaaggucggugccuaauuaucuucuugggcuucuugccugccggucuauccugaccccccagcugggcugcccugucucuccuccugacucacgcccucgucuccgcugucgcugucgcuacugcugcugcaggggccggauuucucguccucgcccucgggcucaggggcuccgugugcacggaggaggcgggcgaggaugggguugggccggagcauggcacugccgaguggggugcggccaccguacaugcgggcagcaggguucgcgccugcccucaggagaagcuccagcacaucggcugccugggccuccacugccaaaugaagggggcuccggccgcacgugggcuccugugggggugcaacagaaaggucagagggcccgaagaggggacaagcccccucccgccgacggcaucuuccccgagguuggggcucaccgguuugucaaggucagcuccagcaucucggagcagccggaccaucuccacaucuuuguggauaacggccacguggagugggguguggccuggggacagagugauuggcgucagaugaugaggugagggccccccccaccccaccgugcuuugauccugggggagggucauguggcgugagggugauuagguuugggggcugguuccugaauucuuggguauggcaaagagguaccuggguaccaaaugccuaucucagauggccugagcuugcuggcaagugcuagugccugaguuguuugaagccuggggcccgcggguaaacagccuggggucuguggacagggagccuggauuuuggggccaggaggagacccaagucucugcucuuaucacucaaaggaccugagcuggcacgcuauuucacaccuguaaucccagcacuuugggaggccaaagcaagaggaucacuugagcucaggaguucaagaagcugccugggcaacauggcaagacgucucuacuaaaaauaaaaaauaaaggccaggcacaguggcucacgccuguaaucccagcacuuugggaggcugaggcggguggaucacgaggucaggagaucgagaccauccuggcuaacauggugaaaccccaucucuacuaaaaauacaaaaaauuagcugggcaugguggcgggcgccuguagucccagcuacucgggaggcugaggcaggagaauggugugaacccaggaggcggagcuugcagugagcugagauggcgccacugcacuccagccugggcaacagagugagacuccaugucaaaaaaaaaaaaaaaaaaaaaccuuaaauuaagguuccugcccaggcacgguggcucacaccuguaaucccagcacuuugggaggccauggcgggcagaucaccuaaggccaggccaggaguucaagaccagccuggucaacaugguaaaaccccgucucuacuaaaaauacaaaaauaagcugggcaugguagcaugugccuguaaucccuguaaucccagcuacucgggaggcugaggcaggagaaucaccugaaccugggagguggagguugcagugagccaagaucacgccacugaacuccaaccuggcaacagagugagacugucucaaaaaaaaaaaaaaaaaaaaaaaagguaccaaguagcugaaaagccugugaccugggggcgagaggcaggcccugaacacuggguccugaaugacgucaguccaucugaggaggggucuggucucagguggcugggcuuauaggcaggggagcagaaacuuggaugucagggcugugggcagaugagcccuucuucccaugaggcugaggagggcugucucugaacccugcugcccauugcugggagccuggggugccagaguuucacagagggccugagcucugcauuccccgguccuggguaggguaggggucugcaauacacucugcagguggggagcccgggggcccgacaacuggauccuggcagcucugggucugugggugacaggucugcaucccaagugaccuggggccuccagguggggguccuggguccuacauauccaauucucaaucaucugggcccugaguggaggucccuggucccgaugugugggcuccugaagccuaggcaugauuucccaaggagcucagucucaaaucagggaagcugagcccagggccaggugcucucgccuagcccaggagcugaguccuucccuggugacgacccucacccucguaguuuucagccuccagcugcagcuuccaguccuccucacucuccucuucuuccuucuccaagucggaaucgggguacaaggcgacagggguaugguuggugucgggaguacggucagggcccugagcgagguaggugucgggggcuucccuggggcgccgggggcggggcugaagcagggcacgggcacaggcgugugcccccacacggcaggccaggugcagcgccguguggccccuacgcuccgccacacacagcccggcgccugcugcguacagcuucuccaccguggaugucucccccaggauggcugccaggugcagggcugucugcagaagcagaggacaggcgguagggagucacacugggaacccuggaccccaagcccuacaccaucccucguggcucaccuggccuaggucauucugcagguccauguacucagugccggccgagaagccuagaagaaaauccaggaaggguucaugcugaugaaucacagccaagugcagugcccuggggacaaagaccggggugagagggcaaaguucaaguccucuugcauuccuucauugaacaaacauggggcgccuacuguaugcuaggccuugugaccacaguucuggaacccccugucagcuaucugggaggucagaggucagaguuucaucagcaaauucguggaaucaauguuuauucagugggauuuccacuucugcccaaaaugaaguaacauggaccagaauucacucccacgugaaacaaacaaacaaacaaacaagagucagacgaaauacgguauaugaagcaacaguguugaagacacuggacaucgugcaaugaaucacagugaccccugaaagacaggaaacacgaggugggccccacacuugacugccacagcuuauugucuugagagaguuucaaagccacggugcagagaggggaauccaagcagagcgcaucagguugucugaggucaggagauggauauggaggaagagucuguggaggccagcguggcuagagucacaggacagaguacaaaacagaguugccaaaggagagauugcuggggaacugcaggagguucucuuguguauuccggagaauacggaucagccaugccugugagucuguggggaugggaaaaccauccaaaaggauuucagaaaagugcucguuacucacacagggccaggaauagugaguguucccaccagccaggcuggaaaaacaucaucacaggcuaucgggugggauacucaggaaggucuugccucaauaguggggaauaauuaacuguagauggggcacugcucaacacccaccuaacaaaucauaaaagcaaaacuggaaagacucaaacuacuuccgaguaauuuaacuccaucccagaauaauauucaagaauauuuauuuauuuauuuauuuauuuauuuauuuuaauuuuuauuuuuugagagagagucuugcccugucgcccaggcuggagcgcagugacacgaucguggcucacugcaaccuccaccuccuggguucaagcgauucuucugccucagccucccgaguagccggaaccacaggugcgugccaccacaccuggcuaauuuuugcaguuuuuaguacagacaggguuucaccauguuggccaggcugaucuugaacuccugaccucgugauccacccgccuuggccucccaaagugcugggauuacaggugugagccacggcgcccggccucaagaauauuuauaggaauacagaauucuccagacuaacaaggcaaaauucacaaugucuggcaccuaaccaaagauuaucaggcauguaaagaagcaggaaaacaugauccauaauaggaaccaucagugaauugaaacugacccagaaaugacagagauguuagaauuugcaaacaagaauauuaaaacaguucauuaugcugggcacgguggcccacaccuguaauccuggcacuuugggaggccaaggcgggcagaucacuugaggucaggaguuugagaccaaccuggccaacacgaugagacccugucucuacaaaaaauacaaaaaaaauuuagccaggcaugguggcaugcgccuguaaucccaccuacacaggaggcugaggcaggacaaucauuugaaccugagaaauggagguugcagugagcugagaucgugccacugcacuccagccugggcaacagagugagacuccgucucaaauaauaauaauaaaauaaaauaaauuucuuuuacucuaugugaaauggcauaauaucacuuuaagguagcccaugauaaccuaaaguuguaaacuaucaacccuacagcaggagucagcaaacuuuuucuguaaggagccagauaacuauuuuagucuuuguaggucauaugguuucucuuuuugguuuuguuuuucuuuuucuuuuuuuguuuguuuguuuuguuuuuuugagauggagucucguucugcugcccaggcuggagugcaguggcgugaucucagcucacugcaaccuccgccucccggguucaagcgauucuccugccucucaaguagcugggauuacaggcgcucgccaccacugccagcuaacuuuuuguauuuuuaguagagacaagguuucaccauguuagccaggauggucucgaucuccugaccuugugaucuguccgccuuggcucccaaagugcugggauuacaggcaugagccacugagcccagcagccauacaguuucuuuugacuacucgacucugcugugucagugcaaaagcagccacugacaauauguaaaugagugagcuugcuugcguuccaaaagaacuuuauuuauggagcuugaaauaugaauuucauacacuuucacuugccauauaauauuauuauucuuuugauuuuuagaaacuguuuaaaaauguaaagaccauucuuagcucacaaccauacaaaagccauauaauauuauuauucuuuugauuuuuagaaacuguuuaaaaauguaaagaccauucuuagcucacaaccauacaaaagcagauggcuggcuagauuuugccuggaggccauaguuugccaacccccaccuuaaagcaaccacuaacauaacaaaaagaggaauaucuaauaagcaaacaaaagaaauaaaaugaggccgggcgcgguggcucacgccuguaaucccagcacuuugggaagccgaggcgggcggaucacaaggucaggagaucaagaccacggugaaaccccgucucuacuaaaaauacaaaaaaaauuagccaggcgaaguggcaggugccuguagucccagcuacucgggaggcugaggcaggagaauggcaugaaccugggaggcggagcuugcagugagccgagauugcaccacugcacuccagccugggugacagagcgagacuccaucucaaaaaaaaaaaaagaaauaaaaugaaaaacacuauacagaaggagcaggauugaaaaaaaaguaacaaaaacuauacccaauaaaaggcaaaaaggagggaggaaaaagaaaacauagguaaguagaauauauauaauagacaugggauaaauuuacacaaucauaucaauaucaaauuaaauguaaauggucuaaacacuaauuaaaaggcagagacugucugggcacagugguucaucccuguaacccagcacuuugggaggccaaggugggaagaaugcuugagcucaagaguuugagaccacagcugcacacaguggcucacaccuguaaucccagcacucugagaggccacagcggguggaucaccugaggucaggaguuugagaccagccuggccaacauggugaaacugcuguugcuacuaaaaauacaaaaauuagccaggugugggggcacgugccuguaaucccaaauuugggaggcugaggcaguagaacugcuuaaacccaggagucagagguuucagcgagcagagauagugccacuauacuccagccugggugacagaacaagacucugucucaaaaaaaaaaaaagaguuugagaacauagggggacaaaaaaauuuaaaaauuugccaggcaugguggcaugugccuguggucccagcuacucaggaggcugaggugcaaggaucacuugagccaggagguuguggcuauaguaagccaugaucaugccacugcacuccagccugggcgacagagugagacuucguuucaaaaaaaaaagucagaacagagaccaauugaauagaaaguaaaaaaaaauuaaugaaaccaaaauuaauuaaugaaauuuaaugaaaauuaacgagacuauaaagcugguugagaucaauauucagugccuccuggaucaggcccugcuugcaucacugggcauacagcaguaaacacaacagacaaaaaacccaguacaaucccucaucugggccuuugcaacugcaguuccuucuccuugaaaugcucuuaucuuguuuaucuauugccucauuuuccugcuuuauuuuucuccaaaguacuuaacuaccucugacuuuauuuccuuuucuuacuuucuauguuucuuucuuucugcgugucuuucuuuguuucuuccugucuuuccauuucuuuccuuccuuguggucuuaucaaucuguuuauuuagcuccacuaaaauguaugcuccacaagggcuuaaguuuuuguuuguuuucuucacugccuuuaucacuagcaccuaaacggagccuggaacgugguaauguguaaagaauauuuguuuaacagaugaauccuuggucucauggagcuaacauucuuuuuuuuaauuuuccuauuuuuuuacuuuaauuaggaauucaacauagaagagcuuacauucucucucuuugaauuuaagauuugaagaacacugcucagaagacaggaucuuagagucagggaccaaguauuaauuucggaaaucaaacucuagggcucaaaucgggaacuaagaaucaaagaucauauuuggagguuagaagucaggagaagccacaguucuaacagaagucucaggacuggagucagguuuggguaucaguggauacaauguggauuccaggagcugagaaucauaguucaagaaaagaagguaagaaaugauuggguuaggaucauagcuagauagaagauugguuuuguuaaaaguuaggacucggggguuagaggucaggaaguucagcaucggaagucagauuuaggaguaugagguuaggaagccucagggaucagagauuaaugaggaaugugacgccggguccuagggcuccguuuggcagccuaagguucacucacguguccccauccucagugacguagccgaagacgaggggagcccacgacagccccgggcccaacuccgcgcccaacccagguccuccgggggccgcugcguccggacccagggagcccaggccgcugucgcaccauucaucugcgucggcagcuuuucccaagcacgcgaccccagccauggcccccgccgccucaggggccccccgcagucgcccgccuguagcugggcuuugccgggaguucuggagcuuccgcccugcgggaaauuccccaccacgcccccugauucacccaaugauaauaugcugaaucgcucacaccccgcccucguacugcauccugaccaaucagaguauucgggaggacuacaacucucuagccguucccacauuuuccgggcgcccuuuaccaacauggcugcugacgccacgccuucugggacucguaguccgguccucgcgcgcuuucuuaccuaacuggggcgcucuggguguuguacgaaagcgcgucugcggccgcaaugucugcugagaguuguaguucugugcccuaucacggccacucccauuucuggugccgucacgggacagagcagucggugacaggacagagcagucggugacgggacacagugguuggugacgggacagagcggucggugacagccucaagggcuucagcaccgcgcccauggcagagccagaccgugagucggggauccggguaggagggucgggccgcgccggggccuggcugaaugcugcaggccccggggcccaaggguggccgcgguggggcgggaaguagggagcgcuucggggagugggauucugagggcuguugcuuagcgaucuguaucgcuaggcugguggguuucugggucgcaguguguucaggguucguuuaccacauccacuugccaaguugccaaugaucgcguguuucucgcaccuugguugcuaaggucccucgcugcaaagaacauaaguugccccggucccgcuugcuauggguaccugauuguuagaggcaaccagaggaugcugagggaccccugcugaccccuccuauggcuuccccuuguuccgcgccucuccuaaaccuaccgccuccacugcaccacugcaccucccuccuaaaccugccucccagccaaagcgucucuucccuucucuuuuccuuucuaaacuucccucugccuuguaaaucuaacccuccccgcacacacacucacacacugucguguccuuccuaacuccuccugaguguuccuucaugcccugaauccccuagguaggaggaggaggaucgcuugagcccaggaauuugaggcugcagugagcuaugaucgcacuauugcacuccaaccugggugacaugagcgagacccuuucucuaaaaaguaaaaaagaaagaaaguaagucagggccagaaacaauggcucaugcuuguaaucccaguacuuugggaggccaaggugguuggaucgcuugagcccaggaguucaagaccagccugggcaaaagccccuacuuucucccugucccccuaaaucuuccucuccagccucucugccccucacuaaucaccucucccggcaucacuuugcauguagauaagaucuuuucuccguccccucccucccucugcuccauuuuuac

SEQ ID NO: 15082 - RNA, 10963 nt, Homo sapiens
guaaaaauggagcagagggagggaggggacggagaaaagaucuuaucuacaugcaaagugaugccgggagaggugauuagugaggggcagagaggcuggagaggaagauuuagggggacagggagaaaguaggggcuuuugcccaggcuggucuugaacuccugggcucaagcgauccaaccaccuuggccucccaaaguacugggauuacaagcaugagccauuguuucuggcccugacuuacuuucuuucuuuuuuacuuuuuagagaaagggucucgcucaugucacccagguuggagugcaauagugcgaucauagcucacugcagccucaaauuccugggcucaagcgauccuccuccuccuaccuaggggauucagggcaugaaggaacacucaggaggaguuaggaaggacacgacagugugugagugugugugcggggaggguuagauuuacaaggcagagggaaguuuagaaaggaaaagagaagggaagagacgcuuuggcugggaggcagguuuaggagggaggugcaguggugcaguggaggcgguagguuuaggagaggcgcggaacaaggggaagccauaggaggggucagcaggggucccucagcauccucugguugccucuaacaaucagguacccauagcaagcgggaccggggcaacuuauguucuuugcagcgagggaccuuagcaaccaaggugcgagaaacacgcgaucauuggcaacuuggcaaguggaugugguaaacgaacccugaacacacugcgacccagaaacccaccagccuagcgauacagaucgcuaagcaacagcccucagaaucccacuccccgaagcgcucccuacuucccgccccaccgcggccacccuugggccccggggccugcagcauucagccaggccccggcgcggcccgacccuccuacccggauccccgacucacggucuggcucugccaugggcgcggugcugaagcccuugaggcugucaccgaccgcucugucccgucaccaaccacugugucccgucaccgacugcucuguccugucaccgacugcucugucccgugacggcaccagaaaugggaguggccgugauagggcacagaacuacaacucucagcagacauugcggccgcagacgcgcuuucguacaacacccagagcgccccaguuagguaagaaagcgcgcgaggaccggacuacgagucccagaaggcguggcgucagcagccauguugguaaagggcgcccggaaaaugugggaacggcuagagaguuguaguccucccgaauacucugauuggucaggaugcaguacgagggcggggugugagcgauucagcauauuaucauugggugaaucagggggcgugguggggaauuucccgcagggcggaagcuccagaacucccggcaaagcccagcuacaggcgggcgacugcggggggccccugaggcggcgggggccauggcuggggucgcgugcuugggaaaagcugccgacgcagaugaauggugcgacagcggccugggcucccuggguccggacgcagcggcccccggaggaccuggguugggcgcggaguugggcccggggcugucgugggcuccccucgucuucggcuacgucacugaggauggggacacgugagugaaccuuaggcugccaaacggagcccuaggacccggcgucacauuccucauuaaucucugaucccugaggcuuccuaaccucauacuccuaaaucugacuuccgaugcugaacuuccugaccucuaacccccgaguccuaacuuuuaacaaaaccaaucuucuaucuagcuaugauccuaacccaaucauuucuuaccuucuuuucuugaacuaugauucucagcuccuggaauccacauuguauccacugauacccaaaccugacuccaguccugagacuucuguuagaacuguggcuucuccugacuucuaaccuccaaauaugaucuuugauucuuaguucccgauuugagcccuagaguuugauuuccgaaauuaauacuuggucccugacucuaagauccugucuucugagcaguguucuucaaaucuuaaauucaaagagagagaauguaagcucuucuauguugaauuccuaauuaaaguaaaaaaauaggaaaauuaaaaaaaagaauguuagcuccaugagaccaaggauucaucuguuaaacaaauauucuuuacacauuaccacguuccaggcuccguuuaggugcuagugauaaaggcagugaagaaaacaaacaaaaacuuaagcccuuguggagcauacauuuuaguggagcuaaauaaacagauugauaagaccacaaggaaggaaagaaauggaaagacaggaagaaacaaagaaagacacgcagaaagaaagaaacauagaaaguaagaaaaggaaauaaagucagagguaguuaaguacuuuggagaaaaauaaagcaggaaaaugaggcaauagauaaacaagauaagagcauuucaaggagaaggaacugcaguugcaaaggcccagaugagggauuguacuggguuuuuugucuguuguguuuacugcuguaugcccagugaugcaagcagggccugauccaggaggcacugaauauugaucucaaccagcuuuauagucucguuaauuuucauuaaauuucauuaauuaauuuugguuucauuaauuuuuuuuuacuuucuauucaauuggucucuguucugacuuuuuuuuuugaaacgaagucucacucugucgcccaggcuggagugcaguggcaugaucauggcuuacuauagccacaaccuccuggcucaagugauccuugcaccucagccuccugaguagcugggaccacaggcacaugccaccaugccuggcaaauuuuuaaauuuuuuugucccccuauguucucaaacucuuuuuuuuuuuuugagacagagucuuguucugucacccaggcuggaguauaguggcacuaucucugcucgcugaaaccucugacuccuggguuuaagcaguucuacugccucagccucccaaauuugggauuacaggcacgugcccccacaccuggcuaauuuuuguauuuuuaguagcaacagcaguuucaccauguuggccaggcuggucucaaacuccugaccucaggugauccacccgcuguggccucucagagugcugggauuacaggugugagccacugugugcagcuguggucucaaacucuugagcucaagcauucuucccaccuuggccucccaaagugcuggguuacagggaugaaccacugugcccagacagucucugccuuuuaauuaguguuuagaccauuuacauuuaauuugauauugauaugauuguguaaauuuaucccaugucuauuauauauauucuacuuaccuauguuuucuuuuuccucccuccuuuuugccuuuuauuggguauaguuuuuguuacuuuuuuuucaauccugcuccuucuguauaguguuuuucauuuuauuucuuuuuuuuuuuuugagauggagucucgcucugucacccaggcuggagugcaguggugcaaucucggcucacugcaagcuccgccucccagguucaugccauucuccugccucagccucccgaguagcugggacuacaggcaccugccacuucgccuggcuaauuuuuuuuguauuuuuaguagagacgggguuucaccguggucuugaucuccugaccuugugauccgcccgccucggcuucccaaagugcugggauuacaggcgugagccaccgcgcccggccucauuuuauuucuuuuguuugcuuauuagauauuccucuuuuuguuauguuagugguugcuuuaagguggggguuggcaaacuauggccuccaggcaaaaucuagccagccaucugcuuuuguaugguugugagcuaagaauggucuuuacauuuuuaaacaguuucuaaaaaucaaaagaauaauaauauuauauggcuuuuguaugguugugagcuaagaauggucuuuacauuuuuaaacaguuucuaaaaaucaaaagaauaauaauauuauauggcaagugaaaguguaugaaauucauauuucaagcuccauaaauaaaguucuuuuggaacgcaagcaagcucacucauuuacauauugucaguggcugcuuuugcacugacacagcagagucgaguagucaaaagaaacuguauggcugcugggcucaguggcucaugccuguaaucccagcacuuugggagccaaggcggacagaucacaaggucaggagaucgagaccauccuggcuaacauggugaaaccuugucucuacuaaaaauacaaaaaguuagcuggcagugguggcgagcgccuguaaucccagcuacuugagaggcaggagaaucgcuugaacccgggaggcggagguugcagugagcugagaucacgccacugcacuccagccugggcagcagaacgagacuccaucucaaaaaaacaaaacaaacaaacaaaaaaagaaaaagaaaaacaaaaccaaaaagagaaaccauaugaccuacaaagacuaaaauaguuaucuggcuccuuacagaaaaaguuugcugacuccugcuguaggguugauaguuuacaacuuuagguuaucaugggcuaccuuaaagugauauuaugccauuucacauagaguaaaagaaauuuauuuuauuuuauuauuauuauuugagacggagucucacucuguugcccaggcuggagugcaguggcacgaucucagcucacugcaaccuccauuucucagguucaaaugauuguccugccucagccuccuguguaggugggauuacaggcgcaugccaccaugccuggcuaaauuuuuuuuguauuuuuuguagagacagggucucaucguguuggccagguuggucucaaacuccugaccucaagugaucugcccgccuuggccucccaaagugccaggauuacaggugugggccaccgugcccagcauaaugaacuguuuuaauauucuuguuugcaaauucuaacaucucugucauuucugggucaguuucaauucacugaugguuccuauuauggaucauguuuuccugcuucuuuacaugccugauaaucuuugguuaggugccagacauugugaauuuugccuuguuagucuggagaauucuguauuccuauaaauauucuugaggccgggcgccguggcucacaccuguaaucccagcacuuugggaggccaaggcggguggaucacgaggucaggaguucaagaucagccuggccaacauggugaaacccugucuguacuaaaaacugcaaaaauuagccaggugugguggcacgcaccugugguuccggcuacucgggaggcugaggcagaagaaucgcuugaacccaggagguggagguugcagugagccacgaucgugucacugcgcuccagccugggcgacagggcaagacucucucucaaaaaauaaaaauuaaaauaaauaaauaaauaaauaaauaaauaaauauucuugaauauuauucugggauggaguuaaauuacucggaaguaguuugagucuuuccaguuuugcuuuuaugauuuguuagguggguguugagcagugccccaucuacaguuaauuauuccccacuauugaggcaagaccuuccugaguaucccacccgauagccugugaugauguuuuuccagccuggcuggugggaacacucacuauuccuggcccugugugaguaacgagcacuuuucugaaauccuuuuggaugguuuucccauccccacagacucacaggcauggcugauccguauucuccggaauacacaagagaaccuccugcaguuccccagcaaucucuccuuuggcaacucuguuuuguacucuguccugugacucuagccacgcuggccuccacagacucuuccuccauauccaucuccugaccucagacaaccugaugcgcucugcuuggauuccccucucugcaccguggcuuugaaacucucucaagacaauaagcuguggcagucaaguguggggcccaccucguguuuccugucuuucaggggucacugugauucauugcacgauguccagugucuucaacacuguugcuucauauaccguauuucgucugacucuuguuuguuuguuuguuuguuucacgugggagugaauucugguccauguuacuucauuuugggcagaaguggaaaucccacugaauaaacauugauuccacgaauuugcugaugaaacucugaccucugaccucccagauagcugacaggggguuccagaacuguggucacaaggccuagcauacaguaggcgccccauguuuguucaaugaaggaaugcaagaggacuugaacuuugcccucucaccccggucuuuguccccagggcacugcacuuggcugugauucaucagcaugaacccuuccuggauuuucuucuaggcuucucggccggcacugaguacauggaccugcagaaugaccuaggccaggugagccacgagggaugguguagggcuugggguccaggguucccagugugacucccuaccgccuguccucugcuucugcagacagcccugcaccuggcagccauccugggggagacauccacgguggagaagcuguacgcagcaggcgccgggcuguguguggcggagcguaggggccacacggcgcugcaccuggccugccgugugggggcacacgccugugcccgugcccugcuucagccccgcccccggcgccccagggaagcccccgacaccuaccucgcucagggcccugaccguacucccgacaccaaccauaccccugucgccuuguaccccgauuccgacuuggagaaggaagaagaggagagugaggaggacuggaagcugcagcuggaggcugaaaacuacgagggugagggucgucaccagggaaggacucagcuccugggcuaggcgagagcaccuggcccugggcucagcuucccugauuugagacugagcuccuugggaaaucaugccuaggcuucaggagcccacacaucgggaccagggaccuccacucagggcccagaugauugagaauuggauauguaggacccaggacccccaccuggaggccccaggucacuugggaugcagaccugucacccacagacccagagcugccaggauccaguugucgggcccccgggcuccccaccugcagaguguauugcagaccccuacccuacccaggaccggggaaugcagagcucaggcccucugugaaacucuggcaccccaggcucccagcaaugggcagcaggguucagagacagcccuccucagccucaugggaagaagggcucaucugcccacagcccugacauccaaguuucugcuccccugccuauaagcccagccaccugagaccagaccccuccucagauggacugacgucauucaggacccaguguucagggccugccucucgcccccaggucacaggcuuuucagcuacuugguaccuuuuuuuuuuuuuuuuuuuuuuuugagacagucucacucuguugccagguuggaguucaguggcgugaucuuggcucacugcaaccuccaccucccagguucaggugauucuccugccucagccucccgaguagcugggauuacagggauuacaggcacaugcuaccaugcccagcuuauuuuuguauuuuuaguagagacgggguuuuaccauguugaccaggcuggucuugaacuccuggccuggccuuaggugaucugcccgccauggccucccaaagugcugggauuacaggugugagccaccgugccugggcaggaaccuuaauuuaagguuuuuuuuuuuuuuuuuuuuugacauggagucucacucuguugcccaggcuggagugcaguggcgccaucucagcucacugcaagcuccgccuccuggguucacaccauucuccugccucagccucccgaguagcugggacuacaggcgcccgccaccaugcccagcuaauuuuuuguauuuuuaguagagaugggguuucaccauguuagccaggauggucucgaucuccugaccucgugauccacccgccucagccucccaaagugcugggauuacaggcgugagccacugugccuggccuuuauuuuuuauuuuuaguagagacgucuugccauguugcccaggcagcuucuugaacuccugagcucaagugauccucuugcuuuggccucccaaagugcugggauuacaggugugaaauagcgugccagcucagguccuuugagugauaagagcagagacuugggucuccuccuggccccaaaauccaggcucccuguccacagaccccaggcuguuuacccgcgggccccaggcuucaaacaacucaggcacuagcacuugccagcaagcucaggccaucugagauaggcauuugguacccagguaccucuuugccauacccaagaauucaggaaccagcccccaaaccuaaucacccucacgccacaugacccucccccaggaucaaagcacggugggguggggggggcccucaccucaucaucugacgccaaucacucuguccccaggccacaccccacuccacguggccguuauccacaaagauguggagaugguccggcugcuccgagaugcuggagcugaccuugacaaaccggugagccccaaccucggggaagaugccgucggcgggagggggcuuguccccucuucgggcccucugaccuuucuguugcacccccacaggagcccacgugcggccggagcccccuucauuuggcaguggaggcccaggcagccgaugugcuggagcuucuccugagggcaggcgcgaacccugcugcccgcauguacgguggccgcaccccacucggcagugccaugcuccggcccaaccccauccucgcccgccuccuccgugcacacggagccccugagcccgagggcgaggacgagaaauccggccccugcagcagcaguagcgacagcgacagcggagacgagggcgugagucaggaggagagacagggcagcccagcuggggggucaggauagaccggcaggcaagaagcccaagaagauaauuaggcaccgaccuugggcugcuguuagagaacucaggcagcagcgccagugacacggggcacuagucaggagagaccuggacagggguggugggaagagcuugggcagaaguggcugaaaaacuaaggcaguggcaaagguagaacucaggcagggguggagaaaaggcguuggucgcagugauuggugaacacagcgggggugggugguagcgcugggggugauuuuaggcagcaagaauuggagaacucacacugcgaaaagaaaaccuuggguggcagugauuugaacaccggcagugcuggggcaggacccgagccagcgguggggagagauauagucagagaacccagcaauacagauccguccuugggcaaggcgcggugcuggaugaugggugcggaggaauuuggguaaaggcagagggaagggguggaggagggccagcucaguugccgaaacucuggaguggcggcuggcuagaaauuggucuguagaaaugaccuugaaaauggaguucuggccaggugcgguggcucacgccuguaaucccagcacuuugggaggccgaggcaggcagaucacgaggucaggaguucgagaccagccuggccaacauggcaagacccugucucuacuaaaaauacaaaaauuagcugggcgugguggcgcaugccuauaaucccagcuacuugggaggcugagguaggagaauugcuugaaccugggagguggagguugcagugaaccuagaucacgccacugcauuccagccugggcaacagagcgagacuccaucuuaaaaaaaaaaaaaaaaaaaagaaagaaaagaaaauggaguucugagagcuaggaaacugggagguugagccaggagcaggggaacuugggcuuugaggcgagaccuaauucuuagggugcucuaugaggacauggguggugggcaaagugacagccgccugagccccucugccugguccccuuugcccccaggaugaauacgacgacauugugguucacagcagccgcagccaaacccggcugccucccaccccagccucaaaaccucuuccugacgacccccgccccgugugauuuguuucauuguuaauauaauuuccaguuuaauaaacaaaacccuaguucugacaaccagagaccagacugaucuugucuucccaguccuccggguccuucuggggcccaucccugucacaucaagugcugcucacggaggcagggugcguuucuuugugcuuuauucacucagaaggguuggagugggagugcauaggugugggggugcuuccugugucagggcugagcccagcccccggcccagcucagacucaccuccuugggugugguuccaaggcacguccgccuccuccccuguuuggguagggguggcguggggugcuaggugagguggaggcuucggggucaacaguccuaagccacagggugugucaggaggaaggagggacugagguaggggucagcccucccuccugagcugcucccccagcgucucugucaccuucuucaguucgucucucaagugcuccagcugcuccaccuccuuuuccugguggggucagaaacgggguagucagcacccaccuucaaaggcaggccaccucggucacugugauugugggccaugucgguucucauaguggcauccagcagcggucguucugaucgucguggaccgcgauggugaccaugcugauugccauaaccccggaagaguggugcuggcuaacgcgacc

SEQ ID NO: 15083 - RNA, 1603 nt, Homo sapiens
gaaggccuaguuaucuguggaggauugaaagggaugggcaguauuuagggcaauggaggaaggcuuggugauauuuggggcauuucuugagauuuggcaauguugaggggcugaaggguacuuguugguaauuuagagucugagggucuugcuauuuggggguugguggcaauuuaacgauauuugggggcagcuugugaaucuuggcgauuuguggggcaugucugaggacuuggaggaauuuggcagagcuagaggcccaggcauuugggguucauuucuggagccugaaggguauuugacaauauuuaagaaaugugaggggcuuugggaucugggagucauuuccgggaucuugggacccccucgagguggggccgggcagggucugacugggccaccgugcaggauggagcugcgggacuuccuccuccauuucgacaccgugcagaucugcucgcugagcccggaggugcugggccccagcccggaggggggcggcuggcacguccacaccuuccaaggccgcugggugcguggcuucaacuccggcgggagccagccuaaugcuggugaggccugaggggcccugagaggcuuccugggguggggggcgcuguggccggcuaggaaacccccuuuuuuccuccucccuuagaaaccuucuggaccaauccucaguuccguuuaacgcugcuggagccugaugaggaggaugacgaggaugaggaagggcccugggggggcuggggggcugcaggggcacggggcccagcgcgggggggccgcacgcccaagugcacgguccuucugucccucauccagcgcaaccggcggcgccugagagccaagggccucacuuaccucaccguuggcuuccacguguuccaggugagguccugggcaaagcugaggcuggagggaacccggaggguggaggggcggggccgggccaaggagcgggggaggcauggaggggcggggccagugggaagaggggagguguggagggcggggccaagggggaagagggggagugguggaggggugggacugaagaggaucggggaggaggggaggaguggaggagcagggccaagagggggcggcgcugggaggggaguagggggcuaguagggcuggggggccaggucucagaggggagagggagcuaagggaaugagagggaggggcucagggacagacagagggacgagguuagggacagagagaggcuggggguuagaagggccagaggggaccaaggauacagagaaggcgcugggagcgcagauggggaaggaagaguuggggaggggucggcgagggccugggucggggacugcggggcaaagguucaauaagggucuaauaggacgaagaaggagggagagagcacagaggugagaaggggcagggaggagacccugagcggcggccaccucuccccugccccgacgccccuugcucuugcuucuuucagauuccagaggaggugagucugggauggggucaaccggcccuggggcuuggucaaccugcccuggggcuuggucaaccugcccuggggcuuggucaaacugcccugggggugggggggcag

SEQ ID NO: 15084 - RNA, 2477 nt, Homo sapiens
ggccuucccucccagggacccaugggccaaggccccaggccaaaggggccccggggaagaugcaggccagcagcgcgagugggcuccuccagguggucagugggggcaggcccaccagccucaccccaccgccugcacccacccccguaggagaucgggcgcaucuccauugagaugaacgggacccuggaggaccagcugagccaccugaagcaguaugaacgcagcaucguggacuacaagcccaaccuggaccugcuggagcagcagcaccagcucauccaggaggcccucaucuucgacaacaagcacaccaacuauaccauggaggugcgcggcugccccgcccgcuggccuuuccaccagcauggccggcuuccucacuggaaaugguucgggccagugagaagauagcugucugcugucuguuguuuuucacucuguuuaaaaauuauugaagagaccagcacuuugggaggccaagugggaggauggcuugagcccaggaguucaagaccagccugggcaacauagcaagacccugucucuacaaaaaaugaaaauauuagccaggcaugguggugcaugccuauagucccagcuccccaggagguugaggugggcagauugcuugagccagggaggcagagguugaggugagccgaggucaugccaccacacuucggucugggugacagagccagacucugucucaaaaaaaaaaaaaaaaaagauugaaaagacuagaucaaaauguuuagacauuuuuaaaaauuacacuuucccuagcacugcucucaucaccaugacaaugccccucacaggacaagcuguucuaggggcccacagagggcaccguuugcccuguggccuuagcaguaucagccuugcucagggccagagccagccagcgggugccgggucagggcagcagcucccacuggcuaacacuccggggacauuacaagcuggucgccgucauauugguagcuugagaaaccaaaagacuggacacucuugauccaacccauacagguccacagaugcuucaaaccagaguuggcuuuuuuguuuuuuuccccugagagccaguggugagacacugaccagaguuuguccaaacagucuccacagggaucccggcacaagauucauggguccuugcccuucugcugccccuguagcugggaaacacacuuacuguggagacagacauuggcagaggcagcagggaggcaccauggcccguguccccugugagguguacaggagagcaggggcuuuccccagggcgggaggacaguucacaguccuccacgugugaaccacggugaggacaguucacagcacccggcccacgaucacgcccccgucuuuccgcagcacauccgcgugggcugggagcagcugcucaccaccauugcccgcaccaucaacgagguggagaaccagauccucacccgcgacgccaagggcaucagccaggagcagaugcaggaguuccgggcguccuucaaccacuucgacaaggugagcagccugccaccuccucggccucuccccucccgccguugccguaccagcccacaccuucgucucugcaucuguucguccauucccaucacaguugcugagcgucggccgccacucccagggccagcagggcccugccacugucaggguguaggugugcggcaccaagaccccagccugggccacuucacacgcacaggcagggggccggaggucccaaguccugccuucugggguggcauccucaccacccccagggcagaugaagucucagcacacccaggcuuugcgacccggucugugaaccuggacacagacaccccgcacagugcuuuuagaauucagauuugguccggcagccucaucagaggggcccugagcgccagaguuugcugccauccccagcccaccccugccgggcugacggacugagaagugugcagccucagcucugcaccuggcgcccccaggacaggauacaguccccucugucccacuccaaaucccaaaggcaaggagaaccccccccccgacccuccaccaguccugggacuuguccucaguucuguagcauccagcugccaccccugcugugggcagagaggucggggaggccucugccuuccuuugagcuuccgagguuggggaaaggaugaaaggggcccgugccgcccccgaccccacgugucccuggccaucuccuuguccauguugccucuaacucuguguuucccuccccuacgugucccuucccccugcccucugcaugugaccccgaucccucauccuggucuccacgccgccccucccgcacaccugccuucggauggccccggcaggaucauggcggggcgcuggggcccgaggaguucaaggccugccucaucagccugggcuacgacguggagaacgaccggcagguacugcacccugggccccagcgg

SEQ ID NO: 15085 - RNA, 11120 nt, Homo sapiens
uuuccuuuuaauucuucagacaugguuuccuuuaguucuuugaacauauuugcaaaauugauuuaaaagauaaauguuugauagaaugaauaaaugaacaaauacaugaacauacaaagaaauaaaugaggccaggggugguggcucaugccugcaaucccggcauuuugggaggcugagguggguggauugcuugagcucaggaguucaaaaccagccugggcaacauggcaagacccccaucucuacagaaaaagauacaaaauuaacagggcaugguggcauacaccuguagucccagcuacucaggaggcugagguaggaggauggcuugagccuaggaggcagagguugcagugaguugacaucaugcuacugcucuccacugcaacagaacaagacacugucucaaaaaaaaaaaaaaaaaggaaaugaaaaacuccaugcaugcaugcacauaugcacaaauaaaugaguguguaagcaggugaauaagcaaacuaaugaaugacauuucccgccuucuugaccacuuccaggaauucagcuagauggagaggaggaggaaccagaggaagagaccacccugggcagccgccucaugagccuguuggagaaagugcggcuggugaagaagaaggaagagaaaccugaggaggagcggucagcagaggagagcaaaccccgugaggacuggggucacuggggagagggcaggggugggguggguagccccaugccugcggagccucugggucccaaagagggcaugaggacagaugcaagggagggguagauaggcaggagugagaggggaagaguggcgggcaaaguggaagcaggcgugguggcucacgccuguaaucccagcacuuugggaggcugaggcggguggaucacuugaggucaggauuuggagaccagcccggccaacauggugaaacccccuucuccacuaaaaauacaaaaauuagcuggguguggcggugcaugccuguaaucccagcuacuuggagacugaggcacgagaauugcuugaaugcaggagguggggguugcagugagcccagauugcgccacugcacuccagccugggugacagagcgagacucugucucaaaaaaaaaacaaaaacaaagaugcaugcuggagguuugccuccagagaugggggcuguagaacguguguguuggaccagggugacacagccuaccagcuuaguggcaaaccucuaacuaagggauggcgguaacccugaaccacuguggcuuccguggccuuggggcuucucuuuucuuucuugaugagaggauuaccaugcugagggauuagacaagcagcuaucauuaauguugggccaauguguuauuuugcaaacuguauauuagccacaucuaacaaggacagauuuccugacguugguacagguuuuaucccacaacauucaggaaacuuuuauggggccaacuaugggccaggcacuguuaccagggcugggaaauacagccgaggggggaaagucaaagccccugcccacgaguuuagauuuuuucuuuuucuuuuucguuuuuuuuuuuuuuuuugaggcagggucucacugcgucgcccaggcuagauagagugcaguggcgcgaucuuggcucacugcaaccuccgccuccuggguucaagcgauucuccugcuucagccuccagaguagcugggacuacaggcgcgcagcaccaugccuggcuaauuuuuguauuuuuaguagagacggggcuucaccauguuggccaggcuggucucaaacuccugaccucaggugauccacccgccucagccucccaaagugcagggauuacggcugugagccaccgcacccagccaaauccacaguauuuuuauagaacaagugggauugugacaugugccuucaaaggugcauggcgaagugcuucuggucggcucugguaucuugcaguuguacaguuuauuauuccuauugaaauuuuuaggaagcccuugugggcuggauauuagggugaacagaacagagagauucuugggcgaauagaaaaaaguuugccaggcugggcacaguggcucacaccuauaacccuagcccuuugggaggccacaguaggaggaucacuugagcccgggaguucgaggcugaagugagcugugauagccccacagcacccuagccugggcaacagagcaagacacugucucuaaaagaaaaaaaggaaaacaaucugcuagaaucugccugcucccagcagguggagggcgcaggugguaguaacugggaaaacuucuggaacagggggccccuuccacauuguucugguccaaggccccaugugccgaccugcccugcauggugcuccaagccuugcauugucuccuucccagggucccugcaggagcuggugucccacaugguggugcgcugggcccaagaggacuucgugcagagccccgagcuggugcgggccauguucagccuccugcaccggcaguacgacgggcugggugagcugcugcgugcccugccgcgggcguacaccaucucaccguccuccguggaagacaccaugagccugcucgagugccucggccagauccgcucgcugcucaucgugcagaugggcccccaggaggagaaccucaugauccagagcaucgggugagacaccgcccuucccccuuacuuugcauauccccuuggguaaugaauacccucaggauacaauaacauucccuuccccaacuucuggcccauccucugggugaucucagucucucgauggcuagcucaccuccuggguaaugucuccuucccuuaccucuccgcccucagugguagcagcuccgcuucugugugacucucagcaggacauuccccaccccccccuuuuuuuuuuuuuuugugagacugagucucacucugucacccaggcuggagugcaauggcgcaaucucagcucacugcaaccuccgccucccagguucaagcaauucuccugucucagccucccaaguagcugggauuacaggcacgcaccaccauaccaggcuaauuuuuuauauuuaguagagacaggguuucaccauguugaucagacuagucucgaacuccuaaccucaggugauccacccgccucggccucccaaagugcugggauuagagacgugagccaccacacccagcugagguuuacccuuuuugagcuucaguuuccucaucuguaaaaccggggagagccaagccuacucugaaggguugugcuguggcuucagugagcucaugcgaauaauaauaauuaugguagcaguauugagcacucauugucaaauaaaucucauucacacaguaaacauuuauuaagcaccuacuucgugccaggcauuucuagguguuuuugagacagggccucacucuguugcccaggcuagagugcaguggcccaaucacagcucacugcagccucaacuuccugggcucaagcgauccuccugccucagucuccugaguagcugggacuacagacacacaccaccauacccagcuaauuuguaaauuuuuuuguagagguagggucuugcuauguugcccaggcuggucuuggacuccugggcucaagugauccuccugccuuggccucccaaagggcuggaauuacaaggcaaaagccaccaugcugggacaacauuugacaaagggcaacauggcaaagaucucugcccuagaggagccugccuugggugcacgccucagucuccuuaugagggaaacagggacccuuccucccacaguggcuguaggaauuuuuuuuuuuuauuuuuugagauggagucuugcucuguugccaagccuggagugcgcaaugucugcucacugcaaccuccgcauaccggguucaagcgauucucccaccucagccuccugcguagcugggauuacggguaugcgccaccacgccuggcuaauuuuuguauuuuuaguagaaaugggguuucaccauguuggccaggcugaucucgaucuccugaccucaagugauccucuagcuucggccucccaaagugcugggauuacacgcaugagccaccgcacccggccagcuguaggaauugagugaguucagaucuguaaaggcgguggugcuaggcacagagugagagggucaagaaugccaacgcugucacagugguggcuauggcccucuccggaccugggccccuggugaccccgcacacucugcccgugcacaggaacaucaugaacaacaaagucuucuaccaacacccgaaccugaugagggcgcugggcaugcacgagacggucauggaggucauggucaacguccucgggggcggcgaguccaaggugagggcccaggcaggugcuggggagcucaggggaggcagccacagagggcaggcccugaccacccugccugucccaggagauccgcuuccccaagauggugacaagcugcugccgcuuccucugcuauuucugccgaaucagccggcagaaccagcgcuccauguuugaccaccugagcuaccugcuggagaacaguggcaucggccugggugagaacccccgagcccaggggcugucccccagaacccacuccuggcaccccguccaggccugccccacuuuccaccagcucacucauucaacaaacacucccucucaacugugguucuggcccuguaaugaguaaugcuggggacacaauagugaccccaauagugacagcccagaguggucagagcuuggaugagggaaguacagaccagaggaggcaccugauccaggcuggaaaaaggguggucagggagggcuucccagaggaggcgagacaagcaggagugagauguucuccccaccucucgccccugcaggcaugcagggcuccacgccccuggacguggcugcugccuccgucauugacaacaaugagcuggccuuggcauugcaggagcaggaccuggaaaagguguggagggcagggcugggccccaggccuaagggaggaaaucgggccgcuacccggcugcuugggacaccugcugauuccaaacucauucuggggggcaauucuggaugguccagugcccaaccagaaggagacuaauuugcagggagagaacggcacccaguuguucauucaugggaugcuuccuggcugugggccgguccgcacuccacgcuucccgucugggggcagguccacagucuacgcuuccgggaugggggcggauccgcacucuaacuuccaggcugggggcggauccgcagucuacacuuccgggcugggggcggauccgcacgcuacgcuuccggguugggggccgauccacagucuaggcuuccagccagguggccuuggcacauuucuucgcucuccgagcuuccacuucuguguacaguggugaaaugcgugggcuccagacuucagcaacuuugcuucugcuccccucgcucccuggcuguguggccuuggauaagugacuuagacucuccagaccccuguugucucaucuguacaaugaauguagucauagaaacgacuucauggagucauucugaggauuaaaugaauuaauccaguaaaguguuuguaaaggggcagucaguaacguuagcugcuguuauauuaucauucaacaaauauguaguguuagcuuaccauaugcaaagcaguagcaauaugacagucaaaaaucccugucuggccaggcaaaguggcuuacaucuauaaucccagcacuuugggaggccgaggcaggaggaucacuuaagcucaggaguuuaagaccagccuggacaauauagggacaccuugucucuacaaaaaauacaaaaaguagguggguguaguggcacguaacuguagucccagcuacucaggaggcuaaggugggaggauuugauagagccugcgaggcugaggcugcagugagcuauggucacaccacugcacuucaccucagggacagagcgagaccccuuaaaaaaaaaaguggccagagaaagccucauugagaaagugacauuuguguaaagcucugaaggaaggugacaggucagguggucaucauggggaagagcauucuaggcagcgggaacagccagugcaaaggcccugaggcaggagcaaaccucauaagcuggaggaacagcagaaagacagcuguggcuggagcagagguagugagggugagggcaggaggugacaggugggucauguggcaucucaucggucacaacaagggcucuggcuuuuacccugagugagaggaggccaggauucugagcagaggagggacgugaccugacucagguguucacagggucccucuggcuguguguggggaacagauugaggggaaggcagaaggacagaaggacagggaggaggcucguguugugguccaggugggagacaaggguggacagaaccgcuacaggaaaggggucuggauccaggcccaaagagaagguucuuggaucucauguaagaaagaauucagggcaacuccauagaguaaagugaaagcaaguuuauuaggaaaguaaaggaauaaaagaauggcuaauccauagacagagcagccccaagggcugcugguugcccauuuuuauguuauuucuugaugauaugcuguuuagcauaacaagggguggauuauucaugccuccccuuucuaaaccauguaggguaacuuucugauauugccaugacauuuguaaacugucguggcgcuggugggagugcagcagugaggaugaccagaggucacucucguugccaucuugguuuugguggguuuuggccggcuucuuuacugcagccuauuuuaucagcaaggacuuuaugaccuguaucuugugccaaccuucuaucuuguucugugacuuagaaugccuuaaccaucugggaaugcagcccaguaggucucaagcuccuguucaagauggaguugcuguaguuuacaggccucugacaggaccagggcuaaugggccgagggaucagagcugaaccggacugaggagccgcagggcagggcagggcagggcagagggcugagccccaggaggaagguggcaugggucuggucucugacugagccccuucugcccccagguuguguccuaccuggcaggcuguggccuccagagcugccccaugcuuguggccaaaggguacccagacauuggcuggaaccccugugguggagagcgcuaccuggacuuccugcgcuuugcugucuucgucaacggugaggaggggguggcaguggcagagcgggaaguauggagucacuggucacacaccucccucgagaugacugcucgcacccugagccacagaugggguccaggcaggaaucccuuccagcaggccuggggcuggcaggggccuguguuaccccuggagguguuggguccuguggcuggcaguguuggauccuggggcuggcgggagccugguguuaccccuagagguguuggguccuggggcuggcaggggccugguguuaccucuggagguguuggguccuggagcuggaugggaccuguguuaccccuggagguguuggguccuggggcugcauggggaggucucugaugguggcucaugagacccccuuuccccaugcggguggccaggcgagagcguggaggagaacgccaaugugguggugcggcugcucauccggaagccugagugcuucggacccgcccugcggggugaggguggcucagggcugcuggcugccaucgaagaggccauccgcaucuccgaggacccugcgagggauggcccaggcauccgcagggaccggcggcgcgagcagugagucucccggcccccuccucaauagggcaacccgcccucccuggccccuggcugccuccccaacccacccaccuucccugcagcuuuggugaggaaccgccugaagaaaaccgggugcaccugggacacgccaucauguccuucuaugccgccuugaucgaccugcucggacgcugugcaccagagaugcaugugagacccugagccagggcaggaugggaagggagggcaggcacagccgcuuugaacgccucaugcaggcacucggugacacggagugagcucccauaugugggugguccuggacuagcaauguuggggacacaacagugaccaagacagccccagggccuggucucacagagcucccaguccaaugggggagacggacagugacacccagaguggucagggcugggaugggggagcacaggaagaggggucggggcugggauugcagggcacacggagaggacucaggauggggauggggaacacagggagaggggucaggauggggauggggucacagggauaggggucggggccaggaugaggggucgcagggagaggggucaggaugagguuggggggaacaaggagagaggucgggacuggggugggggggcacaggcagaggaacgagggcuggaaacucuagacagccuccugagaaagaggccugcucuacccuccugugugguaagggagggagcagagcagucacugaguggggcaccagcgccugaugagugccccucucccucccucuacuccccagcuaauccaagccggcaagggugaggcccugcggauccgcgccauccuccgcucccuugugcccuuggaggaccuugugggcaucaucagccucccacugcagauucccacccugggcaaaggugcagaggggauggaacuuggcgaaggagugaugcuggggagggagcggcuggguccgcagggcauccccgaacccacccucccugccugcagauggggcucuggugcagccaaagaugucagcauccuucgugccggaccacaaggcguccauggugcucuuccuggaccguguguauggcaucgagaaccaggacuucuugcugcacgugcuggacgugggguuccugcccgacaugagggcagccgccucgcuggacacggugagcaacccugcccagccuggccacccuccccacuuccacagagggacaggagaugggucacgguagagcagcagcagcugcuuuuguuuuucuugggauuguggacauaucauaauccccaauaccaucaucaagauagaaaaugaaaacgaagaaacacugaauuccgaugaagggugaguaggaaucuccaagaccuccaguuauaagaaaucaucauuugaggucaggcguggugacucgcgccuguaaucccagcacuuuggggagccgaggcgagcggaucacaaggucaggaguucgagaccagccugaccaacauggugaaaccgcaucucuacuaaaaguacaaaaauuagccagacgugguggcgcacacuuguaaucccagcuacucaggaggcugaggcaggagaaucacuugaaccggggaggcggagguugcagugagccgagaucgugccgcugcacucccgccuggcaauggagcgagacuccaucucaaaaaaaauauuuuguucgcaguauugguuugguacugugggcacacagaacucuguacaggaacagcaauaacagaagggugacagggcaaggaagaugagcacugagaagugaccaccgauuuggcaaagucaaggucacuggaaauggggaugagcaguuucagcaggggacagaagccuuccgagaggggguuuaagagagccuggggcugugcaugguggcucaccccuguaauaacuuugggaggccgaggcggguggguugcuugaagccaggauuuugagaccagccugggcaacauggagagauccugucucuacaaaaaaaauuuaaauauuagcugggcauggugcugcacaccuguaguccccucuacuagagaggcugaggugggagaaucacuugagggacagacauugaggcugcagugaaccaugauuacaucucugcauuccagccugggcgacagagcgagaccuuaucucagaaaaaaaaaagaaaaauaaauuagccaggcauggaggugcgucccuguaguccuagcuacuagggaggcugaggcaggaggaucacuugagcccaggaauucgaggcugcagggagcuaugauugcaccacugcacuccagccugggcgacagagaccccugucucuaacagaugaaaaagaauguauuacaggaagaaagaugaggguuagagaggagauaagcgugcagaccauugauauuuacagaagagccaaaucuguaaugggguucauuaaucucaucgaccaguuguguguguuugaaauuuugcauaauccaaaguaguaagugguggggugggggcugugggcauaggggugugggcauagggugggaggagggugguagagauugggaggagcagguuuugggggagucaucagaagcuuggauccuuuggccacagucgcucaagacaggugccagagcagccccaggggugugcagcgggccugauguccucacccugcgcccuaggccacuuucagcaccaccgagauggcgcuggcgcugaaccgcuaccugugccuggccgugcugccgcucaucaccaagugugcgccgcucuuugcgggcacagaacaccgcgccaucaugguggacucuaugcugcauaccguguaccgccugucucggggucguucgcucaccaaggcgcagcgugacgucaucgaggacugccucaugucgcucugcagguggagcggggcaggcuucaggguggggcaggggcaggggcaggggcaggggcaggggcaggggcaggggcaggggcagggggaggagcaggggcaggggcagcagagcgggccuggacgggggauucuacaucuugugcauugucccgcagguacauccgcccgucgaugcugcagcaccuguugcgccgccugguguucgacgugcccauccucaacgaguucgccaagaugccacucaaggugagggcaagcgcucuuuagcaucucauuuccaggccgcacccacugguuugcucuucccuccuacugcggggcucauuugugucggcacugcccagcc

SEQ ID NO: 15086 - RNA, 2066 nt, Homo sapiens
cggaggccauggccuugccacuucugcaucccgggacucacgcagcaggcgcaguccggcaccggguucccgaagcgcagccgcgccauccccgccgcagagcgcgcgauccgggcagugcagcucccgcagcaggcugccgagcugccgcagaaaguccuccuccgcgccagggccugcgaggacaggggugucagggcucgguggccccguggcggccccccugccacccucccgcuccguguuuaccgucgccggcgcucagcaccuccgcgcccgccucucgcugcugcucgagggcgcccagcgucgccagcuccgccgccagccgcacgcacagcccccugaagucugggcaugaggcgccccgcgacgccgcccccgggacaccuccauaccuguggggaccgaggcagcgggagggggcggggaugucacugggaaucccuuuucguccgcguccagggggcagaccuggccuuccugcacccaccagccucaccgcacacccuuuuaccccagagccagcagguccugggccaccgcggcccccucccacgcuuccgccuucaccgccuccaugaaaguguggucucggcgcgcccccuggcggccgguggcaggcuccgccccaaaagcgccgcgcgcacgagcuccccgcagcguccggcggcacugaccaaucggcaucuucccgcgcaggggcuugggugcucccauuggcgcaggaggacgccgaacccgccccggggcccgcccgccccgccccucggcuaaccugucgggguuguaggaacgcccccuggagcuguaaauugcagugcguucgggaucuccgcugucaagacaagcuggcggcgggugucacuguugcggcgacauaaaaacaacuucggugccauuuuccuuuuccucccucaguugucuucugcugguguuuuguugguuuguuuuugaggcagauuucgcucuaucguucaggcuggacugcaguggcgccaucgcggcucacugcagucucgaccuucugggcucaagagauccucccgccucagccucccagcuaaauuuuuaaaaaucagucagccuugguggcuuacaccuaguagcugggaccacaggcgcagaccaccgcgccuggcugauuuguuuuuaauuuuuuuguagagacaagguuuccucauguugcccagccugguuuccaacugcuggguucaagcgauccgccugccucggccucccaaagugcuggaauuacaggcgugagccacugcaaccggccaauuuuuuuuuuuuuuuaaaguuuuguagaggccgggcacgguggcucacgcauguaaucccagcacuuugggaggcugagguggguggaucacuugaggucaggaguucgagaccagccugggcacauggugaaaccucaucucuaauaaaaauacaaaaauuagccgggcgugguggcacacgccuguagucaccacuauuugggaggcugaggcaggagaauugcuugagcccgggagacacagacugcagugagccaagaucgcgccacugcacuccagccuggggacagagcaagacuccgugucaaaaaagaaauaaaguuuuguagagaggggucuagcuaugucgcccagguuugccucuaacuccaguguucaagcaauccuucccucucagccuuccaaagcuugggauuacaggcuugagccaguguuccuggcccuguccucugcucuuaaagcagcccagacggagugguguucacccaacucugccuaaaauccaaaacuuccucccuccuuuccaccucaggguuugaauuacauaagggacccaggaaucccagcacaccccucacacaccaggcccuccucaucgaucacgaugugccuguuaggccuucacuccucucccucuuaggccuuggagugagcaggugcaaugcaccauagugguuaagagauuacacccuaggaaucaggcaaaggguuagggcuugauucuguuacucgccagcuccauguuccugccaaauugcuucccaucuguauaauggggau

SEQ ID NO: 15087 - RNA, 11183 nt, Homo sapiens
agacuuugucacagacauuucuuggagcagaucucgugcccccucccccgaugacaaggcugggucuuuggcccccauccucccccaccacuucagccugcacugacacuaacaauauugaggucacagacuggcuuagaaacaagaucaggaagauauauguuggggugccucccccaaaucugggggccaagcauccgaucugaggggcaagcggcugggaaauugggccugggggcuccagggucugaggucugccuggcucccagggcggcccuccauguaccccugauuugggggcaaugaaggggaaucauggaucagaggugggucucagcagggagcaggacugggggaccugggagaggcgcugcugggaaguggcggccaggggaccuuuccuuagcccccaccgcuucaucugcagaucccacagcaccguacagcacucuggucccccgucccaccccuccccaaaacgagguagguuaagaauggagcuucccccccgcccaccauggaaggggggagaccgaggcacagagaggggcauggggacccaggcugccccagcccccaaucccuccgcccucagcucuggugggucugacagugaugagagcugggcagaguggggaggggagagacacccccgcuuuucucucacccaucccagggucugguugggagugcugaaucucacagguuccggauguaauaaauaguuaauaauuuaaaggaagagacagaggaccuaucccuugaaccccaacaaggccauccaagucuggguaaugaagaaagguuaagugcacaguuccagaugcuuggggccagaugcaggucccaagcccauacaacauugagacugucuugcuccaagaccuugaggcccccauacaggacaccagaucuucgauccacuggaagccccauuucacuugggggaaaaaagccuguggcaccccccuuugcacagaagagacucagugggccaugaaacaggcuuucaaacuuccugaagcaacuucucacucuaaaguggaagagagccaggugcaguggcucaugccuguaaucccagcacuuugggaggcugaggcagguggaucaugaggucaggaguuugagaccauccuggccaacauggugaaacccugucucuacucaaaauacaaaaaauuagcugggugugguggcacaugccuguuaucccagcuacucgggaggcugaggcagacgaauggcuugaacccgggagggggagguuguggugagccgagauugugccacugcacuccagccugggugauacagcgagacucugucucaaaauaaauaaauaaauaaauaaauaaauaggaagagaagggguuaauggagggggagaacauaaaaggugggacuugaaccuggacuaggaauuaagguugugcuugaaggaaggucugcaagacugggggcugugggacagcagagccauaacuagccugaaaguuuccauugcacacacuucuucugagggcacaguguggccagcagacuggugugacuuccagcuccucgaaacccugggcugugugccuucacuuaaugaagacccugcauaaucaucugugacaaugcuggguccuagacgugacagugagggagcuccuacuugguccuuuuuuuuuuuuuuuagagacggucucacuacauugcccaggcuggucucaaacuccuggccuuaagcgauccuccucccuuggccucccaaagugcugggauuacaaggcaugagccacugugccccacccugggugguccuacaaugaguuccaaaugguagggaucccacccuaagauaaagggguaauucugaggauugcugggggcuugggcugggauccuugggaccagaauuccagaggcuggaaccuugggguuuuaggggccuauggaugacaggauucaaggggcagcaggucucugagguccgacaaguggggaugggggaaucagguguagaggcaacuugggguucaucagacuagagagguuugaauccaaagaaaucuggggucugagggugcuggggucuuggggcaccucgaaucugaacgccucugguauggagggaugaaggucuuggaucaggaacaaucccaauguuguagggucuugagccuugcauuugggggucaguggcaccuuugggguauuggauccagugcuccuaaaguaccuuagggucacucaagggcugagggccaagggcaucagaggucugggucaccaugagcauccccucuucugggagcuggacucccagcccuuaagggguugggaaucuguggguagaaagaagcugaagauuccaggacauuuggggucucaaaauccagguccaggagggacugcaagagagggcuauuugagaacucgagaccaguaucucggguccugagguguugguggccuucagucgcacaucugaggaccccaggcaccucugaguccuauaaaugauauccaaagcuccugagaacccuggcuuggggguggguggaccuauggaggucuuugaucccuggcuuccagagcaucuuggugucugauaucuggaucuugggggcucugggaugggucucccaagucauuuugguaagagaacagcucguguuucaguauauccgagcacucagugcaucuuaagagucuggggucccagggugucugggaguucccuggacaucuuagacuucaguguucccggacuggaggccaggucugugggcacuaagucguggguagauuugaggggcagcaucuggagauuccagagcauaacagaguuucaaacucuguuugaaacuuucucagggguccugcugucucagggguccugggacuaugagaaugucucagaugugggggcaccaggucuuaggugaauauucaggaacuguuugugggugacuccagguccuauggucucaagaucugaucugggaguugaauaaaggcagagccaguuaugggcaaguccugacuaauuguggggcuguaaucugagggacauggugccaggcgugaccggguucuagguuguucauuucaacagggaccugcccuuuucgggaucuaugugcucccuggccuuucugagaugcaaaguauggggacgccuggagccuccucguggggugugggggugggggaacgccagaacucaggacgccugggacuucuuagacagacaccccaaugaagcuggggcuggggucucucaguccuagguuuggguuccagguuccaggucugagaucucucaauccaaacucaagcuccaaguuccggaugugccuagguuuggguuuuagguccgaacggaguccgggguccuggacccucaauuuuggguccucgggccggcuaggggacccaccaggccguccucaccgcgcagccuccucguggcgacccccgcagccggcgcagccgcaucgcgcugcgacccaguggcacgcgcgcaggggcgcguagcagcagaggcagggcacugccagggagagcgcggccagcgcggcccagcgcgcggcggggcgcggguggcccggcucgcaggcgcacggguccgagaagucgcccucggcguccgacaggcagugguagagcaagcucucggcgcaccacaggcagcuuagacggcgcaccaggaggcgacccggguccggggccucugcgcagcggccgccacgcccgucugcucugcgacggaagagcgcgcggcaaugcacgcagcgcgcugccuccuccgcuuccggggaggccuuggcaggcgcagaggaugggcccgggccggggggugggcgagcggggggcgcugggggcgcagccucggucaaaggggcagguagugccgcugggggacccagggcagcgccccucaacgcgccggucuuggcgaagcgcacgacgcagguggacagggcgaggggcgcggguggcccggagcgccgguaauccucguagccgcggccgccccaccccaggcccccugccccugccaggggcucugaggguuccggaauccccgugaacgguagaagcggaggguagcucugcggaacgaagggacaaacagaucagaauccaucccagucuuagccucaaggauccaguucccuagcgcacucuugggucugggauucagauuuucaagaccccagcuugcuucucucccaaggucccucaauccccacuuuucuccagggacagacagaggaauccacgcaccaaccccacaccuuuaaggacccagaggccgaagguuccuaguccuguccucucuuaagauccaagagccccagcucccagcccccucuaccuugagauccagggguucuggacccagccaccuccuccuuaaaggcgcaggaguuugguuccugggccucuuuuacccuucuggguaccgacucucccacccuccccgugaauuuaacaguccucuuccaggaguuccccaaauauacacucugaaaaugguccuaaaccucucuggacuucgaaaccccucaaaaucuccaagagcgcaaggagacucgggaggcccgcacccaagccuccuagaaacccaggccuccaagccucucccuauuuccccgccgcuuucucccaguccggcccaguuaucaggucagccauccccuggaaucuguguuccccaccuccccgggccauggcucccgcucccuucgggccccgagugcaccgccccauucccccaggagccccaggcucccaggucgcaccugagcggaggagcggcggcgcugggggggcguggucggcccgaagccugaagcugacuccaucgugaugaugggggccgcagcggcgcugggaggagucuccuggcggcugugacuggaggaggagucgcuguccacgugggacuggaggagauuggcggccucagcgcggggacacgcccccgcacagccgaugcccucacauagacccccucccauugagagcgagggcucugcggccaggaaggccuggguucaaaccccggcucugucacugacugguugugugaccuccggcaagugagcucaccucuuugagccucaguuuccuccucuguaaaacggggauccuaagaguaccuauucauaaggaugcgguuagggccacugucaagggcacagcauaugccugaaguacugggagagcuggaaaugguuauuguuauuuuugugggacucuucuccugaucuaaucagcucgccaaaccugaggaacaucuaaucgucuucccgcuucucagaaucccucuccccugggcagccagcugccuuccucucucacucccagccccacacuguuauuggggcagucccgcccacuccgagugcuccccuucccaugcaaaccagccucuguucugaaacuagcugaaacgacuucucagacccuuagcuuccuuucugccacuuggacauaacuccuaccuuaucugcacacugccuucaauagacauucauugagcacccacgacgugccagacucacgaagaccacugugcagauuccagagggggccuggacagcagagcaucuuucccggguaagugcuccauggaugggaacugucugcaacuguuguggccccacuucaucucccaugacccuggaacccuccccuuuucugcccagggaaucaguuuuguuccuccagguguuuuaggcaacucccaagguuuccagcaagugccaaauugcacccgauauuaugugcauucauucauuccguuuauucaacacauauuuacuaaacacuuacugugugccaggcacuguuucaggcauuggagacacagcaagaaacgaacaaaagauccuugccggccuggagcugacauucuagcaugggagauagaccguaaacuaauagauaagaaaauaggccgggaaauacaccuguaaucccagcaauuugggaggccaaagcgggcagaucacaaggucaggaguuugagaucagccugaccaacauagugaaaucccgucucuacuaaaaauacaaaaaaaauagcugggugccuguaaucccagcuguuugggagacugaggcagaagaaucccuugaaccugggagguggagguugcagugagccaagaucgugccccugcacuccagccugggcaacagugcaagauuccgucucaaaaaaaaaaaaaaaaaaaaagauaauaguauuuucagaaaggaaauaaggaaaaugccuuagaacaugggaaaaauuuagcacuagacaaggggcauuggcagauugcaauuuuaaauggaauacuuaaguuuaaauacucagggaggcccucccugagaagaugauauuuguauaaagccuugaaagaaacaagggaaugagccacaaggaaaucugggaaagaguguuccaggcaacagccagugcaaaggcgcuggggcagggcugugccugccacguuagaauaagagugaagaggccauguggccgaagccgaguaagugagggggccagacacacagggccacauggcaugggaucucauaugccacuguaaggacuuuguccuuuacuugagugaguuggagcccugggaggcuucugagugugggaggggcaugaucugacucagccguugauagggauccucuggcuaugugugggggcaggagggaaggaguugacagugagaagcuauugagaugguccaguugggagaugaguuuggaugguaccagguuggaggcagauugugaugauuuggaaaguagaaccaauauuugcugacagaugagaugagacgcauaaaagauaaggagucagggaugacuccaagauuuagagccugaguaacuggaagcaugggguugucaauaauuuguucauccauuuacuuucaauauuuauucauuuuuauuguuuauauauauauuuuuuuuaauuuucugccuuuccacacuagaauagaagcuccaggaggaaaggaacuuuuuguucacugauguaacccagugccuaaagcacugccugguauacagaagguacacaauaaggacccuugaaugaacgugugaaucaugacagggcagaaagacuagaauaacugggauugaauugacacucauaguuccggcccaauuuuguguacccgguguguggcauggugccugcuacacaguaggugcucaagaauguucauagaauaaaaacaaaaccccuacccucccccagcagagaggcauccuggacacucaccgucagagggcagggggucucugcaguauccugggaaggagaggaggaggaggaggaggaggagggggugagugagccuggggcagggagagaggcagagagugaguuccuugagcccagcuucuccucccgcucccaggccagcccacagugcacaucaccugggcugcucaccucgacccagugcggccagcgcagccagcaggcucuucuggaacucaucagccucugcagggcucugaaacgucaguccaaacuugcagucacccaggcuccaguggugaaagaugggauucaccuuguuguaaaccaagccuggcuucaguguacacuccaagguugucugaggggcagaaggaaagcagggucagauaccccaacccagacaugccugugacgucucguccaucaccagcccccaugcauacccuagugucuucucacaaaccucauuucccaacccuaaguguaacccugaacucugaucaacacugauacgacuccccaguuuuacuuguuuuguuuuuugaaacagucuuacucugucacccaggcuggagugcaguggugugaucagggcucacuacggaaucaaccucccagucucaagugauccuccugccucagccucccaaagugcugggauuacaggcaugaacccccacacccagcuacgcccaauuuuacugaacacaccucugaugcucaaauauuuucccaaccccuugaucccuacauuuuccuaauaccucccucugaugccccuguagaaaccccgaaucuugcugaauggcccaaaacauuguuaaccccuuucugauaacccaacauccccccucuggcucaacaauacuucccagacuuuacugaacaucucacaauauuauugugaauccucuucugauaauaaucucuggaaacuuuacccaaaaaauauucucucucucuuuuuuuuuuuuuuuuuccagaugagcucucucuguguugcucaggcuggucucaaacucuggacucaagcauuccuccggccucagacucaugaguggcugggauuauaggcacuguacccagccagcacuuacuccaaaacagucuuaucagacuuccacagauuccccuucagaugcuagccaacacccuauugauguucccucaaauccuugccuaguaucaccauauuccuucacuccauuucaaaucccuccacugacuccugcuccaaaaaaaaaaccuuucccccaagccuuucacacaauccauaucuuucuacuacaucccuagcugaaacugauucaacacugucccuccacauugugcccgacagcccaguuauuccugaugaacccauguauagaauugucaaccaucucugacacuuucaaauggaccccagcaaaugcuucacuauacuuagggcagacaggggccaggugguguagggccucguggcaaggaucucugagcaagauggaggguuuugagcagaggagggacauggugugagucggggcgggggggggggggcagugcccccuguggaacagccugggguuggagcggggaggaggagcaguacagggagacagcgaggauagucuggcuggaaguggcaguggacaggacccuccaaacaccccauguauccugcaauucccaacucuuaucuacaggacagauauucacucccaaacuucacaccccagcuugauuccuaggcugggaggcaaccugaccucugcuccacaugccagccccucuccccucccuccccaggucccuacccuccccgcaugccccaggguggcucacuuucuggucccggaggcguuccccguggaugacguagugccccuggcgggccccccccucgggccuggccccucggacccgacacacgcucaccuggcugaggcccccgccccccacaggcagccagcccccacuggagucaucucgggccaucaccacagcucggacccgcaccauguaccugcaggagguggggggaaggacagggacaacacagucaugagcucaaacccugcucucccauggaauguucccucaacccucaucuccccuccaacuucaucucucacguccagguccacugcacccuaagcuagcaauacccaccuucaaccccauggccaccgucuuccacacagcuccuuucuuccucaugccaucucuucucucucaccucuaucuucuucuccaugucugcccuuucucucuguacccaccuuucccccaucucuccguccccacccccauagcccugguguugcccuucccucccccuccugcuuaucccuaucacccccuucuccucccucagcacauacccacagccccacccagugcucccccucacagcugggugccugcgcauauauauuuucucugggcccaucaacucagcuccuguucucccaacccugccuccgcacccugucguccaggccacaggcugggugagaaacccaggcucuuucccccccacccaccccuucccggauuuaugaaugagaccggaugcaaagcucacugagucacccagcaacgggagaugggcagggaacagggagagaaccagaaauggccagaaagagaggcucagagggagacggaggcagaggaagucagaaacgggcgaccgaagacacauccagagagcauuucauucacaaaaaucaaggcugcucccccaggccccagccgagggaagccaggggggaaagaugggaugggggggcagauugauccuuccucccucuucccuucccgccccccagccccagcauccuucagaaccauuuuaccccgccccccagcucagaggacguagcccuccgcccaguaaucgggaucaguguccagcccuucacugccauccagcacagggacccuggcgucccaaccuuagggacccggacgagcucuagcccccucccccaccugcaggcugcuggguuucccgggcccuucaggaggggaaggggcggcugcagcgcccccagcccccuuuucucaaugggaugggauuuugugaaugagcagucacgugacgcugcuuccuuuguccgcccgccucccccgacaacaggugaagcagggaaugagagcagggguccccccagggccuagcuggaauggggcacuggcauuucaggguggccuacgcuccccacacauccugugucccccggggggagugguccucagcguuccucaacggugaggguccaggacggaauuuugugaauggggcauccucggagaaaguccagaccccacaaaugaagacugguacccugaauggcugccgcgcaguuugggggguccccacucucuaguccuccuagccggggccuugggggcgccugggugggcagaaggcgcagcgcggucacggccgcccccucaucggggcaggcagucugucagcccccgcccccucgccccccucggcaccugccugcgaggcuccggccgggcuccgagcggcggcgacgcggccuccuccuccuccuuuucguuccggcucccuggcuggcuccggcggcgcuggagacgggcaccgggagccggggcgaggggggagggagggggaaccuggaagacggguggggggggaaggggcggcuugggggagggguaagagcgaggcgggcuuacuugccugcuggguccuagagcccggcacuagcuccagagagcaaccccccagcccccauuuucuuaagauccagaggggaucccccacuuuuccacccaucugcgccauuggucucuaaugcuaugaggaggggacggggcagggacagggacuggucucaagguucuaaagaggugguggucuacgcuguggcuugggugccug

SEQ ID NO: 15088 - RNA, 3800 nt, Homo sapiens
ggaguauuucaaggggagaccuagguucguaaggggccgggcucccgcgggcucgcaggagggcggggccucgagcuccgggggcggggccuacaucucgggguccgcccuaguugucucgcccacuugccuucacccgcacccccguucuuuucgguuauuuucugcuacggcaguucccugcccugccccgggcccagggcgccgcggucugaacucugcucggcuggaggacucggugaguggguuccucuggggggaggcggggccagggcggagcuuggggacagggguggagcuugacuguggaugccagcuaguagaccuggagcgggaagagguuuaggggugaggccugaggaucugccccugccugggaagagggcgggacccaggugcucuagagagaggcggggagucggagaguuagaggagaggacugagggaucagcaugaccagccaaggggacaggcauggaaccuuaguacauaauggggcugguagugaaguaucuuaacagcagcuguguuggggacaugggcaagaaggcgugagugucgaaggucggggaacaggagugcgaccuaaggacuugggccugaucggaucuuggagaacaggggcggggccggugcggacgcauuagaucaaguacagccagccucguaggguccccacggcccuggcaggcugacuggaguaaauuuuucugacuagucuccgagcuccgucagaaauggggaacuugcagucggagccauccgcgggcgggggcucccgaaaagugcagcccucggaccgcgcccccgacucccgccggacgucccugguggagcccgagaugaccucccaggccaugcgccugacucgugggcugggugucugguucccuggcagcgccacacccccgggacucaugguaccccgggagccccaggccucacccucgacccugccccucaccuuagaacggcccucuccagugaugcccccuccugaagaggcggccgcggucucugcaccacccccggcccccgcggggacucugcugcccggcccgucuaaauggcaaaagcccgcgggcacuccaguuccccggauccgccgccugcuggaggcgagccaucgcggccagggcgacccuccgagccuccgcccgcugaagccgccgccgccgccccggcaacuauccgugaaggacacugucccgagggccccaucccaauuuccgccgccccuggagacuuggaagccgccaccaccauuaccuucugaacggcagccggcggaccgcagaaucacuccugcucuggccacacccgccucacccccgacagaaagccaggcugggccccgcaaccagggccagacggccggcagggcucgcggaggggcgccuccccaugcgggcgaaggcgaaauggcccagccugcggauuccgaguccggucugagccugcuguguaaaaucaccuucaagucgaggcccucuuuggccccuccggcagccucgaguuccuuagcagccaaagcuucgcuggggggcggcggaggcggcggccucuuugcugccucaggugccaucucuuacgccgagguccugaagcaagggccccugccuccuggagccgcucgccccuugggagagguuucucgaggggcacaggaagccgagggaggugauggagacggcgaagggugcucugguccucccucggcgccugcgucccaagcccgggcccuaccgccgccacccuacaccaccuucccaggcucgaagcccaaauucgacuggguuagcgcucccgacggcccugaacgccacuuccgcuucaacggggcuggcggaggcaucggggcgccgcgacggcgugcggccgcacucucugggccuuggggcuccccuccgccaccaccagagcagauacacucagcucccgggccccggaggcccgcaccugcccugcuggcgccgccuacguucaucuucccagcacccaccaauggcgagcccaugcgcccggggccuccaggccugcaggaguuaccaccgcugccaccgcccacaccgccgcccacacugcagccaccagcgcuccagccaacgccgcugccgguggcucccccgcucaccccgggucugggccacaaggagucagcccuggcucccaccgcagccccugcucugcccccagccuuagccgccgaccaggccccggccccauccccggcuccagcucccaccguggcugagcccucgccgccuguguccgcgcccgcacccgcggcugcgcccaucaagacccgcacgcgcaggaacaaggguucccgugcagcccggggcgcgacccguaaggauggcuugcauggagaugguccucgcgaacgagcuacagcuaccgugccugacagcagugguggagggggugguggcagcggggccucucagacuggggcagcuaacacccgcgcugcgcgccacuggcugcccuuccaggugcuuaacuccugucccugcaaguguuacugccaccaccagccacgccaucgccgccugccacgcaacgucucugccuggugagaggggagaagggacaggagggugccgaaccccagacugcuggauagaguccuacucagcccuuuggcuuccugacccuagaaugacccguggccuucaucucugccacaucucaaaccuagcugagcucccacccuucaggaccaagaggacccaugaucccaugcugaccuuugacggggaaagggggacacccuggcccagcccuauggcauccaaucccuaaguggacucuuggcccuccuguaccucucuuggagccauuagagagggaggcuggucccagcuggccugacccuauacacugccuugacccugucccugaggguaucaaggaggaccacguccgaggccacucagggaugggggugaggggaugacugucuuccuggaacuaaauggggguagaugcacgccuccaacuuuacugggcacaggggcagcccuggacuccugaccccucuagccucugaggacuucuccugacucugggacucaaggcuucagccgccagagggcacugaugucccagcccuugugcuggggaggcuccuccugagucccacauccagggggacaaugcauccuccagccacccccuacccacacugaaucaccagaucuggccacuggggucugauacugacuccugggagugcugaaccacugggagacugcccuggaccucuugaagcuuagcugggacacucgccagcccucagcucccuuuccuauuaaguggccacagcccugcccuaaacugccuuugggauauuccaauauagccuucagaagcuucccuauucauauggggacagggaggcccuagaagggcuagaggccuggucccauugcugggcuuugcugacucuacccucccccacuaggcugagcacauccaccaaccaccugggcgagccacccuggguugccaccaucaagcuguccggcucucugguggccaagcuggagcacuacgacuugcaggccacccauuccaacugaguguagucggcucaacacccuccaccuuccccuccaugccaauaaaauaaccaauccagaugccagcagccugucaaucacucgccaaggcaguggguagggugcagcagggcaggaucgccauuaaagcacaucuuggaaacaaucgugaagcuggaccagagcagcaguaacugagguuccauucacccagcacccagacugaugggucca

SEQ ID NO: 15089 - RNA, 3800 nt, Homo sapiens
uggacccaucagucugggugcugggugaauggaaccucaguuacugcugcucugguccagcuucacgauuguuuccaagaugugcuuuaauggcgauccugcccugcugcacccuacccacugccuuggcgagugauugacaggcugcuggcaucuggauugguuauuuuauuggcauggaggggaagguggaggguguugagccgacuacacucaguuggaauggguggccugcaagucguagugcuccagcuuggccaccagagagccggacagcuugaugguggcaacccaggguggcucgcccaggugguugguggaugugcucagccuagugggggaggguagagucagcaaagcccagcaaugggaccaggccucuagcccuucuagggccucccuguccccauaugaauagggaagcuucugaaggcuauauuggaauaucccaaaggcaguuuagggcagggcuguggccacuuaauaggaaagggagcugagggcuggcgagugucccagcuaagcuucaagagguccagggcagucucccagugguucagcacucccaggagucaguaucagaccccaguggccagaucuggugauucaguguggguaggggguggcuggaggaugcauugucccccuggaugugggacucaggaggagccuccccagcacaagggcugggacaucagugcccucuggcggcugaagccuugagucccagagucaggagaaguccucagaggcuagaggggucaggaguccagggcugccccugugcccaguaaaguuggaggcgugcaucuacccccauuuaguuccaggaagacagucauccccucacccccaucccugaguggccucggacgugguccuccuugauacccucagggacagggucaaggcaguguauagggucaggccagcugggaccagccucccucucuaauggcuccaagagagguacaggagggccaagaguccacuuagggauuggaugccauagggcugggccagggugucccccuuuccccgucaaaggucagcaugggaucauggguccucuugguccugaagggugggagcucagcuagguuugagauguggcagagaugaaggccacgggucauucuagggucaggaagccaaagggcugaguaggacucuauccagcagucugggguucggcacccuccugucccuucuccccucucaccaggcagagacguugcguggcaggcggcgauggcguggcuggugguggcaguaacacuugcagggacaggaguuaagcaccuggaagggcagccaguggcgcgcagcgcggguguuagcugccccagucugagaggccccgcugccaccacccccuccaccacugcugucaggcacgguagcuguagcucguucgcgaggaccaucuccaugcaagccauccuuacgggucgcgccccgggcugcacgggaacccuuguuccugcgcgugcgggucuugaugggcgcagccgcgggugcgggcgcggacacaggcggcgagggcucagccacggugggagcuggagccggggauggggccggggccuggucggcggcuaaggcugggggcagagcaggggcugcggugggagccagggcugacuccuuguggcccagacccggggugagcgggggagccaccggcagcggcguuggcuggagcgcugguggcugcagugugggcggcggugugggcgguggcagcggugguaacuccugcaggccuggaggccccgggcgcaugggcucgccauuggugggugcugggaagaugaacguaggcggcgccagcagggcaggugcgggccuccggggcccgggagcugaguguaucugcucuggugguggcggaggggagccccaaggcccagagagugcggccgcacgccgucgcggcgccccgaugccuccgccagccccguugaagcggaaguggcguucagggccgucgggagcgcuaacccagucgaauuugggcuucgagccugggaaggugguguaggguggcggcgguagggcccgggcuugggacgcaggcgccgagggaggaccagagcacccuucgccgucuccaucaccucccucggcuuccugugccccucgagaaaccucucccaaggggcgagcggcuccaggaggcaggggcccuugcuucaggaccucggcguaagagauggcaccugaggcagcaaagaggccgccgccuccgccgccccccagcgaagcuuuggcugcuaaggaacucgaggcugccggaggggccaaagagggccucgacuugaaggugauuuuacacagcaggcucagaccggacucggaauccgcaggcugggccauuucgccuucgcccgcauggggaggcgccccuccgcgagcccugccggccgucuggcccugguugcggggcccagccuggcuuucugucgggggugaggcggguguggccagagcaggagugauucugcgguccgccggcugccguucagaagguaauggugguggcggcuuccaagucuccaggggcggcggaaauugggauggggcccucgggacaguguccuucacggauaguugccggggcggcggcggcggcuucagcgggcggaggcucggagggucgcccuggccgcgauggcucgccuccagcaggcggcggauccggggaacuggagugcccgcgggcuuuugccauuuagacgggccgggcagcagaguccccgcgggggccggggguggugcagagaccgcggccgccucuucaggagggggcaucacuggagagggccguucuaaggugaggggcagggucgagggugaggccuggggcucccgggguaccaugagucccggggguguggcgcugccagggaaccagacacccagcccacgagucaggcgcauggccugggaggucaucucgggcuccaccagggacguccggcgggagucgggggcgcgguccgagggcugcacuuuucgggagcccccgcccgcggauggcuccgacugcaaguuccccauuucugacggagcucggagacuagucagaaaaauuuacuccagucagccugccagggccguggggacccuacgaggcuggcuguacuugaucuaaugcguccgcaccggccccgccccuguucuccaagauccgaucaggcccaaguccuuaggucgcacuccuguuccccgaccuucgacacucacgccuucuugcccauguccccaacacagcugcuguuaagauacuucacuaccagccccauuauguacuaagguuccaugccuguccccuuggcuggucaugcugaucccucaguccucuccucuaacucuccgacuccccgccucucucuagagcaccugggucccgcccucuucccaggcaggggcagauccucaggccucaccccuaaaccucuucccgcuccaggucuacuagcuggcauccacagucaagcuccaccccuguccccaagcuccgcccuggccccgccuccccccagaggaacccacucaccgaguccuccagccgagcagaguucagaccgcggcgcccugggcccggggcagggcagggaacugccguagcagaaaauaaccgaaaagaacgggggugcgggugaaggcaagugggcgagacaacuagggcggaccccgagauguaggccccgcccccggagcucgaggccccgcccuccugcgagcccgcgggagcccggccccuuacgaaccuaggucuccccuugaaauacucc

SEQ ID NO: 15090 - RNA, 9479 nt, Homo sapiens
acaccagggcccacaccuuuuguuccacaaagagcccaaacuggcagccuacagauggguuccauuucacaugucauuugaaaaauuguuuaauucacugccaacauuuauucuuuuuaguaggacacuucacccccuuuguugaaaaaaucugguacccugguccagcauuccuauguguccacagcuggcuagaacagucccccuaccuggggccaugcccuccugcaggccacagugcugcuggggccccacagugggcguccauguuugagacccugagcaaugcccaccagacagaggcugacccaguuggaggcuaucuccaacuccugaaugccccaaaaccuccaaguucuucagauauaagaacuugucucucugccgucccaacuggggagacaagggccuggaagagggaaugucaguccaccuuuauugggcgaaacccugcaguguaacuguuuuaaauaacucgugcccugccccacccagugcccggggggcucagacgaucaucuccagcugccgggcauacucgaugaccuguuuggccaguucuguggagggaaugguggugucuuccggcuucugcugcuggcuggcaaaacuguaguaguuguuggggcccaggacccacccucgcugcaggaaaggagggauuagagacgaguagagugaucacaaaggcuccauccccacccuauggggccagcacuugcccacguguccuaugcucucuuuucucaccaaucguacucugcccaacgacccuugacaaguaacuucaccucucugugccucaguuucucuguguugagacugggacccuaauuacacaccucucugggucaacugugaggauuuggugaaucaacaucuuuaaagcacugaggauaguguuuggccugagugacagaucaguuaccagcugucaccaucacuaaaauucaauuucaccuucuucuuuuuuuuuuuuuuuuccccagacagagucucgcucugucacccaggcuggagugcaauggcgugaucucggcucacugcaaccuccacccuccuggguucaagcaauucuccugccucagccucccgaguagcugagauuacaggcacccgccaccacauccggcuaauuuuuuuuguauuuuuuaguagagaugagguuucaccauguugaccaggcuggucucgaacuccugaccucaggcgauccucccaccucagccucccagagugagccuaggugggaggauccaccuuggugcgcgggagccacugcacccagcccaauuucaccuuccauagccuggucccagcccuccuccugcaacaccaagcguugcucgugcucaaacgccugagaccaaaugaagcaaagucuugcagaaaaagcugccaccucuaagaaauuuugauaaagacagcagccaacaugcgugcagcgcccaccuccagcugcugccagguacuaagcucaucccauguaucuagccccauucuguggauagagaaacugaugucagagagcuuuggcagcuugccuagagucacacaguugaacuuaaaccugggcagucuuguuccagugucccucuaagccaccccacacuguuguuagugacuucaccccuuggucccacggccccuugcccuguaccccagccaccuucuuggcguagucugucaucuuuuuggguguguugaagaagaggauccggguggccucagugaaaaggauuuucucguaggccuucucgaugcacccagcgaucucaucccugggggaagaugagaagcuccucauuacugagcaucaacaaccucccaggaccuguccccccagaccugacaugugucagcucugacccuggaguucagcacugauggcaggaauaugugaagggcccuguuuuauucaucaaggcucagaaggggagaaacuugaccagacucgcaaagcaagcaagggccacgggugauccccacugaaaucucugacuccugggcccacacucugaaucccacucccagccacaggauuucaggucugaaacccagcuugggacucacaugagggcaucucuucucauaacacccaucaccagggugcugcaccccacuucauagauccugaggggguuccuuguacccaucaagaggcaccacgaacaacaccgaaguagaaauagagcaaggcaugaagucacuguagugagggaggggguaagcucuggggaaaagccagugauggggaggagugccuccaauaucgcuuaggccaugcgguagguaguggguacuggcuaccacuccucacucgaaugccucugggcuugccuuugcaccuaaggcauggaaacucauucugauuuggugcucugcccgagugcaucagcucagccaccacuucgacacccuuuuacuccucaagggauuuguaugucacauccaucugcccgugggaugucacuugugcacacggcaacccaaggggcugcugggauuuggucaacccauucuagagaaggagaaacugaggguuccacaguuuugguggccggaggugaagucucaugacucacuggauggguaucuaggacggaagaugggcuaagacaggccgcacaaucccugccugcugaaccaauuccaugcucagguuugacacacguggccacacaugucaacagccaaggguggugagaugagagccguuauccacaaucccaugaccaggcccaauucacugaaaaggagagcugaggugcuaggaggauaagaaacacaccuagccuacccagacaaccaauggcuggaaugagauucagacucggagcuguccgacucaagcccaaguucuuuccaaacuccacagggcccggccccgcuacgcaccugauagugucgagcaggaugucaaugaagaagguguagcucucggcggggauguuacccuuggccaggaacacuuuguuguagcugcccuccaucagguacugcagaagccgggaagggggaagaagagagaaugaagaggaggcugcaaaggggccuaccugugugggccucaucacacuccuagugccccuguaaucccuuugccacacagccacaccccugcccuggguacccccucuuccagaaagcccuugcugguuuaugcgcacacacacacacacacacacacucucucucucucucucucacccccucuuccucccucccucccuccccccaagccugcucugggcuggcaucucauuaucucaucuacuguccaauuauccaucuauuuuccaggagggagacagcgcuggcuccaccacaggcucaucccuguacaccuuugcccgaacugugcugcccgcccuaacugcccucucucccauccucuccccacugaccaaauccucccauaagaugucagcuccaggaacaacuuccuaaccuuagguccuaaggcuuugcccuggcccugcucacuuuguuccaaaaacacugucuucuuggcuguccuucgaacacagcagacacaguacugccucaggacauuuggacuggcugguuccucugcccggcuguccacaggguucagucccuuacccuuuucuuuucuuuuuugagccuguugcccaggcuggagugcaauggcacaaucuuggcucacugcaaccuccaccuccuggguucaagugauucuccugccucagccucccgaguagcugggauuacaggcacccaccauccgccuggcuaguuuuuguauuuuuauagagacgggguuucaccauguuggccaggcugguuucgaacuccugaacucaggugauccacccgccucggccucccaaugugcugggauuacaggcgugagccacugugcacggccacccuuuucuuuaaaaaauauguuuuuauucauuuauuuucuaaauagagacagaaucucacugucacccaggcuagaauacaguggugugaucauagcacacugcagccuugaacuccugggcucaagcaguccuccugccucagccucccaaagugcugagauuacaggcauaagccaguuccucacccuuuucaagucuuucuccaauuucaccuuuuaggugaggccuucugacuccccgagauaaauaucacccaucccugccucuccacccuccuuccugcuuuuucuccacagcacucagcaucugacagacugcgcaggccacucacucuucgggcuuacuaucugcuuccacaccccagugucaucaccacaagaucaugaauuucaccugcuuggcucacugcacagucugacaaccuaccacagugccaggcacacagcugggacucaguauuuguuggacaaacaagaggauggguccguggguggaaagaugggugaacccuggccacuccuucaggaaagcccuccuaagaccaccccugcaccacccacuuuggccagguccuccccugccccuugccaucucacuugcuccagggacacugggugcuugauguagacauuggucuguauguccuuggcaggcagccgcuccaacuccguguggaacucagccacccgguucugggacagcaggaagaggagguugaggcccaagagcuggugcauauaggcugacucggggagcugcucccuguggacgugggauggggaagcagguuaaggaggauuuaagggccuagcgagcccucuaccccaggcuccaggaauccucacaacgccccaugcaucuuccugaagagguaucagguccuggguuuucauaugaggaaacugugucccaaagaugcaugaauaagucauuuacaagagucauauugagucauacaagagcgagugaccucacuucagugaaaugacaaccucgguuucccaaaguguaaacuggguaucaccauaguauccuuuuauuuauuuuuugagaaggagucucucucuguugcccaggcuggagugcaauggugcguucuuggcucacugcaaccuccgcuugccggguucaagcgauucuccugauuuagccucccaaguagcugggacuacaggcacaugccaccaugcccggcuaauuuuuuguacuuuuaguagagacgggguuucacuaugcuggccaggcuggucucgaacuccugaucucgugauccacccaccucggccucccaaagugcuuggauuacagguaugagccacugcgcccagcccuuuuuuuuuuuuucaauuccgagacaaggucuugcucugucacccaggcucacugcagccucaacuucccacgcucaagccauccucccaccucagacuccaaaguagcugggacuacaagugcacaccaccaugcccagcuaauuuuuuuuuuuuuuuuuuugagacggagucuugcucugucgcccaggcuggagugcaguggcccgaucuuggcucacugcaggcucugccuccucgguucaugccauucuccugccucagccucccgaguagcugggacuacaggcgcccaccaccacaccuggcuaauuuuuguauuuuucuuuuagagacaggguuucaccguguuagccaggauggucucaaccuccuaagcucaugauccgcccaccuuggccucccaaagugcugggauuacagguguaagccaccaugcccagccugcccagcuaauuuuucaauauuuuuuguagagacaggauuucgccauguuggccaggcaggucuggaaaucuugggcucaagugauccuccugucucagccucccaaagugcugggauuucaggcaugugccaucaugcccggccucacaguauccauuucguagagauggguugaaugaacaaggguuaagugaauuaaaugauucaacccagguaaggugauuagaacaauaccuggcccaaauaaacacaaaguguuagcuauaacuauauuaagaguuacuggccgggcgcgguggcucacgccuauaauccaagcacuuugggaggccgaggcggguggaucaccugaggucaggaguucaagaccagccuggccaaccuggcaaaaccccaucucuacuaaaaauacaaaaauuagcugggcguggucgugggcaccuguaauaccagcuacucaggaggcugagggaggcugaggcaggagaaucacuugaaccugggaggcggagguugcagugcaccgagauccagccguugcacucuagccuggguggacucuagcagggcgugguggcgcaugccuguaaucccagcuacuugggagacugaggcaggagaauagcuugaacccgggaggcagagguuguggugagccgagauugcaccauugcacuccagccugggcaacaagagugaaacuccgucucaaaaaaaaaaaaaguuauuggagucagaugcaaugacucaacaccuguaaucccaacacucugggagcccaaggcaggaggaucacuuguggccaggaguucgagaccagccugggcaacaaagcgagacccccaucucuacaaaaaauuaaaauaaaagagccaggagugguggugugcaccuguagcccuagcuacuugagaggcuaagguaggaguaccgcuugagcccaggaggucaaggcuguggugagccaugacugcaccacugcacuccagccugggcaacacagcaagacccugucuccaaaaauaaauaaauaaaagaaucaccacucccuacuuuaacagggaaacugagagagguaaagucauuugcccaagaccucauaaucaggaagcggcuggauguuucaaagccagauuugucugaugucaaauucccaaucauuaaucugugcagguaucauucaguuuuauauucaacacauauccagugagucccuguucugggccuggcccugugguaggcagugcuagggacauagcaguaacugagacaguuccaagcucugccuuuagaaagcucacaguccagugagagaaagggcugggaugagcaggcacaggcagaggggugugagcuggaacugcauuggaagccacaggaaagaacuuggucuugugccugaggaccaugaagagccacggcagguucugagcgggguauggacagugucaaauuuuagugucacaugauccuacuggcugccacagggguuugagucagaggggcaaggcuggggccaggacacgugaaaggugauggcagccccacugggcagagggggugcaaugugggaauggguagggggagacugacuagucaagccaagucucaggaccuccaagccaagcccugacccugcaccacugaggagagaacuaagccaggaggaguucccagaugaaggaagaggacccaagcagccagagcuccagaaauaaaggagcuuccaugcaaccacccccccaguugggggcagggcccauucucacuuguaaucaaaguaguagcauuugagcugggccauguagcgcucgaaggaggggauguccuugcguaggaugcuccauugggccccgaucuccaguaugucaccugugggugacagagugagcucucaggaggugacugaggucucuuccccaaccaccagugcuaccauuccugccaugacccccagauuaucacccccaaccaaccccagugacacucacgggccagaauuagcugcuguuuggucagcuuggucccugugguuggcaagaaguugagcuccagaagaacuagcugauggggaggggagggagggaagaaagaaaagaagggaauucaaauacagaugacuuaccugcucuacgcucuggucuucccacuuggaaaauggagcuaaccaucauccagacucaugaggaaugcuuucucauaaagcacucagaacagggccugagcacgcaacacaugcccauuuaagauuacaucacauuacaauuauuaauagccccacuggggaaacaaggagggacacucagugccugacccaguggaaucacgcggcgguggggacaggaguacauuccauucuuggcccaucuuccccacaaucuauuggggaagggguagcugggcuauccccaaaaucuauaucugggagggggagguccaaaucuccccccacaguucagcccauacaucuuuccuuagcaggcucagcagcuuguuccaagccacuggauuuacacucccucccaacagauguuuggucugaagcacucugggccccguauucuuguucucuacuuguaagaauauuucuucuagguucaguccugccuucacaacuaggcugcccccucucccaacagaugcgagccuaagccccagaucucucagauccuaacccagccuggucuuaaccacacacccucuacacagcccaccuuuucagccucauucuuuuaucacuccgggcaguccucacuucccacuuggucuugccuggaauccaccaucaggaaaagcccgaaucccaauccugccacuccgaccaguuaagccuccacgcaccaaaaaucuaaccccucacucaguucugccauaagucuuccaaucauucccccaccacccccgcguggguccauuccagucaucucucacuuaaaaaaaaaauguagagacagagucucgcuauguugcucaggcugaucuugaacuccugggcucaagcgacgcucccccgccucggccucccaaagcgcugcgauuacaggcgugaccaucaacgcucccugucccucucucgcuucuugacgcccuccgagcccccacuuuggcuguuccaaaucuuucaccccaucggaucccccagcccgccucagucucgcuggcaccgagguggcuuccgcggcccgggacuugguuggguccagacaccucguagcgccucccacgcccgcaacacucgguuuccugggccugccgacuuuaccuugagucgacccagcucuuccccgcacuugcuaagauuggggcuuuuacgguuccacucgcccuugaguugcucguacaugccggucgcggccugcagaacagcgcccgagguugccgcgggcccggagcucgagaagccugccgccccguucaccgccgcggccgccaucuugcgugaugcggcaagcagaccgccugauuuacggcagcgccgccuacaaacgcuugcccggcggaaguggggccgagagguggagcccaaggcccggggcggggcuacaaccugccucagcccgccccggguagcccgccgucgcucucgagguggcgcccucggagcccugcccuuaaugaacaugucaguuggagcuccgccucugucgucacucaagauggugaccggaaguuggcuuuugcccuaacugaaaaugacagcugucucaacaccacccccccuacccaccucacgguuccaauaaugaacauggcugcccuggcuucagucugagugcucgggacgcuacguagcuguccuggaggu

SEQ ID NO: 15091 - RNA, 1836 nt, Homo sapiens
auagcauuucuggcgugucuucagaaauugccguguggccagcauaagggggggcagcauccugggccacgucucccacccccucaggccggguguccaccgggaagucccccuucacccgcuccaagaccuugccuggcauuugaguauggaaccuucucagauuuugcccacagggcccggggagaagcaaauccucaccauguuaggagguuuggggaaacugaggccccgggagcagaaaccugaggcugcagagggccagggacuuguccccagcugccuggggcuucuaggcagaggcuggaaguauguccgggcucucacucuggcccagagggcucaaggguaaaucccuugguuccucucucucuuucccacccagauccggacgcugcggcugaagaucuuggcagacgcagcagcugagggggucccggugcguggggcccggaaccagcugcgcauguaccugaccauggcgguggcggcggcgcagccuaugcucauguacuggcucaccuuccaccuggugcggugagcgcgcccgcugaaccucccgcugcugcugcugcugcugggggccacuguggccgccgaacucaucuccugccugcaggccccaagguccacccugucuggccacaggcaccgccuccaucccaugucccgcccagccccgcccccaacccaaggugcugagagaucuccagcugcacaggccaccgccccagggcguggccgcuguuacagaaacaauaaacccugaugggcauggcguggacagccucuccuuggccucgcgcacgaaugggcgggcccagcgcugggcagggggcagggagcuggggacgggccagaguaggcaccacgcugaccagucgcagaaggcagagaggaagguuuaaugagcccuguccagggcccuucaguggggagccuccuucuucuugcccuucuccuucuugcccuucuccuucuucuucacuuugggcuucuuggccuugcccgggaugcucucgugcugcuuggagccagcagcgugggacuguggggccgagggcagggaugggagagaagagaugguucugggcuggaagcgagacagggggaccacuccccgcacccuccccgccagccccagugcggggacgccucucuggggugcagggcacgugcuuggggacgcuggcgagagccccuuaccuucacauccguguccgaaucgcuggagcugcugcuggagucggaagagcugugguguccuugcuggauggaggugcggcagugaggcggcgccccuuacccagcccccugaaguuggaggccuaaggcaggacccuggggucaggggcaaccccagccuucccgccccuccgcagccggugaugaggcgacuuaccuuuggacccggaccugccccugccuccgaccggcccugaacuuuguggggacugagcuugggaucucccccguggcccgcccccacaccgggcuucugggaggugggcuccagggcuguggagagaaguugggugguuggugcaggcagcuucugggcuugaguccggcccccugcaccuccaguccacacuccccaggagcucaccugcucccaggucgaacuccauggcgguaagagaaguuggguccuaaggccaagggcgccugggcccugcagaggagcggagcagggggaggagcgcugagaccugcccguuggaggaaugcugagacgccccacccaaccucuguccugguccucagcccugacucauugcccggcaccacccaggauuuccucugugagaagugggggagauggacaggugacug

SEQ ID NO: 15092 - RNA, 10426 nt, Homo sapiens
cccccgccccacaggaucccggcccgggagcccccgaugcagggacccgcccgggacucuggguccccgcccauaccucaacuucgcacgacugcgugccucaagccgacgcagcggccuacucucgcacugcagacggggaaacugaggccugaggcggccgggguggggcagaccucccggcgagcccgagcccccgcccccggcuagccccgcccuggcccguaagaagcacccggggcgcgaggcgaaggcgcacagcgcggggccaggcuggguccagcagcgcgauggcagcucagcggcugggcaagcgcgugcugagcaagcugcagucuccaucgcgggcccgcgggccagggggcagucccggggggcugcagaagcggcacgcgcgcgucaccgucaaguaugaccggcgggagcugcagcggcggcuggacguggagaaguggaucgacgggcgccuggaggagcuguaccgcggcauggugagcccggggagggcucggggguggucggggacagauagagcccgggcgcggagaccccacgcccuuggggucucggugcacacucgcuggugcacggccagccuggucugcacaagaggacgagcgccccagggccgggcacucauuggccuggccauccgugcucuauggcauugugcuuguggacacaccgagagcaacacacaaagacuugggucuccagagauguguccaaacgccuguggagggccagggguuuagcaugaggagggaggaggcuaaguugagcugaaaccgccacgucuggagaaagagugggggaaggggggugucauaaagccaaacacagacauggugacaggggagauacagccacacagagacccacggcaaaggaagcaaaagcagacacagaugugcacagugaaggaagcuauagccacucacggacacagcccagaaguaacagccaugcacaaacccacaaggacacaagcgggggcugggggggggucaccuacaguucaacauaugcuacagucacagccacccgcagacacagcggcaugggccacagccguaggcagacacagcacaaccccacuggaacacaaaaugacucaaguuacggcccuuccuuaucuccuaaagaaaaaacugaccaccuucaagcacaagcgcugauccgcagccacucaaagacauaaaacaacagaaauuggcccagcacaguggcucacgcauuuugugaggccggggcaggaggauugcuugacgucaggaguucaacaccagccugggcaacauggggaaaaccugucucuaccaaaaaucuuaaaacuuagccgggcgugguggcaugcacgcacuuguaaucucagcuccucaggaggcugaggugggaggauugcuugagccugagaggccaaggucacagugagccaagauugcaccacugcacuccagccugggcaacagagcgagaccgugucucaaaaacaaacaaaacccaacagaauuuauaacuacacccagacauaaaacuguguaagcaccgggcacgguggcucacgccuguaaucccagcacuuugggaggccgaggcgggcggaucaccugaggucaggaguuugagaccagccugaucaacauggagaaaucccgucucuacuaaaaaauacaaaauuagccgggugugguggcacaugccuguaaucccagcuacucgggaggagaaucgcuugaacccgggaggaggagguugcggugagccgagaucccgccauugcccuccagccugggcaacaagagcgaaacuccgucucaaaaacaaacaaacaaacaaaaaacuguaagcuauaggaacagguggacauacaacugcagaacccaccgcugcucacaggcacacaagagccuaagccacagcuacauguauugacacacacagguacuucaucacuugaguuucugcuugaagucacacuuucagugacuucuuuuuucuuuuccuuagagguggggccucauuggccgagcacaguggcucacgccuguaaucccagaacuuugggaggccaaggugggcagaucacuugaggucaggaguacgagacuagccuggccaacauggugaaacccugucucuacuaaaauuacaaaaauuagccgggcaugguggcaggcagcuguaaucccagcuacuugggaggcugaggcaggagaaucacuugaacccgggaggcggagguugcagugagccaagaucgcgccauuguacuccacccuaggugacagaaggagacuuugucucaaaaaaaagaaaaaagaaaaagagauggggccucgcuauguugcucaggcugaucuugaacuccuaggcucaagcaauucucucuugucggccucccaaaaugucaggauuacaggcgugagccacugcgccuggccuucugugacuucuguaugcuacaguguacacaggacccacgaguccuccucuucauggugcgacaaugguggaaggcauggcccuucucccauggugacaugcagucccucuguucucagacucacaccugggcccauacaggugaaccaaucugguugcuaguggcagguggcaucuaugaggccauucucagguggugggccccacagcugacuguggacacaugcugaugugucacacacccaagccagagccacacaccucacaccugcaggaccacaguccacuauacgaagccacugcacgaugccaggucccucugcauccucggccagccccaggcccuuggcaucaggcuguggcccuggcagagacucacacaccuguguccuugcugaagccccuucaccacacaugaaccaggaccauccagcccugaagccccaggccugaagccgacagccggacuuuggguuggggaggaaaggauucauaaccccaaggcucucuugcucccucgacagcuggggacagcuggguccuauucccagcagggguacugagccagccugcgcuugggccacugccuguagaggccacacucagcgccccgcucuuagcagcugaguugagccaugacucaucccacccacccaccuugaggggccucggugguccucccuucggucucaccaggcugcauuuuggcccucugggggcuggcccaagccguccccucccuuccuguccccucccuuccuguccccugggggaaggggccgccccagcuggcugcuggcugccagccucuccuccccugcaccuagugcuaagacuuuuccuugaaagggcagaagccagcuccucucccgaaucccagaaucugacauuccaggacuccacuaggccuguuuuccucugugggaacuagagccaaggcgagagacccgugccagccccgaggcucccggggcccaugggcccaggcaucgggcugguacagggccccggggcucucucagcccaucugucaccccucccccccaacacccagaugucccgucuuggcagugcugucccggacugccacauuaaugcuccagaacccgccagcugggcccuggggccgguggggcuccugcagagcccuggacaaaggcgagggagggagggaaggggauccuaagcaccccucccucccuggcccuaggaggcagacaugcccgaugagaucaacauugaugaauuguuggaguuagagagugaagaggagagaagccggaaaauccagguagguggggggacgugucccccagccucccacuuugcaccucccuaaaaauaauagcaauaguucacguguuuacugagugcucacuagaugccgggcacuggugugauggcuuuacauguauucacucacuuaacccucacaaaacccuccgaagcaggcgcuagugugagcuccauuuuccccaugaggaaaaugaggcccagagagguugaaucccuugcccagugucacacagcucagaaggagcagagcugggcaucgaacccaggcaguuuggcagccaugucuuugcuuauggcuuauaccuuuuuagaggagggaagugcugugugacccucucgcccucucuggaucuaguaacucaccccugcccugagucgauccacaugccccuugggcucuguuccucucuugaagcuuggugggcaguccacccuggagucugacuuccauuugucuugcugcuggggccuuuugggaaagggaaggggcuggaggggaguagguguuagucauuuacuguuuuguuuuguucuugguuggggguuuuagggacuccugaagucaugugggaaaccugucgaggugaguuuucucucccucauucucucccuguucuggccccaaguacucugaugggggagggggaagaagcuggcagaagggucucuggggaacaccacccggccccaccacccccggccccaaccugcccuccgcagcucuuucuggucuccaggggugucuuuuguccuccuacuugucucucucccucucucccccaucugcugagggggcuccauucuguccucccccaucugcccuguuuuugccucuccugugccuguccuuuggccaccagccuucgggcucagucucccucuguccuccccugucacugccuccgccaccccgggcucccuuccccaccucugggggcccuccauccucccaggcccugaagcugagcggcccaaccccucccacuuccuucccugcuuuaaaagggaaaacuauucauguuucuccaacuagcucuagggacaaacgucauugcauuucuguucgcccuggaucuaucucuggggaccugucuccacaugucucuguuucuuucucuguccuuaugucucucucugucucuaucucuacaugucucucuguuucugugucuguuucucccccucccccacuccguaucugucuccuuggaucucuaucucucuuccuagcucuuucucuccaucccucccaucgcccuuuccccaucucugucuuucucccggcucacuuuucucucuaugucuauagccuccgccccuaacuccccccaccccacaaucagagaacaggaggaggcgcccaggucagggacugggcuggacaggggcagagggugcccccgcacuguucccauguucucagcucccccacccugucucaggacuucauccaggagcugcuggcaaagcuucaaggccuccacaggcagcccggccuccgccagccaagccccucccacgacggcagccucagcccccuccaggaccgggcccggacugcucaccccugacccucuugcacucucccugccccccggacgccgcccagcuugcuuguguauaaguuguauuuaaugguucuguaacaauaacacuguguggcuguuuuuccuccccccggguuaccaugggcuuccccgagcuccccccacaaccucccucucuccuccuguggccucugcucaugucccugucccagcacugcagcugggccugccagauggagaaucacuccucccgggccagaaagcaugagaacgggcccugcugagcccacgcccuugggauuuauauccuagaccuugccuucccuugaacuccccaccccacccccauccccagucccagcaagcagggccccuauaugcaggcuccugcaggaaucugggucaaggggcaugcucaugaccaaaggugaccgauauugacucaguacaggugaucacacagcaaacaaaucauucagccacuccaugaaaucugcgcugugcuuauaauggcccuugguacugaggcugcaaagaugagaggaagauggucucuggcaucaaggugcucacacacuauggggggagaagggccugagugugagaaucagaacaaagugugcugaauggcucaagauaccugggagcuuggcagaggggagggagcuauucacucuggggguggugaagaaaucugggagggccuccugaaggaaguggcauuaaggugggcuuugaaggaugcauaggaguucugugaaauggauacccuucucugaggacucugaacuuauggguggagggauugauauuggggcagagccagggaaaacaccaaauauugccagggccauccaccagucaggaaggacaauggcccccagagcuggaucagggaagcccccuauugaacccagguuaauccuuucaugcuggggcauggagaggccuggagggucccaagggagcagcugggccaucagaaguggguaguggcuuuuuaaaaaaaauuuuauuuuauguuuuuuaauuuuauuguuuaaaaaaaauuauuuuguuuuuugagacagggucucauucugucacccaggcuggaguccaguggugcaaucuuggcucacugcagccuugaccuccucaggcucaggugauccucucaguucagccucccaaguagcugggacuacaggcaugcaccaccaugccuggcuuuuuuuuuuuuuuuuuuuuuuuuuuuuuuuuuuuuaagaaacaggaucuugccguauuguccggucuggucuuaaacucuugggcucaaauuaucagccugucucggccucccaaagugcugcaaugacaggggugagccacugugccugaccuaauuuuguuuuagagacagagccucacuuugucacccaggcuggagugcagugguacaaucauagcucacuguagccuugaccuccugggcucaauaaauccuccuaacuuggcaucccaaaaugcugggauuacaggugugagccaucauggcuggcuauuuuuuuacuuuuuuguagagacaaggucuccuuauguuguccagacuggucuuggacuucugggcucaagcaauucacccaccacacccagcccucuauuucaacauugucuuuuuuuucuuucuuucuuucuuuuuuuuuuuuaagaugaaguuuugcucuuguugcccaggcuggagugcaauggugcgaucucggcucacuguaaccucugccuccuggguucaagcgauucuccugccucagccuccugaguagcugagauuacagacaugcgccaccaugcccggcuaauuuuuuguauuuuuaguagagauggguuuuaccauguuggucaggcuggucuugaacuccugaccucaggugaucugaccgccucggccucucaaagugcagggauuacaggugugagccaccgcgcccagccguauuuuuuuuuuuuuuuuuuuuuuuugagacagagucucgcucugucauccaggcuggagugcaguggugugaucucagcucacugcagccucuaccucccaaguucaagugauuucuccugccucaaccucucaaguagcugggauuacaggcacaccacuaugccuggcuacuuuuuguauuuuuagcagagaugggguuucaccauguuggccaggcuggucuugaacucccgaccucaagugaucugcccaccucagccucccaaagugcuggguuuacaggugugagccacuaggccuggccuauauuucaacauuuuauuuuauuuuauuuuauuuuauuuuuugagauggagucuugcucugucacccaggcuggagugcaguggcgagaucucaguucacugaaaccucugccuccuggguucaagugauucuucugccucagccucccgaauagcugggauuacaggcgugcaccaccacaccuggcuaauuuuuguauuuuuaguaaagacaggguuucaccaccuuggccaggcuggucuugaacuccugaccucgugauccaccugccucggccucccaaaguacugggauuacaggugugagacaccaugccaggccuuuuaauggccuuuaauggcacggcuacauucuaaugguucugguuggaccaguggucccagguguguauaaucaggagcugggguggggcuguggccgugcuuaggaccagggcagggucagagcugggcugucucaccaaggacaaaguacaucucccacguggccuccacugacugaaguuggggccccagggcccuguccccaccugugccauuaaguggccccgccaggauuaagcacuuaucccgggugucugagcuccagucugggaggaagagaagaccccccugaggaggagcauccaggagcacccuggccuguccagccguucaggugaccuugcugucucugugcagauggacccaaggcuuccagugcucccuuuccuccacacuguauagagaaugggcaagucccuccugcugacaucccagcuccuaagcccguguccuagaacaccccacuugggccugcagaacccuuucuacuucccucucacagaaucucguuuggguuccuuguccugguggaggcgguaugcgcucaaaacccagguucuaaaguccugugugugcguguguuaggccucaguauccucaucuggaaaauggguacuuugcagaugaggaaacagaggcccagauuagggaugucacuuguucaaagucacauggcugggaaaugguggugcugggcuucagucccaggcauuaugacuccagagcccaacuauuuaacuccugcucuacagggucccuuuaaaccacagcaacaauugcuauuguucagugaugggaaaauauuggcuaauucauacuaaggucuucaugauugcucgcaauccguggagauaaccaaucuaaagggcaauacaauuaacugagaacaaugcuacagugaaggacugggaggccaggcggggugacucaagucucuaaucccagccaaggucacaggauugagcccaggaggucgaucacaccacugcaugcagccuggguaacgaagcagugucucaaaaaaaaaauaaaauaaaauaaaaaagggccggguacggugcacgccuguaaucccagcacuuugggaggccgaggcagguggaucaucugagguugggaguuugagaccagccugaccaacauggagaaaccccguuucuacuaaaaauacaaaauuagccgggcgugguggcgcuugccuaaaaucccagcuacuugggaggcugaggcaggagaaucgcuugaacccgggaggcagagguugccgugagccgagauugggccauugcacuacagccugggcaacagagcaaaacucugucucaaaaaaaaaaaaaaaaaaaaaaaggaaaagaauugggaaacggcacaccacagugguuagugguuaagaacauggauuuuggauuacugccuggauucaaguggcacuuccuagcugugugaucuugagaaagucaccuaacuucucugugucuguguccacaucuguaaaaugaaggugauuuuaauaguaccuaccuccagggauuauugugagguuuuguuuuauuuuguuuuuugagacaggguuucacucugccacccacacugggguacaguggugugaucuuggcucacugcuaccucugccucaggggcucaaaugauccucccaccucagccuccgaagcaucugggauuacaggcacacaccaccaagcccagcugauuuugguauguuuuguagaaaugggauuucaccauguugcccaggcuggucucgaacuccugggcuccagcgauccacccgccuuggccucccaaagugcugggauuccaggugggagacaccgcgcccagccuguugugagguuuaaaugcagagaauacgcuaggcccaggcacaugguaagcacuguuaucaacccugucauuguaaggaggggacugaucauuagcuccuauggucaccauuucuggccagcaggaagucccuuaggaacacugaaccacagcucuucagauacagaaaagccccaaaggggccaggagcaguggcucacaccugugaucccagcauuuugggaggcugaggcggguggaucaccugaggucacgaguucgagaccagccuggccaauauggugaaacaccgucucuacuaaaaauacaaaaaauaauaacugagcaugguggcacaugccuguaauucuagcuagucgggagacugaggcaggagaauagcuugaacccgggaggcagagguugcagugagccaagaucgcgccauugcacuccagccugggcaacaagagcggaacuccgccucaaaaaaaaaaaaaaagccccaaaagacacaguguacuuaacccaccaugcgccgcccuccccgccuuguagccacacuagccuccccacccagcuggcuccuugccucccaccgucugugguccguuucccacucagcagccagacaacgccuuuucucacucucacccuaaccuccauccacccuguucucucuuccucuuuccuccaaagguuaccauuuuaaaaagaaaaucaauuuc

SEQ ID NO: 15093 - RNA, 2486 nt, Homo sapiens
acaccaggggcuucuccccucaaagccauaccccgccucugggcgggcaugggggguggugggugccagccaggggcauggacagagccuuuuucuaaagaaaaagacaaaaaguuaaaaaaaaaaaaaagaagaaaagaaaagaaguuaauauauacaaagaguccuccaaggccuggcuggguggaggggcgcugcugagaguguccaccgggcacccgccucugccggccccccgccgggcgccccaaccccaauuucuggagcugcagccgucccgcgccccacccaaggugggcgccuuccccucuugugcccagggcggugggcgugguguccacccgccccuccuggugcccacgguggauacugcaugaugugaaccuugguuuugaacucuguuccugccccuccccgaccgccccagccugugcccgccccgugccugccguggcugguggguggcggugguggggccgggugggcccccgcccagcgccugcuggaaugagaagcacagacuccgccacggacuccuuuucucucccuccucccgccccgccaggccuggcggcccccgccccccucgcuggccauuuugggggagugagggggcgugguuguuucuugugguuguguguguuuguuguucggguuuuaaaaaagggaaacugagacugcaggugggggaggugguggguuuuggggggauguccccuaauccaggagugcccccucacuugucaccgagucuccucuauugccugccucugcugugaauuaacuuguucuguguauuaaacugggccugaccccucugcccacgacugccucguucucccgucugguuuggggcaucaccaagaaggaggaccgggggucgacgggccuuguugggggugaggcgaccagccagccccuaccuccauccaccuccuucuuccccugccugcacccugccucuccccggcuuugucccagcuccgcccugcuuugccagaaaggaggagaagggggaugggguggaggggcucccgcccagccagcugugguugcccuggcaacgggcugcugcagcugcagcgggcgcagccgggagggaggcgggagccgggccgggggaagggaagggcugggaagaggacgguggguuggccccuccugaggcugggguggggaacgggggugucaggaggugucaucccagacccagacaucuccagggggcuccguguccuggauguggggcaaaucagcgguggcgauaagguggaaagagaggcgcuaagggagggcaggaggguaucuagacacgggcacugggagagagacugagaugugggcgacggguggggggcgggagugaggagugagggaacuaggacacagaucaggagagagaaagagacgaggacagucacacaguuauugagagaaucagaaaaaagagcaagagggugcagaagggagagagacaggaggaaggaccaggagagaggaagggagcaggggugagaaggagguuuaacggcagagagggaauaacuaauaaaaaauagcugacaugcugggagagacgggaggaggagaaggaggacggugauuggggaagagcagcagcagauuuagggagagguccuccaagaggggaggcagagaaggagguaacaucuaucaggagagggaagagugagagggagccacauugcggguggagagagagagacuugggaucaggggcaggcaaagucccaggacaacaggcagagauggggagagacgcgggcggcaggggagagaaggagacagacuuuaggggaacagcagaacaaucugcagagagagccggagguaugagggacccagaaagauuggggaggagagacagggauguccgagacgggcagaggaagcuggaaacugggacacgaagggaagggccgggccucaaagcacaguuugggcgcgaccaggggcuggcgugcgcgcgaguuguggggugcuggaagcagcuggcguggcuccggcgccaggagaggaugugagaacagccuguucccaggcuucccgcccccuucgcccgguggcggggggagggcagugcggguugaggacggggccucgaggaggaggagggcggagacagggagggugucuagaacuccagaauuuuuaggagaugugggaauggcugguccugcuccuccggaugccagccccacgccuuuuggaaaaagacauuuuuuggagggggcagggucugagucagagaagcacuggguuuuagcucagagaugugaaacuccacgacagguacauggguaagggaggcagaaagaccccaccuggccagccccgucaggaggcuaggcuucccucaaggggcuggacuucgggauuuucaggaggaauuuccugauucagaaaccaguuugaucccgguucccaaaaugcaaauguucaccaggccagaugcagaucugggg

SEQ ID NO: 15094 - RNA, 2486 nt, Homo sapiens
ccccagaucugcaucuggccuggugaacauuugcauuuugggaaccgggaucaaacugguuucugaaucaggaaauuccuccugaaaaucccgaaguccagccccuugagggaagccuagccuccugacggggcuggccagguggggucuuucugccucccuuacccauguaccugucguggaguuucacaucucugagcuaaaacccagugcuucucugacucagacccugcccccuccaaaaaaugucuuuuuccaaaaggcguggggcuggcauccggaggagcaggaccagccauucccacaucuccuaaaaauucuggaguucuagacacccucccugucuccgcccuccuccuccucgaggccccguccucaacccgcacugcccuccccccgccaccgggcgaagggggcgggaagccugggaacaggcuguucucacauccucuccuggcgccggagccacgccagcugcuuccagcaccccacaacucgcgcgcacgccagccccuggucgcgcccaaacugugcuuugaggcccggcccuucccuucgugucccaguuuccagcuuccucugcccgucucggacaucccugucucuccuccccaaucuuucugggucccucauaccuccggcucucucugcagauuguucugcuguuccccuaaagucugucuccuucucuccccugccgcccgcgucucuccccaucucugccuguuguccugggacuuugccugccccugaucccaagucucucucucuccacccgcaauguggcucccucucacucuucccucuccugauagauguuaccuccuucucugccuccccucuuggaggaccucucccuaaaucugcugcugcucuuccccaaucaccguccuccuucuccuccucccgucucucccagcaugucagcuauuuuuuauuaguuauucccucucugccguuaaaccuccuucucaccccugcucccuuccucucuccugguccuuccuccugucucucucccuucugcacccucuugcucuuuuuucugauucucucaauaacugugugacuguccucgucucuuucucucuccugaucuguguccuaguucccucacuccucacucccgccccccacccgucgcccacaucucagucucucucccagugcccgugucuagauacccuccugcccucccuuagcgccucucuuuccaccuuaucgccaccgcugauuugccccacauccaggacacggagcccccuggagaugucugggucugggaugacaccuccugacacccccguuccccaccccagccucaggaggggccaacccaccguccucuucccagcccuucccuucccccggcccggcucccgccucccucccggcugcgcccgcugcagcugcagcagcccguugccagggcaaccacagcuggcugggcgggagccccuccaccccaucccccuucuccuccuuucuggcaaagcagggcggagcugggacaaagccggggagaggcagggugcaggcaggggaagaaggagguggauggagguaggggcuggcuggucgccucacccccaacaaggcccgucgacccccgguccuccuucuuggugaugccccaaaccagacgggagaacgaggcagucgugggcagaggggucaggcccaguuuaauacacagaacaaguuaauucacagcagaggcaggcaauagaggagacucggugacaagugagggggcacuccuggauuaggggacauccccccaaaacccaccaccucccccaccugcagucucaguuucccuuuuuuaaaacccgaacaacaaacacacacaaccacaagaaacaaccacgcccccucacucccccaaaauggccagcgaggggggcgggggccgccaggccuggcggggcgggaggagggagagaaaaggaguccguggcggagucugugcuucucauuccagcaggcgcugggcgggggcccacccggccccaccaccgccacccaccagccacggcaggcacggggcgggcacaggcuggggcggucggggaggggcaggaacagaguucaaaaccaagguucacaucaugcaguauccaccgugggcaccaggaggggcggguggacaccacgcccaccgcccugggcacaagaggggaaggcgcccaccuuggguggggcgcgggacggcugcagcuccagaaauugggguuggggcgcccggcggggggccggcagaggcgggugcccgguggacacucucagcagcgccccuccacccagccaggccuuggaggacucuuuguauauauuaacuucuuuucuuuucuucuuuuuuuuuuuuuuaacuuuuugucuuuuucuuuagaaaaaggcucuguccaugccccuggcuggcacccaccaccccccaugcccgcccagaggcgggguauggcuuugaggggagaagccccuggugu

SEQ ID NO: 15095 - RNA, 596 nt, Homo sapiens
uccccaaagccuccauuugcuuccauccuagggguguuuggagaggauggcuguggggagcugacuuuggcgucuaggaagagagguggugggcccagaggccgggccccucccuggcuccucccagccuucccagggcccuuacccagggaugcggggccacagggaagagacccuucgccccuuggguggacucccugacuucccagccaagaaugugguuguccuuuuuguuccaaaggugacccagcugcgccgucaugcgagcaaagcgguggcgcuuugugccugaagcccacuuucuccuuccccagauagaucagcucaaagcugucugcccuagagaagcuccagaaagcagccaagccagacugggcaugcugcuuggggcugugggggaauuaaccaucucuuuucuuugugucaaagguggggaagguauuaaagcaacagggcuuccuggauagagccacaguuaggagcccagauucagggcuuaaacuccggcuuccccacuuacaccuugggcaaaugccuuccaugugccucaccuuagcuuucccaucuguagaaugggacaguaauuccugugcuua

SEQ ID NO: 15096 - RNA, 1203 nt, Homo sapiens
cacccccgcuagcgcacuugcucccuccgucuacugcgcgcaaaacccgauggaaauaacagggagccuggaauaaagcugacccuuucccguaucagagcgaaaggccagguacacgaagacggggcugggaucugucuccgaguuccccgcaguuuccaugggagggagcucggguaaagcugugcaaucugcaguucuucagacugcgucuuuuuguuugggggccuucauucacuccgggguuccuguaucuaacucggagccauuccgggccgcuggaccugggcggcucugaagcgagaaggcagaggacgcaacagggcacccggcgcccagucagcgccacaaacuccacagcuacugccuccuggcucacacugaggucugcgccgcccccgcgccacccccgcgcccauugccucggugcaagcgaccaacucaccucucggagccgacaccagcagcgaagccggaaagaacugcgagcggaggccugugggaaauguaguccgccgaugggagggacugguuccagccccaacgggcugcgcggagugcgcaugcgcgggggccggagccccgggugcgcucggggcgggaaggcccuccgcgcugcguggggcugaggcgagcucgggcuugcguuugcuuuugucgcugaggaagacuuuuauuuguuuauuuucuugagacagggucuuacucugucgcccaggcuggagugcaguggcgugauuagagcucacugcagccgcgaccucccgggcucaagcgacccucccacccgagccuccagaguagcugggacugcaggcgcgcgccaccacgcccaacucauuuuuuaaguuuuuauagagaccagaucucccuauguuacccaagccggugucgaacuccugggcuuaaaagauccucccgccugagccucccaaagugcugggacuacaggcgugagccaccaggcucagccgcggaggauuuagaaagaaguuuuggcaccagcagaugccuaauauguguacuaaacaccuaccaguuacucacugcauacacccaagcaaggugugggcacacaucaggcaugcaaugaaaauacucucaaagcccaccagaaccuggagcaggacguaaaccuagaaaggucgcucgugcucacugcccucucccuuucucccacucugucucugucucugugugugu

SEQ ID NO: 15097 - RNA, 1578 nt, Homo sapiens
cggguggggccugggguuccuggacagaggaggacuacgcguguccuugggcggagaagggaggugacuccggcggaagaggacaaggcagaaugcaggcccuucgggugaggcccccaugggcugggccggagccccccacccagaaaaccccgcccuaauacgcgacucuccaagugcccccgcaucuagggccuuggaacgugagccaccuucagggccugggacuccccgcuaaacagccugggucccuucccccacaauccacucuucggagacaacuggggacccccaccccggcccaaagccccggguuugaacuugacaucucgggaacccuuaacacuggccucacccgggccuucucaggcagccuggacgcucccggggaccuccauuccgguccccacguucccgggaccugguuuccucccuuuaauccaggaaacccucccccaacaaaaaucucaggacuuaggccccccagaacaaaguccuucuggguccucucccuuccaggacccucuaggcagcccggucacccccaggccagacuccagggcgaguccccucccaacccagcuggcaguucgcggguaacagaauccaagcuauuacccuccucgccuuugggacgcucgcuagggauggggcuguccccacguccaggccucagagagcggggucccacuucaggacaccccuccaggugccuccaauacccgcccaccucccaccccgcaggugucccaggcgcugauccgcuccuucagcuccaccgcccggaaccgcuuucagaaccgagugcgcgagaaacagaagcucuuccagguggggggucgggggggguggggauccgacgcgccagccgggagcgcgccgagccggggcaggcggggcgcgcucuaaggagcagccagcaccccuuucucaucagacacccccacauccaggaggacaaugacaucccguuguaccugaagggcggcaucguugacaacauccuguaccgagugacaaugacgcugugucugggcggugagcgcagggcccgucugggcugcgggggaggcggggcuggacccagaguaagagguggcugguuucugggcaggacugaccaggaucuggguuggggguuggcguuuaggaagggggucgaguacugagcuggagucaggccugcagggaggggaguaacuaggguuugggcucuugucccaggacgggggcuggguuagugguggggcugaggcccagggaggagucggggagaaagcucccagcccggucuagaucaaagccagggggcuuuacaauaggaguccaaucugggaagggagcuggaguccgaacuagagcugggguccaggcugggaaccagggagccugaaggccuuaaaagccugggauguccagggaggggauuaggucucauucugucuccaacgcuuccccuuucuaggcacugucuacagcuuguacucccuuggcugggccuccuuccccaggaauuaagaccaagaagccuggggggccugagagacuugaacaagugucaauaaacgcuggccucug

SEQ ID NO: 15098 - RNA, 2725 nt, Homo sapiens
aucaggcugcgcggugcagggcgcggugcugugcguaggugucgggccgggagcuggugaagccgcaguccucgcacacgugcagcuucucgcggcgcucacgguaagcguagcuggccggcuguccaugcaccuuagcaaggugagcuuccagggagcagcgcugcguaaacgcuuucccgcaagcacugcagcggaagggccggaucccugcacagaugggcgcagaggggagggcuggacagagagggcaaugggcucuggacuaaagcgcccccacccugcuuuccaguguugagcauuucugguaccuauuccaagcucuucagacucuuccgcccaugacccaccaucugcuaccgucacccagugcagacaugggccagacaccugugucuccacucucccucaccaggaugcucccuccccugggggauggagagggaggccuucccuugccuuucgaucuggagccugaaucguauaaccggcauccgucugcacucugcauuccgugacaggccccuauuuuggugccaccuuacacccacccacugggguccgagagacaucaugucuugauucuccauaccccacauacacaaaccauggacacuccacagcccagcaccucucuccauuuccuuccauccccaccuggggcccagcaacuuuucccugucccugccacugcucaccagugugaguccucauguggcgcuugagaucgaaggcgucaugaaagcccuugccacaacagcggcacagguggcggcgcacggggcuguggcacuugaggugccuugucagcaugcgcugcagagggaaggccuuagggcagagcgggcagcccagcgucccagggccccugggagcagaggucagguugcccugugugggcugcuggagggaugcaggaguuauuagccucucuggcuggaccccauccacccuuuguuacucugcaaaugaguauuuacagaguguccugagccaccacggaggauuaggaaggcaggugggagacagugauuagugugugugccugucacucuccagggccuucccucacuaucccaugguccuuacuuucucuaugccaagucccaucuucugaugugacauacacauuuuuuuuuuuuaaagacagagucuugcucugucgcccaggcaggagugaagugguaugaugucaggucacugcaaccuccgccucccggguucaagcgauucuagugccucagccuccccacgauuacacgauuguaggcaugcgccacaugcccaguuaauuuuuuuauuuuuuguagagaugggguuucaccauguuggccaggcuggucuugaauuccugaccucaagcaauccacccaccuuggccucacaaagugcugggauuacaggcaugagccacuaugcccggucuauuuuucuaauuuuauuguuuuuuuugaggggggauggagucuagaucuguuucccaggcuggagugcaguggcgcagacucggcucacugcauccucugcccugccuccuagguucaacugauucuccugccucagccuccugaggagcugggauuacaggcacgugccaccaugucuggcuaauguuuguaauuuuaguagagacaagguuucaacauguuggccagccuggucucgaacucaugaccucaagugauucacccgccucggccucccaaagugcuggaauuacaggcugacuaauuuuauugucuauacaugcagccccaaccagaauauaagcuccauaaaauuguggauuuuugucuuauucccgcugaauauaacagcccaugccuagaacagugccuugcuuucaugaauauauuacauuccggcuggcgcuuuccuuccuccaaugcaugcacagcugaaaaagcccuuaucucccaucgcacuccuguugccuugucccauguucugacauaaagcggaucauccacauguggggaugaaucuugugccccgcuggaagagaucccuguggcugccggcccuggugccuggggugagaccuaacaguagagagcucacuacuaggaaaggagaggcauucccaacacagagaaguaggggcggacaggucccgaggcuggagggcgugugcagaugggucgggggagcaaggggcugucagcuucauuaaggcugagagcaggcaggagcgaaacagcuggcuuugcuagccaguuacacacucaccgcuguccacggaucccugacacuggacgacuguugugccgguggcccccccaggcugcugcagucugaggagaaaagccagauggugacacugcgucucuccugccccuuaccuccaggcacagugaggggcccaccugggauauaggcaucuccccggagcuggucaggcagauggccccaguuggggggcuguggacgccgacuccugaccaggaaggcgcggggcaugcccuccggaaggcucuccacacacaggggcugcuuccaccugcugucagaccucagccccaggaugacuaucccuggugggaaaggaggggaagccucugaggaaccucauucucuucaugcaaauuuccuggcuggcccugggaguggacuaagcuggcucagguuaccccugccuggggaccugcccaucuucucccagguuuuggagggaaccauccagccuccagggguggacaagcacuaggaccaccaagcagagcca

SEQ ID NO: 15099 - RNA, 50245 nt, Homo sapiens
cggcuuucccgcggcuguucgcuguuccagugggucguggcgguggcggcagcggcgguuaggggauguaacggucgcccgccuccggcgugacgauggcggccguaggguccggaggcuaugcgcggaacgaugcaggggagaagcugcccucugucauggcgggaguuccggcgcggaggggccaguccuccccgccccccgccccaccaaucugccuacggcggcggacgcgacucucgacggccuccgaggagacggugcagaaccgggugagaagcugcucgccaugucuaccccaguuccaggcuuccuagguuuccccuagucccguccugagaacuguggccccgacaucagcccccggccaguccccucagguuguucccugccaugccucguccccuaacccccgccccuuuagccacggccccucccacuuucuccucgcugcuuucccggcuccacccucagcguuggagcaauucggggguuccucgcugguucccacccguggaaaugcauuuugcuucuguaaaucacagccuaguccugcuauauuuuaacccccguucuaucgccuuuagacgucacgaucauagcucacugcagccucacugcccuggcccccgcugagucauuaaggucccuucgaggguucgguccagaguguuaccugccccaacucuuccucgcuucuaccccgccuucucucaccuucugcgaucucuauccuuuuuccucaccaaggugggauucuuaauccauauugucacucaaaacuaugagaaagacgugagaaguuauuuauaaaaucucugcagugcugccuggggaggagggcguacagaacaguucccuaaauccugagacagaaaaauggaaagaaaugauuucacaguagguagaaggaauuccauuagcacagcggcaauuaaaaaaauuguuuuccagcuguguaggcacaaaaucuguuuuuauaaaauggagaugauaagaaccauacuacugguagggcgcgguagcucacgucuguaaucccagcacuuugggaggccaaggugggcuguucaccugagaucaguucaagaccagccuggccaacauggugaaacccgucucuacaaaaaguagaaaaauuagcccggcaugcuagcgcgcgccuguaaucccagcuacucaggaggcugaggcgggagaaaucgcuugaaccugggaggcggagguugcagugagcugaggucaugccacugcacuccagccugggcgacagagugagacucugucucaaaauaaauaaauaaauaaauuauacuauugcauuggagggaaaugaaauuuuaauugugaucuucuuggcacggaguccagauaaagggaggauaccugguagcugcugguggagcuuguuccugccccaugacuuucuccugcacugugauuauaccgcccacuccuggcuacagggcucuggcuguaccucccaugugcucucugucaccaagguucagucacacuggccugcuuuugguuuuccugaggcuccauauucuuuucugccuccuggccuuugugauuggugaguccucagccugggcuuuuugcugcaaucugccugucuggcuccuucccauccuucaagucucagccugaaugucgcuaucuugaaaggccuucucgaaccccauucuaaagcaaacagccaccuucaucugucacccagcacccuauacuucauagccuuuaucuuauauguuccugaaagugcccuuugagcuauuaaacuacauauaacaauagcaaauucagagaggcguuauagcaaaguggcuaagagcacagacugcugcugaugguaugguuggacccaggcagccugagcuuaaacuuuaguccuguucuuccuggcagguuaugaacuucgcuuuuucuuuucuuuuuuuuuuuuuuugagauggggucuuacucugucauccaggcuguagugcacuggguugaucucggcucacugcagucucagccucccugggcucaggugaucuuccugccucaagccuccugaguagcugggacugcaggcgcaugccaccauaccugacuaauuuuuuuguguuuucugguagagacagggucucgccguguuggccaggcuggucuugaauuacugagcucaagcgaucugccugccucggccucccaaagugcuaggauuacaggcgugagcuacugugccccgccaaguuaugaacuuaucugugccucaguuuucuuaucuguaaaaugagaauaaugauguagaaaucucucauaggguauuugugaggauucaaugagguuacauauccuaggcacuuagaacaacacuggcauauggcaaguacucuauucauguuagcuaauacugauauuaugacuguguauuugggguaauauuuauuuauuuuuuuuguuuggcagcacagaguugaucugucuugcaaagaccuagucuaaaagugaccauucauaccagggcccaguaaugcugaucgacagauaagacaacaugagugccauggcuugguuguuuguguuggaauccuggcacuaccccuuccuggauggguaaccccucuuggccucuguuuccucaacuguuuuguuccuuuuuuuuuuugagacagagucucacucugucgcccaggauggagugcaauggugccaucucagcucacugcaaccuccgccuccuggguucaagcgauuuuacugccucagccuccugagugccugggauuauaggcaugggccaccacaccugacuaauuuuuuuguauuuuuaguagagacaggguuucgccaucuuggccaggauggucucaaacucuugacugagccaccacacccagccuuguuuaaauuuuaaauauuacuguucaugugguuuuuuacucguugaaaccgcucaaauuucuggacugugaaucugauguggggaaacugucuaccuuuggucacuacugugucucuccuguacagcccaaagugcuagcuuuggagccagacugccuggguuuguauaucaacauugccacuugcagauguaggaucuugggccucagacuucuuaccuguaaaacaggggugauaauagagccuucuucguggcuuguugggaggauucaagucuuuuauacauauaaaaguacuaagaggccgggcacaguggcucaugccuguaauccuagcacuuugggaggccgaggcggguguaucaccugaggucaggaguucgaggccagccuggccaacauggugaaaccccaucucuacuaaaaauacaaaaauuagccggacaugguggcaugugccuguaauccuagcuacucaggaggcugaggcaggagaauugcuugaaccuggaaggcggagguugcaaugagccaagaucucaccacugacuccagccugggugacagagcaagacuccaucucaaaaacaaacaaaaaaaaguacuuagaaacuuauucacaggucaccuucucaccgcggcauucgcccccuuccccugugcuccuaaccuccuuaucugcuuucuucucucuugcacccaucauuacuuggcaucuauuucacauauuuguucugcuccuuuucuauguucuacauacccaucaccaguagaaugugagccccccgagggcagggauuugucucuuccucaccacucugugcuuuucaccuagcguuguauuugucaaaggaauguugagagaacaaguguuagcugcugguggauggcguggccacagaagcucaguguggguguugaauguagcaggaccugaauggguggccaaggcggcugcaccauguggugcuggcuagggugggugccucugacuugggcuuuuucuuugcaggugucacucgagaaggugcuuggcaucacagcccagaacagcaguggccuaaccugugaccccggcacaggccauguggccuaccuggcaggguaagcagauaagggccucgacgucuaaucauugcuagggaauuuggagcuuggaaccugaagccauccguaaaucgcucugagccucauauuuuucaccuguagaauguggagaauggggccugccucugagagcuguggagaggauuccauagcccccucucugucuagaacaguuccuggcauguagugagugcaaugaaagccuuuauuaugacuacaggggggaggugacagcgauucugggaaagacaggugauuaaaguccacgcuguggugucagguaaccuggauuugugucccagcucugccauguaugcugcucucugagccucuuccucugccucuguaaaacagagcuggugacccccucugcuugcauaguugagaagacugaagaagaugcuacagcuguucauuccauaaauacucauguagccuggcacugugcuaaggacguccccucucuggguuuguuuccuuaucuauaaaugggccuaaauagucgugaccugaccuggcaguugugaggauuuaaaacaauuacaucccucuuucucucuuuuuguuuuguuuugcuuuuuugagacagagucuggcuguguugcccaggcuagaaugcaauagugugaauaacagcucacuacagccccaaccuccugugcucaagcgauccucccaucuucaccucccauguagcugggacuacaggcacaugccaccacagccagcuaauuuuuuuuaguggagaugagaucucacucugucgcccaggcuggucuaaaacuccugagcucaagugaucccuccugccccauacucccaaagugcugggauuauagccagcuuaaggucuuaauuagccuagggccugacagacauuaccucagaggaaguguugguuucuauuuaagaacauagcaauguuaaagugcccuagaauucucagcguaaacaccuggaggagggggaggaggaggagaccagagagaaccgagggagcuuguuuauuugugggcuuuucuggugggaauagaaucaucccaggaccccaacacuccccacaguugaggcacauuuuccucuuucuucccagcugugugguggugauuuuggaccccaaggagaacaagcagcagcacaucuuuaacaccgccagguaggcugaggccugggcccggggcagggguggaaccaggggcuuggcacgccuccccuccccuacacagccuggagauacucauggguaggugcucacucauucacuuacauguuggcucagcagcauucgccugugcugggugcuguuccgugugcuggggacacagcagugaccagaggagacgagaaucucugcuggcuagagcgagacagacuguaaacuagucagcaaauuacgggcugaucaugaucagugcuauggaggaaaugauggaggaugucuucgggcagguuugugggcagagaauaggaggaaagccuuaucagaaggcucagggaacgcugccuugacucugagaccugaaggaagcgagagggugacccauaagaagcuguagggagagcgcuucaggcagggggcacaggaagggcaaaggcccugcagugguuaagaaucuccggcgcuuuagaagcagccagggaucugggugccuggagaaaggagcagggaagaugaggcuggaccaggcagaagccacaucccguaggccuugcagccuuguagagggucugcauagcaugcugagugcagagagcagccacaggagggcaccacaggccaggaaugugcuuuucacccccagcccuccagcagcucuauucccugcuuugcuuuucuccacaaaauuugcucccaucucugauaugcuguccaguuuccucauugaugguauucacugugggucucccucagugugagcacucuugagagcagggacuuucucugaguucauuucugugucccuagcaccaaagagcaguaucuggcauauugauggcuauuuucuaagagaaagacuuaacaugauuuggguuuuagaaagaucccuucagcuauaaguuuacuggggaaggacccgcuccucugccuuggggcuaacugaucacugcuacccuggggauguggucccaauagggcugugaccuuuggaaggcacaccaugucccuccuuggcauagcucaggcucagcuccuuuggcccaguucuccagguggauggauaaggaguggguuuucuccugcccuuauggucccuaagguacgguccuuaagcuacggcagguucuuguuaucugacagaagugcauucccucuugaaaguggcuuuuuggaccuuuugcuccuaacuguggguucuguuacuggugauaagggcagagcuggguuccauuccuggcucaagcgucuauucacuguggaaucucaggugagacacuucuuucagagccuuggucuccucugaaaauaaaauagcugccuccaacugggagagcauucauaaggcagcagcuacaaaccagagucacacacacuugcccaauauaguauguuuuaaagguuggauaaguggacaacauuucaaguuuuuuaacacaaaaauccaaaugucccuuuuguuuggagaagugagaaauucucuggccucuggggcccaaauuccccuguggcagugaggggcugagcuuagugaaauuugucaggcccguuguggccaguuccucacaccuguguugccucccuaaucccuguaggcaguggaguggguggccuggaucuauaguagaugguaugcagguguccgcccuuggccaccagugggugugcauuaggaggugguguggccaguguggggauuuucacuccaacugcauaucagaaucaccuggucccugugccucaccgcccccccaccgccacgcaagagaaagccaaaucaguugaucugggaugaaacuugggcauuggcaauuuugagacuuuuuauauugaaauaauuucagacuuagaauaguacaaagagcuccuauauaccuauguaccuuucacauauuucacaaauguuagcuuuuuuuucuuuuuuuuuuuuggacacagagucuugcucugucacccaggcugcuggagugcaguggcacagucucagcucacugcaacuuccaccucccggguucaggugauucucaugccucagccccccagguggcugggaccacaggcaugugccaccaugcccagcuaguuuuuuguguuuuaguggagacgggguucaucauguugcccaagguggucuugaacuccugagcuuagacagucugccugccucagccucccaaagugcuaggauuacaggugcgagccacugcacuuggccaaauguuagcauuuuaccacauuugcuuuaucauuuuuugucuauauacauauuaauuuguucugaacuauuugagaaucaguuguagacaugaugccccuauaucucuaaauacuucacgccaggcauggugauucacgccuguaaucucagcacugugggaggccuuggaggcaggaagaucauuugaggucaggaguuugagaccagccuggggaacauggcaaaacccugucucuacuaaaaauacaaaaauuagccaggccugguggcaggcgccuguaaucccagcuacucgggaggcugaggcaggagaaucgcuugaacccgggaggcagagguugcagugagccaagaucaugccacugcacuccagccugggugacagagcaagaguccgucucaaaaaaaaaaaaaaaaaaaaaaaaaacuuaaucaaauaaauacuucaguguguauuuccuacaaaaaaaaaugacaaucuuuuuaaacuguaauacauccagcaaaaucaggaaaugaaaauugauauaucacucucauccacuccccagagggcaccauucaggagucagccuuugucccaugaauguccuuuauggccaaaggauucugucuagaaucacacauugcauugaguuguccccucagucucuuucaggcugacguggcuccucugucuuuucuugacuuucaggaucuugacauuuuuuuuuuucuuuuugagauggagucucugucgucaggcuggagugcaguggugggauccuggcucacugcaaccugacuccccaguucaagugauucuccugccucagccucccgaguagcuaggauuacaggcauaugccaccauguccggcuaauuuuuguauuuuuaguagagcugggguuuccccauguuggccaggauggucucgaucuccugaccuugugauccgcccgccuuggccucccaaagugcugggauuacaggcgugagccacagcaccuggccacuuuuuuuuguuuuuuuguuuuuugagacgaagucucacacugucgcccgggcuggagugcaguggggcgaucuuggcucgcugcagccuccaccuccuggguucaagcgauucucugccucagccuccugaguagcugggacuacaggcaugcgccaccgugccuggcuaauuuuuguauuuuuuuuuaguagagacgggguuucacuauguuggucaggcuggucacgaacuccugaccucgugauccacccgccucggccucccaaagugcugggauuacaggcuugagccacugcacccggccaaucuugacacugaggauuguagacgagguauuuuguagagugucccagcauuuggguuuguccaaugccuccucacgggcagacucagguucugcaucuuuggcaggaacagaccagaaggggugcuguguucuuccuggugccuccucucaggaggucuccuaugacuggugguguucacugggagcacuuggccaagguguugccugccagauuccuccacuucaaagccucucuuuucaccuuugugauuagcagguauccuggggacaucuuuccugagacagugcaaauauuaucuuguuccucaccaaacuuucacucaacuaaucuuaggcuuugacacuuuucagaugcuccccagggaaaucuaauguacagccaggacugagaacuacuggcuuagaggucagggcucugcccugucugguuagguaacugcaggcaggggacuuccuuguguugcagucaccucaucugccaaguugguucaugagagcccugacuccaugaagcaugcuugaggaaucagugcacugauggccagacagcauuugccagagggccaggcacaaggucagggcaugcgacagguuagagguggcuacgggcaacagaaaccccuccacagcauggcuuaaaacccaagagcaugcucuuccugcaugucauaaguccagaggugggcagcccaggggcugugucucugaacgccacauuuuuuuuuucugucucucuuuuugagacagagucucacucuguugcccaggcuggagugcaguggcgcgaucuuggcucacugcaagcuccgccuccuggguucacaccauucuccugccucagccucccaaguagcugggacuacaggcgcccaccaccacgccuggcuaauuuuguuuuuguauuuuuaguauagacaggguuucaccguguuagccaggguggucucgaucuccugaccuugugaucugcccaccucagccucccaaagugcugggauuacaggcgugagccaccgcgcccagccccacuucuuuuuuucucuagacggagucuuggucuguugcccaggcuggagugcagcagcacgaucuuggcuugcugcaaccucugccucccggguucaagcaauucuccugccucagccucccgaguagccgggauuacaggcuccugccaccacaccuggcuauuuuuuguauuuuuaguagaggugggguuuugucguguuggccaggcuguucgcgaauuccugaccucaagugaaccacccaccccucugccucccaaagugcugggauuacaggcgugaggcaccgcacccggcccccauuccuucucuccuguuccaccccauuuauugugaggcuucuggucuugaagucacuucauggcccaagauggaguucuggcugucgugugcguauuucaggaggggaacugguaggaagcagggcaaaggguucccuuugacgaguauuucaggaagucccacacagcaugucaguuuacuucuccuuggccagacuaagucauguagcuguaccugcauaguugcaagcauaaaacugggguuaugucaguaaggaaagagaggcgaguggauauccaggaggcagcuugcccuguuuguugcaguaaggagccacgggaagccugggaagcagguugacuugaugaugaauauuccaugaaguugccaaagucucacuuagcgacauuuacuuaguuaucuacacaccaauuuaccaucucacguagggagacaauuauuagauuguuaaggaacaaagguaaaaauaagauuaaaagagagaagggaguagaaggaaaccauacaaucugggaacagugaaucuugcugccagaaaccuacgagcuagccuguucauucagugcuugugcaggcuagcuaggaguaucagaaacauuuuggcucuuuauggauuuuccagaacaccuugaguauuuagcaguggagcacaggcugcaggcuaccuugaugugaugccugccaggauccucccaucagcaccacccguuuaguuaggccaggccuguaccauuuccugcaucucuauuucucaguguuacaggguggauagggucuuaggauacccacugcggcagagggagaagaaagcaggguccgcauacagugucuacuccauuuggguuuggugucucagggcggaaggggccuuugcauuuacccccauuucucugugugcuuugcugggcacaccagcggcacuggcucugugggagcugcuugagcucaccucugcuggccucuuccgaggcuugggaggcagaagagggcagaguccuaucagagucgccaggauggggucuggcuggccacccucagcggaaccagugaucagcucuuuucuuuauccccaggaagucucucagugcucuggccuucuccccugaugggaaguacauagugacaggggaggugagucgugaucgugacugagugggagucgggggcuggggggucuuggaagccauuccuucugcucccggcaggccugggagucccuggaauagcuccuuccugggccagaacagcccuguagcagaugggggagguggcuuuugggcacauccuguggcaaugccaucuucggccuugacaacccucuagcccugcccaguacagagcccagcagcaguaacgaccccaccuucccuagaaugggcauaggccugcugugcgcaucugggauguggaggagaagaaucagguggcggagaugcuaggccacaaguaugguguggcguguguggccuucucacccaauaugaagcacaucguguccaugggcuaccaacaugacauggugcucaacgucugggacuggaagguaagagccgaccagcaggccuguggcaggcagccagcugccacagcauccuaugucuugggcacagggagagcuacaugagaggacgcaguaaagugcucacucacccaacagauaacagcuauugagcaccugugacaugcugaucccuuauuguagggcacaaggcaggcucccagcuagaagcauuauacauauuuuuauauugaccagcugugaccuuaggcaagugacuuaacaucucugugagucuguuuccuccucuguuagauggauauaguaguacuuaucuuguugaguugugagacuuuaaugaguugauaagcacuggaaggcugggcuuuggaacagcuguggagcuggcagaaguggguaccaaguccuggcucugcccauaacccacuaugugaccuugagcacaugacaucucccccucugagccugguaggguuggggagaagcgccucccucguggggcuuuugagggauugaggaaauuucauggguuauccugugaagggcucagggcagggcccagagcaggagccccaucugugacagccauagguuguguuguccuuacaucccagccgugacuguccccaauaccaugugugggcugcagagcuuagacccuuggagagagcucuggaacauacugucccauggggaccauuccaagccucugucccuuccucugucggugaggaaugagcagggugccccacauagguuuccccauacagcagcucccuggagggucccaggaagacagacuuggaguggggacgagcagggaguuccagccugagggcaaaggcacaaacaguccaguggaaugagugcuggcaugagcuucucugcacuuauucuuccagaaagacaucguaguggccuccaacaagguaucuuguagagucauugcccucuccuucucagaggacagcagcuauuuugucacuguugggaaccgccaugugagguucugguucuuggaagucuccacugagacaaaggugaguuucugucccugccccuuuagccaggcccugagggagucaccaucgguggcagcauggucuccuguuucucccugagauuugagggcagcggucucgggccauuuggccucucaggggcccagcugcugcuucugggccuacucucagggugcugaugcacaggcccugccaggaacccccugacccugggaccagcucucauucuuggacugcugcuguccagccccucuguccagaguggcaggguucuaguguuuucuucccuucuccauuuggaagagcuucuuagaguucuccuguuuuguuguguccuaucaucuggucaugcagggcccagcuguguggacaaguaucucacuacgcccucugugucuccaggugacgagcacagugccccuuguagggcgcucgggcauccugggcgagcugcacaacaacaucuucugugguguggccugcggucggggccggauggcgggcaguaccuucuguguguccuacucgggccuccucugccaguucaaugagaagagggugcuggagaaguggaucaaccugaagguaccaccucccucucugccaucagcuggacagacucuuucucgugauaugugucugcaggggugcucaucagcauugaccacacagguucugcuuaugugacuaguggugaaugacgcccacucucugagcuuaagguuccacaucuguaaaaugggaguacugcugcccuccccgcagagcugauaaggaagucacgugagauaacauaggcaaggcagugagcacggugcuugguacccugaaaugggcucaaggugacaguuguuuucccaugacuauuugaucuacuucacauuucuuuucuccuuugagcacucuggcugguagaggauugcauuuuuuuuuaauuaauuuauuuuuuuuuauugaucauucuuggguguuucucccagaggggguuuggcagggucuuaggacaauaguggagggaaggucagcagacaaacaagugaacaaaggucucugguuuuccuaggcagaggacccugcgggcuuccgcaguguuugugucccuggguacuugagauuagggaguggugaugacucuuaacgagucugcugccuucaagcaucuguuuaacaaagcacaucuugcaccgcccuuaaugcauuuaacccugaauggacacagcacauguuucagagagcacaggguuggggguaaggucauagaucaacagcaucccaaggcagaagaauuuuucuuaguacagaacaaaaugaagucucccaugucuacuucuuucuacacagacacagcaacaaucugauuucucuaucuuuuccccaccuuucccccuuuucuauuccacaaaaccgccaucgucaucauggcccguucucaaugagcuguuggguacaccucccagacggggugguggccgggcagaggggcuccucacuucccagaaggggcggccgggcagaggcaccccccaucucccggacggggcggcggcagggcggaggcggacccccaccucccucccugacgggccggcuggcugggcaggggcugacccccaccucccuccuggacggggcggcuggccgggcgggggcuaaccccccaccucccucccggacggagcggcuggccgggcgggggcugacuccccccaccucccucccggacugggcggcuggccgggcgggggcugacccccaccucccuccgggacggggcggcugcugggcggagacgcuccucacuucccagacggggcagcugccgggcggaggggcuccucacuucucagacggggcggcugccgggcggaggggcuccucacuucucagaugggacggccaggcagagacgcuccucaccucccagacagggucgcggccggguagaggcgcuccucacaucccagacgggguggcggggcagaggcgcuccccgcaucucagacgaugggcggccgggcagagacgcuccucacuuucuagacggaauggcagccgggaagaggcgcuccucacuucccagauugggcagccgagcagaggggcuccucacaucccagacgaugggcggccaggcagagacgcuccucacuucccagacgggguggcggccgggcagaggcugcaaucucggcacuuugggaggccaaggcaggcggcugggagguggagguuguagcuagccaagaucgcgccacugcacuccagccugggaaacauugagcacugaguaaacgagacuccgucugcaaucccggcaccucgggaggccgaggcuggcggaccacucgcgguuaggagcuggagaccagcccggccaacacagcgaaacccuguguuugguggagaccaaaaaaauacgaaaaccagucaggcguggcggcgcgcgccugcaaucgcaggcacucggcaggcugaggcaggagaaucaggcagggagguugcagugagccgagagggcagcaguacaguccagcuuuggcucggcaucagagggagaccguggaaagagagggagagggagaccguggggagagggagagggagaccguggggagaaggagagggagaggaggauugcauuuuuuaaaaauuggagguaccauugauuuaauaacuuuucagucaaaaaagacuacacaaaauacauaaacuuuuauuuauuuuuauuuauuuuuacuuuuuuuuuuuuuuugagauggcgucucacuuguugccaaggcuggagugcaguggcgcaaucucagcucacuacaaguuccaccucccagguucaagcaauucuccugccucagccucccaaguagcugggauuacaggugccugccaccacgcacagcuaauuuuuguauuuuuaguagagacaggguuuuaccauguuggccuggcuggucucgaacuccugaccuuuagugauccauccgucuuggccucccacugcgcccggccauaaacuuuuaaacuaaagcaugaucuaucgauacauugcagagcuucuuuccuuuaguaucugaagguuugagucaaagcuguuuucccaucuggaaucaguugcccauuuggcuauccgcccgagcguugugguuuccucuccuguuccuggccugccuuugugacucacucuggagaucaccuucgagguuaauggcuuguggaagaguuccaaguuuuaucucuguccuaguugguuaaacaucauuuucucuuuuucaagcaagugaaaagcuuucaauagauagauguuuauuuccuaagcacuaaaugacucauaaauuaagucccuguagauuuggaaaaacuccuuaaacuguaucuagaggucuagcacuuccuaguaggauagacaguccuuucuagauacuguaacuuuuuucuguaccgcuuuggaguacagucuuuaugaaguuguuuguaagcaaaagggaauaaaauuuaagccuaaaggcugggcgcgauggcucacaucuguaaucccaaugcuuugggaggccaaggcagguggaucaccugaggucaggaguucaagaccagccugaccaacauggugaaaccccaucucaaaauacaaaaaauuaucugggugugguggcggccgccuauaaucccagcuacucuggaggccgaggcaggagaaucacuugaacccaggagguggaaguugcagugagccgagauugugccauugcacuccagccugggcgcaacaaaaaacucuaucucaaaaaaaaaaaaaaauuuaagccuaaaauucaacccuguuacuacaagugacuuaccugaaguugcagucugcugaacagguauuuuccauacacagcuacguuucucuguagacagcagugacaauucuguuuccguucaugccucugccuaccugcuggcacaugucuuucaauagcagcaguaugcuauauccugauuucacaaaucuuaaaauaugcuaaaaugggugucuuagacccaaggaacuguaagucuucucuggaggccuaaggcugcucugucaguccccauauccccgggccaggccacgugaagcaccaaauccacuggggucccuuuugccccuacaggucucccugucuuccugccucugugucagccaggagcucaucuucuguggcugcacagaugggauaguccgcaucuuccaggcccauagccugcacuaccucgccaaccugcccaagccacacuaccuugggguagacguggcacagggccuggagcccagguacugcccuguggggagagggaaugggaggggcccacccagagucuguccacuggcauucauccaugcuuccagauccaucuaucugucuguccaucccacaaauacccaucaugacucucagcccugggcauuacaaagcagaaaaguccuugccuuccgaggcaagccucacagugagaagugaggcuggguagggggaagaaacagugagaaaacaaaggaauaauaucauuucagauagcggucagcauggugaagaacagugcagagcaggugugaauguggcggaguguuuccauccacauggcugaccccuacuaaguggcugcuaagugccagcccugggcuggaagcaggacaugccuauuauaaugaagcagcaaaaucucugccucucugcaguauagcaagggggcucgaugauaagcaaguacacgaaaaagauaauuucaauaggcaugagugcuuuggggaacacagcagggacucgggaaggagagugacuggggugggcugugcugauugggugccuggugagaaggagcugcuguguggagagcugggucccagcaguugaggugacagcacacugggcuuguuacguugcaggaauaguaagggacuguguggccagagcccaguguguccggggaggauggugggagaugaggccaguguggggcgccuguagucuauccucaggucagugggcaguugcugggguuucgggcguugggguaaaugaccaggccuuacauguuaggucccucagcugcugugucgagaguggauagaagcacuaggcuguggcuuucuucuccuuuguugcaagucuguuuuauggaauugggggcuaccuaaccagggggugccaggugccuagggcugccucuuuguggauuucuggaugcuagcuccugggugccuuuuccacgacagggccugaacaggggaacugggugucaugaaggaaaggagggggcgagcaacccacaggcaguguuguguuguaguagucgggcucacagcucugcugucuucuguugugcucugugaccuugggaaggugacuauaccucccugugcuuccguuuucucauguguaaaauacaguaccuagcucuuauugugguugugagaauuuauugcagguaaaacucucggccuggcacaguguaaaugcucaguaaacuguagccuucauagggagaccccaggccaagggacagcuccccagccuccuuaggacacagaggcuuuuugaucaugcguuggugaggccaagaagaggugggaccugagauacaugccuauuaucuuucuaugcucagagagagagcaggagcuuggguugggugaaaugaugggcgauaaauguucauaggaaucaaaaacucaauugcucucggggccaggcaaaaauuuccgguuuguagccucuauaugaaaagcaaagcagaggaagagggaagagggaaaaguagaauuggagcaggagagauggauggccacaaauaccaugagggauggcauugccggggaggcaucuccacugucacuagagguggcugucacuacucagugacauugauggugauugauuacccauguggccuuguuagcuuccucuuccacaggaaggcggaagcagucuacccagauacaguggcacugaccuucgaccccauccaccaguggcuguccugcguguauaaggaccacagcaucuacaucugggaugucaaggacaucaacagagugggcaagguguggucagagcucuuccacagcuccuacguuuggaacguggaggugagccccccccccacccccuugccccugcuuggccucugcacaguuccccacaguuugggaacccauucaguaauuccuucagaagauacucauugacucccuccuaugcaucaggcccuguccuaggugcugaggacacagacacaaaaucccugcccuuaacaagcucacauuuggaugggaaaggaaaccuggaaacaucaucagugaauaacacgccaagcagcaguaacccucugaagaaaaaugaggcggggaaggggaaggggaaugcaggugguauucuagagaggagaggggucagggaaggccucccugaggacauaugagcagagaccugcaggaaaucggggagugagaccugcaacugcuggggagaaccacaagcacagaggcccugcggcaggaacaugcacuccacagagagcuuugcuguggaggucguuuauguauuucacugcuuuuuuuaaaaaggaguugaagacggggcaugguggcucacaccuguaaucccaacacuuugggaaucugaggcgggaggaucacuugaguccaggaguuugagaccagccugggcaacacaagacccugucucuacaaauaauuuuuaaaaauuagccaggcaugguagcacacacguguggucccagcuacucaagagguggaggcaggaagaucacuugagccugggaugucaaggcugcagugagcugugauugugccaccacacucccacacuccagccuggguaacagugagaccaugucuaggaaaaaaaaaaaaguuuugaaguuuuuauuuucugagaaugaauuuguggguuuuuaaaaauucucuaaaguuaaccaggcacaguggcucaugccuguagucccagcacuuugggaaaucgaagugggcagauugcuugaguccagggguucgagaucagccugggcaacaugaggaaaccccggcuuuacaaaaaauacauaaaaauuagccaggcgcgccuauaguugcagcuacucggcaggggcugcggcaggggggcugaaaauuucuuacugggaauguuuguccuagagaaauuggguuuucaguggccagauucaggaucgugagaaagaacuuuguccuuuugaauaggcagcauucagccuaugacucugguugaaucugucugccuucauggggcugacguuuuuguugacagcacuuuuuuuccacucaaagaauguuuuuuaauaacuuuuaaaauuccuguaugaaauuuuuaaaaauuugggauaauaggugaaauauuacagauaaggcuacaguccacauugaugacuucccugcccccaguucugcucucucucgcccucaccauuaucaauuuuauuaugggugucuucaguugauuuucuuugcaucuccuuauuguuuauguauauagcuguucaacaacaguaucuguggauagaucuuuucaucaguucuagaaaauucucagccaauacugcuucuacccucuucucucucuuuuuuuuuuucagacggaguuucacucuuguugcccaggcuggagugcaauggugugaucucgguucacugcauccuccgccucccggguucaagugauucuccugccucggccucucagguagcugggauuccaggcaugcgccaccacgccuugcuaauuuuguauuuuuaguagagacgggguuucuccuuguuggucaggcuggucuugaacucccgaccucaggugauccgccugccuuggccucccaaagugcugggauuacaggcaugagccaccaugcccggccuauucgcucucuucuaagguucuaucuaacucuaagguucuaucuguauucuucauguuucugaaaauaaaaaucacacaaaagauauguagaguuuaucaauuauuguuagcagcuuuuuuucccccccaagacggaaucuggcuguguugcccagucuggagugcaauggcacaaucuaagcucacugcaaccuccagcuccugcguucaaacaauucuccugccucagccucccgaguagcugggauuacaggcagccgccaccacgccuggcuaauuuuuguguuuuuaguagagaugggguuuaaccauguuggccaggcuaguuucaaaccccugaccucaagugaucugccugccucggccucccaaagugcugggauuacaggcgugagccacugugccuggccuguuagcagcuauugaugcucaguuccuggacccuuuuauuuauugaggguugcaauauggugauauucuaaaucuauaauuuauuuuuauuaguuggacuacuuacgugaagagauauuugcucucaucugccauuuggucacccagugcuauacuucauauaggaaaggcaggagaaauacuugauucuuucccuuuauuuaccaguuuucaagauaaugaauugguucccuauccucuaaagguaacuaguuuuauuuaauaucauuauaaacucauauauauuuaaauauaucagauauguuuuaaucuauuguaauuauuaacuuuauuggagcucauaucaucccaucuuuggccagugagagccucuuaacauuggcuccugagcccuuuggacaugacccuaguauuucuugauagccaccuugcugccugggaugccaauauguuccagucucaucuuguacauuuccugucacacaucaggaaucaaccauuucucgaaaagaccauguuuuuuuuuuugggcugggugcaguggcucaugccuguaaucccagcacuuuggaaggcuggggcaggggaauuacccgagcccacgaguuugagaccaaccuggccaacauggugaaaccuugucuccacuaaaauacaaaaaauuagccgggcaugguggcaggcgccuguaguccuagcuacuugggaggcugaggcaugagaauugcuugaacccgggaggcagagguugcaguaagccaagaucaagccacugcacuccaaucugggugacagagggagauccuaucucaaaaaaaaaaaaaagaaaaaagagaaagagaaggccaggguuuuuuuuuaguacaaauugggacuucagaaucacagguuggguguuagggaugcucaucgcuauugggucguucuuccagaagccuaguucuuaaggacacaggggaugguggaauuagaauauccccaguaacucauuugcuuuuucccacauuauacaugcaacagucugagaauggacaacuuuucaauucugaagauaguuaaaacaauuguaaugcauauguucucucuguucucuccaauuuuuaaaauaguuauacuauauuuacaggaucugaauauguagccauuauauacuauagugucucccuuuugaccccuguuuauuuuggaauggggaauuauauauguguguauauauguauguguguguguguauauauauauauaaaaugauaaaauauacaugacaucaaguucaccauuucaacuauuuuaaauuguaccauuugguggcauuuaguacacuuacagugucaugcagccaucauuacucucuaguuucagaacauuuucaucacccacccaccccaaaaaauccuguaucuguuaagcaguccuccccauuccccacuccccccauccauggaaaugacuaaucugcuucugucuuuauggauuugccuguucugaaucuuuucuuuucucuccuucuuuccuuccuuccuuccuuccuuuuuuuuuuuuuuuuuuugagauggagucucacucugucgcccaggcuggagugaugcaguggcacgaucucggcucacugcaagcuccgccucccggguucacgccauucuucuuccucagcguccugagcagcugagacuacaggcacacgccaccacacccagcuaauuuuuuguauuuuuaguagagacgagguuucaccauguuagccaggauggucucgaucuccugaccucgugauccgcccaccucagccucccaaaguggugggauuacaggcaugagccaccaugccaggcuguuuccuuucuuuuccucuuucuuucuuuuuuuuuuggauggagucucgcuuugucacccagacuggaauacagaggcacaaucucggcucacugcaaccuccaccucccgaguuaagcuauucccaugcuucagucucuagaguagcugggauuacaggcacaugccaccaugccugaugaauuuuuuguauuuuaguagagacaggguuucaccauguugcccaggcugguuucaaacuccugagcucaggugaucugcccgccucagccucccaaagugcuaggauuacaggcgugagccaccaugccugaccugaauauuccuuauaagugaaaucauagacuaugugggcuuuugugccuggcuuucacuuagcauaauguuuucaagauuuauccauguuguagcaugugucagcacuucaugccuuuuuaugguggaauaauauuucauuguacggauagaacacauuuuguucucuguuaucaguugacggccacuuggguuuuuuucuaccuuauggcuguugcgaauaccacugcuaugaacauguaaguacaaguuuuuuuguuuuuuuuuuuuugaaacggagucucacucugucgcccaggcuggggugcagugguaugaucuccgcucacugcaaccucaggcucccagguucaagcgauucuucugccucagacuccugaguagcugggauuacaggcacgcaccaccaugccuggcuaauuuuuguuuuuuuaguggagacacgguuucgccguguuggccagguuggucucaaacuccucgccucaagugauuugcccaccucggccucccaaagugcagggauuacaggcgugagccacugugccugacguaguucuuucuuucaguuacaucacuuuguuucugaguuuuuguagguuguuuuucauaccuuggaucauuuuuuaaauaucuuuuaccuucuuuugaaacaguaggcccagcgugguggcucacgucgguaaucccaacacuuugggaggccgaggcagguggaucaccugaggucaggaguuugagaccagccuggccaacauggcaaaacccugucucugcuaaaaauacaaaaaauuagcuggccgugguggcgggcgccuguaaucccagcuacuuggggggcugaggcaggagaauugcuugaacccgggaggcagagguugcagugagccaagaucgugccauugcacuccagccugggcgacagggcgagacucugucaaaaaaaaaaaaaaaaacaaaguaaguuauaguuuuuaucuuuuuuugugaaaauauguuucugcugugcuuuuuuuuuuuuuucuuuuuuaagaguaacuauuggauuugaccuugguccuuuccuguuguucauuuuuaugugauaccaguuuuucugaaauuuuagaaguuggugugcuucaggacagauuuuccaacuacacaagaagaacucugucuuuucuuuuuuuugugggggugggguggcauguuuuguuuuguuuuugaaaaggagucucacuguuaccuaggcuggagugcaguggcaugaucacagcucacugaagccucaaccucauaggcacaagcaguucuccugccucagccucccgaguagcugggaccacaggcaugcacuaccaugcccagcuaauuuuuuauuuuugguagagaugggaucucauuauacugcccaggcuuguuucaaacuugggcucaagcaguccuccugccucagccucccaaagugcugggauugcaggcuucuguuauuuuuauacuguguuaaaauauggcagccugcuuucugauacuuccuuuuugugguccucuuuaucuguuaugucucuucuuucgucucaaucuccucuuuacuuuauuucuucugucccuguugugauuggucaauuucauuucuacucuuagcaguuucucuucaguguggagcuuuguccuggaaggacaaaguucacaggaucuucuccagucccuuuaggccuuaccccuugcacucaacugcuguugggguggaugaaacccuccuacuuucagcugcuguucaguuuggcccagugugcuuuccaaugaacaccucuuggcuacuuuggaauuauccuguugcugggucugucagaugccuuauuacuucucugucucccacaugcaugcugaugauauguaggucuugugauugguggugguuugucccacucacuuguauuuugggguuuaugggaguauuuugucacugaguuuugcuauaaauguugucuguagguuuggguuuugcuaucugguugauguuuuucuuaugucgagauuuugggagauuaaaaaaauuaaugccgcuacuaucaucuucccaguucucaaucuuccguauuuugaaaucucuuuauaugguggcucuuuguccuucucagcuucauucuaaauaucuuuaguuuugucuuucaguucacuuaauuuucuccucaguuauaucuaaucuuugguuuuuaauguuuuuauuuuuuuauuauuuuuuuuuugagacggagucucccucugccgcccaggcuggagugcaguggcgugaucucggcucacugcaagcuccgccucccagguucacgccauucuccugccucagccuccugaguagcugggacuacaggugccugccaccacgcccggcuaauuuuuuguauuuuuuuuuuuuaguagagacgggguuucaccguguuagucaagauggucucgaucuccugaccucgugauccucccgccucggccucccgaagugcugggauuacaggcgggagccaccaugcccggccuauuuuuuauuuuuuuauuuuuauuuuuuugagauggaguuucgcucuuguuacccagacuggagugcaauggcgcgaucuuggcucacugcaaccuccgccucccagguucaagcaauucugcugccucagccucccagguucaagcaauucugcugccucagccucccgaguagcugggauuacaggugugcaccaccacgcccagcuaauuguguauuuuuaguagagacgggguuucuccauguugaggcuggucucaaacuccugaccucaggugauccgcccaccucagccucccaaagugcugagauuacaggcaugagccaccgcgcccggccaauauguuuuuauuauucauuucuagaagcuguucuguuuuggucuuuuucagcccugcuugguuaaucuuuauaauuucugguuggcugcacacuuuuaaucuugucaaaauuaucuuuuaguucuucaaacauauugaauguaguuauuuuauauucugucugauaauuccaauuuggguuuuuuuauuuuguuuuugguuugucugucuguuuguuuugagacacagucucauauguuggccagaguagacuugaacugcuggucucuagcaguccuccugccucagccucccaaguagcugggacuacaggcaugcgccaccuccccugauuuaauaauuccaguauuuaaagucuugcuagacucuguugcuucugcugcuucuugcugaugguaccucguuuucuuuugugcuuagucauguuugauugaguuccacauuucccuuggaaguuuauuugaggguauguguuaaggccuaggcugaaggugggacauggaugauauaugguagcauuuuguguccuuuuuuuuucuuguuuauuuuuagcauagaagguauugcacgauaccuguuuaucuuuaacuuacuuuuuuuuuuuccaugaaaaugcaacaguaagucauagugcugucauugagucauccuuugccuuguccucugggaacuguagguguauccugaguuugaagaccagagagcuuguuugccaucaggauccuuucugacuuguucuucagacaacaccauucgcuucuggaacuuggacagcagcccugauucucacuggcagaaaaacaucuucagcaaugugaguggcuuccuuugugaaccaucuuucaggaggaacaaagaccuacuguaagcuugaaugcaggggcaggagagagucugauggacccuagauguuagguuccaugagggcaagagccggcaaccaaggcaggucccucucugcaucacugccucuuguuucucuuucuccugcccccucucugagguggcacgcucuauccucucugauucuuugccaguuggcuccugcucugcagauguguggacguggccacucccggcagcccaacacacccagcccaggugaaauugcuuccuaagucuugagauggaauucccugggagagcaccugaugagccagcccauucagcugccacacagugaggccucacggggguaugggcagaaugcuggcgagagccaugaugggaggcugggaagaaaaguuugcugaggaaauuuugguuaguauugcaagcccagugagagggcgucucuggggagcugagaccugagucaugcauucauuuauucugcagacacuuauuaacguccaugccaggugcuuggcuacaugcuagggacacaacagugacuaagacucuucuguccuguggcacacacaaucuagugagggccgacagugaacugacagccgaccauguuaaugcacaaucacaagugcgaaaagcacugugaaggaaaaugugcagggugcuaguaggacauagagcagcagcaugugaacuuaucugggacauccggagcagcuucccgcggaagggacagcuaaguugagauugggaagaguaaagagggaaggggagagggucuauacuuagggaauagccuguaugaaggcccuggggugggaaacagcugggugaauuggaaaaccugaaagaggccagugugauuggaacuaaaaagacccuccaugcaggaggcuguagcaggugcccugcaggugcaccuuuauuacuccccucauucccuacccagugcuaccaucgucuccucuguaccugugacauacaugcuguuuuuggcugcacacaauagaaaaacucaaaacaagagguaaaaguuagguuucugacucaugaaaguagucugaagguaaccaguuuagaccguucugcaggaagcccuuagggauccaagggccuuccagcucucuacucugucauuugagggagcaggcuauguccucaugacccaguguggcuaugggggcuccugcuaucauaucugaguuccaggcugcaggauggagaaaagacagcagaagaauacgugcuugcuuuauauuuaauaguucagaauuuauucacauauucuuaucuagcugcaggggaggcaaggaaauaauuauucugauuggugaaacucccagcucaaaauuagaguuguauuacuaacgaagaagagacuggcuauggagggacacgauuucagaggugcuucugagcugcucgugcugaccucagcccuguccuuccugcagacccugcugaaggucguguacguggagaaugacauccagcaccugcaggacaugucacacuucccagaccgggggagcgagaaugggacacccauggacgugaaagccggggugcgggucaugcaggucaguccugacggccagcauuuggcuucaggcgaccgaaguggaaaucugaggcaagugggcccuggcaguguccaguguacaccucccagcuccagcucagguucucagggcagugggcagaagcccuggccuuggcaccuccugcugcccauugggaaugaggggcugugaauaguaaucccaugaacagcucccauugggaacuuaagcucguaagaggcuuccagaagggcugagagcagaguaacuaccaggaccucagcagcuagggugugcagauuuugccuauagaguguacaggcaagcucacaugacucuagggcagcgugacacuuucaccagccacaugguaccagugcugaacugucaccgaagaugccagcuggaggaggguccugguggcucugggagaggggcuaugagggugggauagcugagaguucaggcugcuuaugugcccuguugagguuuggcaggauguuaccaacccaguaggugcuagugggacauaggcccuguugcugggaccagguuuaagaugacaaaugacagcugugaccaccuggguauuggagccacuggggaauggaggagaguugggggaaacuagaggggacauaaaggggcagcagccaccaggcagccccaggagaguaggcuacaaguuuucaaacuuuccuguugucaagaagagcagaaagugccgauuuuuuucugugaaauucgauaauuuuuaaauauuggcaccuguuuugauaucagucacuguaugagaccagcucagugugucagugagcugcuuacauugacauggcacugucuggaguggcaaaacgguaccaagagccaacauggggauagugcucuucccccuuggugggcgcuggccugagcacuguguugacugauuuaauccucucacugaccccugauguaagugauguuauuggcacaaggugucuggaguaagaucacacggguagaaugaagaagcugggaugacucgaugacugauuucauuuggggagaaucaggaaggucuagauuugagacucuuuuaacaaugagagacuggaaucaaauguucucauccauagcuccuauccuggacuaugaccucuggccccuagccccuggccccuguccuaccccagggaccaccucugaugcagcccuacguaaacaccugccccccuagaagacuguccuagaucccuggggcucuguucuggcccaggcaccacaaggggcugcugccugcugaggugcucccugguucaacacggcucccuuuacgauggcagguuucuaaaugagaaaagugguugugcaugucuagaguauuuggccaugauaagggguucucauuguugguggccuggccauucugaccuauucuagaagugguagagcacauggggcugggguguggggcuucagcgggcggugugugucucccaggauccacgagcugcacuucauggacgagcuggucaagguggaggcccaugaugcugaggugcugugccuggaguacuccaagccagagacgggugagcccgcagcagggguggaaugggggucaggcagggaggcagccccccuggcagggccacagaaagggguaguuggugucuggugggacuguggaugacagcugggaguuuuguguucgguaagggccccuguagcuggacccugagaccagaguggcugggacuucagaaagcaagacacccgcaggcaggacucagcuugacuugcccgcugcuggugccagcacccaagccaaagggguggauguaugaaugagugaauugugaaugagaagauagauugauuguuaggcauuauuuucaaaaaguuugaagccuauagaaauauugggagaauauuauaaugaacaccccauaggcuucacccaaauuccucaauuuuuuuuuugagauggagucuugcugucacccaggcuagaggggaguggcaccaucucugcugacugcagccuccaccucucugguucaagugauucucgugccucagucucccauguagcugggauuacaggugccugcugccaugccuggccaauuuuuguauuuuuaguagagaugggguuucaccauguuggccagguuggucucaaacuccugaccucaggugauccgcccgccuuggccucccaaagcgcugggauuagggcaugagccaccacaccugaccuuuuuuuuuuuuuuuuuuuuuuugagacaagagucucacucugucgcccuggccggagggcaaugacgcgaucucaguucacugcaacuuccgccucccagguugaagcgauuccccugcguucaagcgauucuccugccucagccucucgagaguagcugggauuacaggcacgcccccaccacacccggcuaauuuuuguauuuuuaguacagacgggguuucaccauguuagccuaggcugaaggcuaggaccauaguagggucuccagaccucaugguccucuucauuaaaacaacagaaaauuccuucugggccaucagaugagaucaugagauaggagaagauuuccaagugaagauuucguuuguuucaagacagagucuugcucugucacccagaugauauauggaugauauaugguagcauuuuguguccuuuuucuuguuuauuuuuagcauagaagguauugcacgaugcuggucucaaacuccugacgucaggugauccacccgccuuggccucccaaaaugcugggauuacaagcgugaaccaccaugcccggcuccucaagauguuuucuaggcugggcacgguggcucaugccuguaaucccagcacuuugggaguuacagaguugguggaguuauauccugaugugauuuuccccauguucuucuuucguucucucaucccccaugcugugugccccaccaacuugucuugaaacauaucuucacucgguucgccucuccugaucuccccucugccucaggucauguuauuaggccucagacauagcaagugaccagaguagggaaggcugguggcagaugggagucuggccacaggcagucaauaggaccugaacaaggcccagguagccagaccucagagggugagaggacacugguuuuggaagaggcugagagguugccagggcuuuacccagcacagacccagcaggcaagagcgcugggcucugcuggggcgucugcuguggaugucccuggaggagcguccaugcgcccaucgagacucauccucccugagcugguggugaggaggugaaaugccagggugugggggcucugggaaagaccacacagagcuaagggaguggcccuugccaggcuugggccaaguuggcuacaguugaagaaccaaagaccccuucuccgaggacugggcagcuuggucacacugcccuucugggaggccagggcacccacgcagccuucaggaaccagucucauucucuccucucacagggcugaccuugcuggccucagccagucgggaccggcugauccaugugcugaacguggagaagaacuacaaccuggagcagacgcuggaugaccacuccuccuccaucaccgccaucaaguucgcuggugagccccuuucuucccgcucccugcgccuugcuagcuacccugcuaaaaaaggauucauucuuucaacucuccuguaaaauauauauccaaacaagugaauacaguaucuguguacaguauacagaauaaugacuggggccggguguaauggcucacaccuguaaucccaacacuuugggaggccaaggaggguggaucaccugaggucaggaguucgggaccuuccuagacaacauggugaaaccccgucucuacuaaaaauacaaaaauuugcugggcgggguguuguuucuguaaucccagcuacucaggaggccgaggugggagaauugcuugaaccugggagguggaggcugcacuccagccuaggcaacagagugagacccugucucaaaaaaaaaagaauaauggccagguaccauggcucacaccuguaaucucagcacuuugggaggccaaggcagguagaucaugaggucaggaguucgagaccagucuggccaacauagugaaaccccaucucuacuaaaaauacaaaaaaauuagccaggcaugguggugugcaccuguaaucccagcuacucgggaggcugaggcaggagaauugugugaacccgggaggcggagguugcagugagccaagauugcgccagugacuccacuccagcuugggugacaaugcgagacuuugucucaaaaaaaaaaaaaagaagaauauaggccgggcgugguggcucaugcuugucaucccagcacuuugggaggcugaggcaggcagaucaccugaagcuaggaguuuaagaccagccuggccaacauagugaaaccccgucucuacuaaaaauucaaaaaaaguaaccgggcaugguggugcacaccuguaaucccagcuacuugggaggcugaggcaggagaauagcuugaauccaggaggccaagguugcagugagccaaaauuguuucacugcacuccagucuggguaacaagagcaaaacuccaucucaaaaaaaauaaaaauaaaaaauaagcugggcgugguggccgaagugaguauccacaguucuuaggagcaagguuugaacuaggacguuguugauagcagagacuguucuaauugcucauggucguaauauuguuaaauacgguacuuggauucaccacgugcagguuaagaagcagaacauuaccagaggcuugcaggccuucucugggucccucccagguuacccuuccucccuuauauggggcucacucccuucugugagccaaugacuccuccuugagcaacaucuaauacuuguaugucaggccuggacccucucaaauguccugucaugaaggagcaugugugaugugcccagacucagaguuuuauauuuguucugucauuucauccucaccaaacuguuauucuguaaagaaaugagacggccgggggcaucucacgccauugcacuccagccugggcaacaagagcgaaacucugucucaaaaaaaaagaaaugagaauaauaaaagcaagaauguuucuaaugcuuaccauguggcagucccuguuccaagggcuucacaucacucuccagagaaggaacugucaccaugcccauuguacggaccggaaguugaggcucaaaggggaggcccagguucagagcaguguuuaacagcuuugaccuuggcaccagagaaugccuggguucaguccugccccuguccucucugugugccuugggacaaggacucugugaaccucuguguucaugcuuguccagugggauggguggugagcauucaggaagacccgcuacaugcauggggccuggcccaaggcucauguggaucuugcaguugauccugauggcacgagccucccagccugucuccacuggucgcugcugcaguccugccucuacuccgcuacucaagucaccuaucucaaucccagacuggagagggugucccuucuuuguccccagccuuuguuucucuauaugcccuugcucugcagagccugccuuggccacagcuccaccugugcccccucacacguacagcucauaccuuacagagucccacccagacccagcacccaccucaccaccuuuaggaagccuugaucccagcacaguugauugauggcucuugcaguggaguuccccagcuaggguccccugcccauguggcccagcccugccuaacacacagcguccuccuccccuaggcaacagagacauccagaugaucagcuguggggcugacaagagcaucuacuuucgcagugcccagcagguaggguggcauggccuccuugggggcuggggugggggguugucggggcauucucugaagguccugccggcccugccaggguucggauggacuacacuuuguccguacccaccacguagcagagaaaaccaccuuguaugacauggacauugacaucacccagaaguacguggccguggccugccaggaccgcaaugugagguaagggguggcccuggacccuuagcuggccuggucugccuuguccuaggcugucugcuuuccucccucuguuccucugguccccaagaagcugggaaggaauugagggacccagcagguguuccuucuugguuuuuuuuuguuuuuguuuuugaggcagagucuugcucuguugcccaugcuagagugcaguggcaccauuuuagcucacugcaaccuccaccuccuggguucaagugauucuccugccucagccucccaaguagcuggaauuacaggcgccugccaccaugccuagcuaauuuuuuguauuuuuaguagagacgagguuucgccauguuggccaggcuggucucgaacuccugaccucaggugauauugcccaccucagccucccaaagugcugggauuacaggcgugagccaccgugcccggccaccagcagguauuucuuagaagcugggcucucccaagccuggccuccaggucagcagagggcuuucuucuggcucucccuagagccggugugggaugacuaaggugcugauguggcacauaaacucccucauucacccguauucccugagcaccuaacugggcuggauggugcugggaucauggcaguggccaggauagccccaggcccuccuucauggagcucacaguccaguagaauggacacggccaccucacagccacagacagugacagaguggucagagaugggggagcccaggggcccuguggagacaccugaccccaccugcggaucaagcaggacuuccuggaggaagagacaccuuagccuggggaggauguggaggagcgagccagggggaggcagagagugagugugcagagggcaaagcagugcaaagaggcucugcaccccuucccaguucuuucucaugcggugccaagcacugagcuugcagugugugggggagaugaacauuaacucaguggauaccccaggacaaccucagcuugagaugggguuucaguuucagucuaggcaucagauggggacaagagguagcagggggcuuccaggggaggggaggacagcaagagccagagaaugagguggugggguaggcggggcccuguuggccgcaacaugccccuacuuccccagagucuacaacacugugaacgggaagcagaagaagugcuacaagggcucccagggugacgaaggguccuugcugaaggugaggaguuggagaccccugucugucugcugcccugaugggccaccuauugugacggcccacaccugagaccugugcccuugguccuuccucagugcaccgcgcugcccagcaccuucucaggccugguuaaacaaggaugcuugcgagaggguggggagggugaccccagcuguguuuccuuuauuuacagagcccuuccccaaguggggcgucuaaguggguuccauuuugaguggcagcaggguauggugggaagaaucagaggcaugaacuccccuccugguuugcccacaccagccacgggucacucaggacaaggggggaccuucucagagccucuggucuaggacaguuauggguucagguucugccucaggcugacugugugaccuugggcaagcaucaucucuugaaaugcacacagacagcuugucucauagacuuguucucuggaggaguucaguuugcacauguucagugcuuagcacagggccuggcuacuguuguuacugcugcggugguuguuaauuucuucacgugucgaaugggagcgggagcuccugcccugccagagucccaugugcugugcaugcagcacgggggagggaggggcccaggccucaucauaaggaagaagcaggcagcuggagugacaugugggucccuuuccuggcagguccauguggaccccucaggcaccuuccuggccaccagcugcucugacaaaagcaucucagugauugacuuuuacucgggcgagugcauugccaagauguuuggccauucaggugggugugccucucugcuugggaugccuccccacccgcccacacccucugacuccgaaggcaagugcagccucucugcuuuguuugcagaaauuauuaccagcaugaaguucaccuaugacugucaucacuugaucacaguaucuggagacaggugggacauggaccuuugggagaguuguggcucagauaccaugagcacugcacucagccugccuguguagagagcauuucuaaacugcccaguuuggauugugggagucuuggugucacacccagcccugaguucaaauaccagcucuaagcugggcaugauggcucacgccuguaaccccagcacuuugggacgcugaggcggguggaucacuugagcucaggaguucgagaccagccugggcaacauagcaaaacccuaucucuacaaaaaauuagccggguguggucauguacaccucuagucccagcuacucaggagggggaagauggcuugaaccugguagguagagguugcagggagcacagaucaugccagugcauuccagccuuggugacagagcaagaccccgucucaaaaaaaaaacaaaacacuaaaaaaacauaucccagcucugccauuuauuuucuugucaccuugagcagguuauuuccccugagccucaguuugcuccccuguaaaagacaccaccguuuacauuuaccuuaaaaauggugugaugaggccgggcgcaguggcucacgccugugaucccagcacuuugggaggccuagguggauggaucaucugaggucaggaguucaagaccagccuggucaacauggagaaacugugucucuacuaaaaauacaaaaauuagcugugcgugguggcaggcgccuguagucccagcuacuugggaggcugaggcaugagaaugaccugaaccugggagguagaaguugcagugagcugagaucgcgucacugcacccuagccugggugacagagcaagacucucucaaaaaaaaaaaaaaaagaaaauuguauggugagaaaugaaugagaugauauacauacauucuuuagcacaugggugguacucaaggaagucccuuuugucacucccuuugauuuaccccaguucuuccccacagcccccuuccucaggucuugaggccuccagaacaggcccugguuugcugggaugccccagaccugggcccaggguguggauguggcaaguccagcaccccugcacuaagcggauagggguguguuuuccaggagcaucuggagaaugggguccaggcugugguguggguggcuucagggucagccacggcagcggcucccaugcuuacucuuccucugccuugugugucucucuuugaccuccgcagcugcguguucaucuggcaccugggcccggagaucaccaacugcaugaagcagcacuugcuggagauugaccaccggcagcagcagcagcacacaaaugacaagaagcggaguggccaccccagguccuggcagccccugccuguccaccagagggaugagucccugccagggccccauggagugaugcuggggacacagugguggccaagacagcccuaggcccugcccuuagcacacucacagcugaguaggggagacagacuuugaauaugcaguuacaguaauagauacaaaaagguuuuguggauuuuuuuaauuuucguaaauaauagagacagagucuugcuguguugcccaggcuugucuugaacuccugggcccaagugauccucccaccuuggccucacaaagugcugggaucacaggugugagccacugcacccggcuaugagaaggguauuaaaguggaaaagcaaaguguuuggcgagccucucagcacugugaugggggaugccccaagcggcugugggaacagagcagucccugaccggccagccaaggggagggguggguagacaggggaucugaggggagggcugcaguggggccacguguccucuuacucccacgugaaagcuguagcuucacuuacuucuuugaaucuucuaaauauauuucuuucaagucuuuauguagcaaagccaauuuuauuugcagagaacucauguucugguuuuugauuugagguuuugguuuggguauugcucauuuugagugggagguuuuuugguuuucuucucuucugcugcugggugugucuguuuuugccauuggcuccauguggcucccagggcaauguggagaccaggccuugacaugggccacugguccugagguccugaggugguguuagagauaucuugcuuuugaggcucccacuccacccccaagcuaugaaccagggcccuggcuucagugccugccucaugccaaggguguuuuaguuucccguacucgggaagagccaccaucauugcuaccaccuacaggaagcccagcacaggacugcagccccgcugucugcuuggcuuucugucccauugcuguggcccugagaguuugcauucguuuguagccuggccuuuguuaaucucaucuauuguggugauguguuucuaguggggagacggcaucaagugagagacuugccagcaccaucuugaccagcagccaagaauauguucacauggagcuuagcacagggcccagcccuaggcaaguccccaccaccagcccauuugccuguauucucuccuuaccauccucauuccuggcuuuaggcaggauacguauguguccacaccuagugagauucacucccugagcccuggagagcaaacagaggaugaucuggaggaagagugugagccagaagagaugcugaagacaccauccaaagauagcuuggauccagguuggaaaaggggcccuauuuugaacuaugucaguguagggaaucauugcuggguuuugcccaugaccuuguuuacagggccuggcacauauuaaaacucaggagucgacagggugcgguggcugauaccuguaaucccagcacuuugggaggccgagguggguggaucaccugaggucaggaguuggagaccagccugaccaauauggugaaaccccgucucaacuaaaaauacaaaaauuagccgggcgugguggcgugcaacuauaguccuagcuacuagggaggcugagacaggaaaauugcuugaaccugggaggcagagguugcagugagcugagaucgcgccacugcacuccagccugggcaacagagcaagacuccgucucaaaaauaauaauaauaauaauaauauaaauaaaauaaauaaaauucaguaaucaggcuuagcgugguggcucacaccuggaauuuuagcacuuugggaggcugaaaugggagggucacuugaggccaggaggucgagaccagccugggcaacauagcgagagcccaucuaugcaaaaaaaaaauuuuuuaaagaaauuagccaggcauaguggcacacaucuguagucccaacuacaugggaggcugaggcaggaggaucacuugaggccaggaguuugagaccagccuggcacguaccaagaccccguuccuacaaaaagaaaaaaauuagccaggccugguggugcacaccuauagucccagcuaccugaaaggcugaggcaggaagaucgcuugagcccaggaauuccauguuauaaugagcuaugauugcaccacugcacuccagccugaauaauagagugagauccugucuguagaaaaagaaagaaacucaauaaucauaucagucaagacucuuucaguauaaaagcaaccaggcuuaagucaggaagaggauuuuuuggugccugaaaauuggagaggauuagcuuucagcauggcuagauccagauagacagaugauguuaaaaggaagauuuuuuuuuguaucuuuuggcucugcuuuucuucauguuggcuuugcugauggacagacugucccuuuacuaggggaaaagauacccccagcaacuacaggcuuauaaaacuccauagagaauagaacaccucuuuccuauaguagcucaagcagagucuuaggguuguguggcucauguuucugguaucugcuguacccacuucugagccaguuguuguagcuguccacaucucagcaugugaucacuucugagggcagagacuguagucagcuccauccacucacaccaccugaccaggcaucaaagauguguuugaggccgggugugguagcucacgccuguaaucccagcacucagggaggccgaggcggguggaucaccugaggucaggaguucgagaccagccuggccaacauggugaaaccccaugucugcuaaaaauacaaaaauuagcugggcgugauggcgugcgccuguaauagcagcuacuugggaagcugagacaggagaauugcuugaaccugggagacggagguugcagugagcugagacugcgccacugcacuccagccugggugacaaagcaagacuccgucucaaaaaauaaaugaacaaguaaaaauaaauugaauuauguugcggauauuguccggaaucuuuuuccucugcaaagucucucaucuaccuguauguuggugaauacaaagcagacgccugcgaaauuuuaaguuauuccccuccagguggccauuuagguuuuuccugauugcacaucacuguuaaugaggcuauggaguggagaccacuccuaagccuccucgaaaugugaggacuucuccaggagagagucugaggaguagcaccacuggauccuggaguuauuuuauuuuacuuuaaaaaaguuguuuuauuauuuuauuucacuauuuuuguugcccaggcuggaguucaauagcacaaucauagcucacuguagccuugaccuccugggcucaagcaauuuucccuccuuagccuguggaguagcugggaccacaggcucaagcucccacacccagcuaaauauguguguaucaggggaugguguguguagagacaaggucucacuguguugcccaggcuggucucaaaccccuggccugaaguauccucccaccucgaccucucaaaguggugggauuacaggcuugagccaguaugccuggccuuuauuuuaaaagagaaccccggcugggcgcaguggcucacaccuguaaucccagcacuuugggaggccgaggcgagcggaucacgaguucaggagaucgagaccauccuggcuaacauggugaaaccccgucucuacuaaaaauacaaaaaaaaaaaauuagccgggcaugguggcgggcaccuguagucccagcuacuugggaggcugaggcaggagaauggcaugaacccgggagguggagguugcagugagccgagaucgcgccacugcacuccagccugggcaacagagcgagacuccgucucaaaaaaagaaaaaaaaagagaaccccaagaguucuccaaacccaguuacugccccacccugcauugcauuaggcucuccauuguccccacacuuuuccugccauccuuugguaguauuaagcuuuuucaccucggucagucucgugagucaaauaucgcaucccacgguuuaaguuugcauuucccuaacccccggugcuguugagccuucugacuucuggguugugguguugccucuuuggggacugcccgguuauguauguggccuguuuguuggguuguuuguccucuuuucauggauucugugucuuuccagauccucguugccugcuaaccaacggcaagcugccacugugggcaaagcggcugguaagucuucagggagaggguugcucaggggcuggcagaggaaacgccuccccagcucugccuucuggaagcccuuuuuccuuuccaugucccucuuuucccuggagaagcccugucauccuuccaggcucagugagacagcccuuuguucaugaucagugcucucugccaggcauuguucuggaugucagggacacaacagugagcaagggaaacaaaagucucucccuucacaggcucacuugccugugugggcgaggaacaauauccccauuaaauaaguaaaugacguaguagguugggugcugauaagugcuguggagggaaaagaaucaagaaggaaaauacgucagccaggugcagugauacgugucuguggucccagcuacucaggaggcugaagugggaggaucacuugagcccaggagguugaggcuguagggaacugagaaggcaccacuacuacacuccagcgugggcaacagagugagauccugucucaaaaaagagaaaaagaacaggggcccagcacggugguucaugccugugaucccagcacuuugggaggccaaggcagguugaucacuugagcccaggaguucaagaccagccugagcaauauagugagaccccaucucuacaaaaaauaaaaaaauuagccaggcaugguggugcauaccuguagucccagguacucaggaggcugaagugggaggauuguuugggccagggaggucgaggaugcagggagcugcacuccacagcacuccagcaugagcaacagagccaacacuuugucucauaaaaaaaauaaaaauaaaaaagaaaauaaggaguguuggggggugucaguuuuaaguaaacaggaaaggccucauugggaaaaugauguuugagcagaguugaagcaagugagacaggcagauacugggacgaauguucuagucauaacagccuauacguguaaaagccacgaggccaggagcucgagaccagcuuaggcaacauaaugagacucccaucucuacaaaagauuaaaaauagccaggcaugguggugcacacccauagucccagcuacucaggagccugaggcaggaggaucacuucagcccaggaguuggaggcugcagugaucgugcuacugcacuccagcuuggauggcagaacgagaccuugucucuuaaaaaaaaaaaaagaaaaagagaccgggugcgguggcucacgccuguaaucccagcacuuugggaggccaaggcggguguaauccaaggucaagagaucaagaucaucccggucaacaugguaaaaccccgucucuacuaaaaauacaaaaauuagcugggcaugguggugcaugccuauagucccaacuacugguaaggcugaggcaggagaaucacuugaacccaggaggcagagguuacagugaaccgaaaucaugccacugcacuccagccuggcgacagagugagacucccucucaaaaaaaaaaaaaaagaaagacaauguggauuauaagagacagaauaagagaggugaaugaaggaugaucccaagguuggggcaugaguaacuggaaaaaacaacugaaacagggaaucuuuaggaggagcagguuugugcagaggaaaugaguugaguugucagcauguuaacuuugaaauaccuaccagacauccauacagaaauguagagcagucacaugugcaauucugaaguuucagagaaaaguucaugaaucccagcugggcauucccagcacuuugggaggccgaaacaggauuccuugagcccaaggguuugagaccagccugagcaacauagugagaguccaccucuaccaaaaaccaacaaaaugggcugggcgcaguggcucaugccuguaaucccaguacuuugggaagccgaggcgggcggaucacuugaggucagcaguuugagaccagccuggccaacauggcaaaaccccaucucuacuaaaaauacaaaaauuagccaggugugguggugggcaccuguaaucccagcuacucuggaggcugagacaggagaauugcuugaaacugagagguggagguugcagugagccaaggucacgccacugcacuccagccugggagacagagcaagacuucgucucaaaaaaaaaaaaaaaaaaaaaaacagagaaagguucacgcuggagauauguaccuggaaguuguuucugaaugguauugaaagccaagaguccagaugggcugugugaaauguccgugucgcucccugcagugagugagcacucagccaguugccugacuguccgauauccuucaagcuaggggacgaugauguggcagauggcuuggccuuccacgccaagcgcagcuaccagccccacggccgcugggcagagcgggccggccaagagccccucaagaccauccuggaugcccaggaccuggauugcuacuuuacccccaugaagcccgagagucuggagaacuccauucuggauucacuggagccacagagccuggccagccugcugagugagguacacacuuccaccgcagccuggcccauagccccggcaccgugacggccccagggccuggcgccuuaggcugacucccacuccaugggggcagggaggauuacaugagauggugaagggcaggagggugagccccaggucuguugcacagcaagacuucccaaggcagacagggagucuuuggaaagugggucacuuggggguuaagagcuuggaugcuagagcaggcuuguacccaagugggggacauuuggguagaucgagcccugacccuacccauuccuguugugugaccuggaguaagaggcuuaccucuuugggcuucagucuucuaaaaaguagucauaauggggucaggggcaguggcuaacaccuguaaucccagcauuuggggaggccaaggcaggaggauuacuuaacgaucacuugaggaguucaaggccagccuaggcaacguagcaagaucccaccucuacaaaaauauuuuuuaaauuuuuuuguuuguuuuguuuuuaaaugguaauaacaaucucuucugccccagagggcuuuuacaggaauccaugcuuaaguauagggccugggcucuuagaggugcccgugcaacuuuagcucuuucucuacuauuuuccaaacaaaauucauuuuuauccuauccuauaauuugucaucuucauugugguauaauauacauccaguaacaugcacagauuuuagguauacagcuugaugaacuaucuguguaauucacguguguccacuacccugggcaaaaucuggaguguuuucuaccucauagaaacccccuucugcccuucccagucagguccccgcaccaggauaaccaguguucugaccucucaccaaggacuggguuuccuauucuugaacuugauauaaauagacacguagaggguugggccuccuauuuuuggugccacaccucuuccucaucuguaaagggacugauaaugcaggggcagaccaggacaagcugguugcgaguggagggcauggcacaggcccugguucacagccuccagcaguggggcugcuggcaugguuccuggcgcacuguugguggccccagccaugccugccucagaauggcugugcugucuuccccauagucagagaguccccaggaagcuggccgcgggcaccccuccuuccugccccagcagaaggaaucaucugaggccagugagcucauccucuacucucuggaggcagaagugacagucacagggacagacagguggguguccuuuccaccaagggagccuuaguuggaggaacccccagcugauagcugcauccuggaagaagugcucucugccuucccagugggcuugugggaguggggacaguugaggccuggauggggcaggagcccagccuuaguucccugguuccaggugggguacaggagggccugaccugggggaaggagggggcauuuggaggaggcggggaggcugucgcagugcuccugcaggagcagcggguacaggugccuaggggcuccggguggggcuagcuguugagucuccagcugaaguccuuguucccucucugcccccacuggcacugcagccaguauugcaggaaggagguggaggccgggccuggagaccagcagggcgacuccuaccucaggguguccuccgacagcccaaaggaccagagcccgccugagggugagugcagggcaggcagggacccugugacagucugugcguucagccaagccccuuucugggcaccgauggugacuuugacccaguacugaagcucagagucugucgaggaagacacauguggucccugcugcugccugaggauucugggcccagcugccuacagcugagagcccagcucugccaccuccuugauguggaacuucccuuauucauaaaauggggggcagcugcucuuaccaucccuccuccagauggggaaacugagcccagggaaggguagcccuggcccuggcucaccagaauggucaggcugugggcuccugaccccgacucuguccuucagacucgggggagucagaggccgaccuggagugcagcuucgcagccauccacuccccagcuccgccuccugacccugccccucgguuugccacgucgcugccccauuucccagguaagcaggggccagacacgcaggggacucgcugcucgggccuggcuuagggccagucacaaugucuaagcacaggcccugcacuuggagcccacugagccuggaagacggggaucccugcuucucagccugcgggcaacagggcagggauggguggggcccgcuuucuccauuucagguggcgucugcugugacucaugguguuggcuccucuugucccuccccuccuucccugucaggaugcgcaggucccacagaagaugagcugucccugcccgagggacccagcguccccagcagcucccuaccccagacuccggagcaggagaaguuccuccgccaccacuuugagacacugacugagucccccugcagagguagggcccugccucacccacaccugccgaggccgucugugcagccugggcacagcauuggcgucccuggaguuggcuccccagcagggccaggagggugaguggagagcaacugcuucguuuuuuuugagacggagucucgcucuguugccaggcuggagugcgguggcccaaucuuggcucacugcaaccuccgacucccugguucaagcaauucuccugccucagccuccugaguagcugggauuauaggcauccacaaccacgcccugcuaauuuuuuguauuuuuaguagagaugagguuucaccauguuggccagacuggucucaaacuccugccucagaugaucugcccgccuuggccucccaaagugcugggauuacaggcgugagccaccgugcccggcccacugcuucacucuugaccugagccucacgaugccuccucacccacugccccugcucguacccugugucuguacauaaggguuucuggggagugccccgcugggcugugggcuggccuagggccagggcugcucggcgggaaggguuaugaggguccccucgggaucuuccccuagagcucuuccccgcagcucugggagacguggaggccucugaagcugaagaccacuucuucaacccacgccugaguaucuccacgcaguuccucucaagccuccagaaggcauccagguagaagcuggccaagcacugcccacccucuggcuccucaacagugccccagggcaggcugaaugagaaucauccccccugcucuccuccccacagguucacccauaccuucccuccccgggcaacccagugccuugugaagucuccagaggucaagcucauggaccgaggcggaagccagcccagagcagguacuggcuacgccuccccagacaggacccacgugaguauugggcccaccuccgucagggcacggggcugggaacccugaggccuuguccucaccucagagcugugccugcagguccucgcugcagggaaggcugaagagacccuggaggccuggcgcccaccacgugagugccccagucccagacggacaguccuggguuucucggcgaguggccggauguccagccuagcuguggggcgugggggcccuagccaucaguucugugugguggagucagugccaucugcuuccguuacagcucccugccuuacgagccuggcguccugugucccugcuuccuccgugcugcccacagacaggaaucucccaacgcccacaucugcacccaccccaggccuggcucaggguguccaugcccccuccaccuguuccuacauggaggccacugccagcucccgugccaggauaucacgcagcaucucccucggugacagugagggcccuaucguggccacacuggcccagccccuccguaggccaucguccguuggggagcuggccuccuugggccaggagcuucaggccaucaccaccgcgacaacacccaguuuggacagugagggccaagagccugcccugcguuccuggggcaaccacgaggcccgggccaaccugagacugacccugucaagugccugugaugggcuccugcagccccccguggauacccagccuggcgucaccgucccugcagugagcuucccagccccuagcccuguggaagagagcgcccugaggcuccacggcucugccuuucgcccaagucucccagcuccugaguccccuggccuuccugcccaccccaguaacccccagcuuccagaggcccggccuggcaucccuggcggcacugccucccuccuggagcccaccuccggugaguacagcccuggagcaaggacuguccccuaagcucauccugugugcuaguuggcucagcuccaaagauggauacuugaccuggccacagggacugugccauucauucauucgugcauuaacuuaaauauuuaaugagcauuacauguugggcuuugugcuaaacccugggacaugggacauggugguaaacaacacagagaacugacagcuucaauggggacaaugcccagacuaaaccuuuaaggaacccgucauauguaucacgaagugacacaugcuuaggagggacagaggagggcgagggagugcaggguggggacagggguugggauuacaaaccagaagauaagaagaggcuucagggaggaggcugcauuggagcagagaccuguaggagugaaggggagggagccuuggggacccagagaaguguuccagacagaaguacagcauggaguccacccagucgcucuggccgcucacaccaauggaaugcagcucaucuugcucauucccuucucucuaccccaggugcacuuggucuguuacagggcagcccugcccgcuggagugagcccugggugccgguugaagcccugcccccaucuccccuugagcugagcaggguggggaacaucuugcacaggcugcagaccaccuuccaagaagcccucgaccuuuaccguguggugagcuaagccccagaguugggaaaggguugaggggucucuugagaccgcccggccuugguggccccugacaaggcuggcaucccuugcaguuggucuccaguggccagguggacaccgggcagcagcaggcacggacugagcuggucuccaccuuccuguggauccacagccagcuggaggcugaaugccugguggggacuaguguggccccagcccaggcucugcccagcccaggacccccguccccaccgacgcuguacccccuggccagcccagaccugcaggcccugcuggaacacuacucggagcugcuggugcaggccgugcggaggaaggcacgggggcacugagggcgcagccccuccaccgcagcccugcugcuucugaggacuuagguauuuuaagcgaauaaacugacagcuuugaggaaugguuccuggugu

SEQ ID NO: 15100 - RNA, 18181 nt, Homo sapiens
ucguccccuucucucugucucccuugccucccccaucacguccccugacaccgacaccccauugcucccacagucuccccagucuccacuuugguccccagcgcugucugcccgagguaagauggggagggggcggcccgcggagaaggggaggggcgaagcauccugaaucccgagauaaacaaacccggggagggggcagccgcgacugaggggccugacgcgggaggagaagaauggggggcugggccugggggagguggcaggcgcugggcgcacacaccggggcccucuauggguaacgggggucccuaugguugcccaagauccaguugcgcggaggccacccggggcccuggaagcuccuaggggcuuggacccuggagccugccgggcacccucuccagcugaccucugccuccaggauuugccugaaggcugcccccaacucugcacccgccccccgagggccaccgaggaccaugacuaagacagauccugccccgauggccccgccaccccgaggagaggaggaagaagaggaggaggaggaugaacccguccccgaggcccccagccccacccaggagcgccggcagaagccuguugugcaccccucggcaccugccccccucccuaaggacuacgguaaccacuguccccacccuggaaucuggccuggagcguuggguggccggggagggugggcugugcucugcugguggugauggugggagaauucuggggaauuugaaggugguccagaggaaucuuggcugcagagcaccccucguuaauucauucauucacccauuggagaauggaauuguaauacuccuagucuuugacucaugacacaucauuccaucauuuagucauucaacaaucauuuuuugaaagcggcuguggaccuggcuuuaugcuaggggcuggggccacagcagggggcaagagagacccagucuuugcccugagacaacucacaggccucaguaacagccacacaaauagguauuaaaccauaauguaauuuuucacauuuagguuuauaugcaagaaagaaaaauauaauguaauauaaauauguaauuacaagacauuaugaaaauuguauuuaccauaaacaagcugcugcaagaguuuuuuaagacauuguuucccugaggagguuacaguugagaagacuggagggugaguugggguuaacuaagagaagggucaggggaaagggcucccaggagagguaaccgcuggguaaaggaucugagguaggaggguauggagcugagagggcggccucuuggagaaacugaaagugucuaaucauugaccgagcgauauuuaucgagugcugcuacucugugacaagccuuaugcugggugccggagauuuaauccuaagugauccaggcaugauccucccuugcaggagagaaggagagacuaaacaagugaacagauaaauaaaucagaaaucagauaaauucagauuggagcaagugcuaugaaagaaagaaaaggugggcugggcauggugucucacgccuguaaucccagcacuuugggaggcugaggccagcggaucaccugaggucaggaguuugagaccagccauggccaacauggugaaaccccaucucuacuaaaaauacaaaaauuggcuggguauaguggcauaugucuguaaucccagccacucgggaggcugaggcaguagaaucgcuugaaccugggaggcagagguugcccaagaucgagccacuacacuccagccugagugacagaguaagacugucucaaaaaaaaaaaaaaaaaagaaaaaaaaaaaaaagaaaagaaaaaaagaaaaaagaaaaagaaauuaaagguggagauacgauaaugacuagggggcagcuaccugcagggguagucagggcugcucuuucugaguagguaacauuuaguuugggacccagagcauggggaggaaucagccauaagagagcuggaaaaagaguguuccaggcagacagcagcaagugcaaaggcccugaggcagaauugaacuuggaacagaaagauccuggagcugcauucagggaaugaucgagguugaggugagagguuggcauaggccagaucuggaagggccuucaaggcuacagugaggacuuugguuauauucuaagugggacaggggagaagaguggcaaggggaggguguuuaagagcagaggaguggcaggucugauuuguaguuugaaagcucccucuggguacuggguagaaggggauggagugcagccagaguuggauguaggaggggaauuuggaagauaugcaggcugggaauccccggcagcugugagguucagaaaccagguucagagagucagcguugccaggauagagcaagacagauggcauccauggacaugucacccacuagagguagaucagggagacuacaaguugacuucagucuaauagaaaaauaagaaaguuggcuaggcacagugguucuggcuuauaauccuagcacucuaggaggccaaggugggaggauugcuugaggccaggaguucgagaucagccugggcaauggagcaagaccccaucuguacagaaaauuuagaaauuagccaggcaugguggguaccuguagucccagcuacuccagaggcugaggugggaggaucacuugagccugagaauucgaugcugcaguaagcuaggauugcaccacugcacuccagcuugggugacacagugagacccugucucaaaaaaagaaaaaaguaaaaggaaguuaucuggggccugaggucgggggggugcuguaccucagaaaacuggaaaaucuccuuuggaaaugcagcuggagguggcuggggccucugacucagugggaggucggaggguauaggcugagcccuccaagcagucuugcuuguagagcgggagagguuuugucccagaaugugaagaaaucuggaaauguggucgaggacagggagaaggcuaagguggacuccaagaggaaaucauguaucuguuaaauuuguacauuaauucaacagagauugacugagcaccuacugugugccaugugcugugccuggccuuggggauaaaggagugaaugaggcagaauagaaucauagcauuuagauccuagugagggaagaagagaggaaaugaaggagggagaaagaggaguaaacaugucaaguagugauaugagcuaugauaaaaauaaauaaauaaauaaagggcugggcaugguggcucacaccuguaauuucagugcuuugggaagccaaagugggaggaucacuugagcccaggaguucgagaccagccugggcaacauagcaaaacguugucacuacaaaaaaaaaaaaaauugcugggcauggugauguauacuguaguccuagcuaccagggaggcugaagcaggaggaucacuugaacccaggaguucaaggcuguagugagcuaugaucauacuauugcauuccaacagacccuauuuuuuuuuuuuuuuuugagacggacuccaggcuggagugcaauggugcaaucuuggcccacugcaaccucugccuuccgaguucaagcgauucuccugccucagccuccugaguagcugggauuacaggcacucaccaccacgcccaguuaauuuuuguauuuuuaguagagauggaguuucaccauguuggucaggcuggucucgaacugcugaccucaugaucugccagccuuggccucccaaagugcugggauuccaggcgugagccaccaugcccagccaagacccuaucucuaaaaaaaaaaaaaaaaaaaaaaaaaaaaagaguaggagauggagaagggcgggugccgauuuagacagugugguuugggaaggccucucugaggagaugacauuugagcaaagauuuauaaagcuuugugaagaugugugggaagucuauccugagugagaagaacagcaagugccaagacccugagacaagaauuugcuuggcacgugggagggacagagggagcccagugugggaaaugagggaaggggaauaagugaggggagagggcugagaacugaggggcuggaugugcagagcccugagggccguggggaagacuuuggucuguacucuggauggguugggagcuggaggaggguucuaagccaagaagggcuaugaugugacugcaguucuaaaaggagcaugccggcugauuccuggagacaccuucuauguggcacuucccugggcuguguauaaucugaucauucauguagucguucauucaccacgcacugaguuccugccacgugccagggcccugugcugggugcugacgucacagagagcaguacuccuuagagucgagugggaagagacagaagugccucuaggcaccacccuggcugggcacagguugauuccugcucauggauacauuuuauuuuauuuucauuuuuauuuauuuauuuacuuuuuuugagauggagucucacucucugucacccaggcuggagugcagcggcgccaucucagcucacugcagccuuugccuccugaguucaagugauucuccugccucagccucccgagcagcugggauuaccggcgcccaccaccacgccuggcuaauuuuuguauuuuugguagagucaggguuucaccacguuggaccaggcuggucucgaacuccugaccugaggugauccgcccgccccggccuccaaaagugcugggauuacaggcgugagccaccgcgcacagccucuauuuuuauuuuuuauauuuccagagucagggucuugcucuguugcccaggcuggcguguaguggcacaaucauggcucacugcagccuugaacuccugggcucaagcaauccuccugucucaaucuccuugaguagcaccaaugcgcaccaccacaccuggcuaauuuuaaaacuuuuuguaaagacaggggucuugcuauguugcccaggcuggucuugaacuuaugggcucaagcaauccuccugccucagccucccaacgcauugggauuacagaugugaaccacugugcccagucauggauacauuugauguggacugcaugguauuugaaacaauugagagaguuuuauuaaaaaccaggacuucuggcuuuauuuauuuuugcucuggagauucagccaaacuucacucauacucucacagggcaacagugggugaggucaguagcagucccccuggacaugcagacuccaagguacugcacucucugucaggcuuuuguuucaggggguggaguuugcugcuauaugggaauugccugaucuuccaacuuuucaagacacacugggcaucgagauuuuuaugugaacccaccugaguuugaaaccucaugcuggccacacagaaaaugccuguggguugacuguggcccaugugccaccagcuugagacccugcauuagaggcucuaaaaggcaaagaccuacagcuccccuacugaggcuggaaggagggggucaguugcguggggugaccuuggaccucuugccaccccagcuuucaccuucuucgaucccaaugacccggcgugccaggagauccuguuugacccucagaccaccauccccgagcuguuugccauugugcgccagugggugccccaaguccagcacaagauagacgucaucggcaaugaggugagaacacuggggaaaccagggggagaggggaugcgguuccccacaugugugggugacccucccugcuccccugguacucacagauucugcgccgaggcugccaugugaacgaucgugacgggcugaccgacaugacacugcuccacuaugcgugcaaagcuggggcccacggagucggugagggcccccuacccccaagucauaagccccaaagccuaggcccccagacccaacacgcugaaaaccacccagaacucaggccccaucuggaacccgaagcuucggaucccaaaguauagucccugaagcccaggguccuccccgugcacugggcccaugcucuggaauggggguuccaagcugacccggccuaucgcgcaggggaccccgcggcagccgugcgccucucgcagcagcugcuggcgcugggcgcagaugugacgcugcgcagccgcuggaccaacaugaacgcgcuucacuacgcggccuauuuugaugugcccgaccucgugcgugugcugcugaagggugcgaggccgcgaggugaggaggagagcccuggcugggagggggcaaggaccugggugagggacgcggagacccaggugaggccaggcugcgaggggaaggaggacggugaucugaggagauagcgggagguuggaggcgugggagagggggcucagggacuaccacucuagggagggucggggcugccaagggagaggggggcuccgaggugggggcggggcucugcgucggaggcucugggaccugcaaguuaagagaugagccccgaggugggaggagggcuggggucccacaggcgcucacccggaaccccuccucuugcccacuuccaguggugaacuccacgugcagugacuucaaccacggcucagcccugcacaucgcugcuuccagccugugccugggcgccgccaaauguuugcuggagcacggcgccaacccugcgcugaggguacugccacccuugcccagaacccguuacccuccugcucccuuccucccccacuucccuccagcaggucucugcguuucccgugacuccccaaauacuacaaaugccgucuguacauucagcaaaugcaauaacagcugaaauaugccuaguguucauuacaugucaggugaagucuauuauaagccuuguuuuacaauggggaaacugaggcagagauuaagggaucugcccagggucauccagccuaucccauggcagugcauaacagcauuucaaggucaugaggaaaguugggcuaggccuucugugaaugagaggguugguccucuccuaagcccucaauaugaucuuugaccucugaccuaugcauuaccaggcuccauccacaaugcuaauuacccugcagccguccaggcacauguauguugggguaacauggccugugccccugagacccugccucuccccauuuuccacuggcccagaguuugacuccugacucuauaccacaggagcccacucucacucucucuaauuuuuuuuuuuuuuuuuugagacagagacuggcucugucauccaggcuggagugcaguggugcaaucucggcucacugcaaccucugccuaccagguucaaacgauucuccugccucagccucccgaguagguagaauuauaggcaugcgccaccacacccggcuaauuuuuguauuuuuaguagagauggaguuucaccauguuggccaggcuggucucgagcuccugaccucaggugaucugcccaccucggccucacaaauugcuaggauuauaagcauaagccacugcacccagcccacaggagcccauucucaauguucaucucccacauguccucauuacaggcuuggggucuccagagauugccucccugagggcgugaccuacagcacugaaguguggcccucaucccuacugccuacacccccaggcccacccucaauuacuugacacacccccagcccugggucucagggguggguuucccuggggauguggucugcaccuuucugcccugccccuucuuuuuuuuuuuuuuugagacggagucucgcucugucacccaggcuggagugcaguagcaugaucuuggcucacugcaaccucugcuucccggauucaagcgauucuccugccucagccucccgaguagcugggauuacaggcacacgccaccacacccggcuaauuuuuguauuuuuaguacagacgagguuucaccauguuggccaggcuggucuugaacuccugaccucaagcaucugccugccucggccucacaacguacugggauuacaggcgugagccaccuuaccccgccuugcccugacccuucuuauucccagguuggcccaggauaugaccuagucuuaccccugcaucacccagacugguggucucuaggggcagggccuccaugggggugugaccugugccacugagucccugccuucuuuucccauuggcccccagaaucgaaaaggacaggugccggcggagguggucccagauccuauggacaugucccuggacaaggcagaggcggcacugguggccaaggagcugcggacgcuucuggaagaggcagugccacuaucuugcgcccuccccaaggucacgcuacccaacuaugacaacgucccaggcaaucucaugcuuagcgcacugggcuugcgccugggagaccgcgugcugcuggauggccagaaggucaggggcugggauguguguuugcauggugggugggggugggacucagccccuuaaucccuuggagcugcguccucgggcagagugcagucccugcccuuugucuacuugccgcccuaacuauccacccaguacuugauuuuaucucaguuguuccgugggugucuccuuugagccucacccugugcugagcucuccauccagggugggaaacaacccgucaucugacagugacggccgagaguggucauggcugccauggggaggggugagcagagugaucugcgcagcucugugcaccuguggcuccccccgggucuugugguccucgaucaggccccucugcucucagagacaagucuggcuaggcaaguccaggccagagugauuggggugugauggggaauguacccaaauugcagauguggaggagcaagccagggaaagaaagggagaaaggagucucagcuugggggagcggguaucacagcugagagggcagagagaaucuucauuuauccagggacuccaauuucacucauuucccggugucccuugggcuccauacgggacccagucuguccuuagggagggagggcugugucugcccccgcccugcugucauggggcuccacuuguaaugaaggggagacagucaagaaaguaaaccuaugguugagaugauuucugggcugggcacgguaguucacaccucuaaucccggcauuuugggaggccgaggugggaggaucacuugaggucaggaguuguuagagaccagccugggcaacauagugagauccugccucuauugaaaaaaaaaaaaaaagguaauuucugguagcaacaagggcugucaacaccauuacauguuuggauuuaguaaauugucccuggcugaaugcuggagugguuuuagcugggguguucugagaaggcuucucugaggaggugauguccaaacugagauaggaaagaacuuccuuugcaaagauaaggaagcagaggaugcaguagguauggagacccagaggcaggaaggggcaguguugacgaggggaguuaugggaagggcggugagguggagaggucagcaaggcugggucacagcagaccuguaggcuacuggaaggaguuugaauuuuguuuuuguguuuuugagacagggucuugcugucacccaggccagagugcaguggcacgaucuuggcucacagcaaccuccaccucccagauucaagcuauucucaugucuuagccucccacguagcugggauuacaagugugugccaacaagccuggguuuauuuuuauuauuaugauuauuauuauuauuauuuugagauggagucuugcucugucgccuaggcuggagugcgguggcgcgaucucagcucacugcaagcucugccuccuggguucaugccauucuccugccucagccucccgaguagcugggacuacaggugcccaccaccaugccuggcuaauuauuuguauuuuuaguagagagagggugucacuguguuagccaggauggucuugaucuccugaccucgugauccgcccgccucagccucccaaagugcugggauuacaggcgugagccaccgcgccuggccuuuuauuuuuauuuuuaguagcaacggguuucaccauauuggccaggcuggucucaaacuccugcccucaagcgauucgcccgccuuggcucccaaagugcugggauuacaggcauaagccacugcgcccggccccauccagaaagcauucugcugugcacgaucuaaucauauccauugcacaauucagaaggaagguuggguugacucuucccauuuuacaagccagacuauaagaggcuccaacaggugaaaaccuuuaucugaagacacggaauacuaaucacugccccuuagagaagcagcauagcacagcgucaugaacucaggcucagggacuugcccagguaaaucucagcuuugcaacuucccaccuguggaccuggagccagugauucugccucuuugggugucaaugucuucauccguaaauggagauaauaauaguaaccaccuuagggggcugguugagguuuaaauuaauuaaaaugcguaaggccauuagaacagaguccagcgcauacuaaaugcucuuugugugugccaggcacuguucuagucccuccaccaacacucuuaagaucagcacuaauugucggggcgcggugccucacgccuguaaucccagcacuuugggaggcagaggugggcggaucacgaggucaggagaucgagaccauccuggcuaacccggugaaaccucgucucuacaaaaaaaauacaaaaaauuagccaggcaugguggcaggugccuguagucccagcuacucaggaggcugaggcaggagaauggcaugaacccaggaggcggagcuugcagugagccaagaucaugccacugcacuccagccugggccaaagugugagacuccgucuccaaaaaaaaauaaauaaauaaaaauaaaaaaagaucagcacuaauuaauuagccuauuauauggaccaggaacugaggcauggagaggugaaugagccucccauaaugauaauaaccacacucacuaaagucucacugcagcuaagcaaguuuacauguguuaaaaauguuuccgccaaaugugguggcucaugccuguaaucccagcacuuugggaggcugaggcagaaggaucgcuugagcccaggaauucgagaccagccugggcaacauagugagaccucaucucuacuaaaaaugaaaaaauuaaccaggcaugguggcacacaccuauaguccuagcuacuugggaggcugaagugagaggaucgcuugagcccaggaguucaagaccagccugggcaaucaacauggugagaccucaucucuacuaauaaugaaaaaauuaaucaggcaugguggcgcacaccuguaguccuagcuacuugggaggcugaagugagaggaucacuugugcccaggaguuugaggcugcacugugccagggucgugccacugcaccccuggcaugggcaacaaagugagacccugucuaaaaaaaaaaaaaguuuccgccagaugaucacuccaugagguggcuuacuaucucuauuuuacagaugaaacugaggcucaauaaguccccugaccaaaguuacagcaugauaauagcuaacaggcugagcacaguggcuucacaccuguaaucccagcacuuugggaggccaagauggggaggaucgcuugaggccaggaguuugaaacuaaccugggcaacauagggauacuccauuucuauuuuuaacaaaaguuuguuguuguuguuguuguuuuaauuagccaggcuuugguggcguucaccuguagucccagcuacucgggagacugaggagggaagauugcuugaacccaggaguucaagguuacacugagcuaugauugcaccacugcacuccagccugggccacagagugagacccugucucuaaaauagaaaaaaaauuucaauaacgaauacuugcugauccuuuacuuaauaccaagcccuguucugagggcuuuaauuucucuauaacagcccuguccaacagagcuuucuguaaugguggaaauauucugucugugcuguccaguaaaguagcuacaagcuacaugugacaauugagcacuugaaauauggcuagugugacuggggaaaugcauuuuuaauuuaguuuaaauguauugauuuguauuuuuauuuauuuauauuuuuucuugagacagagucuugcucuguugcucaggcuggagugcaguggugcuaucugggcucacugcaacccuccuggguucaagcaauucuccugccucagccucccgaguagcugggauuacaggcgugcaccaucaugccugguuaauuuuuguauuuuuaguagagauggggguuucaccauguuggccaggcuggucuugaacuccugaccucaggugauccucccaccucggccucccagagugcuaggauuauaggugugagccaccgcgcccggacuaaauuuauuuauuuuuaaauuuaaaaaucaucugagucuucuuucuaagguauguauuuauuuauuuuugagacagggucuugcuuguugcccaggcuggagugcaguggcaccaucauagcucacugcacccuugaacuccugggcucaagcgauccucccaccucagccucccaaguaacugggacaacaggcuugagcuacugcaccugguuaccuuuuuucuuucuuuuauagagaauagggucuugcugucuuuguuuuuuggaacagauuaagauuagagggucucgccauuuucacccaggcuggucugaaacuccuggccucaagugauccuccagccuuggcaucccaaaguguugggauuauaggcaugagccaccacacccggccuuaguuuaaauuuaaauuguuggccaggcaugguggcucaugccugugaucccagcacuuugggaggccgaggcggguggaucaccugaggucaggaauucgagaccagccuggccaacauggcgaagccccgucucuacuaaaaauacaaaaauuagccaggcgugguggcaugcaccuguagucccagcuacuugggaggcugagaugggagaauugcuugaacccaggaaguggaauuugcagugagccgagaucgugccacugcacucgagccuggcaacagagugagacgcugucucgaaaaaaaaaaaaauaaauaaaauaaauaaauaaauaaauuuacauuguccuauguggcuagucacuauucacuauaugagacagggcaacucuuuaacaauccuauaaggugaguauaauuucuguucccauuucacagcaaaggaaguugaggcacacagagguuaagucauguagccagcaaauggugaugugugaccugggguuugggcccagggcggccucaugcaacccaccuugcugcccgugugugggcacuccacguuggccucccagcauuccuuccuuagccaucgccucccuucucuccccagacgggcacacugcgguucugugggaccacggaguuugccagcggccagugggugggcguggagcuggacgaaccugagggcaagaacgauggcagcguugggggcguucgguacuucaucugcccucccaagcaggguuaguccgaccucgggcccaagagggguguggcuggguguccacucggcaguucugaugcugcugacugggaaauaggggauggaggaugggggccgagggcagaggcuuggacaacaccaggcucggauucuguaccccuaggucucuuugccuccguguccaagaucuccaaggcaguggacgcaccccccuccucugucaccuccacaccccggaccccccggauggacuucucccgugucaccggcaaaggccgcagggaacacaaaggucagagaggggaucccuguggugggaagagccaguuuggggauguuguguggguagcucagcuucugugacucaguuucuccucaggcccaaacuccaguuuuggaagacaagcucugaguuccugacuucugugacucaguuuccccuuuggcucaguacuggcacccccuaguucuuagaaggaccuguggguucccugcccucugugacuuaguuuccucucagacccaaaggucucccccaguuuuagggaagaauccuuggagauccugucuuuugucauuugaucuacuuuuuuuuuuuuuuuuuuuugagucaagagucucgccuuguugcccaggcuggagcgugguggcacgaucuuggcucaccgcaaccuccgccucccggguucaagcaauucucgugccucagccucccgaguagcugggauuacaggugcccaccaccacaucuggcuaauguuuguauuuuuuucuguagagacaggguuuugccauguuggccaggcuggucucaaacuccugaccucaagugaucugcccgccucggccucucaaaauguugggauuacaggccugcgccacugcacauggccugauuuacucucggacccaauuuucccuucauuuuaaaaggacaguuucuggguuccugacuucugacucagcuuuuccuuauccaacauauccucagcuuugagaaaggauuuugggguucuucagguucucugacucaguuucccuucaggccuaaagccccuuccuaauucucuggcaucugggauucaguuucacuucaaacgaagaacaggguuuucuaccuugggguuuuccagguggcacgagguucccaaagcuggccucagccccacuacccaccuccuacaccuucuacccuuaggcaagaagaagaccccaucauccccaucucugggcagcuugcagcagcgugacggggccaaggcugagguuggagaccagguccuugucgcgggccagaagcaggggaucgugcgcuucuacgggaagacagacuuugccccaggugaggauggggacucugggccgggaggcaggcagggccuugagaaauccugacacccucgugcugcagguuacugguauggcauugagcuggaccagcccacaggcaagcaugauggcucugucuucgguguccgguacuucacuugccccccgaggcauggggucuucgcaccagcaucccguauucagaggugagcccaaacuuccagcccaaacccagggcaccaccuggagcccugauccccccucagauggccuccuccucccagaccagcaggacaguguggacacccccgagcccccagcccuuuccucauagaucccuggggcccagcucucagucagacccuggccuuuuguggcucugacuucucccccuccccgugucuccucaggauuggcggauccacugauucccccggggacagcguuggagccaaaaaagugcaucaagugacaagugaguuaggggaugauauguugggaggaguguacguuuggggaugggaggaagggucauggguucucagguauauacuggugacagucucugguauuuaauuggggacacaggguccaggaaaaugaugagacaagguccacaaaaagauaggugcuagaggauaugaggaaauuagcaacaaggcucuucggggacaugagguugagcagauacuggggacagggauagucacugggggacauggugggaauuauggacaagaggcccagauggguauugggaauguaggauccagguggggacuggagacauggggagguauuaaugagaaggggucuggauggguauugaggacacagguggucugucauccccucacuugacauccugcccuccucuucagugacgcagcccaaacgcaccuucaccacaguccggaccccaaaggacauugcaucagagaacuccauuuccagguguguggccaaccccuguccccucuccuaugugacauucagggagagggauccauaaggcaguuggacccagaggucuggagcucuggucagggcuggaaagagagguuaggaaaacuugugacuuguaagcauacccagaaacagucuuuaggguguagggccccgcacugaauucuagugaauuccacuuucgggugggccgguaaaggaagcagaacacccuucacuccauacgagccucagaacaacagcuagagaccgggcgggguggcucaugccuuuaaucccagcacuuugggaggccaaggcaggcggaucaccugaggucaggaguucaagaccagccuggccaacauggugaaaccccgucucuaccaaaaacacaaaaguuagccggacacaauggcauacaccuguagucccagcuacucgggaggcugagacaggagaauugcuugaaccugggaggcagagguugcagugagccgagaucgugccauggcacuccagccugggugacagagugagacuccaucucagaaaacaaacaaacaaacaaaccacagccagagagguagaggcagaauccagaaaggccugauagcaaacacugggggaaaggcugggggugaugggugcagauguccccgcugccugccuaagggcgugacccugucauccuccuuuccagguugcuguucugcugcugguuccccuggaugcugagggcggagaugcagucuuagaggcccuggacaccugacaaagagacagaguccccacuagcaucuccugacacccgaggagcccugagucacccugagauagagauucccaguaacacauccagaguagagaccccuguuagccagcccucgaucauugaggccccauuauuaacagauacucccauaauaacccccaaauacagaccccaugucacccagaaagagauucccugaguagcaccuucaggcuagucccuauccccaaccccucagagcagauucccagauuaacagauuuccauaucaccccaaaugauggugacccucuccacauaaugcauuacaacagaacauucuugaaucacccaacccuggaucagaaaccuccccauuaacaaacacugccccuuaaguccucuugaaauaaacauaggucacacccccaaagcaaaagaguaacagacauucaugucauuguuccccauuuaacaucaguccucucaagaugucgugaccccauggucacccugaagcccuuagauuccaaccccucaaucagagacuuccuucauuaacaaagacccuuguucuuaucccucaagaagaaacccaccauaaccagcccacugucaccccuaauuuacagacaccaaaacaguccuggaagugcuaauuacaggaccccccaagucuuccuacccucugcacccucaagaaacccccagugccuuguaugaagcccaccccacauggcccacagcuccugugcuggccagacucccagaaaauucucuauuuuuuaaguaacgacuucccccuuugggggaccccaaaauuuggaggccccauucuaggacucuggggaucccaaacccuagaguacacacgucccaaacuccccugugcccucaaguccuacagccccuagaagaccccaaugccguaacuccuaggacccccaaaucauggaaucccaaauccccagggaaucccaaauuugaaaauccaaucccaaguccccaggaaacccaaucaugagguccuugugccugguauggaggagacugcagucaggauaugcauuccaggcucccagacaccucaagcccuauucacaggcaccaggaaaccccacacaggaauucccaucccuggaaacuggagaauuucaaugccccgaguccauggguuucaagacaccaaauuccaagagccccagcccuaagggaaccccaaauccuaaagccuccaucucuaauaaauggaaggccccaaggcccugaggggaucucaaauccuggaaccccgauuucaaucuacguucuagucacuggccucaaaggaccccacagcaccugggccagaccaacagcucgagggagaaccugaaggcccaggggguccagggcggaccuggggccccgaccaccaaggacagcucacgacugccccuucacugcauguccccaaacucagcaugacuccuguccucuucaauaaagacguuucuauggccu

SEQ ID NO: 15101 - RNA, 5180 nt, Homo sapiens
gcccuugaagccucugggagcucccauuggccugcggacucugcgucuguaauguggggcggaaauggcugggagggggauggggauguugaauuuggaaauuggaggggacgcugguggacggucaguuuuggggagugcuggggguagagauggaugucaauagggcugaaaguggggauccgggggagcccagaguaggaguccgaggaggcucagagcuuggaguccuaaaaggcucggagucggggaucugaaugguucagggagggaagaagauuugggagucagccucagagcuaaagaucucagggugcuggagugaaggggcgcucaggaggggaaauccgaggggcguccaaauggggggauccgaggaggcugaggguggacaugucugaggaggcucagauuggggucacaggagugcacagaaugggauucgguggggggcgggggucgcugaguguugauagccgggcucacaguugcaggucugaagcggggucucaagguguuuaaaggggcucuggagugcagcccugggggcuauguguagagcuuuugagaaaggcucccuguguguggggccagagaauguucucugugggaggauugagaaggcauauguguaguuggaugggcccuuaguggacagaguaaugggggauuauucuuggggcucauuguguccgggcauggaacguaggggcucucuguguggcuuguaagaugcugaagacucagauuuuagagaccaagugcguuucagaagagggcugaggugaggccuggccugugaugggguggaaugcugcaucaugguguuagggcgggaggccuagugacuucaguauguccuccccucccuacaggauugggugcaaggaguugguguugauggaggagcaggacgccagagucccagcccuggaaccguucagaguggagcagguugucagaacucagggugcagagggugaaggaggcaggcugauuccugaguucuuggguugggacugcccccuuccaccaaauucauucuuacugucagaguccauucuggaauggcacuggucccuugacuuuagacccugaccugucugaggacauccugagccugucuccaggcauagggguugcucugugaugauauguccucuguguggguugaagggccacaccuucagggggucuuucuauccuaggcaccaccuguaaucuacuaugucccugacuucaucuccaaagaagaggaggaguauuugcuucgacaggugaccucagugcccuacuggucuguuuucccacucuucccauauuccuccccaauguccauccucuguaugagagcccccaaggcugcagugaagaccccgacagaaggaacaaggaaguuacagagcucauacucccucuacugagauagcccaauccugcuagcuuagagaauaggggguuauaaacauaggcugagauagcccaguucagaucauugagacuggggaguaaagaauuuuguauucagauuucugugcugagauagcccaguaaacucuuuccugugcuaaaauagcccagcauagacccagagcacaauaagguuaccaaauacagaccaucuacgcugagauggcccagucugcauucuguucuuaagguuuggggaaagaagaauuuucaaagcucagaguuccugcccuuugcagccccagugccuaaguuacagagcacagaucuucccuguguuggaguaacccacugaucuugaguccaggaaaaaauuagcuacagaacacagacuuuuuugcugagauagcccauuccagaccuuugcguucuuggcauugaaaaaucuacauauuauagaauuccugggcugaaauagcccaguacagcuccauaaccaugaagggaaugaguagauuaucaacuagagcuagacuuguuggacugagauagcccauucuagaucauuaggaucuuggcaguggaagauuuucaaaguacuuucuuugcugugcugagauagcccagcuuugcauacucccucccccaggcaauaggaacaagucgguugcagaacucaaacuguccucagagagcccaggaaucaggaauuuuuguuuguuuguuuuuugagacaaucuugcucugucgcccaggcuggacugcaguggcgugaucucgguucacuguagccuccgccuccuggguucaacugauucuuguguuucagucuccugaguagcuuggauugcaggcgugugacaccacaccgccucccagguucaagcgauucuccugucucauccucccaaguagcugggauuacaggugcaugccaccaugcccagcuaaguuuuguauuuuuaguagagacgggguuuccccauguuggccaggcuggucucgagcuccugaccucaagugaucugcccgccucggccucccaaagugcugggauuacaggcaugagcaaccagguuuggcacggaaucaggaaauuagaaugcagacuauuugcugggcugaaagagcccuguccagccccagaacucugaguagauugugagacccacaacucucagaccacgguugugcagcccugauuccuaaauccugguagacacaggugggcuuuggggccaaaggcguucccaggaaaaaaggcaaaccacaaaauccuaggaacccaccgccccagggaauggucccacagacacagaugacccauuuccaucccggagguaaaggccccuauguuggucuaggugggaggaucauagaggggugauccugagaaaggagugacccccuucccaccucuuagguuuuuaaugccccaaagccaaaguggacccagcucucugggagaaaguuacagaacugggguaaguaucccuggcugggggcaggagugauucugggauguaggcuggggcaggggacucagguccaauagacuuaagacaucagagggucccugacagcucaaggggccccaagagccaggaggauucugaaggggucaguggagguccugagggauuagggauuuccugaugaguugggaguaucugaaagggaccuguggucuggagaagugaggaaaccucugaaggacccaguggcuaucuccaaacggucaggggucccugagaggaucagggugcuuccagccacuguggaaucccuaaugggggaucuauugcuauaggggggcccucaggaccccauugccuuccccaggugggcuuccucauccccgagggaugguuccugagcggcugcccccauggcuccagcgcuacguggacaaagugucaaaccucagccucuuuggaggccucccagcuaaccauguccucgugaaccaguaucugccuggggagggcaucaugguaaccacacacccucggcccguguccccccacucagacuucugagcugugcuggggcaggggacucuguacccacccucacucauuaggcagccacaucucccaaacaggcauucaccucccugucccuggcuugggaagccccccuuugacccagaggguggggguuguggacuccugcccugcccagcccuggugcccacucccuagccccacgaggacggaccacuguacuacccgacugucagcaccaucagccugggcucccacaccgugcuggacuucuacgagccgcggcggccagaggacgaugacccuacagaacaggugggcccccagacacugccccagcugcuuguaggcacuucaaccucgcacauccuccaagaugaccuggucccacaugccuucgggguacuccuggcacucucccagauaccuucccuuguccccucaugggguguacccacuuccucccagacacccaacccaucugcuuacagggugucugucccacaugccaugauuuucacaggcuccccgaugccccaaccugcugaauggauaccccugacuccccagcagacacugauauccuuagauaccccaccgccauuaacucggggggccucaccuccucccagaugcucuaucugccccugcucagggugccccagacguccugcuacuccaggaaugugauuuggggugcaggacacccccagauucuccuugaccccuugacacaauuucucugagugaugcauuucuagcaccccaguguucacagaaacgccccugaacacgccgacccacuccuugaggcuugcccucgagcccugcaugcuccuggaugcucugacacucccucagcugugcgguuguccucuaauguccugauguccuugggaacccccacugccucuaaccucugccucacucucuccucaccugguccuggcuucagccaugcucucucagcccagcucugccuguauuuccuggggacugccuauuccugggucccagccccagccucagccccuuugagaucccagcugcagcucccaccggccgcugacccuuugacgcccccaucugccaccuagauccugcccccucccgagggacggcagagcccucgcccucccuuuccagcagccccagcccaggccccagcaauuuucacuccugaaccaccaaagccuccaucauugugagcacacuugcucuucagcuuuugccccuggggacuagcugauccccggaggcuaccgaccucucgcccacccccaccccccgacuucuugagcccugcugacccucaacccgcccugcagccucggccuccgccccggcccaccaccucgcuacugcuggaaccgcgcagccugcuggugcuccgcggccccgccuacacgcgucuucuccacggcaucgccgccgcccgcguagacgcgcuggacgccgccuccucgccgcccaaugcggcagccugcccgucggcgcggccgggagccugccuggugcgcggcacccgggucucgcugaccauccgccgcgugccccgcgugcugcgcgccggccuccugcugggcaagugaccgccagggccgggaccccucggauucccagguuccugccccuuuggggcugcugugacuccgcgaccuaggaaccgugggcaaagggggcuccccuggguuauuuauuuucccaauaauuuugugugagcuacagaagaccccauaccaaauaaacaaaaaaaucuuuccu

SEQ ID NO: 15102 - RNA, 11194 nt, Homo sapiens
ccagcgacccuggggcggcggucguccaaacgcguggccacaggccuugcuucucgcuugcagacaacugaggccagccagcagcgcgacaggaugggcggccacgacgcgggugccggauaggucuccugcucucugcaacugcagcgccucuggaagccuucaaggcucaauggauggggccagcgggcaggguggccuacgcgguccagcagaacaggcuuagggggcuugaggcgccucaagagcgugggcccagcgcccgccaccaccgcaaacuccuugugccggucgccgggcggcagcgacggcgucaccaucgauuagggagugcccagcagguagcgccgcagagccagcgccgugucccgggaggcgcgcccacgcgcguucaccgccuccacuuccucgggccgcgacgucgcugcuugcacagcgccgccugccgcgagcccugcagcuccucugccccgggcgggcacacccacaccgucgugccuggcugcaggcgcggggagcacggggagaguggcgcccacgcagggagcgcugucaccagcaucgccgucgggggcccugugggcgguggcgacauauauagcuggaaguugggcuucucagcgcccccguuuuccgagaaagccgugaugaagcggcagcccuggaaacauaaaacacagacguccgucgggcuugagggaaccaggagcccagaggaggcagucaagaauaauccgguggauuuggaagcuaaaugcgucagauucuaauucugacucugccacuuucucucccucucucccucccuccuucucucccucccucucucccucccuuccuuccuuuucuuuuucuguuuuagagaggagacucaaucuguugcccaagcuggucucccaggcucacgcgauccucccaccuuggccucccaaagugcugggauuacuuacaggcgugagccaccuugcccagccgacucggccacuuucuagccaagugaacuugggcaagucaccuccuuucuuggggcuuaagcugcugugucuguaaaggggguaucggugcacacuucacagaaugauggggagcuugaugucaaagccauggcaugaagucagcuauaucaauauuagcuuaaacuugcuucuuuugcaccaucuguccccaaaaggcccgcccagccuccucagaaccaguuuugccaaucuccuggcacacagucugcccaaauagccccuuguccagcuggccagggcccugucccaagaaguuccacuguggccaauccccugucacagagccaugccagacagccucccaaccugagccagcacaaccagccccucccuaccccacacucugcugcaaauccagaccaacucaccagcuuucuguguuccuucuggggcacucacccuguaggaaacccaaggcaccgaggcacagcuggggguagagggagauagacugguuagugugguuccuccugccagccuucccuccaggccucccacugcaggggcaguacggggcacaagggagaccucagagaagggcucagccucagagcccagggcccgggggucaccugccagagcagggcugaggccaaccacauugcaggggcauuuauaguccuaggugccugggccuggcccucagcacccacccugggucuacacacaaauguacccauuaguacuggcuccagccugaccuggugccacugaucauacagaggccuaaguaugggggugcuggguggagaaaggaggggacagagaaaggaaagacagcuauggggagguggggacagagaucggcauagagaguaaaugugggagagggaaagauacacaaaaguuacggugaaggccaggcacaguggcucacgccuguaaucccagcauuuaggaaggccgaggcaaguggaucaucugaggucaggaguuugagacuagccuggccaacaugguaaaaccccaucucuacuaaggacacaaaaauuagccaggcgugguggcgugcaccuguaaucccagcuacuccagcuacucuggagagugaggcaggagaauugcuugaaccggggagguggagguugcagugagcugagauuuugcacuccagccugagcaaaacuccguuucaaaaaaaaaaaaaaggguuauggugagaugaagagauggacgaggggagagggacagauaggguaaggaauggagaaagagagaaggaaaaagaccagcugaggcuccggcggacugcuggcagacauggccacuucccgcuuaccccagcaacacuaauguuaaagcaguucaucagaaggcaacaaguucuucuccucuacagaaggauuuuccaaacaauucagcaaguuccaaaugauucugaucgcaaauaccugaaggauugggcaagggaagaauucaaaagaaacaaaagugccaccgaagaggauacaauucggaugaugauuacucaaggcaauaugcagcucaaggaguuagaaaaaacacuugcuuuagcaaaaucuuaacuauagcauuauucugaaggauuuucaaagucuccauguguuuuguugcauuuaggauuaacaauggacaacacaaagcccagucuuacuauuuguauguacaguauuuggugauagagagcaaaggaaaacacaucaaaacaguugccuuaacacugaaaaacauacccugcauuuugaaaauguuuauggauggcucagcaguuuuuaaaagaagcaaaacccacuaacaaauggccaguucgcacaugaaaagcugcuggacacaaucauuagggaaguguaaaucaaaacuacuaugaggccgggcacaauggcucgcguuuguaaucccaguacuuuaggaggccaagguagguggaucauuugagaucaggaguuagagaccagccuggccaacauggugaaaccucaucucuacuaaaaaugcaaaaauuaaccaggugugguggugcaugccuguagccucagcuacucgggaggcugaggcaggagaaucacuugaacccaggaaguggagguugcagugagcugugauugugccuacugcacuccagccuggaugacagagugagacucugucuccaaacaacaacaacaacaacaaacaagcaaacaaaaaacuaugagauaucacuucacauucacuagaauggcuguaauuaaaaagagaaauaauaacaaguguuggugaagaugugcagaaauugcaacccucauacauuguuggugggaauguaaaauggugcagccacuucaggaaacagacugucaguuccucaaacuaaugaaacacagcugccgcgugauuuagcaauucuaccccuaggcccauaaacauuauuuggcagugaaaagaaagaaggacugauauacugauauaugcuaaacauggauaaaccuugaaaacguuaagugaaagaagccagucacaaaagaucacgugaugauuccauucauaugaaguguccagaauaggcagaaagauuagugguugccuaggcuggcuguagguggaauggauuaacuguuaauggguguaggguuucuuuucagggugaugaaaauauccugcaguuagcuugugguguuagguugcaugacucugaauauacucaaauccauugaauuguaucucaauaaagcugaaaaaaaaaaaagaccaaagacagacaagaaaguaauuuauuccaggaaagccuuuuuuuuuuuuuuuuuuuuuuuagacggaguuucgcucuuguugaccaggcuggagugugcaauggugcaaucucggcucaccccaaccucugccucccggguucaaacgauucuccugccucagccucccgaguagcuggaauuacaggcaugcaucacgaugccuggcuaauuuuguauuuuuaguagagaugggguuucuccauauuggucaggcuggucucgaacuccugaccucaggugaucugcccaccucggccucccaaagugcuaggaauauaggugugagccaccacgccaggaccuuuuuuuuuugagauggaaucucgcucuguugcccaggcuggagugcaguggcauaauccuggcugacugcaaccuccgccuccuggguucaagcaauucuccugccucagcuuuccaaguagcugagacuacaggcaggugccaccaugcucagcuaauuuuuguauuuuuaguagagacgggguuucacauguuggccaggcuagucucgaacuccugacuucaggugauccacccuccuccucagccucccaaagugcugugauuacaggcgugagccaccgugcccagcaucggaagaagcccuuugaauauugaggaagugguuguauuuggagagagugagggauguaaguuucucagacagaauaagggauugaaggggcaagguggagaagcugagaccugaagaccauccuaagacaagaggggcacagccgggugugguggcacacaccuguggucccagcuacuugggaggcugaggugggaggauugcuugacccagggagaucaaggcugcacugaacugagauggugccacuggacucuggccugggugacagagugaggcccagucucuaaaaauaaaaaaguaaggccaggcgcggugcucacgccuguaauccuagcacuuugggaggccgaggcggguggaucacgagaucaggagaucgagacuauccuggcuaagacggugaaaccccaucucuacuaaaaauacaaaaaaauuagccuggcgugguagcgggugccuguagucccagcuacuuggaaggcugaggcaggagaauugcuugaaccuggcagagguugcagugagcugagauugugccacugcacuccagccugggugacauagcgagacucugccucaaaaaaaauaaaaaauaaauagauaaauuagaaaagagguggcagggccagugcggggagggggaggacuccugagccugcugagagagaaguuuuuuuuauuuuuauuuuuugagacggagucucgcucuguggcccaggcuggagugcaguagugcaaucuccgcgcacugcaagcuccgccucccggguucaggccauucuccugccucagccuccggaguagcugggacuacaggcgcccgucaccaggcccggcuaauuuuuuuguauuuuuaguagagacaggguuucaccguguuagccaggauggucuugaucuccugaccucgcgaucugcccgccucggccucccaaagugcugggauuacaggcgugagccaccacgccuggccgagagagaaguuuucagucucauuugaacuugaggauccuaggaagggggccgggagccuguguucugaggauggaggggaguggagauggggcuucugugccugaggaaggaggggacugcagaccugaacuccugaggaaggaggaagcuagacgccugggcuccuggauuguggaagugaccagagacagaggcaggagagggcaccaggugccuggauguggaggucuggaggauuuggggacagagguucccgugagaaaacaauggccuauacaucacuuucuucuucccagaacguccucucggcuucccagaagcugagaacaauggagcuacagccuucuaggaggaucucggagaggagggcaaggauggaucuccagaaauggagaagcaagggacccuggguacaguuaccaacugccucucccccagaugcuaguagcugcacccaggccuccuucucccccagaacguuaccuuuggugggaggaauaaggggagcauucaagaagcaacccauguucuuucuuuuuuuuucucuugagacagagucucacucuguugcccaggcuggagugcaauggggcgaucucggcucacuacaaccuccgccuccuggguucaagcgauucuccugccucagccuccgggguagcuggaaccacaggcacgugccaccacgcccaaguaauuuuuguauuuuuaguagagacaggguuucaccauguuggccaggcuggucucgaacuccuggccucaagugaucuauccaacucggccucccaaagugcagggauuacaggcaugagccaccacgcccagcuggaacccacuuuccuucaauagcuucaucugucacuugcuuaagauccuccuucaucacaagcagaggaugugguuaguguuuccuuccugccugagguggggaacaaacauaugugcuagaaacagagcuggggaagagggauggcgugggaagggcugggaugcuagaggcugaggagcucagacugucccaggaacccuggggagccaugggggugccuauacagaggaggguuuggcuuuaggaagauccuggaccagagaagagacugaggccaggagcccagugcaaggacccagaugggugaggccagaacuagcccaggauggggccggggcagggaggaaggggaggugggggacauucaggaggcugcauggggguugcucucccagacaggaccuagaaggaggcauagguccgagaagaagccgaggugggugugggauccagugggugugaggggccccaggggauguccaggaagagggguccgggaaacugagguaagccaggucuggacuuaggagagaugcugggguugaggauggaaauauggagguuguagccuggugagguggcucaggccuguaauugcaacacuuugggaggcugaggcgggaggaucacaaggucaggaguuugagaccagccuggccagcauggugaaaccccgucucuacuaaaaauacaaaaauuagccaggcuugguggcacacgucugcagucccaccuacucgggaggcugaggcaugagaaucacuugaaccagggaggcggagguuguggugagccgagaucucgccauugcaauccagccuggacaacacagcaagacuucaucucaaaaaaaaaaaaaaaaaaaaagaaagaaaagaaaagaaauaugaagguugccaacagagaagaaaaacagguguuaggggucgaugucccugaaugugaguacagaggcaggaaggggcucauucccagcuccccgaggccacagcauuuaggggaagcugaagaggaaguucccaaggaacugcuguuuuacccagagggcuggggagagugaagugcaccccgggggucuauggaguugaagccagaacauauccagaagaaaguccuuugaaaucucacauuuuauacucgaaauucuugccaauuuugcauucaccuccaucagucuauccaugcgaguuuucauauaaaaagauuuucaaguacuuaccagugagugacauucuguaaccuacccuucugcaucccccgccacccacgguaaacauuugcaagugaaaaugaggcucuggguucaucccgugguuuuggggucucccagcucgucuccugcacugggaugucuauuacccaagguucugguaaacgugcccaugcuggccucuccuccucagaaucacccacacucccagcuccuuccacaggcagcugagucccccaucuucucccuggccuugugcccccauccacccuccccaugguagcuagauggaucuuucuuucuuucuuuuuuuuuuuuuuuuugagauggaguuucauucuuguugcccagguuggagugcaauggugcaaucuuggcucaccgcaaccuccgccuccuggguucaagcgauucuccugccucagccucccgaguagcugggauuacagguaugugccaccacgcccagcuaauuuuguguuuuuaguagagacaggguuucuccauguuggucaggcuggucucgaacucccgaccucaggugauccgcccgucuuggccucccaaagugcugggauuacaggugugaguuacugcgcccagcugccagauggauuuuucuaaagugcaaaccugacccugucccuccaccuuaucacccuccacccuccauggccccacagugcgcccuucucccauggugcgccagccacacugaacucuggcucauucuuugagugugcaguccucucuuuuuucuuuuuuuuuuuuuuugagacggaaucucacucugucacccaggcuagugugcgguggcaggaucugggcucacugcaaccucugccuuccaaguucaagcgauucuccugccucagccucccaaguagcugggauuacagguuccugacaccacguccagguaauucuuuguauuuuuaguagagacggguuuucgccauguuugccaggcugguuuugaacuccugaccucaggugauucgcccgcuucagccucccaaagugcugggauuacaggcaugagccacugcgccuggcccucucuuggcuuuuguacccaaugcucucucuccugggaagacccucucugccucggcucucucuguaaaucccucaaguguucgcuccuccgggcaggacuggcuacauaauuugcagggcgcagugcaaaaucaaaauguggggcccuuguucaaaaauuauuaauuucaagauagugacacuagggcauuaaagcaagcauaggguacuucuaaguuuggggcauggugcaaccccacagucacacugccauaaagcuggcccugccucaggaaaucuuggacugucuccccaccucccaucccaggcccaguuagaaacuucagauugcuucuuggccuuuuggcuaagaucaaguguacaacccucuggcucugggaguccccugggcuucugcaaaagcccugaucauucuugccuguucuuuccccauccccgaccacucugggaugccauuguuuugugauuaucuauuuccuccacuggaaauagaacucuuuuuuguugguuuguuuugggacggagucucgcucuguugcccaggcuagacuacaguggcccaaucuuggcucacugcaaccucugccucccggguucaagugauucuccugccucagccucccagguagcugggauuauaggugccugccaucacacccggauaauuuuuguauuuuuaguagaguugggguuucaccaugucggccaggcugguugcgaacuccugaccucaagugacccaccugccucggccucccaaaguguugggauuacaggcaugagccacugcucccagccuugaacuggaacucugagggcaagggcuagggcuguguuggucaccacaauguucccaacgucacuccgcacaggucaggacgacaggcagcacugauaccuaucuuugcuuuugcgagguaugagagggcacagccaucagggaggacccaaaggcaggaggcaggcgucagguuccacccugaacacaaacauccuuuuugggaacaccuuuuaucugauucucucacauaugugcccaugcaaagagcugcaaaagcguggcauuagccucagccuugcaggagaucacagguguccccagacacucagggccuuugucagauuuagccaccccaagacacauggguuggaucuggcaguacacagacagggcagaauccugguauugggucuacagucacuucaagauaaugcuccagcagccggagcuuuggucuaaaaaauguguggggccaaaagcagaugaggaauugaugaggaauugacaguagaaguaguuguacucccugagcucaggaaauugauggacuuagcuaggcaguuggacaagcuaauuauuauuauuauuuguagagaugggguauggcuauguugccugggaggccacagcauuuugggggaaguuaaaguuccuaaggaacuacuguuuuauccagagggcuggggagagugaagugugccucacaggguccacggaguugaaaacaggcuggucuugaacuccugggcucaagcaauccucccugaggguggccucucaaagcacugggauuacaggcaugagccacugugccuagcugacaagcaaaauuuuaacuuuaaauccuagacacaugugauuguguguuucugcaggcgggugggggugguccaggcaugcugugggggaacaugggggacccaugcuagagggaccagucugcccuccucccauccuuccugcuuccauauuuguaauaagcuacuaccaagugugugucccccuuccagcccugcauuuccuguguccacauucccccugaccacccacugccucucagccuccauccacugucugccugcuacuugagccuggaaaagguccgucauucccaugcuacacagaagucccucccccaucuaagggguggagcuguggauaucagagcccagugucuuacaacucuucuucccaucucugcaaucuugcugcagaacuggguagcuguacaguagggcacacugucugcuggguggggggcagaggccucuaguaaggucgucucaaaucucucuucaaccacuucaggccccaacuugguccggaucacccuucugcuuggacuauugcaguauccuccuccccacagagcuuccuugagaucagggacugcuacucucauuagaccucaaaacccuucaaugggccaggcgggguggcucaugccgccuguaaucccaacacuuuaagaggccgaggcagguagaucaugaggucaggaguucgagaccagccuggccaacauggugaagaagucucuacuaaaaauacaaaaauuagcugggcgucguggcagggcaccuguaaucucagcuacucgggaagcugaggcagaagaaucacuugaacccggguagcggagguugcagugagccaagauugugccacugcacucuagccugggcgacagcgagacuccgucucaaaaaaaaaaaaaaccaaaaaacccuucaauggcuucucaugccacuuagaggacaauccacacuccucccagcagccuacgggguccugcgucaucggcucccuuccugcuuuccagccucaacccaaggucacucucuucccuucccuccccuacuucagcccccuggccucagcucuuucacucaugcuucccucagcacaggcucuuccauuugcacggaauacccuucccaccccuuucaugguuaacuccaaccugcgcauccuucaggucuccgcca

SEQ ID NO: 15103 - RNA, 4486 nt, Homo sapiens
cuuccuccuucacuugccuggacgcugcgccacaucccaccggcccuuacacugugguguccagcagcauccggcuucauggggggacuugaacccugcagcaggcuccugcuccugccucuccugcuggcuguaaguggugaguuaggggcuuccguggcugccucccgggucccugggcucagcuuggggcagggcagggagugggguggaacgagagaaccaaaaguggguguugggaugggagcagguccccaaccucccaaagccuguggguuucucccagagcccaagcccccaaguuuugucguccgcuacaagcaggggagaagagacaucuaaguguguugccacaggacaaguugugcagaaguaacgcacauaguccgguggcccagacgccagcccccugagucccgccagacacgcucucccccuugcuaaccucuuggcugucaggauccaccuucccuggcuucuaaacuugccucccccacccccgucauaacucugugccucaguuuaccuucuuuuuccuccucaggucuccguccuguccaggcccaggcccagagcgguaggccuagacccagcagucccucucucuaccucccagagaccucccugucuccgucucucccacacccuuuccaaaccucccugccgcugaccccccuccccacaguucccagcacacacugaccuccccugaccccugugcugcagauugcaguugcucuacggugagcccgggcgugcuggcagggaucgugaugggagaccuggugcugacagugcucauugcccuggccguguacuuccugggccggcuggucccucgggggcgaggggcugcggagggugaguggggcuagcaggggacauccugaggacuugccuagauggggguggggggcuggguaaacucccagaucucaaacauccaaagggaugguaauggaggugcugauuuggaaugacaaaacacccucaacucaccacucugccugucucugcaccccacaacaccccucaccuccagcagcgacccggaaacagcguaucacugagaccgagucgccuuaucaggugagaaaaccagacuguccuccucacauuucacuccugccagggauaucugccccagauacuccuucaugccaucagagggaccucaaagccacucugccuaaagcacccccaaaccuugaaggcacaugggacaucuguccaaaacugggccgaaugaucaaccacaagcuuauggucagcuuaaaaugugugaagaggggcugggcacggugacucaaaccuguaaucccagcacuuugggagacagaggcggguggaucacuugaggucaggaguucgagaccaacauggugaaacccugucucuacuaaaaauacaaaauuagcugggcgugguaacgcaugccuguaaucccagcuacuugggaggcugaggcaggagaauccuuugacccaggaggcggagguugcagugagccaagaucacgcaauugcacuccagccugggcaacaagaggaaaacucugucaaaaaaaaaaaagcgugaagaguuaaaaagaaaaaaaaaaggguggcuuugccuuuguaaguguaaacacaggccuugccagaagucaggccaggaauuuucuggaagaaacccagcccuaggacgacugauuucugggagacgcucucaguagggcagagaaugucauucagcccuaccuugguaacucuaaagagaggaguccuagaaucucuuuuuuggguuugaggacccuucaucccuuugagaaacuaagaaaaucuagacucccagaaaaaucuacacaaaaaauacaaaauugugcauauaaucugagagcaguguaaauguucuuuauaauuaaaaaaaauuuuuuuuuggccaggcaugguggcacacaccuguaaucccagcacuuugggaggccaagguggguggaucacgaggucaggaguucaagaccagccaggccaggauggugaaaccccaucucuacuaaaaauacaaaaauuagcugggcauggugucaugcgccuguaauuccagcuucucaggaggcugaggcaagagaaucgcuugaacccagggggcggagguugcagugagccugggcgacagagugagacuccaucucaaaaaaaaaaaaaagacaggggucucacuauguugccccagcuggucucaaacucccagucucaagugauccucccgccucagccuccgaaaaucuugggauuacaggcucaagcaaccaugcugguugaguauucuugaagcucuuuuuucuuucucuacuuuaauuuuuuuuuuuuuuugagauggagucucauucugucacccaggcuggagugcaaugguguggucucagcucacugcaaccuccaccucccagguucaagcgauucucuugccugagccucccgaguagcuggaacuacaggugcaugccaccacacccggcuaauuuuuguauuuuuaguagagaugggguuucacuauguuggccaggcuggucucaaucuccugaccucgugauccgcccaccuuucccucccaaagugcugggauuagaggugugagccaccgcgcccggccuuaauuuuuuuuuuuuuuuuaaaguagagauagguucucacuauguugcccaggcuggucucaaacuccugggcucaagagauccuguuaccucggucucccaaagugcugggauuauaggcaugagucaccaugccuggcugaagcucuuuuuaaaaacuauagaguauacaagagaaucuagucaucuaucccccucucugucaauguuccuuuuuaacccuuuagggggucaugagauucucuaagaccucuccccugaagaaugcacgcccagacuagucaucauauaugauuuuaggguuucugucugaggccugccccugggggccacauagauccucccccuaccccaagugugaacacugcugugugaagucugauauauugucugcaaccagcuuugccuauucaccucacuuguggauaaaguuucuuugugaagucuaagaaucucagguuuggcucugugauauccagaagaccgaggggcccuuccaguuacugguggcagugaaauuuuagggcaaagcauuacccggauguauuuauucccucuguggaugugucuagcaccuauaagugcuaaaugcuggggacacagugacagaguuuauauccuaguuaagacaaacuuaaagcaaaugaacaaauaaaauaauuuugggaggcacaguaaaggaaauaaacaggcuuuuuuuuuuuuuuuuacaguggcuggaguguggggggaagaaacuacagaggggaaauugagaaaugccucucugaggaggugacgugagcugagacuugaagggagaggggaucuaggggaacagaguuuuaggcagaggaaacagcacacgcagggacccugaggcuggggcacacugaugaggcagaggagaagggggaacauugaauguacuugaauaaaauccggaucucuuucauggcuauaaggcugaagaagcugccaggggccuugcaggccacugggagaaggcuggauuuuauuuggugggucccuuccacugauggcccccauuccuuuaggagcuccagggucagaggucggaugucuacagcgaccucaacacacagaggccguauuacaaaugagcccgaaucaugacagucagcaacaugauaccuggauccagccauuccugaagcccacccugcaccucauuccaacuccuaccgcgauacagacccacagagugccaucccugagagaccagaccgcuccccaauacucuccuaaaauaaacaugaagcacaaaaacauuaugccagauccuugggcugaugggauggggacauguggggguucugagggggccuuggauccagaaacaguucaugggagggaggcuuugggaacucugggguucuuugagaaagaauacgacuacagguguuucaauuguuuuauuacaauccaaaaguuggggcggggguuccugugccaccacacaccauccaggaugagagggucagaagucaaagguccaagcugcaggagggucagccccugccuggcauguugauguagacuuugccaucuucuggggauaggggagagaaagcaugaagcuugaccacccauaucuccacuucccuggggacccccugcuucagggguuuccucagggguucccccaggcaccucccccaggguuuccccagcaccuccuccagggcuuccccaagggcccccucccugggacccccucccuagggacacuauacaccuuccaggccccgcccaucuccgcccucaccuugggcggggcugcggcgugggcgugcgcacaggaacaccgcccccacgaugagcagcgaugccaccgcaucagcagccacg

SEQ ID NO: 15104 - RNA, 4486 nt, Homo sapiens
cguggcugcugaugcgguggcaucgcugcucaucgugggggcgguguuccugugcgcacgcccacgccgcagccccgcccaaggugagggcggagaugggcggggccuggaagguguauagugucccuagggagggggucccagggagggggcccuuggggaagcccuggaggaggugcuggggaaacccugggggaggugccugggggaaccccugaggaaaccccugaagcaggggguccccagggaaguggagauauggguggucaagcuucaugcuuucucuccccuauccccagaagauggcaaagucuacaucaacaugccaggcaggggcugacccuccugcagcuuggaccuuugacuucugacccucucauccuggauggugugugguggcacaggaacccccgccccaacuuuuggauuguaauaaaacaauugaaacaccuguagucguauucuuucucaaagaaccccagaguucccaaagccucccucccaugaacuguuucuggauccaaggcccccucagaacccccacauguccccaucccaucagcccaaggaucuggcauaauguuuuugugcuucauguuuauuuuaggagaguauuggggagcggucuggucucucagggauggcacucugugggucuguaucgcgguaggaguuggaaugaggugcagggugggcuucaggaauggcuggauccagguaucauguugcugacugucaugauucgggcucauuuguaauacggccucuguguguugaggucgcuguagacauccgaccucugacccuggagcuccuaaaggaaugggggccaucaguggaagggacccaccaaauaaaauccagccuucucccaguggccugcaaggccccuggcagcuucuucagccuuauagccaugaaagagauccggauuuuauucaaguacauucaauguucccccuucuccucugccucaucagugugccccagccucagggucccugcgugugcuguuuccucugccuaaaacucuguuccccuagauccccucucccuucaagucucagcucacgucaccuccucagagaggcauuucucaauuuccccucuguaguuucuuccccccacacuccagccacuguaaaaaaaaaaaaaaaagccuguuuauuuccuuuacugugccucccaaaauuauuuuauuuguucauuugcuuuaaguuugucuuaacuaggauauaaacucugucacuguguccccagcauuuagcacuuauaggugcuagacacauccacagagggaauaaauacauccggguaaugcuuugcccuaaaauuucacugccaccaguaacuggaagggccccucggucuucuggauaucacagagccaaaccugagauucuuagacuucacaaagaaacuuuauccacaagugaggugaauaggcaaagcugguugcagacaauauaucagacuucacacagcaguguucacacuugggguagggggaggaucuauguggcccccaggggcaggccucagacagaaacccuaaaaucauauaugaugacuagucugggcgugcauucuucaggggagaggucuuagagaaucucaugacccccuaaaggguuaaaaaggaacauugacagagagggggauagaugacuagauucucuuguauacucuauaguuuuuaaaaagagcuucagccaggcauggugacucaugccuauaaucccagcacuuugggagaccgagguaacaggaucucuugagcccaggaguuugagaccagccugggcaacauagugagaaccuaucucuacuuuaaaaaaaaaaaaaaaauuaaggccgggcgcgguggcucacaccucuaaucccagcacuuugggagggaaaggugggcggaucacgaggucaggagauugagaccagccuggccaacauagugaaaccccaucucuacuaaaaauacaaaaauuagccgggugugguggcaugcaccuguaguuccagcuacucgggaggcucaggcaagagaaucgcuugaaccugggagguggagguugcagugagcugagaccacaccauugcacuccagccugggugacagaaugagacuccaucucaaaaaaaaaaaaaaauuaaaguagagaaagaaaaaagagcuucaagaauacucaaccagcaugguugcuugagccuguaaucccaagauuuucggaggcugaggcgggaggaucacuugagacugggaguuugagaccagcuggggcaacauagugagaccccugucuuuuuuuuuuuuuugagauggagucucacucugucgcccaggcucacugcaaccuccgcccccuggguucaagcgauucucuugccucagccuccugagaagcuggaauuacaggcgcaugacaccaugcccagcuaauuuuuguauuuuuaguagagaugggguuucaccauccuggccuggcuggucuugaacuccugaccucgugauccacccaccuuggccucccaaagugcugggauuacaggugugugccaccaugccuggccaaaaaaaaauuuuuuuuaauuauaaagaacauuuacacugcucucagauuauaugcacaauuuuguauuuuuuguguagauuuuucugggagucuagauuuucuuaguuucucaaagggaugaaggguccucaaacccaaaaaagagauucuaggacuccucucuuuagaguuaccaagguagggcugaaugacauucucugcccuacugagagcgucucccagaaaucagucguccuagggcuggguuucuuccagaaaauuccuggccugacuucuggcaaggccuguguuuacacuuacaaaggcaaagccacccuuuuuuuuuucuuuuuaacucuucacgcuuuuuuuuuuuugacagaguuuuccucuuguugcccaggcuggagugcaauugcgugaucuuggcucacugcaaccuccgccuccugggucaaaggauucuccugccucagccucccaaguagcugggauuacaggcaugcguuaccacgcccagcuaauuuuguauuuuuaguagagacaggguuucaccauguuggucucgaacuccugaccucaagugauccacccgccucugucucccaaagugcugggauuacagguuugagucaccgugcccagccccucuucacacauuuuaagcugaccauaagcuugugguugaucauucggcccaguuuuggacagaugucccaugugccuucaagguuugggggugcuuuaggcagaguggcuuugaggucccucugauggcaugaaggaguaucuggggcagauaucccuggcaggagugaaaugugaggaggacagucugguuuucucaccugauaaggcgacucggucucagugauacgcuguuuccgggucgcugcuggaggugagggguguuguggggugcagagacaggcagaguggugaguugaggguguuuugucauuccaaaucagcaccuccauuaccaucccuuuggauguuugagaucugggaguuuacccagccccccacccccaucuaggcaaguccucaggauguccccugcuagccccacucacccuccgcagccccucgcccccgagggaccagccggcccaggaaguacacggccagggcaaugagcacugucagcaccaggucucccaucacgaucccugccagcacgcccgggcucaccguagagcaacugcaaucugcagcacaggggucaggggaggucagugugugcugggaacuguggggaggggggucagcggcagggagguuuggaaagggugugggagagacggagacagggaggucucugggagguagagagagggacugcugggucuaggccuaccgcucugggccugggccuggacaggacggagaccugaggaggaaaaagaagguaaacugaggcacagaguuaugacgggggugggggaggcaaguuuagaagccagggaagguggauccugacagccaagagguuagcaagggggagagcgugucuggcgggacucagggggcuggcgucugggccaccggacuaugugcguuacuucugcacaacuuguccuguggcaacacacuuagaugucucuucuccccugcuuguagcggacgacaaaacuugggggcuugggcucugggagaaacccacaggcuuugggagguuggggaccugcucccaucccaacacccacuuuugguucucucguuccaccccacucccugcccugccccaagcugagcccagggacccgggaggcagccacggaagccccuaacucaccacuuacagccagcaggagaggcaggagcaggagccugcugcaggguucaaguccccccaugaagccggaugcugcuggacaccacaguguaagggccggugggauguggcgcagcguccaggcaagugaaggaggaag

SEQ ID NO: 15105 - RNA, 12588 nt, Homo sapiens
aagaucggggacccggcggcggcuccgcgggggaaacagcgaggcuggcgcagcgccgaggccgcggcccugggggcccgcaauccacgccacggaauccccgagguaaugggcgcgggcaggacgcguucggcccccuaagagagugagggacugaggaucgaaagacucccgaggcccugagggacggagcugaagcgucaguccuuuaucccgagagugagggcccuagguguuuggaggaggaggggaucguggaucgugacagaggggcggcugggaucccagacuucuggguccugggggugcaggggccuggggauccaggaucgcagggccccgagggugcaagggcugggaggcuugggaggcuggaucucuggguccuuggaggugcuagggguugcuggcaaccgagacuccuaccccuagaagcagggacuaggcugagugcggggggggggggggggggcgugguugcuuaaaaucggcgugggucucgguggggaaggguccggagccuggccucagggucuacgcuggcggugacccugccucugccccgcccugggauuuccggauggccacccgugcggggcugagcaggaauuccccuugcgcggggauuccacgagcgccacgaucggccgcgcgccccgccucggagcaggacaccuggggcacaggacuuggggggaaggggaggauggaagauucccuugcgugagcgccguggcgucagcgcgccgcgucggggcuguuuccgagccaccuccucccgcccccgccccgcgcaauccccacuuaacccuuccuccgccggaacccaggcucggaagggugaggguucugucuuucugagucgugggaaggaguuugggaacuggggcucccagguccuagagaggaaggaacugaggguccagauuccuggggccugaaaaagagacuguauggaugggccuuuuuuuuuuuuuuuuuuuuuuuuuaauggagucucucucugucgcccaggcuggagugcaguagcgcgaucuccgcuuacugcaaccucaaccuccgccucccggguucaaguguuuccccugccucaccugggauauacagccgccugccaccacgcccggcuaauuuuuauauuuuuaguagagacgggguuucaccauguuggccaccugaccucaggugauccgccccccuuggccucucaaaguguugggauuacaggcgugagccaccgcucccggcccggggugaggccuuugacuucucgaggaggggcgcuggggacuccugauuuccgggucagguucuagggaaaaaaauguugggaaccuggaugugagucuagggagugacgccuggcgccggccccccaccaacccgcugacuucaaaacuuggauaucuggggguggaauuuuuuuacggaaguggggugguugcugcagaggggugcccuccucccccuuccucacuuuccgcgacggugguggaaaguugggucagagggaaagugcggagcaaaaggaaggaaacggcggaggcggaugccccaccccaaaucuucuaauggcuuuggaggagucaggcggcaucuaugugccaguuuuuccgcgcgggagggcgaggagggugcccaaacccacuccccgcgcgccacccccgcggcauuuaggugacuuaaggacccuugaugacuucccccucuccucucccgcacagugagcaggggugagcgcagccacugcccaacgcaaaccgugaagaagcuucuggaagagcagaggcgccgccagcagcagcagcccgacgcuggcggggugcaggugaggccagggagccacagcucuccggaggccccgugcugucccguagggacucagcggcuugccgggcccucggggcugaugagaggggugguccugaccgaaaugucuuauagauccgagacagacccggaggaaucugccagauaaagucaccuggguuccuuuuugcuuuugucucuacagggacaauuucucccucccccagagcagccccugaccccaucugugaaugaggcugugacugguaaguucucucagcucccggccuccccaucccccuucccuaagggacucagacaucgcagcucucagaacuuugggacaccugggagucaggcccucauucuucccuuuuuuuuuuuuuucugagacaggaucucacucuguugcccuggcacuggagugcaguggcgcuaucuggcucacugcagccucaaccuucugggcucaagugauccucccgccucagccucccaaguagcugggaccacaggcgaugccaccuugcuuggcuaauuuuuuaaauuuuuguagaaacggggucuggcuauguugccuaggcugguaggcccucauucuugcuggaacucaguagcagucugauuuccuagguucucuugaguccaguagucuaugcacauaguccuacggagccccagggcccaggcucagccuuuuuagugccccaggaguccaggcccucaauuccucagugucccaggaauccaggucccgggagcuuggugucccagaaguacuaacucucaguaccuugggagacgccaggcccucuagcccuggaugugacguccccaacucugguaaccagaccugccccugccccuccucuuacacgcaggccacccucccuucccagcacacucggagacuguggguucuggaccuagcagccugggcuuuccagacugggaccccaacacgcaugcugccuacacugacagccccuacucuugcccugcuucugcugccgaaaauuuccugccuccugacuucuacccacccucggacccagggcagccgugcccauuuccccagggcauggaggugagauacagaguggguacaggaugcugaagggccccuaaaaauucgcaguugcacuccugcaguauucugagaugucuggagcucaguuacgauucccuuuuccaggccgggcgugguggcucacaccuguaaucccagcacuuugggaggcugaggcaggcggaucacuugaggucaggcguuugagaccagcuuggccaacauggugaaaccaaaaauaaaaaaauuagcuggguguaguggcgcacgccuguaauccuagcuacucgggaggcugaggcaggggaauugcuugaacccaggagguagagauugcagugaguagagauugcacugcugcacuccagccugggugacagagcaagacucugucaccgaaaaaaaaaaauacccuuuuccaggugggcaaaacugaggccuaaagguccaaggucacuuggcauagaugggauacccaggggcucugcaugcagaugugugugugguggcuugggauggaggaauucucagcugacugggucuccccaccaccugcacccuccaggaccccccagacacccaguucuauguaggaucuucucugccacaggcuggacccuggagaguuucugcacccccuucaggacccccacaguuccccgcuguggucccuggaccaucgcuggagguggcccgagcucacaugcuggcuuuggggccacagcagcugcuggcccaggaugaggagggggacacgugaguauaagggauaggguugucugcagacucuuggcuuggugggggcuguucucacggcugucccccaccuguccucaggcuccuucaccuguuugcggcucgggggcugcgcugggcggcauaugcugcggcugaggugcuccagguguaccggcgucuugacauucgugagcauaagggcaaggugaggcuuggggccugaacucuccuggguucaggggaggaaggagccuggggccuggaccccuggauccuagagaagaggggaauggggggugagcuccuggggcugaggggggauggggcugggagccugguuuucugacgggagggaaccaggagcccaaccugacuucuccuguggccugcagaccccucuccugguggcggcugcugccaaccagccccugauuguggaggaucuguugaaccugggagcagagcccaaugccgcugaccaucagggacguucggucuugcacguggccgcuaccuacgggcucccaggaguucucuugguauggccagcuggcaggcagggguuugucugggggguagacugguugcccagauuuuggcuuccagggccaggaggccaggggauacccuuacccagcagucugccuucucuuccucccaggcugugcuuaacucugggguccagguugaccuggaagccagagacuucgaggguaaguugggugugggcagggcuggugugguugguguggcugggcgaggugggugcagaugcgggucccucacugucuccauucugcaggccucaccccgcuccacacggccauccuggcccuuaacguugcuaugcgcccuuccgaccucuguccccgggugcugagcacacaggcccgagacaggcuggauuguguccacauguugcugcaaaugggugcuaaucacaccagccaggugagcggggaugugggcggucagacccugggagauuguguggaauggggccacuuggauguccgggagcuccaggcaaaugcugacuuugccucuuccuugcugcgugcccuugaacauguuacuucacuucucugugccuuagggguuuuuuguuuguuucuuuguuuguuuugagauggaguuuugcucuuguugcccuggcuggagugcaauggugugaucuuggcucaccgcaaccucugcaucccggguucaagugauucuccugccucagccuccugaguagcugggauuacaggcaugagucaccacgccuggcuaauuuuuuuguauuuuuaguagagacaggcuuucuccacauuggucuugcuggucucgaacucccgaccucaggugauccaccugccuuggccucccaaagugcugugauuacaggcgugagccaccgcgcccagcaggguuuuuuuguuuguuuguuuuuuuguuuuugagacagggucucacucugucgcccaggcuagagugcaguggugcaaucucaucucauggcaaacucugccucccagguucaagugauucuccugucuuagccuccugaguagcugggacuauaggcgcacgccaccaugccuggcuauuuuuuuuuuuuuuuuuuuguauuuuaguagaagugggcuuucauuguguuggccaggcuggucucaaacuccugaccucaaaugauccucccaccuuggccucccaaagugcugcgauuacaggcgugagccacugugccuggccccuaguuguuaacugggaauaauauuacugaccuuaggguauguuaucaagcacuuacuauucauucaucaagcacugaguuucauagauuagcuuauugaaaccucacaaacacccuuugacauguguacucuauuuucucuauuuuacugaaaaggaaacaggcaugggaaaucaaaaaucuuuuuuuuuuucuuuuugagauggaguuuugcucuuguugcccaggcuggagugcaauggugugaucucggcucaccacaaccuccgccuccuggguucaagcgauucuccugccucagccucccgaguaacugggauuacagguucccaccaccacguccagcuaauuuuguauuuuuaguagagacaggguuucuccauguuggucaggcuggucucgaacucccgaccucaggugaucuuccugccucggcuucccaaaaugcugggauugcaagcgugagccacugcaccuggccucaaaaaucucuuugagacagggucucacucugucacucaggcuggagugcaguggcaugaucacagcuuauugcagccuugaccuugugcacuuaagugauccucccaccucagccucccaaguagcugugaucacaggcaugcaccaccaugcguggcaacuuuuuuguaagguggggucuaacuauguuggccagguuggucucaaacuccugagcucaagcaauccuuccaccucugccucugaaagugcugggauuacaguugugagccacugcacccagccugaaaaaucuuauagcuugugacugucagagagagaauuagaacccagguagucugacuuuagaaccuagcuuuuaauuauguucuguuccuuuccugugacaguagcuccuucauaggcuggcugagagaauuaaacauccacaaaaaauguuuauuuauuuauugagauggaaucucacucugucacccaggcuggagugcaguggcaugaucucggcuuacugcaaccucugccucccggguucaagccaugcuccugccucagccuccugaguaacugggacuacaggcaugcaccaccacgcuuggcuaauuuuuuuguauuuuuaauggagacgggguuucccuauguuggccaggcuguucucucaaacuccugaccucaggugagccgcccgccuuggccucccaaagugcugggauuacaggcauaagccacugcgcccagccgaaaaauguuuuuuuaguuaaagaauguugaacaccaauaaaauauagaaaauaguggaaugaacuccauauguccaacaucaauaaccagccacucauggccaguccugccccauccacucucucacuuucaagugauuuuuuuuuuuuuuuugagauggcucucgcucugucacccaggcuggagugcaguggugcgaucucggcucacuguaagcuccgccucccggguucacaccauucuccugccucagccuccugaguagcugggacuauaggcacccgccaccacgcccggcuaaauuuuugcauuuuuaguagagacgcaguuucaccguguuagccaggauggucucgaucuccugaccucgugauccacccgccucggccucccaaagugcugggauuacaggcgugagccacugugcguggccucucacuuucaugugauuuuuaagcaaauuccaacauguauuuuuuucaaaaauauuuguguaucuuuaaagaauaaugguguuuagcagaauuagcuagaugguggggauggacuguaagaaggacgggcaugacugaguagagacaagauaaggcauuauuagcgggguuaggaaaugaaugaugguaaucuaggcucuuaaugguugcaaaguagagcuaagugaucauuugggcaauacagagaaggugaaauugauacuuugguaauucauucguuucuucacucagaauuuuggacacauaugauguagcuaccagugugcuagugauggggcauaaaguugcuuuuuguuuguuuguuuuuuagagacagagucuggcuuugucacccaggcuggagugcuguggugcgaucacgaaucacugcagccucgacuuccugaccucaaacauuccuuccaccucagccuccuaaguagcugggacuacaggcaugagccaccucacccggcuaauuguuuuauauuuuuuguagagagggggggucucacuauguugcccaggcuggucucgaacuccugggcccaagugaucccccagccuuggccucccaagugcugggauuacaggcgugagcugcugugcccagcuaccuauaauguuuuaauaagaaaagaccacuuucuuguacuuuuagacauuaaaauuuaauggaaaagagaggagaugauaaguaaacaaagaacugaacauaauuacaaauugggaugagagcugccuugggaauguagaaggagcucuuagacaauaaaaagauuggcuuuauauuggaugcggggcucacaaugaaggucauucugaggaaauuacauuuaaguugagcaagaaaugaugaagaggaagaauuaacugugugguaggguucugggagaacucagaaaucagggaguauuucucugaaaaaaggacaaauaauuuuuuuuuuuuuuuugagauggagucucgcucugucgcccagguuggagugcaguggcacagucuugguucacugcaaccucccagguucaagugauucuccugccucagccucccgaguagcugggacuauaggcaugugcuaucacaccccacuaauuuuuguauuuuuaguaauaauaauaaguuuuuuaaaaauaagaaagauggcugggugcgguggcucaugccuguaauccaagcacuuugggaggcucaggugggcggacugcucgagcucaggaauucgagaccaaccugggcaacauagggagaccccaucucuaaaaaaaauacaaaaauuagcugggcuugauggcacaugccuguggucccagguacucaggaggcugaggugggaggaucaccugaaccuggggaggucaaggcugcagugagccaugauuuugccaccacacuccagccugggugacagagcaagacccugucucucaacaacaacaacaacaauaauaaaagauaagaacucuuucccuguaaucccagugcuuggggaggcuaaggugggaggaucacucgagcccaauagguugaggcuacagugagccuuggucacaccacugcacuccagccugggcaacagagcgagacccugucucaaaaaacaaacaaaaaacauagcuuuuuuuuuuugagacggagucucauucuguugcccaggcuggauugcaauggugugauuuuggcucacugcaaccucugccucccggguucaagcuauuccugugucucagccucccaaguagcugggauuauaggcaugugccaccacgccuggcuaauuuuuguauuuuuaguagagacgguuucaccauguuggccaggcuggucucgaacucuugaccucaagugauccgcccuccuuggccucccaaagugcugggauuacaggcaugagccccugugcccuucgaaaaaaaagaacuuuuuaaaccucaguaucauugcucugucuuuaaaaaauuaaagauuuucuuguaauaccaaauauccuggcuguauucaaauuuccuuuuggcuguaaaaugauaauuuuuuucauuaaaaaaaaucaagauccaaauaagcacacauauuaugauguuacgucuuuucaaaucacucuuaaucuagagcuuugguuuugucuucaucauuuuuuggacgagcaaacuaggugguuuugcccuguuaucagcacauaaaauguuuaacauucauuaucguuacaaacuccuuaaagacacauaaaaagguuucauuuuagaaaaugucuuuuauuuucccccaaauaugaugggaacagcucaauauuguggugcaguauugcaauauuagcuaguccacugauuaaugcugccaacuccugugcuuguagauaaaguacagucugugugggucgggaugcaauuuaauguguugaauggagggcagguagccaaggcaguugcuuugaagaacuggaaaaggagucucuuucucagacacuggugggaaaauugucaugagaaauguacaguucuggaagguguauggugugaaugguacacccugagacgugguguugugcggugcacaagacauacaacugaauaaggcacucuugguggggcucgcagaagagggccagcaucuuauuuauuuauuuauuaauuuugagauagagugucacucugucacccaugcuggagugcagugguguggucauggcccacugcagccgugaacuccuaggcucaaaugaaccuccugccucagccucccaagcagcugggacuacaggugcgcaccaccacgccuggcuaauuuuucuauuuuuuguagagaugaggucuugcuguguuguccaggcuggucugcagcuccuggccucaagugauccuccuucuucagcuucccaaagugcuaggauuacaggcgugaaccaccgcacuccgccaagggucagggucuuuaaagacuccuggauucugugggagggcaccuaggugugaggcuggcccugaccucugccauucccuuccccucaggagaucaagagcaacaagacaguucugcacuuggccgugcaggcugccaaccccacucugguucagcugcugcuggagcugccccggggagaccugcggaccuuugucaacaugaaggugggagcuggggcugggaagugcagauugugugggguacgguagggggggcagugggauguuagggguccugggggcuguggacguggaggggacgaugugugggaucugcaggggaaaguauaggaagcagacacagauugccccagaacauguaguccguggacacagggaugcaugcagcguggcuguggccgggggaggucugggaugugaaaggacaaguguaggacguagacaaggcagaaauugaagugcaguuuagaggccugggccagcugagcccagauccccaccagcccuccccuuacuuuuccaggcccacgggaacacagcccuccacauggcggcugcccugcccccugggccggcccaggaggccaucgugcggcaccuguuggcagcuggggcggaccccacacugcgcaaccuggagaaugagcagcccguucaccugcugcggcccgggccgggcccugaggggguaaguaagcacugagccugccuguagaguggccucugagcucgcgggcgcgggaugaccucccugccccacccaaugcucgcuuucagagaaugacuucuaaucucggaaggugacuucagcccucaggcaacccugacucuauaaugugaccucugaccucaguguuucauccuuuaccccagaauggugacuucucugaucucuaccccaacccugaccucacagugugaccuguacuuccaacccugaaucuugcuugaccucaaggugugaccuuugauccccccaagugugaccuccuacccccugccccuaaccuuggguccugaccucagaugugaccuuugaccucuuaccuguucccuucaauucccucucauuccucacccccaggugggaacccccagccagcagccccuuucccuucacugaaguucugcuuccugacccuuucucaguguacgaacccaggccuugaccuucuucccacaucuuuauuuuuauuuguuuguuuguuuauuuauuuauuuugaggcagcgucuugcucuguugccuaggcuggagugcaguggcaugaucauagcucacugcagccucgagcuccugggcucaagggauccucccaccucagccucuccaguagcugguacuacaggcagucaccaccacacccagcuaauuuuguuuuuuuuuuuuuuuaagagauggggucacacuauguuguccagguugaucucaaacuccuggccucaauugauccucccgccuuggccucccaaaguguugggaucacaggaaccaucacucccggccuccuucccaaaucuuuuuuuuuuuuuuggaggcggagucuugcuuugucacccaggcuggagugcaguggugcaauuuuagcucaccgcaagcuccaccucccagguucaagugauucucccaccucagccucccaagcugggacuaaaggcacacgugccaccaugcccggcuaauuuuuguaucucugguagaggcgggguuucgccauguuggcugggcuggucuugaacuccugaccucaggugauuugcccaccuuagccccacaaagugcugggauuacaggcgugagccacugcaccuggcucuuccaaaaucuugacucuggaccucugaucuucaaauccaaagggacccacucaaccucucuucucuagccccucccucugcauggcgugccuuccccaccucuccuuccaaccugacagacuucucucccuccuuugccuugucuacagcuccggcagcuguugaagaggagccguguggcgccgccaggccuguccucuuaggacucaaacccagacccuggacugauuuuccaguccccaccguccugcgggacagccagcguaugcuaauguugcaaacccaugauaauguauguggaauauccugccauugggguuuuacauuaaaaccccagaauggcugcagaggggugaacaggccccaauauuuggggugcugugauaccccucuucuacccacaaggagcccucuugaugauuucugugaaaucgaggccccuugauuguuucugugaaacacccugcaccccuaguccuuuccccacugagaucuuucggguucucuccccuaacucagcucuucguucccagaaacccagauguaaucccccuacguggugcuuggggcaucccgauaccaucucaguaaaucuccuacaauggccuccucacccuccccgggacccacacccuucagguccucacccugagacaggagggacccucugagaucagggacccuuaggucucacugcucucugauucagagcucagcugggcccccaguuccagaccccagcauucccggucacucccucccuaaucugagcaucacucaagcucuuuauuaaacucaauuug

SEQ ID NO: 15106 - RNA, 11276 nt, Homo sapiens
cuggccugguagggaagaggacuuuauugggauguuaguagggaaacaugagagggugaauuccagggaauagacacuaggaccaagguggcggucaccuuaaagagccauaaauaaacuuaaaaaauaaauuaaggugaggaggugccacguggggaggcugcugggacuaucugggaauucuuagggauggaauuuuggaauuggaaaggggaaauaagaauuuccagccgucucacaaaagggugugaaaugaucacuucaagacucccugcugcccuaggcugggaguugggguucuggggcuccaggaagaggggaggucugggcucggcugaaggggugaagggggccgggucagggucguuccuccaggaagcgguaagugggguucucauagccgugccgcugcaguucgcggagcugcugcuccuccagggucagcaugggguccaccugcaacgagcaggggagggaaaggacaguguggugcgggggcgggacugcccgcaagucucucaggccgcccacacccgggcucaggaacucuucccacaccuccaccacgccaugguucucaccuccaccacgccauggcugauagccccguagggcuucuuccugcgcaggagcagcauggagaggacgaugagggagccuccgcccgcucccaugaucagcagacccgacacagccucacgggacaccccugucccagcuggugccugcagggagaggagauggggcagagggcuucuuugaggguccuguguggcuuugggaaucacagccuggccgcugaccucuggucucuuccccuagguacccggcuguuccuccucuuaccagcucaucccucugaaucuccgaugaguggaaagggaaaccccuuggaacagacgcauucaccugggggagcaggaggugucaggaacccagaagccuggcacuggcuucuuccuacccaagggcccaagagagcgucccccagcccucucauuuucuaggaucucaauuccacguccucagcucccucuucccucaggacaaggaauccaagcccccagcaucuccucccucguacccagccauauaggccccgaucuuguuccccuuagggagcccacaguucugacuaacuuaccuuucgcucauacuguuccagcggguucaucuucucuuucucaggggaugcagcaucuuguucuguggacccuacccccaagucugaucucauucuuuuuuuuuuucuuuagacagagucucacucugucacccaggcuggagugcaguggcaugaucucagcucacugcagccucaacuuccugggcuccagugauccuucuacgucagccuccugagcagcugggacuacagacaugccccaccacacccagguaauuuuuaaauuauuuguagguacagggucucauuauguugcccaggcuggucuagaacucguggccucaagggauccuccugccucagccucugaaagugcuaggauuacgggugugagucaccagcgccuggcccuaucucauucuuuaggguccagaggagggggcuggaaaguacaucaaacucuaccccagggggucugagguucccaauggauggacccuguuuccuucuggguucagggauucagugggauuuggaggcugggguuaacugugagacacucaccuuuuggaagggucaugggggugucugcuggcagccagaggaagcaagggaguggaacagugaagagaggaggguaucagcaaagaaagguggagaaacauccuuccagggacuaagaaggaggauuggggauccuacagaggccccugcaaccuuagacguuccuccucauccucucccagucacugugguggugaagacacccucagacucuaggggauuacaaauuaggcuggggccuguucccuaaugucuggggucaucuauaugugggcucacucaccauccuuggaaucuggaggcugcagcccacccuuguccucgcugcugcccccaggggcaggggcuuccaauucacugggacccagguguucagaguggaggaguuccucugagggggacaugcagaaagguggcugagguagugagcauaggggugaguggagggcacccuaccaguagagcaagugggagaucaugcagacagcagagucagccccaagugugggguagccagaagugugaucugagaaagugggaagcuggauggaggcacugcuggcaggaaggauggaggcugaaguuucaagauuauguuuuuuuuuuguuuuuuuuuuuuugagacagagucucacucuuguugcccagcuggagugcaaugaugcgaucucagcucacugcaaccuccaccucccggguucaagcaauucucuugccucagccuccuaaguagcugggauuacaggcaagcgacaucaugcccggcugauuuuuguauuuuuaguaaagacgggguuucaccauguuggccaggcuggucucgaacuccugaccucaagugauccacccgccucggccuccuaaagugcugggauuauaggcgugagccaccgcgccucaagaugauagcuuucuuaaauacuaggagaaucaggguuaugugugagauauccaggagaaagacacaauagaugugggggcugcaauaggucacacuuuccgguaugcauauagguuccuucccuugaaucuggacugaauuuguaacuugcuuuaacaaauagaaugugggcccaagccuuaagaccuagcaacuuccacugugaugucuuagagagcauaaaccaccauguagggaaucuagcuacccugcugaugagaccacauggagaagcuccacggagaagagaggccuugcgcuuccuuggagagagagaaagguccauuugugcuagacucccagccccuagaugaucugcuagcuaaauacagcugcaugcuugaccacuggcaagaccacugaaagaaccacucugcugagcgcagaccggauggcagaaucaugaacaaagaaaaaucauuguugauuuucacugcuaaggucugggcuguuuguuauagaggaauaaaugaaauugggggggcccaacauuuaggagucaagaucugcccucagagaucuguaaugggagccaggguaauagacacucacggauuuggggccgcagcuccugagccagguggggguucuggucaagcaggcccaggcucugauucacccucuccucaaucacuugaagguggguaugcaccugugggugaguggacaugaaggaugaacugcgcaaugcaggcuggagaugaggaaacugaagcaguaugaaggaggaauucaauagcgacugaggaaaagcggcacaugcaauggacaggaugugugguacaaggguuaggaacugggccauaggagaaggaaauugaagaauaaaguccaaggaacagaaagugggguuugaggggauuccagagacagagauugaggauuggagggucauauagaaaugacaugguucaaggcaagauuuggaguucaagagcacagaauggaguuucauagacaggaagaaaacauccaggaaaggggaauucaaauuugagcgcacagaacagggguuccagggaaaacaagugaaguuauggagaaaggagguugagggacaggaagaggguucaaggaacaagaaggagauucucgaccgggcgcgguggcucaugccuguaaucccagcacuuugggaggccgagguaggcagaucaccugaggucaggaguuugagacuagccugggcaacauggcaaaacccugucucugcuaaaaauauuagauuggugcaaguuauugggguuucuggccgggcaugguggcucacgccuguaaucccagcacuuugggaggccgaggugggcagaucaccugaggucaggaguucgagaccagccugggcaacauggcaaaacccugucucugcuaaaaauauuagauuggugcaaaaguuauugggguuucuggcugggcaugguggcucacgccuguaaucccagcacuuugggaggccaaggcaggcagaucaccugaggucaggaguucaagaccagccuggccaacaugcugaaacccgugucuaccaaaaauacaaaaauuagcuggggccgggcgugguggcucacaccuguaauccgaguacuuuaggaggccaaggguggaucaccugaggucgaguucaagaccagccugaccaguauggugaaacccugucucuacuaaaaauacaaaaaucagccagauguggugacacccgccuguagucccagcuacucaggaggcugaggcaggagaauagcuugaacccaguaggcggagguugcagugagcccagaucaugucacugcacuccagccugggaaacagagcgagacucugucaaaaaaaaaaaaaaaaauuagcccagugugguggcaggcuccuguaaucccagcuacucgagaggcugaggcaggagaauugcuugaacccaggagguggaaguugcaaugagccaagaucgcacacugcucuccugccugggcgacagagcaagaaccugucucaaaaaaaaaaaaaaaaaaaagacgauucugggaaaggcagugaaaauccaagggacagaacauaggaucgacggcggggggaguaggaauccaagggccaagaagcaggggucaaagacacagcaugugaggguccauguuucagggucaggaagcugagcugagagacugggaaggggcagagaagcgguguucaggggauaggaagggguccaagagacagaaagagggucuaagggacaagagaagagccugaggcgcgggcgucugaggaauagcggcgcauuugggagcuggaaggaugugagcaccuggaagcgcaucugcugugccuucucgggauccacggcggccacaugcugguaguggcgcagcgugugccucuguuccuucugcuccgcacgcagguagcgccgcagggccaacaggacacgcuccgccuguggaagggacacaggaugcccaagcccgcccugacccuucucacccucugcucucugcccccacgguccccgcaccugaggcggaucugccugcagggcugccaggaagcccuccaaggcagcccggcgcuggucguugauaagggcgaugacgcggguggcguggguuuccaccaggcgcugucgcucaccagacaccugcuccuccagagucugcagaauggacuggaagugcuggggagcgggugggcacagggucaggagaggagaagaugggucaaagccuggucaaagagagccuggaaaggcagggcuacaugggguuggggggcguuccagggguccaggccugggcagaaccaaagguuauggacuggaaggggugggcuacagggccaggcagaguggaggugggacuaggcccacugggagccaaugugaggauguaaacuguaagauugagugggagcaaucugggagcagaacugaccaauguuaaggugaaagggacaaagccuugcagggcuccuggccugggcagggucaaacuggagacaggcuguguauaaaugacacgauaggggugggacaaagagcuggaaugggggcuaacaugaguggggucuccaugggguaggucagguuaauaaaggugagauuggcccagcagagccagaaucagggggcggggccugauagagacauaaaugcaucaaagagagaccaagaaggcccuggcugcaucugcagaggcccuggcuugggacaggacuccagagccagcccugagaggcaagucaagucuguagauggggccgaauauggccaaucuggggaggagagcagugucaggucagaugacggcuaagaggggcagagcugcauguaggcauggggccaggaaaggcugagauaggugggaagggguggaacuggaugggcagggcacagccagagccaggugaaacugagugugcuccaggugguggacaggcaugaguaggacccacuggggcuguccuaccucauucagggccugucugucggcuuuaggcagguucuuggacugguugucugccauggcccauucacgcaucaccugcauagggaggggagcuucaggaucccagaauccacccugauccaccuggcaagucccccaaccccucuuuaagauuuuagaagccccauggcugggcgcaguggcucaugccuguaaucccagcacuuugggaggccgagguggguggaucacaaggucaggagauugaggccauccuggcuaacauggugaaacccugucucuacugaaaacagaaaaaauuaucugggcgcugugguggguaccaguagucccagcuacucgggaggcugaggcaggagaauggcgugaacccaggagguggagcuugcagugagugggagaucacgucacugcacucuagccugggcaacagagcgaaacucugucucaaaaaaaaaaaaaaaaaaagauuuaaaggccccagaucccuuaagucucgcuggcuccuggguucccaagagggaagauccagaaggaguuuaaagugaaagagaggccaggcgugguggcucaugccuguaaucccagcacuuugggaggccgaggcggguggaucuccucccgccgggaguucaagaccauccuggccaacauggugaaacccugucucuacuaaaaauacaaaaauuagccgggcgugguggugggugccuguaaucccagcuacucaggagacugaggaaggggaaucgcuggagcccgggaggcagagguugcagugggccgagaucgcaccauugcacuccagccuggguguuaagagcgaaacuccgucacaacaacaacaacaaaagaaaaaaaaaaaaaccaauaaagugaaagaguaccauagaccagaguuuccagagaaccugguagcgucucagugggauucuagaagggccauggaucucuggccaucuuagggggugguguugagagcucaaggucaaaggggcuuagggagccuuuggagguaguaucaauguguccuggaggaauuuccugguauuuagggagcucuguacuguaggggguccuggggcccccaguauuaucaccucauuaaucuggcgcauccuacgcuccuccagguccaucuuggcccucaggaaccccucgugcucacugauuuccccaggcaugccaaaguaaauauccacaccgucugugggccucggggugggagugacugcaagaccagggaucaggaggucagucugcagcccaccuccaggucgccuuuucuaccuagagaaccacauuuccuagagugcacuggagaccaucaugcacccaguuuagccaccgcugcugccuggcauuaugggagauguaguucuggacugggccuguucuugcaaagcuuaggaauccauuacaccaucuuccaagcuuuccugaaaugauccucaagaccuacccaauggccccucuacucccaaguacccccaaaccacccccucccuuggcagguuagcccuucuacuucuauuuuauccaaagauacucucgucuuuucuccucaguugggccuuuccccuauaggccccucccaaagacaccccccagcaagacucccccagaucuuucucccucuaugguggagaggccccagggguucagagacugccucaccuuugccgaccacugcaaguguaugggagcuugggggugggaccguuuccucuuccucuucagccugcggaggcuccacgaaguaaucaucuacuggcugugggaaggauuccuccucuuccucguccucagcccccucuacucugcuccccgggggccaggaccggguggaggggucacugagggagcaggagaggacccaggcaguaagaacccaggccugggcucccaggcuuccauccccugccucaggaaccuugagaugggcauggaggguucccucccacucacccaacugcugucccagaugggucgggggucccuggagggggacagcacacauacuccacaccacggaaccgauccgagccacaggguaagagcaugcccgagccgugcaggaugaggcccugggagcugcaggccuguaggaagagugggcccagaugccaggauugugggaugggaggggguagauggggaacugggcugccaggguuggggguugaugaggcugggagccuggauuccugcuucuagaggaagggguugggggaugaaauucuuagaucccaagugcgaagaggaugcugguggcccagacuccucgguucugguggcggaggguguuagaggucccaguuccuggguugugggggcuggggacgggugggccaacguccugaccuccugugccuccugaugccuccggguugaacucucacauugguccaugcgcuccuggugcaagaaccggcagccuucaggcaccagcagggccucacucacaaauucaccagcuggggaagcacgggacaccagggugagauccuccuauagccaccaaccccacccuccucagaauccagauauuuuauccucagaggcuucucugccccacuuaggacacaagcacccagccccuuaauguaggccugagagaggggcucagaaccuugccccucagaaacucccaccucaguuccccucuccccgccugggacucacgcaggcagcggaagggcacaaccugguggugggggugggcgcagcugccgcuccgggaacccccgcaccagcgcuccauggggauggccugcguagccugcuccacacgugcaaucugcagcuccggguacaucuggggggaucagaugggggcaaucagcccacugccccgccccugccagccaccccucuccaguagucaggucccuuuucucuuucuuucucccucuuucuuucuuucuuugagacggagauuugcucuugucgcccaggcuggaguggaaugguacaaucucggcucacugcaaccuccuccucccagguucaagcgauucuccugucucagccuccugaguagcugggauuacaggcacgcaccaccaugccaggcuaauuuuuguauuuuuaguagagacggaguuucgccguguuggccaggcuggucucgaacuucugaccucaggugauccgccugccucggccuccccaagugcugcgauuacaggcgugagccaccgcgcccggccagguccguuuucaaggcucuaguauucaugaggacaucgcuucccuaggcccugcuucucccuagcaccagccuuagauauccaagcuccuugugcucauuggccacgcccacuagcaguuuucccuuaaaagucccgucaucuuuaagcccuaucucuuuuccugugcuguuucuuucugaaggucccucuaagcccaccucucuggucaccccuccccgcagucagauucgucuccccaaaggucucacccuccuuuaggccccgccuuuuccucuauuccgccucuccaaaacucucccuucccguuauaaauuugucuuuucauggccacgcccccccagcucuccgcgcucucauugggcuccaccccuuuccccaucuugcugguccuuaaggucucuuucugucuuagccccgccuauccuuucgccacuccccccuacaccucuacucuuuacaaagaccaccagauuccuaaauuccacuuccucucuggcuaucucgcggcucuccccuuuuccugacuuaguaucucaaaacagguccccugccccuagcauaguugcgccucuuuauuggccacgccccccagccuccacgccuuagaucgcgcagcacccuggaccacgccuuuuucaagucuagcuuucuaugggcggccccgccucucccguucggccccgcccaccugucugcaguacuccagcacgcgcugcgggucccggagacagcgucgagagcgcugugggucugguucccagcggccggugcgcaggucccggugaaggguuaggcgcccgcauaguccagccaccugggccgaccccggggccuggauggaaguggaaaggacagugagggcucggggggcguuggcaugaggguccccugguucuuugcucccuaggaccgagacccccagcaccagcccccucccccaagcaccgcacaccgccuccauggaggcaccguucccugggaaacagcucccguagggcgggggcgccccagcgcucccguugcuauggcgaccugggucccccgggauucuuucugccuuguugccgcggagacagacuccgcccccaccccagcgcagccgcucuggagcccgaagggguuaaaccugaaucgcggaggaggaggccagaacccaggaguucuggccccuccucccuccaucccuugcucaggcucccguugcaggaugcaaagcugacaaggccuggcuucaggggccuacaguccuggacaccagguccuugaggacuggagagcuacaucugguugggguggguggugacugaaggacuggacuccuggguccugggaggcugcaagggccuccauauggguccagagaauacaaggggucuggauuauuggaucuaaaugccucgcugcuugguggguccuauguccaggcgggaggggguuggggccgagucaccugggucuggagagggggcuggacuucugggaccaggggcucugaauagaccaguuccuaugcucgagaugggagggggcugggacgucgcaugaugggggagcuggggccuggaacccuggguucauaaaugugauugggggcgccugggggcugaccaccuggcuggaaagaccgcgcuuucugcccuggacauguccgcgccggcguccagagacccggucccgccccuucccccaucccccaggacccggcccggccucaccucggccgcgccggggcucccaccggccaggcucccgauggcgggcugcgcgcgcagaagcagcagcaauaguggcagcagcagcggcagcggcggcuggcccgggcggcgacuuagaccgcgagcagcggggcuggcgggccccaugucccggcccuugcgcccucacguccccugcacucccgcccggcccggccccagcggugacaggagcucccagcgccaccgccgccaccuccuccucccgccgcccccgggcug

SEQ ID NO: 15107 - RNA, 11276 nt, Homo sapiens
cagcccgggggcggcgggaggaggagguggcggcgguggcgcugggagcuccugucaccgcuggggccgggccgggcgggagugcaggggacgugagggcgcaagggccgggacauggggcccgccagccccgcugcucgcggucuaagucgccgcccgggccagccgccgcugccgcugcugcugccacuauugcugcugcuucugcgcgcgcagcccgccaucgggagccuggccggugggagccccggcgcggccgaggugaggccgggccggguccugggggaugggggaaggggcgggaccgggucucuggacgccggcgcggacauguccagggcagaaagcgcggucuuuccagccagguggucagcccccaggcgcccccaaucacauuuaugaacccaggguuccaggccccagcucccccaucaugcgacgucccagcccccucccaucucgagcauaggaacuggucuauucagagccccuggucccagaaguccagcccccucuccagacccaggugacucggccccaacccccucccgccuggacauaggacccaccaagcagcgaggcauuuagauccaauaauccagaccccuuguauucucuggacccauauggaggcccuugcagccucccaggacccaggaguccaguccuucagucaccacccaccccaaccagauguagcucuccaguccucaaggaccugguguccaggacuguaggccccugaagccaggccuugucagcuuugcauccugcaacgggagccugagcaagggauggagggaggaggggccagaacuccuggguucuggccuccuccuccgcgauucagguuuaaccccuucgggcuccagagcggcugcgcuggggugggggcggagucugucuccgcggcaacaaggcagaaagaaucccgggggacccaggucgccauagcaacgggagcgcuggggcgcccccgcccuacgggagcuguuucccagggaacggugccuccauggaggcggugugcggugcuugggggagggggcuggugcugggggucucgguccuagggagcaaagaaccaggggacccucaugccaacgccccccgagcccucacuguccuuuccacuuccauccaggccccggggucggcccagguggcuggacuaugcgggcgccuaacccuucaccgggaccugcgcaccggccgcugggaaccagacccacagcgcucucgacgcugucuccgggacccgcagcgcgugcuggaguacugcagacaggugggcggggccgaacgggagaggcggggccgcccauagaaagcuagacuugaaaaaggcgugguccagggugcugcgcgaucuaaggcguggaggcuggggggcguggccaauaaagaggcgcaacuaugcuaggggcaggggaccuguuuugagauacuaagucaggaaaaggggagagccgcgagauagccagagaggaaguggaauuuaggaaucugguggucuuuguaaagaguagagguguaggggggaguggcgaaaggauaggcggggcuaagacagaaagagaccuuaaggaccagcaagauggggaaagggguggagcccaaugagagcgcggagagcugggggggcguggccaugaaaagacaaauuuauaacgggaagggagaguuuuggagaggcggaauagaggaaaaggcggggccuaaaggagggugagaccuuuggggagacgaaucugacugcggggaggggugaccagagaggugggcuuagagggaccuucagaaagaaacagcacaggaaaagagauagggcuuaaagaugacgggacuuuuaagggaaaacugcuagugggcguggccaaugagcacaaggagcuuggauaucuaaggcuggugcuagggagaagcagggccuagggaagcgauguccucaugaauacuagagccuugaaaacggaccuggccgggcgcgguggcucacgccuguaaucgcagcacuuggggaggccgaggcaggcggaucaccugaggucagaaguucgagaccagccuggccaacacggcgaaacuccgucucuacuaaaaauacaaaaauuagccuggcaugguggugcgugccuguaaucccagcuacucaggaggcugagacaggagaaucgcuugaaccugggaggaggagguugcagugagccgagauuguaccauuccacuccagccugggcgacaagagcaaaucuccgucucaaagaaagaaagaaagagggagaaagaaagagaaaagggaccugacuacuggagagggguggcuggcaggggcggggcagugggcugauugcccccaucugauccccccagauguacccggagcugcagauugcacguguggagcaggcuacgcaggccauccccauggagcgcuggugcggggguucccggagcggcagcugcgcccacccccaccaccagguugugcccuuccgcugccugcgugagucccaggcggggagaggggaacugaggugggaguuucugaggggcaagguucugagccccucucucaggccuacauuaaggggcugggugcuuguguccuaaguggggcagagaagccucugaggauaaaauaucuggauucugaggagggugggguugguggcuauaggaggaucucacccuggugucccgugcuuccccagcuggugaauuugugagugaggcccugcuggugccugaaggcugccgguucuugcaccaggagcgcauggaccaaugugagaguucaacccggaggcaucaggaggcacaggaggucaggacguuggcccacccguccccagcccccacaacccaggaacugggaccucuaacacccuccgccaccagaaccgaggagucugggccaccagcauccucuucgcacuugggaucuaagaauuucaucccccaaccccuuccucuagaagcaggaauccaggcucccagccucaucaacccccaacccuggcagcccaguuccccaucuacccccucccaucccacaauccuggcaucugggcccacucuuccuacaggccugcagcucccagggccucauccugcacggcucgggcaugcucuuacccuguggcucggaucgguuccgugguguggaguaugugugcugucccccuccagggacccccgacccaucugggacagcaguugggugagugggagggaacccuccaugcccaucucaagguuccugaggcaggggauggaagccugggagcccaggccuggguucuuacugccuggguccucuccugcucccucagugaccccuccacccgguccuggcccccggggagcagaguagagggggcugaggacgaggaagaggaggaauccuucccacagccaguagaugauuacuucguggagccuccgcaggcugaagaggaagaggaaacggucccacccccaagcucccauacacuugcaguggucggcaaaggugaggcagucucugaaccccuggggccucuccaccauagagggagaaagaucugggggagucuugcuggggggugucuuugggaggggccuauaggggaaaggcccaacugaggagaaaagacgagaguaucuuuggauaaaauagaaguagaagggcuaaccugccaagggagggggugguuuggggguacuugggaguagaggggccauuggguaggucuugaggaucauuucaggaaagcuuggaagaugguguaauggauuccuaagcuuugcaagaacaggcccaguccagaacuacaucucccauaaugccaggcagcagcgguggcuaaacugggugcaugauggucuccagugcacucuaggaaaugugguucucuagguagaaaaggcgaccuggaggugggcugcagacugaccuccugaucccuggucuugcagucacucccaccccgaggcccacagacgguguggauauuuacuuuggcaugccuggggaaaucagugagcacgagggguuccugagggccaagauggaccuggaggagcguaggaugcgccagauuaaugaggugauaauacugggggccccaggacccccuacaguacagagcucccuaaauaccaggaaauuccuccaggacacauugauacuaccuccaaaggcucccuaagccccuuugaccuugagcucucaacaccacccccuaagauggccagagauccauggcccuucuagaaucccacugagacgcuaccagguucucuggaaacucuggucuaugguacucuuucacuuuauugguuuuuuuuuuuuucuuuuguuguuguuguugugacggaguuucgcucuuaacacccaggcuggagugcaauggugcgaucucggcccacugcaaccucugccucccgggcuccagcgauuccccuuccucagucuccugaguagcugggauuacaggcacccaccaccacgcccggcuaauuuuuguauuuuuaguagagacaggguuucaccauguuggccaggauggucuugaacucccggcgggaggagauccacccgccucggccucccaaagugcugggauuacaggcaugagccaccacgccuggccucucuuucacuuuaaacuccuucuggaucuucccucuugggaacccaggagccagcgagacuuaagggaucuggggccuuuaaaucuuuuuuuuuuuuuuuuuuugagacagaguuucgcucuguugcccaggcuagagugcagugacgugaucucccacucacugcaagcuccaccuccuggguucacgccauucuccugccucagccucccgaguagcugggacuacugguacccaccacagcgcccagauaauuuuuucuguuuucaguagagacaggguuucaccauguuagccaggauggccucaaucuccugaccuugugauccacccaccucggccucccaaagugcugggauuacaggcaugagccacugcgcccagccauggggcuucuaaaaucuuaaagagggguugggggacuugccagguggaucaggguggauucugggauccugaagcuccccucccuaugcaggugaugcgugaaugggccauggcagacaaccaguccaagaaccugccuaaagccgacagacaggcccugaaugagguaggacagccccaguggguccuacucaugccuguccaccaccuggagcacacucaguuucaccuggcucuggcugugcccugcccauccaguuccaccccuucccaccuaucucagccuuuccuggccccaugccuacaugcagcucugccccucuuagccgucaucugaccugacacugcucuccuccccagauuggccauauucggccccaucuacagacuugacuugccucucagggcuggcucuggaguccugucccaagccagggccucugcagaugcagccagggccuucuuggucucucuuugaugcauuuaugucucuaucaggccccgcccccugauucuggcucugcugggccaaucucaccuuuauuaaccugaccuaccccauggagaccccacucauguuagcccccauuccagcucuuugucccaccccuaucgugucauuuauacacagccugucuccaguuugacccugcccaggccaggagcccugcaaggcuuugucccuuucaccuuaacauuggucaguucugcucccagauugcucccacucaaucuuacaguuuacauccucacauuggcucccagugggccuagucccaccuccacucugccuggcccuguagcccaccccuuccaguccauaaccuuugguucugcccaggccuggaccccuggaacgccccccaaccccauguagcccugccuuuccaggcucucuuugaccaggcuuugacccaucuucuccucuccugacccugugcccacccgcuccccagcacuuccaguccauucugcagacucuggaggagcaggugucuggugagcgacagcgccugguggaaacccacgccacccgcgucaucgcccuuaucaacgaccagcgccgggcugccuuggagggcuuccuggcagcccugcaggcagauccgccucaggugcggggaccgugggggcagagagcagagggugagaagggucagggcgggcuugggcauccugugucccuuccacaggcggagcguguccuguuggcccugcggcgcuaccugcgugcggagcagaaggaacagaggcacacgcugcgccacuaccagcauguggccgccguggaucccgagaaggcacagcagaugcgcuuccaggugcucacauccuuccagcucccaaaugcgccgcuauuccucagacgcccgcgccucaggcucuucucuugucccuuagacccucuuucugucucuuggaccccuuccuauccccugaacaccgcuucucugccccuucccagucucucagcucagcuuccugacccugaaacauggacccucacaugcugugucuuugaccccugcuucuuggcccuuggauuccuacuccccccgccgucgauccuauguucugucccuuggauuuucacugccuuucccagaaucgucuuuuuuuuuuuuuuuuuuuugagacagguucuugcucugucgcccaggcaggagagcagugugcgaucuuggcucauugcaacuuccaccuccuggguucaagcaauucuccugccucagccucucgaguagcugggauuacaggagccugccaccacacugggcuaauuuuuuuuuuuuuuuuugacagagucucgcucuguuucccaggcuggagugcagugacaugaucugggcucacugcaaccuccgccuacuggguucaagcuauucuccugccucagccuccugaguagcugggacuacaggcgggugucaccacaucuggcugauuuuuguauuuuuaguagagacaggguuucaccauacuggucaggcuggucuugaacucgaccucaggugauccacccuuggccuccuaaaguacucggauuacaggugugagccaccacgcccggccccagcuaauuuuuguauuuuugguagacacggguuucagcauguuggccaggcuggucuugaacuccugaccucaggugaucugccugccuuggccucccaaagugcugggauuacaggcgugagccaccaugcccagccagaaaccccaauaacuuuugcaccaaucuaauauuuuuagcagagacaggguuuugccauguugcccaggcuggucucgaacuccugaccucaggugaucugcccaccucggccucccaaagugcugggauuacaggcgugagccaccaugcccggccagaaaccccaauaacuugcaccaaucuaauauuuuuagcagagacaggguuuugccauguugcccaggcuagucucaaacuccugaccucaggugaucugccuaccucggccucccaaagugcugggauuacaggcaugagccaccgcgcccggucgagaaucuccuucuuguuccuugaacccucuuccugucccucaaccuccuuucuccauaacuucacuuguuuucccuggaaccccuguucugugcgcucaaauuugaauuccccuuuccuggauguuuucuuccugucuaugaaacuccauucugugcucuugaacuccaaaucuugccuugaaccaugucauuucuauaugacccuccaauccucaaucucugucucuggaauccccucaaaccccacuuucuguuccuuggacuuuauucuucaauuuccuucuccuauggcccaguuccuaacccuuguaccacacauccuguccauugcaugugccgcuuuuccucagucgcuauugaauuccuccuucauacugcuucaguuuccucaucuccagccugcauugcgcaguucauccuucauguccacucacccacaggugcauacccaccuucaagugauugaggagagggugaaucagagccugggccugcuugaccagaacccccaccuggcucaggagcugcggccccaaauccgugagugucuauuacccuggcucccauuacagaucucugagggcagaucuugacuccuaaauguugggcccccccaauuucauuuauuccucuauaacaaacagcccagaccuuagcagugaaaaucaacaaugauuuuucuuuguucaugauucugccauccggucugcgcucagcagagugguucuuucaguggucuugccaguggucaagcaugcagcuguauuuagcuagcagaucaucuaggggcugggagucuagcacaaauggaccuuucucucucuccaaggaagcgcaaggccucucuucuccguggagcuucuccauguggucucaucagcaggguagcuagauucccuacauggugguuuaugcucucuaagacaucacaguggaaguugcuaggucuuaaggcuugggcccacauucuauuuguuaaagcaaguuacaaauucaguccagauucaagggaaggaaccuauaugcauaccggaaagugugaccuauugcagcccccacaucuauugugucuuucuccuggauaucucacacauaacccugauucuccuaguauuuaagaaagcuaucaucuugaggcgcgguggcucacgccuauaaucccagcacuuuaggaggccgaggcggguggaucacuugaggucaggaguucgagaccagccuggccaacauggugaaaccccgucuuuacuaaaaauacaaaaaucagccgggcaugaugucgcuugccuguaaucccagcuacuuaggaggcugaggcaagagaauugcuugaacccgggagguggagguugcagugagcugagaucgcaucauugcacuccagcugggcaacaagagugagacucugucucaaaaaaaaaaaaacaaaaaaaaaacauaaucuugaaacuucagccuccauccuuccugccagcagugccuccauccagcuucccacuuucucagaucacacuucuggcuaccccacacuuggggcugacucugcugucugcaugaucucccacuugcucuacugguagggugcccuccacucaccccuaugcucacuaccucagccaccuuucugcaugucccccucagaggaacuccuccacucugaacaccugggucccagugaauuggaagccccugccccugggggcagcagcgaggacaagggugggcugcagccuccagauuccaaggauggugagugagcccacauauagaugaccccagacauuagggaacaggccccagccuaauuuguaauccccuagagucugagggugucuucaccaccacagugacugggagaggaugaggaggaacgucuaagguugcaggggccucuguaggauccccaauccuccuucuuagucccuggaaggauguuucuccaccuuucuuugcugauacccuccucucuucacuguuccacucccuugcuuccucuggcugccagcagacacccccaugacccuuccaaaaggugagugucucacaguuaaccccagccuccaaaucccacugaaucccugaacccagaaggaaacaggguccauccauugggaaccucagacccccugggguagaguuugauguacuuuccagcccccuccucuggacccuaaagaaugagauagggccaggcgcuggugacucacacccguaauccuagcacuuucagaggcugaggcaggaggaucccuugaggccacgaguucuagaccagccugggcaacauaaugagacccuguaccuacaaauaauuuaaaaauuaccugggugugguggggcaugucuguagucccagcugcucaggaggcugacguagaaggaucacuggagcccaggaaguugaggcugcagugagcugagaucaugccacugcacuccagccugggugacagagugagacucugucuaaagaaaaaaaaaaagaaugagaucagacuuggggguaggguccacagaacaagaugcugcauccccugagaaagagaagaugaacccgcuggaacaguaugagcgaaagguaaguuagucagaacugugggcucccuaaggggaacaagaucggggccuauauggcuggguacgagggaggagaugcugggggcuuggauuccuuguccugagggaagagggagcugaggacguggaauugagauccuagaaaaugagagggcugggggacgcucucuugggcccuuggguaggaagaagccagugccaggcuucuggguuccugacaccuccugcucccccaggugaaugcgucuguuccaagggguuucccuuuccacucaucggagauucagagggaugagcugguaagaggaggaacagccggguaccuaggggaagagaccagaggucagcggccaggcugugauucccaaagccacacaggacccucaaagaagcccucugccccaucuccucucccugcaggcaccagcugggacaggggugucccgugaggcugugucgggucugcugaucaugggagcgggcggaggcucccucaucguccucuccaugcugcuccugcgcaggaagaagcccuacggggcuaucagccauggcgugguggaggugagaaccauggcgugguggaggugugggaagaguuccugagcccgggugugggcggccugagagacuugcgggcagucccgcccccgcaccacacuguccuuucccuccccugcucguugcagguggaccccaugcugacccuggaggagcagcagcuccgcgaacugcagcggcacggcuaugagaaccccacuuaccgcuuccuggaggaacgacccugacccggcccccuucaccccuucagccgagcccagaccuccccucuuccuggagccccagaaccccaacucccagccuagggcagcagggagucuugaagugaucauuucacacccuuuugugagacggcuggaaauucuuauuuccccuuuccaauuccaaaauuccaucccuaagaauucccagauagucccagcagccuccccacguggcaccuccucaccuuaauuuauuuuuuaaguuuauuuauggcucuuuaaggugaccgccaccuugguccuagugucuauucccuggaauucacccucucauguuucccuacuaacaucccaauaaaguccucuucccuaccaggccag

SEQ ID NO: 15108 - RNA, 3815 nt, Homo sapiens
ggccaacggcuguggagcauguugggaauuguaguuccagugcgguggagcccuagcgacuccagaccguauccagcccguccuaggcugugcugcucucgccguugguccuccccagccuccuguagucccuggaagagcgaucggccucaccugcgguccaucccgcggcucccuccgcgcuuccggccgcucugcuccuucacccaacaggccccgcgcgcaucuccgucgcuuagcaacgcccuaucagccccgccccucucugugcccgcgccggaggcgagcggccuccaaggcgaccaaugaaagagaggaaacagaaguacccggagggagguguuucaggauuggcugggacgacugccugcccgacagggcguguuugauuggagaaccugccgaguguagcaguaauuggcaagaccgugcaccaaugggaaggaucugaggcugggcuugcgguuaggaggugaucuaaaguacccucgcuuaaaagucccgcuuuuuaagcgccuucuugcugcagaaguccugucccgaccccggucuaacuaccauucuuucuguugcaggggcaguggggcggguuggggggggggcgcgcucugcccucucucuaaccgcuauuccuccaucaguugggccaaucaguccgucccaacggucaucuaacuucuuucuugcugcaggagcagcugguugcaucaguugccaggucugggcuccuggccgagguagcgggaucaaaaugagcuauuuccagccccagcgcgcggcccccggggggccagccugaacuguucaugcucgcgcccccuggccucugcgcaccagaggcugagucagaggcacagaauuaggcccggccugccgggggacugggcccaaggucuggcugaggauaaggguagggagggccuguucuauguccuccugacauccuggcggggcuaccgcauucuccaggaaucugcuccuaaagaccuccaucugcgucauccucagagcugccaggggggaggcaguggauuaaagggacuggaaacucuuccgugggccucuuggguccugggccccaaucaccacgcugugcuccccacacccgcaaggcucccccuccucagccuuaguuuccucuucuggaaauuggggaaucuucaugucaccuucuugacagcauuugccaggcauccagcaggcgcuuaauaaauggccaagucauuguuuggguuucuaaauaaggcucuccuaauggccgggucuggccacggucccagugucccugggcagcccuccgaggggccggcacagggcgcacuauaaaugagcggcugcgcacgcaggggcacugcaacgcggaggagcaggauggagaucccugugccugugcagccgucuuggcugcgccgcgccucggccccguugcccggacuuucggcgcccggacgccucuuugaccagcgcuucggcgaggggcugcuggaggccgagcuggcugcgcucugccccaccacgcucgcccccuacuaccugcgcgcacccagcguggcgcugcccgucgcccaggugccaggccuggggaggggugaacucgaccacuuccauugccaggggucuggggcagccuggggugggaacaugugagagaauguucguuggccuugggcgggguggagaguccgcagcuccgaagggcuuccggagucaaugggaaucugaggcccgcacacugcagcgggugggagguccccgucgcucuuagguggggggcgggguggggggcucucagcucuccagagaauggaaggccugggucacucuaaggggagucuugcuuacucugaaggaggcuggugauccgggaaaucuggggaaaaggaggcgggcagugacuccugaggggaaggaauguucuuagucucggggaagaguugagagacugugugcgguggcccgauaucuccagaagaggaggggagagggcccugcgacuugaggaaggguucccggccacucugaagugggggaaggcuaccaguagcugccgaggucccgugacucgagugggagaguaggcagaggacccuggagacggggaaaggggcaucuuggcgaguuuggcggggcuggcggagaagggacccggggcucugaggagggagcuggggaaucagugcccuggggggcacgaugacuucggauucgcugacaccgggggagggcagagguuccugaccuugcaggggaagggagccucaucacugcgggggagagggcaaucccagauauuacagggggagggcguaucccuguuguucagggugaagagguccugggugacucccaguaggagagcugacugcucaacuccggaggccagagugagccgcggcacggaaccgacggggguggggucucccuggguggguccuggagccuggcccagcccaaugacagucccgcccgcgcccgcugcgcucaggugccgacggaccccggccacuuuucggugcugcuagacgugaagcacuucucgccggaggaaauugcugucaagguggugggcgaacacguggaggugcacgcgcgccacgaggagcgcccggugagccgcggcguggggcggggcuggagcggguacgcucgccgccgggccggaggggcggggccgcucaagccucccuccccuccaggaugagcacggauucgucgcgcgcgaguuccaccgucgcuaccgccugccgccuggcguggauccggcugccgugacguccgcgcugucccccgagggcguccuguccauccaggccgcaccagcgucggcccaggccccaccgccagccgcagccaaguaggagggggcugggccgcgcccgcaccccgggagccuccucaggcucccucuauuaaagccgaucugacuccgcccagccagaugucccgagugcgccaaggacuguccucucacccacuccuggauucugcccugaccuccauccuggacacugccuugauaacauagacccuuccacugacacccucgcucucacacccccuccagcuuuccgaccccacaccgacaacuccccggcuuccagacccuaccagcacuacccuaacccucagccgacagucucagccccaccgacccacuuucuuggcauauagccccacuuaagaccccuccucuacuuccuucugaguccucuacaaagacauccggguacuacauuuccaucccuucccuauuuugacaccaaauuaugguguagacagcccucccccaaccccaggccagucaggcacaauccccccaccccccaaacguccuggacugcacagaccucccacuccagaccauccaggccugguucccaagacccgauccuuccccugcaaccagacagucuacaacugcccccuccagcccauuuucugccgugaaaccccagccagccacaccagacucuggaacccuuuuucgacugccccaacucuuggacaccaggccaacuagaacacccaacaccaaacuguacagacucucccaccccaaccuccccagacucugcacggauguccuaggcccccuccccaacucuaaccagaccccaucccccuaagucccuuugucuugacccccaagucuucaaccagauauccucggcaacccaccucccacccuccuccucuucuccuucaagacccaacugagcacccgcucugauuccccacagccuuucucccugccaccacucccuuagucuuucccaggcuuacucucccaauaaaugugcuagagcucugccaac

SEQ ID NO: 15109 - RNA, 3815 nt, Homo sapiens
guuggcagagcucuagcacauuuauugggagaguaagccugggaaagacuaagggagugguggcagggagaaaggcuguggggaaucagagcgggugcucaguugggucuugaaggagaagaggaggagggugggagguggguugccgaggauaucugguugaagacuugggggucaagacaaagggacuuagggggauggggucugguuagaguuggggagggggccuaggacauccgugcagagucuggggagguuggggugggagagucuguacaguuugguguuggguguucuaguuggccugguguccaagaguuggggcagucgaaaaaggguuccagagucugguguggcuggcugggguuucacggcagaaaaugggcuggagggggcaguuguagacugucugguugcaggggaaggaucgggucuugggaaccaggccuggauggucuggagugggaggucugugcaguccaggacguuugggggguggggggauugugccugacuggccugggguugggggagggcugucuacaccauaauuuggugucaaaauagggaagggauggaaauguaguacccggaugucuuuguagaggacucagaaggaaguagaggaggggucuuaaguggggcuauaugccaagaaagugggucgguggggcugagacugucggcugaggguuaggguagugcugguagggucuggaagccggggaguugucgguguggggucggaaagcuggagggggugugagagcgagggugucaguggaagggucuauguuaucaaggcaguguccaggauggaggucagggcagaauccaggagugggugagaggacaguccuuggcgcacucgggacaucuggcugggcggagucagaucggcuuuaauagagggagccugaggaggcucccggggugcgggcgcggcccagcccccuccuacuuggcugcggcuggcgguggggccugggccgacgcuggugcggccuggauggacaggacgcccucgggggacagcgcggacgucacggcagccggauccacgccaggcggcaggcgguagcgacgguggaacucgcgcgcgacgaauccgugcucauccuggaggggagggaggcuugagcggccccgccccuccggcccggcggcgagcguacccgcuccagccccgccccacgccgcggcucaccgggcgcuccucguggcgcgcgugcaccuccacguguucgcccaccaccuugacagcaauuuccuccggcgagaagugcuucacgucuagcagcaccgaaaaguggccgggguccgucggcaccugagcgcagcgggcgcgggcgggacugucauugggcugggccaggcuccaggacccacccagggagaccccacccccgucgguuccgugccgcggcucacucuggccuccggaguugagcagucagcucuccuacugggagucacccaggaccucuucacccugaacaacagggauacgcccucccccuguaauaucugggauugcccucucccccgcagugaugaggcucccuuccccugcaaggucaggaaccucugcccucccccggugucagcgaauccgaagucaucgugccccccagggcacugauuccccagcucccuccucagagccccgggucccuucuccgccagccccgccaaacucgccaagaugccccuuuccccgucuccaggguccucugccuacucucccacucgagucacgggaccucggcagcuacugguagccuucccccacuucagaguggccgggaacccuuccucaagucgcagggcccucuccccuccucuucuggagauaucgggccaccgcacacagucucucaacucuuccccgagacuaagaacauuccuuccccucaggagucacugcccgccuccuuuuccccagauuucccggaucaccagccuccuucagaguaagcaagacuccccuuagagugacccaggccuuccauucucuggagagcugagagccccccaccccgccccccaccuaagagcgacggggaccucccacccgcugcagugugcgggccucagauucccauugacuccggaagcccuucggagcugcggacucuccaccccgcccaaggccaacgaacauucucucacauguucccaccccaggcugccccagaccccuggcaauggaaguggucgaguucaccccuccccaggccuggcaccugggcgacgggcagcgccacgcugggugcgcgcagguaguagggggcgagcgugguggggcagagcgcagccagcucggccuccagcagccccucgccgaagcgcuggucaaagaggcguccgggcgccgaaaguccgggcaacggggccgaggcgcggcgcagccaagacggcugcacaggcacagggaucuccauccugcuccuccgcguugcagugccccugcgugcgcagccgcucauuuauagugcgcccugugccggccccucggagggcugcccagggacacugggaccguggccagacccggccauuaggagagccuuauuuagaaacccaaacaaugacuuggccauuuauuaagcgccugcuggaugccuggcaaaugcugucaagaaggugacaugaagauuccccaauuuccagaagaggaaacuaaggcugaggagggggagccuugcggguguggggagcacagcguggugauuggggcccaggacccaagaggcccacggaagaguuuccagucccuuuaauccacugccuccccccuggcagcucugaggaugacgcagauggaggucuuuaggagcagauuccuggagaaugcgguagccccgccaggaugucaggaggacauagaacaggcccucccuacccuuauccucagccagaccuugggcccagucccccggcaggccgggccuaauucugugccucugacucagccucuggugcgcagaggccagggggcgcgagcaugaacaguucaggcuggccccccgggggccgcgcgcuggggcuggaaauagcucauuuugaucccgcuaccucggccaggagcccagaccuggcaacugaugcaaccagcugcuccugcagcaagaaagaaguuagaugaccguugggacggacugauuggcccaacugauggaggaauagcgguuagagagagggcagagcgcgccccccccccaacccgccccacugccccugcaacagaaagaaugguaguuagaccggggucgggacaggacuucugcagcaagaaggcgcuuaaaaagcgggacuuuuaagcgaggguacuuuagaucaccuccuaaccgcaagcccagccucagauccuucccauuggugcacggucuugccaauuacugcuacacucggcagguucuccaaucaaacacgcccugucgggcaggcagucgucccagccaauccugaaacaccucccuccggguacuucuguuuccucucuuucauuggucgccuuggaggccgcucgccuccggcgcgggcacagagaggggcggggcugauagggcguugcuaagcgacggagaugcgcgcggggccuguugggugaaggagcagagcggccggaagcgcggagggagccgcgggauggaccgcaggugaggccgaucgcucuuccagggacuacaggaggcuggggaggaccaacggcgagagcagcacagccuaggacgggcuggauacggucuggagucgcuagggcuccaccgcacuggaacuacaauucccaacaugcuccacagccguuggcc

SEQ ID NO: 15110 - RNA, 1882 nt, Homo sapiens
aucgaaaguuaggguccuuuauugggggaugucagcagagaacgugggacaugaaaacaagucuuaggaguuugagaaggggcucccaggacaggcuccucugcuuuaaggagccuguccugggagaauaagcagggccccaguaugugcagaaguugucagggggugcccagggguauggugaaggagagguaguccccaagggcaccccagcggggccgguagaucuggaagauggugauccaggaggugagcacuaucacccagaagaggaagcccacagcugagcgccagacaucugucaugggaaacagaagcuggaaggguuggccuccggcugcucuccagacuucccuagaccagccuucccuucucacccagagccccaacauuuuggauccuccauugucccuucccaccaagauuccccgcuucccccucuccccugccacuggccucccuccucugugcucuagacucacagccuuugauuuggcucuguucuguguaggcugggacaaggaaggccucucggaagaaccagaagauguugaccaaccagagaaaaggcaggaaagcaaaccccccuagggagaaagaaaaacaaacaaacaaaccccaaaaccucauaaggcaaugaagaucuucuccaacucccaccgagaucuauuuggaagaaacucucccacacccaaguucaaauggagauuucuguugucagggacucaggaaucuggcuccucuuugggauccaggaaucugauuccucaaccaucucuuucacaggacccaagaguccaggcccucaaucccccuccucucuugggauccagaaauugaggccccagcuuccucauuccucaggacccaggcccuccccacucaaauccaggagucggcguucgcagguccuucaucucuuagacuuaagaauccaggccccgaggcccucuucccucgggugcucuaguccaguccccucucuucuccugggacccuagcgaucugccuuacccagguaguacuuccggcacagguucaauuucuccucauuggacacucgcuccagguucauagcugcgcuggggccgggucgucccaagggucugcggggcaagacccaagccuugacccuaaguaacagaugcaaggaucacgaacaaccacgccccuauuagaacaaaucagagauaaauguaaaggucgguuugcugaaagcagggcauccccacccccacuaguaagcuggcuggauuaaagagcucuuuauauuuacuagggugggcgaaacgacccccaacucaccaggagagcucacuuccuccggcuggggugccuuagcuacuuucaguuauggacguuugcgcgagacgccccagguuucccuggagauuguagucuucuuugggcgaggcaacacugcacgcaugcgcuguuaaaagaacuccuaccggggagucuauggggagggcgcgcgccucccacgcgcaagcgcccuggggcguuuccgagcgcuugguaagcgccuggagagggcaacgaacuacacuucccagugcuccuaagcaacggaagugacguaagagcagccagaccuggagggcuuggguaaaaauggcugaauauuuagcuucgauauucgggacugagaaggacaagugagaacgggcgcugggaguggacucucggggggucggggccgggguacugggguccugggugguggggcgguguuucuggggugcccagcuuccccggcccucgguucaccuuugucuuugcaccuuuuccaggguuaacugcucuuuuuacuuuaagaucggggucugccggcacggggaccggugcucccggcuucacaacaagccgacauucagccagg

SEQ ID NO: 15111 - RNA, 1882 nt, Homo sapiens
ccuggcugaaugucggcuuguugugaagccgggagcaccgguccccgugccggcagaccccgaucuuaaaguaaaaagagcaguuaacccuggaaaaggugcaaagacaaaggugaaccgagggccggggaagcugggcaccccagaaacaccgccccaccacccaggaccccaguaccccggccccgaccccccgagaguccacucccagcgcccguucucacuuguccuucucagucccgaauaucgaagcuaaauauucagccauuuuuacccaagcccuccaggucuggcugcucuuacgucacuuccguugcuuaggagcacugggaaguguaguucguugcccucuccaggcgcuuaccaagcgcucggaaacgccccagggcgcuugcgcgugggaggcgcgcgcccuccccauagacuccccgguaggaguucuuuuaacagcgcaugcgugcaguguugccucgcccaaagaagacuacaaucuccagggaaaccuggggcgucucgcgcaaacguccauaacugaaaguagcuaaggcaccccagccggaggaagugagcucuccuggugaguugggggucguuucgcccacccuaguaaauauaaagagcucuuuaauccagccagcuuacuaguggggguggggaugcccugcuuucagcaaaccgaccuuuacauuuaucucugauuuguucuaauaggggcgugguuguucgugauccuugcaucuguuacuuagggucaaggcuugggucuugccccgcagacccuugggacgacccggccccagcgcagcuaugaaccuggagcgaguguccaaugaggagaaauugaaccugugccggaaguacuaccuggguaaggcagaucgcuagggucccaggagaagagaggggacuggacuagagcacccgagggaagagggccucggggccuggauucuuaagucuaagagaugaaggaccugcgaacgccgacuccuggauuugaguggggagggccuggguccugaggaaugaggaagcuggggccucaauuucuggaucccaagagaggagggggauugagggccuggacucuuggguccugugaaagagaugguugaggaaucagauuccuggaucccaaagaggagccagauuccugagucccugacaacagaaaucuccauuugaacuugggugugggagaguuucuuccaaauagaucucggugggaguuggagaagaucuucauugccuuaugagguuuugggguuuguuuguuuguuuuucuuucucccuagggggguuugcuuuccugccuuuucucugguuggucaacaucuucugguucuuccgagaggccuuccuugucccagccuacacagaacagagccaaaucaaaggcugugagucuagagcacagaggagggaggccaguggcaggggagagggggaagcggggaaucuuggugggaagggacaauggaggauccaaaauguuggggcucugggugagaagggaaggcuggucuagggaagucuggagagcagccggaggccaacccuuccagcuucuguuucccaugacagaugucuggcgcucagcugugggcuuccucuucugggugauagugcucaccuccuggaucaccaucuuccagaucuaccggccccgcuggggugcccuuggggacuaccucuccuucaccauaccccugggcacccccugacaacuucugcacauacuggggcccugcuuauucucccaggacaggcuccuuaaagcagaggagccuguccugggagccccuucucaaacuccuaagacuuguuuucaugucccacguucucugcugacaucccccaauaaaggacccuaacuuucgau

SEQ ID NO: 15112 - RNA, 6189 nt, Homo sapiens
agcaaaguucuuuauuggguguuaagcccagcaaaccccagaugagccaagcuuggacagcacccgcaaugcaucugcccgcccuagcugggcgaggugugugccaagcuggcccagggaggcagagggcucccuugccaccaccaucucaaucagagcccgcagcggcgagcgacucggccucagcgaauaggcaaagguggaccaggcagcaggcagcccauaucuugcggccaggugucgaguagugccaugggccauacccccaccuggcccaggcucaggguccagcaguacaaucagcucuuccagcaccuccagcucauccaggaggcgagacagggguugugacgccagacuggacaguucuggaagaaaggggaaggguaaaggugcggaagagcgggcguccaguccaccuucccugccccggggcuccuccaggacuaaccccugcucaggaguggaaguagugaggccuccuuccauguguccccugucuccagggcgccuggggaggacagaugcgaggaggaagggguguggguguuggggacuccgcagaccaagccaggauagggauaggggucggcuuucuccuugggccagcagagaugccagagcagaauaaacaggaggaucgcuaucaccgccaaggucaggagcaggaccagcaccacgagcggaaggaaauucggccaggccugcugagggacaggcucagggguccuccaggcaauggaacuugcuggugagcugcgcuccugggagcuaggggcgccuggguuuccaggugugagggggcagugccccuuggcagggaccggccucuggggauaagggguuggaguaaagcuggaggccacacuccacuccugcccgcucccaaaccucccaacuuuauauccuuuaauggggccacaucccaucugauacgguaucugauaagguaguugggccccgcaaggcccaacuaccuuaaccuaggaccucccgaccccugcaggccagccaccuccugaaaccacggccccaccccuuacguggggcuacgccggcucccuacaucuaggccccccaccuccagcacgcccuugcccugccgggagucccaucugcaccucucugcagcgccacgggguucugcccccgcccgcggcgggaguaggggucacggcuccgccgccgcaggggcuacauagcuccgcgccgucgggguugcacugcccagaagaacacuuucggaacgggggcguuacgaaaucgccguggucauugaguccgcaguuuucccggaacucauagucuagcgggaaagcugcgcuccagugcggccgccuagcccgccccugcgcgggcaacgcccucucccuucgcccuaucccagcgugccccgccccuccaggacgcuuccagccuauuagcgugcgccccggucuugucacuuuucuccgggcucgccuuuucaccccccuccagccugcuccgcacgaagcuccgcccacucccggcuucucuacauaaagcccacccuuuccacgcggccccuaucccgccucuccagccauauccauucgcuguugcccuacgguagcccgcacuaucugcacaggcucugccugccaucccugucugaucugcauaaggcccaccgcuuagaccccuaagcaagccucucuggcccguagcccacagaccucgccccuuccccgcucccuaucaccugcaagcuccgcccaagcaaggcucggucucggauucucacccgggcaggggggcggcccgaagcguugcaggcagcugcugcagcacuuguugucuggguuccaguauucaaggcggccgcaguacugggaggcuuccggcgguggcgccagggccagaagcaacaaggccgucaggaggcaucguccaggccccaucuggggggccgugauagcgggacuuccaaacacagcgccucugcuacacuuuccggggaaaucgggcagaagaaaggacgcggugaugugggggaacagaauucucacgccucuucggaagccgggaaucuacccccgagcccucaucccccaacugagccgguuaucagagaagcccacaaggccacuaggggacuaacagggcugcggaucuagauugcaagaaugcauaucccaccucugccguguccucacccacccacccucccuuuuccaucccuaaaauaagacaaugauagcaccugucucauaggguuauuguggagaauuagaaccgucauuagaaguaaagcaggggcugggugugguggcucaugccuguaaucccaacacuuugggaggccaagacaggaggaucacuugagcccaggaguucgagagaucagccuggacaacaaaaugaaaccccaucuuuacaaaaaaaaaaaaaaaaaaaaaaaacagcaaagcacuuugccaagugcaguggcucacgucuguagucccugcuacuagggaggccaagguaggaggauugcuugagccaugaauuacagaccagccugggcaacacagcaagaccucaucucuaaaaacaaaaaaaacuggccgccgggcgcaguggcucaugccuguaaucccaacacuuugggaggcccagguggguggaucaccugaggucaguaguucaaaaccagccuggccuacauggugaaacccugucucuauuaaaaauacaaaauuagccgggcgugguagcgcaugccuguaaaucccagcuacuugggaggcugaggcagaauugcuugaaccugggaaguggaggcugcagugagcugagaucgugccauugcacuccagccugggcaacaggaaugaaacuccuuaaaaaaaacaaaaacaaacuaaagugcugaaaacagcaccucacauacaguaaacucaguguuuaaguguaaggcauuacuaacucccaucacaauucggcaggcacggaggagucagccccauacuggcuggagaccaccucccagcaccucaccucaccuuugaauccuaaucuccuuggggcuagggcuccucccaccugccacaaccaggucucucccccuugaauaagccucagauggaggugcuaagguuuucagcacaaagguguccccacccuaccaguaccguuaggguccugggucccaagcuggccgugccaaguuccucagcugaaguuguggccaggacccagucuuguuuccccuuuucgucacauguguggguggagggaaaugccaaaccacagcaaaagcaaguugaugccgaagugaaacacgcagcuuuauuaagacaggggcgguagaagaaggucuccaugcugaacagauuacauuauggagcccgggagccugggaaggauggggcaggagagugaagggggcuuugaggagagguccugccaggaacaucugucccuguugggggugaaggguaagggggccagggccucagaagcggccaugccagugaucaggggaacaccgaugguuccucucucggggaugguggccaguauggaaccucgggggugaccugggaauaggagcguugagaguucuguuagaacccugaggaguggugcagagauccugcaggccugccucucugcucugggaugaggcaggagggugcugaaauaacuagaguucuaagacacgaccucaguggccaguaucaggggaacucaguggccaguaucagggguggcaauccaggcuggucguggauuagggguucaggcugguuuggggauugggacuuagguacuggucuccagauggagcucagaacuacucuuaggguauaagagucuugggaaugaccgggcgcagugguucacgccuguaauccccacacuuugggaggccgagauggguggauuaccugagguccggaguucgagaccaggcuggccaacguggugaaaccccaucucuacuaaaaauacaaaaauuagccaggcaugguggcaggugccuauaaucccagcuacuugggaggcugagaaaggagaauugcuugaaccugggaggcagagguugcacugagccaagacugcgccuuugcacuccagccugcggaagaagagcaaaacuccgucucaaaaaaaaaaaaaaaaaaaaaaaaaaaaaacagucagccgggagugguggcucacgccuguaaucccagcacuuugggagggugaggcagguggaucacgagguuaggaguucagaccagccuggccaagauggugaaaccccaucucuacuaaaaacacaaaaauuagccgggcaugguggcaggugccuguaaucccagcuauuugggaggcugaggcagagaauugcuugaacccgggaggcggaaguugccaugaaccaagauggugccaaugcacuccagccugggcaacagagugaggcuccaucucaaaaaaaaaaaaaaaaaaaaaagauucuugggaacgugguuacuggggcuuaggguuaggcucaucugaggauauaggggccuuaggacaugaggagacauagcaggcugguccugagguaccugcgccuggguccccgcccauagagcugccucuggagguucugggaaaugggccgcagaugcaugaaguugcagaagccaccucggguacauucccugcauagaggguagagagauggaggaagccauugucacugacagccccuaccacgcauucaaagucugggauuccaagugcccaucccacccuugaacuaccauaccccaucucauacuggcgacagcaugacucccggaagucagugacaggagacagcucaccgugcacagccugcccguugaaccagcgguuacugaguucagccacggcccgcucuccauccuccucccuccggaacugcaggaaaugucagucagggucagcaggagaacucagagaucuucaggggacucacuacccgcucuggggcuggacuggauuuagugaugaaauucaagcugagagccuacaguggccaccaucaggcauugaaacgccuccacuucugggcccuaaguggggggcagcaagcaccuugacauagacguugcccacgaggugguccccaagguugucgcacacauucaucucuucaaucuccccauacuucuccugcaguucugugaacaccuccuguggaagacggggaggaacucagcugagcucccacaagaaaccccaucugccccuaccaacccucaccucgaagaagcuaucauagugcuccugcaccuccacgucacucacaugaccuggggugggggcgggcaggguggaaucagaguguagccuacugggggcuguucaccuugcccccaggccuggucccuuacucacagugugauccgucugcaguuugggcuguguucuguggauuccgguacagguugagcagcacuauggucugcacagaauuuaaaaggggcggggccugagcucagagggcagggcugcaugaacagagagugaggcaugaagguuggggguggaaccuuacaccccagccuaagcaucaugagugcaucggcgauccuuugccccuaagaaaccagaaaagggauggaggggacuggcaaggaugaacagcgggauggaagggacuggcaaagaugaacagccgccguguguagccuguacgcaugggggcgcgaccaaguucccgggaaaacggcacgaagaccggugggaggagccugcagaaagguccaaugagaaaaaaagccgggcgguggggagggacucaggaacccggaauaggcgggacauggugacgacggccccagaaggggaagggccagggagccguuaacccccgaggcuccgugccgggucucaccuggcugaaugucggcuuguugugaagccgggagcaccgguccccgugccggcagaccccgaucuuaaaguaaaaagagcaguuaacccuggaaaaggugcaaagacaaaggugaaccgagggccggggaagcugggcaccccagaaacaccgccccaccacccaggaccccaguaccccggccccgaccccccgagaguccacucccagcgcccguucucacuuguccuucucagucccgaauaucgaagcuaaauauucagccauuuuuacccaagcccuccaggucuggcugcucuuacgucacuuccguugcuuaggag

SEQ ID NO: 15113 - RNA, 20885 nt, Homo sapiens
cggugccaagauggcggcggcggcgggcggcggcaguugccccgggccuggcuccgcgcggggccgcuucccgggccggccgcggggcgccggcgggggcgggggccgcggcggacggggcaacggggccgaaagagugcggguagcucugcggcgcggcgguggcgcgacggggccgggcggagccgagcccggggaggacacggcccugcuccguuugcuggggcuccgccggggccugcgccggcuccgccgccugugggccggcccgcggguccagcggggccggggacggggucggggccggggcuggggcccgagucgaggcugcgugccggaggaggagagcagugacggggaauccgacgaggaggugaggcgguuggaggcguccccggcgccggguggggcggaggccggggcuuccaggggucuggguugucccgggggcggcgugggcaggccggguccucaggguuccuucggagagacggggcacggagggagggcggcugcaugcagcuuccgggggaaagggccucuggaaguggguagagaagccccggcugcagccaggcacucgcgcccgaugucggucccgcugaagugucuugggccgauccuuuucggcagcuggcaaagcuagggcgguggagguuugggcgaggaggcaguggggacugcauguccagccagucgugguugacagcggcagcguggccuuggcagacagguuggagcugucugggcucuuaccugugggccgccccgccgggccucgcaaccuccugguuucuccagggccccaguuucucuuggcaucucagguagagugguggagggcuuccucuuggggcucggguugaacaggagugggaugaaggccgggacugggcacucuagcaggucagagcucagcucaggauuucucccccagccuuucagaacaggcaggaagguguggguugcguugcccuggacgguuaauaacaaccugagagcucgcaguggagccuguacgaaagccaucugaugcccuccccgccccuucacuugcgggccccuguucccaacuuaaugcagaaauaaauuguggcccgaaagggugucaguggaggucccacuuuggucugaauuggacucugaaggaaucugaguauggggccugcugccuuuccugaggagacccugucgucuucucucuugggccagugaaccauggcuuuggcugugcuggugugguccggcacuggggaucggaguucgaaauaccuggcgccuccaucccuagggagagacccucucuuccacuacccgcgaccuuugagucuuuuucguucuuuuuaaauaggcagggguaugcuaagugggaacuggggauauuccucgauaccucagauggaacgagggcuuuggcacugacugcuguuucuccccuccaccccgguccccuaaaucaggaguuucaggguuuucauucagaugaagauguggcccccaguucccugcgcucugcgcuccgaucccagcgaggugagugacgggggaacuccaccucuuuagcgucacaggaauuuauccucgcccuucgugucagcucuucccuguucaacuagccucugucaguugccgaauguguucuguguucagaguccaagcuagucugggcagcgggggaaacacacaagcaagacuuagucccugcccuccuggagcgccuuccucuguguguagggcuggcuugauccaucuccccacaacuauucuccuuuuaggucgagcgccccgaggucggggucgcaagcauaagacgaccccccuuccuccuccucgccuagcagauguggcuccuacccccccaaagaccccugcccggaaacggggugaggaaggcacagaacggauggugcaggcacugacugaacuucuccggcgggcccaggcaccccaagcaccccggagccgggcaugugagcccuccaccccccggcggucucggggacggcccccaggacggccagcaggccccugcaggaggaagcagcaagcaguagugguggcagaagcagcugugacaauccccaaaccugagcccccaccuccugugguuccagugaaacaucagacuggcagcuggaaaugcaaggaggggcccgguccaggaccugggacccccaggcguggaggacagucaagccguggaggccguggaggcaggggccgcggccgagguggugggcuccccuuugugaucaaguuuguuucaagggccaaaaaaguaaagaugggacaauuguccuugggacucgaaucaggucaaggucaaggucaacaugaggaaaguuggcaggaugucccccaaagaagaguuggaucuggacagggagggagcccuugcuggaaaaagcaggaacagaagcuggaugacgaggaagaagagaagaaagaagaagaagaaaaagacaaggagggagaagagaaggaagaaagagcuguagcugaggagaugaugccagcugcggaaaaggaagaggcaaagcugccaccaccgccucugacuccuccagccccuucaccuccuccaccccucccacccccuucgacaucuccuccacccccacucugcccuccaccaccacccccaguguccccaccaccucuaccauccccuccaccgccuccugcccaagaggagcaggaggaauccccuccuccuguggucccagcuacgugcuccaggaagaggggccggccuccccugacucccagccagcgggcggagcgggaagcugcucgggcagggccagagggcaccucuccucccacuccaacccccagcaccgccacgggaggcccuccggaagacagucccaccguggcccccaaaagcaccaccuuccugaagaauauccggcaguuuauuaugccuguggugagugcccgcuccucccgugucaucaagacaccccggcgauuuauggaugaagacccccccaaacccccaaagguggaggucucaccuguccugcgaccucccauuaccaccuccccaccuguuccccaggagccagcaccaguccccucuccaccacgugccccaacuccuccaucuaccccaguuccacucccugagaagagacgguccauccuaagggaacccacauuucgcuggaccucacugacccgggagcugcccccuccucccccagccccuccaccucccccggcccccuccccacccccugcuccugccaccuccucccggaggccccuacuccuucgggccccucaguuuaccccaagcgaagcccaccugaagaucuacgaaucggugcuuacuccuccuccucuuggggcuccugaagccccugagccagagccuccuccugccgaugacucuccagcugagccugagccucgggcagugggccgcaccaaccaccucagccugccucgauucgccccuguggucaccacuccuguuaaggccgagguguccccucacggggcuccagcucugagcaacgggccacagacacaggcucagcuacugcagccccugcaggccuugcaaacccagcuccugccccaggcacuaccgccaccacagccacagcugcagccaccgccgucaccacagcagaugccuccccuggaaaaagcccggauugcgggcguggguuccuugccgcugucugggguagaggagaagauguucagccuccucaagagagccaaagugcagcuauucaagaucgaucagcagcagcagcagaagguggcagcuuccaugccggugaguguggucccugggcccagcggcacacccagccauccagccuccauucuuugcaacccccuaaccuuccgccuccuuggacacuuuccagcauugcggggaacccucagaaccugccuuucugugaucccccaccuuccuuuguuccuccccagaccuggcccuucucugugcuaguucccugucccuaucuuccuuuuuuuuuuuuuuuuauuuuugagaccgagucucacuuuguccaggcuggagugcaguggcgugaucucggcucacugcagccuuugccucccggguucaagagauucuccugccucagucucucgaguagcugggacuacaggugcccaucaccacgccuggcuaauuuuuguauuuuuaguagagacaggguuucaccacauuggcuaggcuggucuugaacuccugaccucgugaucugcccgucucggccucccaaagugcugggauuacaggcaucagccaccacacccagcucccugucccuaucuuuccucacuguccagccccugacccuguuuauucccugccagcugagcccuggagggcagauggaggagguggccggggcugucaagcagaucuccgacagaggcccuguccggucugaagaugagucgguggaagcuaagagagagcggcccucaguaugcaucgggaggagggcccugaagaagacuggcgggaggaguggggcugcgggagcgcaagcugcccacacacacuccgauuucucccccagggucccgaguccccugugcaagguccccgcaucaaacaugucugccgucaugcugcuguggcccugggucaggcccgggccauggugccugaagaugucccucgccucagugcccucccucuccgggaucggcaggaccucgccacagaggguagguggggagacuggacagccaugucagguuuggggaugaccccacacuugggugacaugcaccaagagccuaggagagagggagccaagucaggugcucagggguuagguggcaagugggcuggagugcuagguccuagagcaacuucauuugggggcaccaggaaccuggcgcugugagaaagcgagagccagguugugggaaagcagggaagugagguagaagccugguggcuuuguggcuccauccccuccucccugccugcugcaauagauacaucaucggcguccgagacugagagugucccgucacggucccggcggggaaagguggaggcagcaggcccugggggagaaucagagcccacagguucuggagggacccuggcccacacaccccggcgcucacugcccucccaucacggcaagaagaugcgcauggcucgauguggacacugucggggcugccuacgugugcaggacuguggguccugugucaacugccuagacaagcccaaguuugggggcccuaacaccaagaagcagugcugugugugaguagcuggggcgugaccucauucccgugguuguugguccccuaggcuuccuaccucacuccucuucugccuggccagagcagugggguuggcauucuuguggagagcuuccucucuucccccagaccaccaguccccuacccuggugacgugcugcuccccuccccagauaccggaagugugacaaaauagaggcucggaagauggaacgacuggcuaaaaaaggugacgagcuuuaaggagcauuucuucucaaaaccguguuagaguuugugcuguggagggagcuguuuuucuuugcucuccucccuugcagcucacccucuccaucuucuccguugugugcuuucauagcuccugcguucauucccugccccgcuucuuucuggcuucucucccagugucccaugucccuggcugagcucaaauccuacuaaguccccuguucccgcagccggacgauagugaagacgcuguugcccugggauuccgaugaaucuccugaggccuccccugguccuccaggcccacgccggggggcgggagcuggggggccccgggaggaggugguggcccacccagggcccgaggagcaggacucccuccugcagcgcaagucagcucggcgcugcgucaaacagcgacccuccuaugauaucuucgaggauucggaugacucggagcccgggggccccccugcuccucggcgucggaccccccgagaaaauggugcgaacugcuuaaugcuuucucuguugaucauuuauuuggucuugugucuuuuguguaggagggacaaggcacccagacccagggcucugucagucugauagagaagguggcugagggcggaggaggagacaguuuuuagguggauguacagaacuggccuaugagguucucagugagccuaaugagugagacuuaagggucauccuaggccuggugcaguggcucacacuuguaaucccagcacuuuugggaggccaaggugggaggaucacuugagcccaggaguucaagaccagccugggcaacauagugggaccccaucccuauaaaagcaaaaguuaguuguaugugguggcacgcaucuguggucucagcugcucaggaggcugaggcaggaggaucgucugagccugggaguucaaggcugcggugggcuaugggucacgccacugcauuccagucugggcaacagagcgagacccugccucaaaaaacaagaaaaagaaucguccuggcgggucuugguuaguuaaagaaggcccugggaauccagguaacauuugggguuguagaagaagaggggcguggaaggggagugaccucacugcucauuguguccugccuagagcugccacugccagaaccugaggagcagagccggccccgcaaaccuacccugcagccuguguugcagcucaaggcccgaaggcgccuggacaaggucagcacggcccgcuccgagagccccuucccuccaggagcuaccuggcaagucagagugacagacacaccugagugucgugguguguccacaugagaggacaggcccugagggaugaggcgggccuugccugucuggaaagcaaaggggucuggaucagggucuggguccaguaggcugggggaaaggcggugaggagaggagucugcaucacggccaggcuggcagcucugaauucccccaccuuuccuccccaggaugcuuuggccccuggccccuuugcuucuuuucccaauggcuggacuggaaagcagaagucucccgauggugugcaccgcguccguguggauuuuaagguauggcauugaguggggcgagucacagagccucugguuggaagaaccucgaugacugugucaucgagaagccaggugggucugccuuguaugccuggcggcccucugauccugcauccucucuucccccaggaggauugugauuuagagaacguguggcugauggggggccugagugugcucaccucugugccagggggccccccgauggugugcuugcugugugccagcaaaggacuccacgagguuagaucucugccuuucuucacagacccccagcucucugucgguccucacggccugauuccuugggcccucucagcugggucucaucccuuggcccucuggccucaugcuaugcccaucauucacuccuuuacccuguccccagcugguguucugucaagucugcugugacccauuccacccauucugccuggaggaggccgagcggccccugccccagcaucacgacaccuggugcugccgucgcugcaaauucugccacgucuguggacgcaaaggucguggauccaagguuugggcccaagggcuggccaggguggguggaggccugaaggugagggcaucccugugccagcagguuucgccaucucugucuccacauccaacagcaccuccuggagugcgagcgcugccgccaugcauaccacccggccugucuggggcccagcuauccaacccgggccacgcgcaaacggcgccacugggugagagaugagguucacccacuugcuuugucucuaaugaauaucaccaccacccccaaacuugcucuaggcuggggcucucaggaggagcagagguuggggauccucuuaagaauugauuaguaauguuuccucuucaaaaauuucacauaggucagauuuauauucagaauuugcauggagugguuuuaggggcuuaugaaucucacauuccgugggcucagaauccccugcuauagccugauguccucuccugcccucauguuccuccuccgugucuguccugcguguuuucuccucuuaccugucccuccuugccugcuuccugcauauccccaauuccuccucgcccgucucccgcucauguugcuccaguccagugccugguuuuccccuaacaucgcccugcucccccagaucuguucagccugugugcgcuguaagagcuguggggcaacuccaggcaagaacugggacgucgaguggucuggagauuacagccucugccccaggugcacccagcuauaugagaaagguggggaccgggcaggggaacuggaugcugggggccacaggggaauggccaggcucuuuuacaggcuuuagcacagacccucuuuucucauggcuuuccaccuuguagcuaugggacuaucucuucaacucagggaacucuuccacaggaguccauccaguauguaaaacagggacacauagcuccucugaggguggugggaguggaaggccugggaccccacugucuuggugucugagguacuuccuggaaccucacgucuccauugagcgguuuggaagccuuauucaggcaguacauuagcaaggcccuguguucugcagagucugaaaagaggccucauccuaaggccgagcacaguggcucacgccuguaauccuaacacuuuggaaggcugaggcagguggaucaccugaggugaggaguuugagaucagccuggccaacauggugaaaccccaucuguacuacaaauacaaaaauuagccgggcaugauggcgggcaccuguaaucucagcuacucgggaggcugaggcaggagaaucgcuugaacccgggaggcggagguugcagugagcggagaucuugccacugcacucuagccugggugacagagcaagacacugucucaaaaaaaaaaaaaaaaaaaaagccucauccucaaggagcuuuuagggacuaguaggggcccaaaacaggggcauaguggaggcagcuaagguacugcuaauccuugaacagagacacucagggcugagugggaacuccagcaccucugacuccuucucuucccuuucucuaggaaacuacugcccgaucuguacacgcugcuaugaagacaacgacuaugagagcaagaugaugcagugcgcacagugcgaucacugggugcaugccaagugcgaggggcucucaggugagucaguggagcaccugggcugcagccucaacccuguggggaccccugcccccaccacaggccccaagaggacuggugggcuaaggguccuugcuggccuaggggcugcugggagcccucacauccucugaaaccacuuuucccuuucccacuuggcuauccuagaugaagacuacgagauccuuucaggacugccagacucggugcuguacaccugcggaccgugugcuggggcagcgcagccccgcuggcgagaggcccugagcggggcccuccaggggggccugcgccaggugcuccagggccugcugagcuccaagguggugggcccacugcugcucugcacccaggucuggagggcccuggaggcaggaugggccggggcuaggcccacccccagcccugcuaacuuccccgcuuugcagugugggccagaugggaagcaacugcacccaggacccugcggccugcaagcugugagucagcgcuucgaggauggccacuacaagucuguggugagugguacaccaggaggagcagguggguggcaggaggagagggcuggaauugugcagaggggacucagucucugacaaacccccuuacagcacagcuucauggaggacauggugggcauccucaugcggcacucggaggagggagagaccccggaccgccgggcuggaggccagaugaaggggcuccugcugaaggugagcucuuccggggaugcuuguggggugggggagugggaccuucagacccugccccugccagcucuccuggggaagcuggcucuucucauccuguuaacccacuccccagcugcuagaaucugcguucggcugguucgacgcccacgaccccaaguacuggcgacggaguacccggcugccaaagugagcaaggcuggguagcagaagggaagccggggagugagggcaaggccagggcaugcaggggccacgcugggcugagaagagaugagcagagguagggucuggagcagagcuggagaggagggugguggaacccaggugagauucccuggugguucuagacuagcaaagcuuuguuucugcuuugugcaggggaaugcuggggacaaagcagugagcgaaucagauugggcucugcuuaaagagcucauuguggagccgggcaggcacugaagacccagauggucagggcagugauggagaauaccagggggcggugggggcccggagggguaccugcuggagccgaggugucagggaaggcuuccugaaagagauggcauuggagcagagcuggggaggaagaguauugcaggcaugaggagcagcauuucguauguccaagcuggcacaagagggccuggcuuauuugguggacugagagaaauuccacauagagagggaguagcgggugucauggcgaguucaggcugguuuguggaugggcccccguucagcugcccuuguugggcacaucagcugcuaacccugccuguccacagcggaguccuucccaaugcgguguugcccccaucccuggaucaugucuaugcgcaguggagacagcaggaaccagagaccccagaaucagggcagccuccaggggaucccucagcagguacugggaaguggggguccagaagccagggcccuguguugguggccuggcuccggguccugauucuuagaccucccuucacauuuccucuucagcauuccagggcaaggauccggcugccuucucacaccuggaggacccccgucagugugcacucugccucaaauacggggaugcagacuccaaggugagggcugcucugugacgcaccagguuguggggccuguucccuggccuccccacaucaugccacuccucuucugccccaggaggcggggcggcucuuguacaucgggcagaacgaguggacacacgucaacugugccaucuggucggcggaagucuucgaggagaacgacggcucccucaagaaugugcaugcugcuguggcccgagggaggcagauggugagggcgcgggcgcagagagguggacagcucucuggcucuuggggaggccuccuccggugcaaacagcucuuacuucacauucccuaccuggcauccuuucacugccaggcugaggucucuugguugcccugggacguuggugcugauggcagcuuuuuccuaugugggcccucuggcuguaaucugggccugaagugugggagucuaaaagugagaagagugcccauugauugaaccugggcugcacgcuuuccaugcuggguggcguugagcucucacuacauccccgugagguuagaauucccccacuccucacaguggugccugggccagguacagagagaccucaggcacucucgggcauuggggugguagagauucccacugcggggguaucugugaggaugaaaauaacacaaccuccgccugaaaacugugacaaagauaaucacacuaaugcuaucagcaaguauugucauucuugcuucaaagaaccagagagaguuuggugugcaccugggccuggaugcggcuggggagaggcugcgccuagggagagccuuugccgugccaggcuagacagggacccaugcagacucagugacaguggugccuggcgcccagccccagcccuggcuucuccccugagcugcccuccccuacgcagcgcugcgagcucugccugaagccuggcgccacggugggcugcugccuguccuccugccucagcaacuuccacuucaugugugcccgggccagcuacugcaucuuccaggaugacaagaaagucuucugccagaaacacacugaucuccuggauggcaaggugggccagaacugugggguacacgguuccuuccccaccucucuuccuguucacuuagggacccccguggcccccaggccuggcccuacugccucucagugucuccucaucuguuuucccagaggccuuuaggccaagccccugacuguucagacuucccuggcauccaccucccccaccaaugcagccaccucacuuugccacccccucuuccaggaaauugugaaccccgaugguuuugauguucuccgccgagucuauguggacuucgagggcaucaacuucaagcggaaguucuugacggggcuugaacccgaugccaucaacgugcucauugguaagcugccugcucuccgcccuguccuccuacccuguccugccugccucuccugaccuccgcuuugcaccacagguuccauccgcauugacucccuggguacucugucugaucucucggacugcgagggacggcucuuccccauuggcuaccagugagcggucggggugauccauggggccaggggacuccauagcuggaucccauuucccaagcauccuaaccgucuuaucccacaugccaggugcucccgucuguacuggagcacaguggaugcucggaggcgcugcugguaucggugccgaauucuggaguaucggccaugggggccgagggaagagccagcucaccuggaggcugcagaggagaaccagaccauugugcacagccccgccccuuccucagguguggcuuuggcucugucuucuuccugaauaccgcucucccuaaacaaaccuacagaucucuguuccccgcucccuuuuggaaaguccaggaggcuugcuuuugcuucaguugcuguaauguaacggcagcucgcuuacugccaugccuugugugccaggggcugugcccggcuuuucaugggaagugagguggggagagcggcacgcugccuacuugaggugggguacuggcuuuuggacgacugcagggaguagagugcuuacagcucccuaacuuggggcacugugcucauggagcgcucuccagugucgccauacuacaccuugaaggggacaguggcugaacacaguaacaugcuagggaagcuggaauuggaacugcaucugcucagcucccaaaccggcccccuuacagccacacuggcugugggauguggcugagagcuggauggcacagggcaaagaaugggcuuggagaugggggagagguuauugugggcagagcaggaggcagaagagauuuggaugguaggaagggcuuuauuccagguuggagcaugacaagaaguggacagaggaggaggguacacccaucccgucuggaaaccagggaguuuuggguggaggagggagaucaguuugcagagguuggguggagccagguaauggagagccuccgggccggggcgggcgggagcgucugauguggcuuggaugcaccaggcaaguaagaaagugguaggacuggccgugcuggagggagggcaguuccccauggcgugcaaagccugcagcagaggcagagaggagauggcaaggagcgaguggggagaggcccugaaggcccccuggcccaggugugugcagguuuugccaacuccacgguggguuuagccuggguggucacuggaaacuggggccuguugugacugggucagggucggggaccugggaggcauaguggcucaggaugagagcaugugggcaggcuuugacacagagccccuaccaccccaaugccauuucucgccucuucagagcccccagguggugaggaccccccacuggacacagauguucuugucccuggagcuccugagcgccacucgcccauucagaaccuggacccuccacugcggccagauucaggcagcgccccuccuccagccccccguucuuuuucgggggcucgaaucaaagugcccaacuacucgccaucccggaggcccuuggggggugucuccuuuggcccccugcccuccccuggugagcaccgggcauguggggguuggggguggagccgcggaggugggagcugcugguaacaccaacccuccccccacaggaaguccaucuucacugacccaccacauccccacagugggagacccggacuucccagcuccccccagacguucccgucgucccagcccuuuggcucccaggccgccuccaucacggugggccuccccuccucuaaaaaccuccccucagcucagggugcccccuccuaccucagucgucacagcccucacaccuaccucaggggagcuggcucccccuggcccggccccaucuccaccacccccugaagaccugggcccagacuucgaggacauggagguggugucaggacugagugcugcugaccuggacuucgcggccagccugcuggggacugagcccuuccaggaagagauuguagccgcuggggccauggggagcagccacgggggcccgggggacagcuccgaggaggaguccagccccaccucccgcuacauccacuucccugugacugugguguccgccccuggucuggcccccagcgcuaccccuggagccccccgcauugaacagcuggacggcguggacgacggcacugacagugaggcugaggcggugcagcagccucggggccagggcacgccuccuucggggccaggaguaguccgggcagggguccuuggggcugcaggggacagggcccggccuccugaggaccugccaucggaaauuguggauuuuguguugaagaaccuaggggguccuggggauggaggugcuggcccuagagaggagucacuccccccggcgccuccccuggcuaauggcagccagcccucccaaggccugaccgccagcccagcugaccccacccgcacauuugccuggcucccaggggccccagggguccggguguuaagccuuggcccugccccugagccccccaaacccgccacauccaaaaucauacuugucaacaagcuggggcaaguauuugugaagauggcuggggagggugaaccugucccacccccagugaagcagccaccuuugccccccaccauuucccccacggcucccaccuccuggacucugcccccaggcccccuccucggcgugcugcccguggucggagugguccgcccugccccgcccccgccacccccuccccugacgcuggugcugagcagugggccagccagcccgccccgccaggccauccgcgucaagaggguguccacuuucuccggccgguccccgccagcaccucccccauacaaagccccccggcuggaugaagauggagaggccucagaggauaccccucagguuccagggcuuggcaguggcgggugagugcgggugcugaggcuggcagagcaggcaagggggcagaugggcgggagaugcggcucauccuucucgggcucgcccucccagguuuagccgugugaggaugaaaacccccacagugcgugggguccuugaccuggaucggccuggggagcccgcuggggaagaaaguccugggugaguggccaggccccucucccuggagggucugggaccucuguccuuccccuuccugacaggucucuucucgcaggccccuccaggaacgguccccuuugcugccacuuccggaagaugguccuccccagguccccgauggucccccagaccugcugcuugagucccaguggcaccacuauucagguagggaccggccuugcccucucccuccuugccugugccuggcucagcugggugacucacagaugcaaaaucagcccucuuucaaaaccaguaucuacucccaggggccaagccugaggcucggugcuagaguuagagaugaccuuggggagccucuggccuugugggagaaacagacauggaaaugacauuucgccucuacgugggauccuuuuaagggucuuuguccagcaugcccaagagccuaggggagggccucagagccuagccugccaggagcugagagagagcuuccuagaguagccaaaggugaaguucuaggaucaucuagagggaaugcagcccagcuagcaccgagaugagggucagggacagugggaagaucagaagaguggugucccagaggcccagggaagggagucgucacaucucagcugccacagagacugccaggccuguggagucuagcguugguguccagugagagcagguggcacaggguggggccuuguguccaaguccagaauugagaccaugguugaagaaggcaaaacagcccaagcacuuggccagaguucagcuaaggaucgggagcgggaggugggcgagcagcguggaggugcuuggugugagggccaagacagcggagccauggauggcagggaagggcaggcugggauggaaaaggcagugggaagaggccugguggcugguuuugaacuggugaccucugagguaaaggagaggagggaaagcagguguuuaugcagaaacuguaauacaugggguggaggccccuggaggaggcuuggcugauggacuccuugaagcuggcgguggagugguggaguuuucuguuggucccugagggcaguggcugggggaguggcugcggccagguaagcugguggucgagcagccugaggcugggauuuugugguggcccaauccuguccagauguuuggauuuucucaugacacacagcucaguugcugagcugggaagcagagugacguggauugagagugcuuaacucagaggcugcuuaugucucagagaugacaugagaauauggcaguggccuuaggaggucccuguccucagggaucagaccacauuuuggugcgggacacagacauguuagcaagggcagguuagagugggcacugagaaaccgagcagugagagcaccugccaggguccuguggucaguccugcuguguuugggaaacuggaagugaggguugggggacacagggaagaaguugacagagguggacucuggggcacugaggccuggagaagacgggagucacacggcaggaguguugcuuuagagucucccuuggggcaggggagguggggcaggguggccuggagaggugacaucgggagaguguggccauguggguuuugccucuccuaaagccuguuccacucaagcuuuugugcccccaacccccaguggucaguccccagcccacaccugcuugagcagcagcagcguuuggugcagcggaucccucccgccuugaagcauugucuucccggcuuccaaggcugcuccugcucucaccucugguccugccuccuugcucacagcugucaggcuagaugugucccgggacccuggccuugacuucuguguaugcucacucccaggggcucccuuccagcuugguggcuguccucccgucuguguucugauugucuccacauugcucucuccagccuagacccugucccugaacuguggccuccuccauccuguccugcugccugcccaccaucuccaccagcagguugcagggggagguuucuaagaggccucucaaagucagccugucccaaacugagcccuccaccugcacgccaaacccauucuucuuuugccuucgcugucucaguccacagcaguuuuauccuuccagguguucaagcccagcguugucccgacccccaucccccuucuucacauccacaucuacuacgucagcauaucccgucugcccuguuuaaucuauuaacccucgagaaauccccuaaauagcucauaacauacaguguacuuggcucugugcaugugagccuauauaauaauauauuuguagcugggcacaguggcucacgccuguaaucccagcacuuugggaggccgaggcgggcggaucaccugaggucagccuggccaacauggugaaacaccaucuguacugaaaauacaaaaauuagccgggcgugguggugggcgccuguaaucucagcuacucgggagacugaggcaggagaauugccugaaucugagaggcacagguugcagugagccgagaucacaccauugcauuccagccugggagacagaacgagacuuugucucaaaaaaugauaauuuuauguuuguaacaguuacagaaauuugcugcaucuaaaaaaaauagaugugcaaaauacaauucuccaguauuuuaaauuuugugugagaaacagaauaaugacagguagaugggauguaugguacacuggguuugagugagccauaggcguguccugaagagccaaaaggccccaagccucuguggaaugcuuuuguacccaagaaguccugcagaagaggagccgcaggcuccuuaggggaagaaauguccauucugcagggcucacuggguaacuggagcagaaggagggccauuagacccuaguaucugugucugcgccuagggguggagagaguggugucugcugggagcacagcggggcucaggggcuuuugaguccgggaagggugaucuucacuccaaccugcuucuugggaccaggugaggcuucgagcucugaggaagagccuccauccccagaugauaaagagaaccaggccccaaaacggacuggcccacaucugcgcuucgagaucagcagugaggauggguucagcguugaggcagagagcuuggagggugaguggggggagugcaguggcaggagggagaguguccauaaaacaccauccugacucagcucuggcucugcugucuccccaggggcguggagaacucugaucgagaaagugcaagaggcccgagggcaugcccgacucagacaucucuccuuuagugguaaggagugggccccacagggggcagggagcuggaugucuccccgagggcaccaugggcccuccacaugacagguguguccucaacaucuccccucaggaaugaguggggcgagacuccugggcauccaccaugaugcugucaucuuccuggccgagcagcuccccggagcccagcguugccagcacuauaaguuccguuaccaccagcagggagagggccaggaggagccgccccugaauccccauggggcugcucgggcagaggucuaucuccggugagaggucuggggugugaugccugggucagggcgccccuaugagagcucuugagggugggaguuaacuguagagguuggaaacugaggccuggggaggagacacuaggucacuugaagaguuauuucuagaguuagccaggcuccguggcucaugccuguaaucccgccacuuugggaggccgaggcaggaggaucgcaugagcccaggaguuggagaccagcguaggcaacauggcaaaaccccaucucuaaaauaaaaauuuaaaaaaguuauuucuagagcugacaucagaaaaaugaaccccacccauuucccuguuagcucugucuucaacaguauauuccuccuuccccugcugccaccugcaggaagugcaccuuugacauguucaacuuccuggccucccagcaccgggugcucccugagggggccaccugugaugaggaagaggaugaggugcagcucaggucaaccagguauggagugugagcuggggggcgggugguggucuggaagggucuuagagagugagcaggggugagagaggucauucugagcaccagccugggugacacugcugucccucaccagacgugccaccagccuggagcugcccauggccaugcguuuucgucaccuuaagaagacguccaaagaagcugugggugucuacaggugagugggguugggggggaggaugccccuuggguggacggacaggugcacuggguaggggguacugucugguuucugucccccuccccccugaguucccuguucauccugcccugcagaucagccauccacgggcgaggccuguucuguaagcgcaacaucgacgcgggggagauggucaucgaguacucuggcauugucauccgcucgguguugacugacaagcgggagaaguucuacgaugggaaggugggcucccaguggcugugggaagacagugggugaagcgagccuguccgcggggacagagcaccugaucuccccaccucaucccugcagggcaucgggugcuauauguuccgcauggaugacuuugauguaguggacgccacgaugcauggcaaugccgcccgcuucaucaaccacuccugugagcccaacugcuucucucgggucauccacguggagggccagaaacacauuguuaucuucgcccugcgccgcauccugcguggugaggagcucaccuacgacuacaaguuccccaucgaggaugccagcaacaagcugcccugcaacuguggcgccaagcgcugccgucgguuccuuaacugaggccguggcugcccaccacgaccccucacaccuccugcugccgucgcugccaucuugccccuagccugggggcucccuagccccucccagagcaucucacccccacccucauguucaggguggaugugggcaugcaggugacaagggcccugccuccaccccuccagcccauccagcaaucgcccccuuucugcccugggggcccaggauguagauauuguacaaagguuucuaaaucccuucuuuucuaugcacuuuuuuauuuaagagguggggucccaggugggaacccccccacaauaaagucugucaauguuuggagagguggucuucccau

SEQ ID NO: 15114 - RNA, 1112 nt, Homo sapiens
ggcugcccugcaguuccuccgaagcagccccccgcaggggccuggagaagcagccgggcccuccugccccaugcuccuucccccgagcaguggcguuacuucugggacuugcccccuugcguucuugccgcacacacugucuucaggccaggaccccuucccaaguaaccggucaccagcggauuaagcaccacacuccaggcacccgugaugagccccagcuuccgccaggagccuccuagauugggguacaggaagcuggccacguuggaggcguuguaggguccuacgcagagcagcagcgugaggagggccccgccggccacccaggcggcccgcagcuuccgccugugcgucaggccggagcgggccagugcccggaggcagcccacguagcagaaggcugugauggccaagggcagaaaaaagagcaggagagagaggcugaagcgggccgggccggcagaggccgggucccaggccuccaggcagaccggagagccguugaccgguguguugaugcccagggagguguugcugugguccagccagccuccuggagccuccaacccaaagaccagacccaggugacacaggacgagggcccagauggccgcgcacaccccccaggaauagcacggccuccggaaggcuugguagcccaaggggaaggcugcucccagguagcggccugcacucagggcggccaggaagcccccgccggcauagagugggaagaagugggccaccgcgaagacggggcacagcgaggccggcagaggccaggccccggaggcuagcgccuccaccgccuucaggggcagagagacugucagcagcaggucggagcagcccagguucagggcguagaccaggcuaggggugagacggagccgggcgugggccgucgcgccucggauggccaggacguugagcgggaagcccagcgcaaaggcggccacauagaggccgaaggagagcugcgggggcagguccauggggccgccguccuggccugcacggcuccugugugcaaccuggcucccuguccucagaucuuggggccccggagaggaggggcuccugggaucacucgcggguuccagcccugu

SEQ ID NO: 15115 - RNA, 4339 nt, Homo sapiens
uaagcaaauguuugaaaacacauacccacaggaaugcugcacauuuuacccagcuacuaugucuagggucguaucuagcacaccagcauggcuacuguggagagcugggacuggaugugagaugagagcuaaaggggaaguaagcaaaccaagcaggggaagguaagagaagacagaagacagagagagagggaccuaacucuaugagaggagucagacaugugcaauugaaaaagacuugcuccugucucucuucugugaauguuugugaauaucccaacgggacacuuucacagaggagcugauugacguggucacagccaucagccuugggacaccagaccacaguguguacacuaaguggcacugauggacacuucagcaucccucuagcugcugucccguuuccccuccucggggaccacagcuguugccaguccuugguuuccuucaggagggugucuggguagaccagccugugugcacacaguccaagauacaugaacagugaagugccaggcaauccuugcaagcaugggcagguggagagcugaggccugcuugacaccuuccugcucagaagcccagugagcaguuucccucccuagggcucagugucauccccuauaaaauggggcuuauggcagagcucaccacacugggugcaucuggggauuuggcgagcucaugugcacaccauugagcauggggcccaaccuauauaaaauauucuacgucugucagcugcugggcacugccacuaucagccucaguagugacugagggacagggcaccagucagagcccuggugcacacagagugaccccagagaagcagccuucccucucugaguccuguuuccuucuguuagguccugacuucauggguuguuguuagcauuaaggaagucgcuggcuaauuuuauagucauugaagucaguggugugcaaccugguuccucaaaggaucacuucccugaaaaaauuccacugcucccuggaggcuuaugcaggccaucccauccccucccucuuguuguguucagcugacagcuuuuugcucagugaguaaguguuagguccauuucacagaugggcugcaaccaaguuugcagugaacccacuaagaccagagcuagggccaggacuaaaugcuggucccaaugccacauuccccuguccccacaccacauuuccuccauccggagacccuguuaccccaacccagggccccauuaacucccuggcagaggcccuguuacaucugcugcugccacagccuccgcccacccuucaggaggcagcaggucccacugcugaugauaaaguugcaggcugccugagcuaaugaaggggcuuccucuaggcugugcacuuagucuucugcuuccaaaccaaaucagaggugaggcacccucucugggcccaucucucuccuccauuuuccuguuggggucccagggaggaagccacuugccuagggcccaggaauuuugcaagccucuugcccuagggaggaaggaagggaggaggaucuuaccuugaacugucaagccuagagccugguggggcaggcagaaaugggugcaguccaugaguuagaaacacuagaggagacacuuugcugcuuggccggggcaggcaaguuaauucccgaggcuccugccacugcaucucaaucuggaaggugaccaggugggcaggacccacgucucccagaugacucauuuuuucuagaacaggggcuuggcugccaaagaggauacuugauuucggcuuguggggacagugguggacccagcaucugggcuuuauauaaagggcagcuuuguugcccuguaaacacacagaccauggguggccacuucuuccaguaaguuagcuggggaguuggaaguuuagguaaaaccuuuugauugacaaauguuggcgaauuaccaugcuguuaaaugaaacauuguucugccacccuggggcugugggugccugcgugcacccucugaaaaaucacacaggaagugggguggggucucugugaagcuggugucccccagccucagggaugcugcagaaauggaaugaggaccaacagggacucagauguccaaggaagcucuacagcggagaggacggcuugggaaggagguccaggcccaggucccuccggaacccaauggguauggggcagccuggcuccugccucaucccccuucuccuguugauuguguccucacaguguaugccgccggcaaagcagccaccucagguguucccagcauuuaugcccccagcaccuaugcccaccugucucccgccaagaccccacccccaccagcuaugauucccaugggcccugccuacaacggguacccuggaggauacccuggagacguugacaggaguagcucaggugaggccgggggaagcaggaacagcuggugggagugugcugggcaucuggacacugaggggcaggggcuggaaggaagagugucuugggagccgaggaggggcucugcuccuggugcgcggccacugacagccacucucccccagcugguggccaaggcuccuauguaccccugcuucgggacacggacagcaguguggccucuggugagaauccaucgucccgaaguuggaugugccuguaagggagaggggugggccaggauccauccucccaaaccgaccaccaccccccugucccuagaaguccgcaguggcuacaggauucaggccagccagcaggacgacuccaugcggguccuguacuacauggagaaggagcuggccaacuucgacccuucucgaccuggcccccccaguggccguguggagcgggguaagcaggagccuuggggucugagggcuuuuaaggugggggggugaaacaugucucccugauaccugccgcagggacucuuggugcaaacccuggaccccgggcuccuccagcagucagugacaccccccuucccugcagccaugagugaagucaccucccuccacgaggacgacuggcgaucucggccuucccggggcccugcccucaccccgauccgggaugaggagugggguggccacuccccccggagucccaggggaugggaccaggagcccgccagggagcaggcaggcgggggcuggcgggccaggcggccccgggcccgcuccguggacgcccuggacgaccucaccccgccgagcaccgccgagucagggagcaggucucccacgaguaauggugggagaagccgggccuacaugcccccgcggagccgcagccgggacgaccucuaugaccaagacgacucgagggacuucccacgcucccgggacccccacuacgacgacuucaggucucgggagcgcccuccugccgaccccaggucccaccaccaccguacccgggacccucgggacaacggcuccagguccggggaccuccccuaugaugggcggcuacuggaggaggcugugaggaagaaggggucggaggagaggaggagaccccacaaggaggaggaggaagaggccuacuacccgcccgcgccgcccccguacucggagaccgacucgcaggcgucccgagagcgcaggcucaagaaggugagggccgcccucccuggcguccagaccgucccugggcccccagccgguccccgcggcucauacccuucuuucuuucucccuugcagaacuuggcccugagucgggaaaguuuagucgucugaucugacguuuucuacguagcuuuuguauuuuuuuuuuuaauuugaaggaacacugaugaagcccugccauaccccucccgagucuaauaaaacguauaaucacaagcucuggagagaaccauuuguucggccgcgcggggcgggggaccggggcugcucccguaugcgucuguaaagcgccgcgucccgggggcaccggaguccggggccgggaggaagagacccagccuggcccggcccgcgcccgcgccgccggccggagaacgugccccgcgcagccgccgcccgccugcgugcgcgccccggccccgcccaggcgugcgcaugcgccccggcccuccgccuucgcgcaccgcaggcuggccguccgggacgcgcgcgcgcuccucuccccuuccagcccaucccccccagccccccaccgaccuacuuuacugucuccaaacucgggcagcccaccuggcccccgacgaccccagccccugcaccggguaccccgacguuccauccagacccgcguuucaccagggcggcgcgcggcgaccucgcgccccgcggagccccgggcucgcgcgcgcccgcccgcccccggagacagacca

SEQ ID NO: 15116 - RNA, 15558 nt, Homo sapiens
gguguggguaggggugcagaacugaaccugggguagcucuccccugcgugcccggagucgcccccucuucauucuccucccccagugccccgagaugccccccuucaaucccuucuccuuccucaacaccuccggauuuguccuuucccuuccuccagcgaccccagaauagagcccucccguuucucccccugcucucucagaggcguccacucacccuagaccugccugccccauccccguucccacccucucccaccacuaugcccucaccccugccccccgucgcccucagcgauucccccuccugcucccaccccgggcucugaagccaggaaacccaagaggaaaugacugagcccgucuggguccccgcccgcucgcgcuccccuggccacacccuccgccuggacgcagcagccaccgccgcgucccucucuccacgaggcugccggcuuaggacccccagcuccgacguaagucccucucgugcgccaccuccauccgcugccccucugcccacgggccgggcucagguggguagggguuugaccccuuccgcuccucuccgccccccauccacgcccacaucucucugccuccucuccugggcuacagugggccgcucugccucgcucccgcccgccugccucagucuccccagcucucugccaccccccucggaccagugccucuuaggucucuccagcgcgccaucccugcaaggcggccccugacaccaacucacuuuuuccucugagcgcgggaggcguuacucacucuuccuccuuccccuccucgccgacucccgggcucugggccccugggggagggaagaggccuccuaucuacuccucugccccaguccccuccuugcgucagucccagugagggauaagcgccuggcggaaggcgcagggagguguuucucugcuucaggagugcccgccggcccuugcagcugcuggaagacccauuuaucucaugcuucuuguuuucuuuggggaccugcaggggaaggaagcagggugacgguuugguauccccaccuaagacccuccccuuuccccugaggccagccgucagccccuggcagggggucuuggaagccagagguuuuugcucagggcagggaaagggcugcaggauccccgggggcugccggaggucggucucacugacaucauggcugaccccagcaucgccuggucccacagaugucgcccucuggucgccugugucuucucaccaucguuggccugauucuccccaccagagguaagacccaucucuggccuccacccugccccagagcccccagccaggccagccccacgugugcugcggggugggugguuggcccgugugaacguuguccugcccugucacccucccgcugagccggcaccaggaaguggggaucccuauggcggggcgacguuacacccucuuuggacaccucagacccggguggcugcuuccagugagucuggccagggccuguccugcugagcauccuccaauuucaccuccaagaagaacucacugaguuucauuuggcggggagauuggugucgguuuucuacucagcagccaggaaaccuaggcucccagaguccccaggcauuacacaguuaggcaaagcuguugagcugggguuaguccaaagaguuggcaacaucucagccuugccuggaaagugucuccugaaagaugggaaccacagggggguauugaucguucuuucuguguggcaggugugguguguguuaggucaguuaggcuuugccucugacagucagucacaccuguugucuugcccauuuuacugaugaggaaacugaggcucagcgaagggaagugcccugugucagaggagaauggguggaggagcugagaaaacaacuguccugccugcccccagaacccagggugcaugccccacugaaggcgcccucauuucuccuucauaaaaugauuuucauauacucguucagucauuugacaaauauuuauugagcaccuacuaugugcuagauauucugugcacuggggaaacagcacugaauaaaacaagaggucacacucuaguggagagagacaaguuaguaaauuauaucgugugcuaggaggugauacgugcuugcagaaaaguagagguaaugaggauuguuuaaacuggguggucagggagggccucacugaggaggugacauuuggaccaacaaacacuuggaggaaaugagggaaugagcuuugcaggugucugggggcugaguguugucugguguguuuuaagaauagcaggcaggugggguggcuggguugggaugagaaggggcagagugggaugacgagaggacagagaagugaugggaccagauggaggaggacuuacgggccacgugagggcuuugcuuuuauguggagugaagugcagccagggcagggcucugaaccaggcgggccccgaccugacucagguggucccaggcucccucuggcugcagguuggaacagacugugggggcggagacaggagcagggagcccaagaaggaggcugcugggauguccaggcuggaggguacagaggcaggaccaggaugggggcaguggaguuauccagcacugaccacaugguaagccgugugggagacccuuucccugcucugugucauuucacccuaucuacagcccugugaaguagauucaguuauuaucccugcuuugcagaugaagcaacugaggcucagagaaaggacuucacuuguuccaggucacacagcaagaaaguuguugggggcaggauuugaaaccagggcccaggcucacccuagcaccugggcucacuagacuaaacugacuuucccaucccacagggaugggcggggagggggacuagaagaaggguucccaggcauuggcauagcugaaaacacuuucagaauuauggauugaugcagccaaagcugagugauuccaccagcagacaggaccccuaagguuucaccagggaggcgagggcggggguggugagaggagggggaccaggcucccuccugacuucucauccuugauuccccaggacagacguugaaagauaccacguccaguucuucagcagacucaacuaucauggacauucaggucccgacacgagccccaggugaggaaagggacacaucuaucaagauccugucauugcaaauaacaacagcaacaaaaaucccaaacuuggaccaaacaagggaauuuauggauuuauguaacgaaaaaguccagguacagaccuucaggcauggcuugaucuaggugcucaaaugaugcuaucagaaccucucuccaccucuugguucuguuuucucuguguuggcuucauuuucaggaagagucuccucucauggggccaagaugaucccuugaagccuggggcugucauccugucugcuaagaaucccagcaagagaauuuccuuuccccaguccagcaaaugucccagaacugaguuaucuuuggccaggcucaggucguaucccugagcuggccacuguggccacaggcauagaaagcugauuggccaggccuggguuccauguccaaccuccaccagggcuggugucagccccgcugaauaaaguggaccaagagucagggaaggauggucccuaaaggaaguucugggggcuuuuaucagagcaggugcauuugggaagcugaguuaaacauguuuuuuuaggcagcacuucucagagucuugagaaagacaauuugcagccagcaucucgaagaaggagcuguaguguggcaucugugggacguaaggucccaaagaaggggacauauugguuacacauuucggcaguuagcaaauggcuggauuaauuaagccauuucuauuacauuaaaguugaguugcuacgggaaucucuggcaucuccacccauagaccuugcccacuucuuuuucucucuccuuuucucuccgugacuccuuguuucuggacuccagaugcagucuacacagaacuccagcccaccucuccaaccccaaccuggccugcugauggugaguagugcaggggcaggcggcggggacaggaccaagacaaacaaaguuuccccucuuccucugacacuauaggucuuugguugcccauuucagucccuacucccagcucugaaugcccugguuuacucuggguggggacagccaacuccauucaauucuuuagaaaaagaaaaccaaaacgcuuuugaaauugugaaauuaacaugcauauagaaaaauacaaaacccauaaauuuacaguguaauaacuuacucuaaauugaaucccuauguaacuaccaaccgggucaaggagcagaacuuugcaaacacccccagaaagucucugugugccagucccauuuauuucuuccuuucaucucuuuuuucucugaucccuuuuuugaauuuuuugaacaauuuuuggacguuuucuugaaguauaauucaaaaagugcucccggccaggcacaguggcucaugccuauaaucccagcacuuugagaggccaagguggauggaucacuugagcucaggaguucuagaccagccugggcaacacagugagacuccaucucuacagaaaaauacaaaaauuagccgagugcguuggcgugcuccuguagucccagcuacucgaaaggcugaggcaggagaaucacuuaagcccagaggcagagguugcagugagccaagaucuugccacugcacuccagccugggcaacagagcgaaacccugucucaaaaaaaaaaaaaagugcucccugauuuuuucaaucgauguuuaaagacacaguaguacaaaaacacauucugccuggaaagaauaaaaugauuguaggcaaaacuaaaccccuuugucaccuccccuccccaauccucguucucucccucugucucugagagguccccacugucagcauugggguagguccccagugauaccacaucccauguauauuacuuggagaaaaugcacugacugugugcuguguuugugugagcuuaaggagaccuuaugauuguucugcagcuugcuuuguuucuucgugcagucguauguuuggaaguucuucucacaucacugcauaaagacuuguuuuguuuucucuccugccugguauuccacaaggcgccuauaucacagcuuauggagucacacacuucuugaugaacauguuggcuguuuccagcuuuuucugucuacacacagcaccacaaugagcaacuuugucccuuccuccuugagcaaacgcacuuggaauauguacugacuaugugcuggucaugguucuaaauauuuugcguauguuaacucauucaaccuucacgcaaacccuaagaggcagaaauuaccauuguccccauuuuacagacaaggaaacagaggcugugaguaacugguucaaggucucacaacaagucagggacgcagcuggaaucgaaguccaggaaucuggcaccagagccugugcuuuuauccaagacaauacagggcaaaggacaugcaugcuuaauguuuuaaaauuugcccuccugccgcccaggcacaguggcucaugccugucaucccagcacuuuuggaggcugaggcggguggaucgcuugagcccaggaauuugagaccagccuggacaacacagcaaaaccuauucucuacaaaaaguacaaaaugauuagcugggcaugguggcaugugccuguagucccagcuaccugggaggcuaaggcgggagaaucacuugagcccaagaguucaaggcuacagugagcuaugauugcaccacugcacuccagcucaggugauagagugagacccugucucaaaaauaaauaaaaguaaaaauaaaaguuccccucccaagugacuguacccauuuccuaacccaccagcagugugcaggagugucccccuucccaacccuacagugacacuugguauacugacauuuucagguuuugccagccucuuagguuuuuucugagauggaguuuugcucuuguugcccaggucgcugugcaauggugcaaucucggcucaccacaaccucugccucccagguucaagcaauucucccucagccucccgaguagcugagauuagaggcaugagcgaccacgcccagcuaauuuuguauuuuuaguagagacaggguuucuccauguuggucaggcuggucucgaacucccgaccuaagguaaucugcccgccucggccucccaaagugcugggaauacagacauaagccaccgcgcccggccccaauucucuuuccccagugacucuuucuuauccuucccuccuugcucuccugaccugaauagaaacaccacaaccccagacccagacccagcaacuggaaggaacggaugggccucuagugacagauccagagacacacaagagcaccaaagcagguauagcaugggacugagagcagcagccuacgauuuuuguuuaauucucuaucuaggucaacauuucccucaguacguuucucagugccccuguuuggggaauuguuaauacauuuaaaaaaaauguuuuugguuuguggucaaaguuauuuggggaacccugaguuaaaguuaaccauguuucuuuguggcaggacuucugagagucuucauuaagcuaauuuucagcaaaggauccccaaggggcagcgugcaguaugcaguguuucccuaacugauagacuuuggaacuuucuuucugucaguuccccucggagggcuggggcuauagaaugugccuguggauauuucuuuuuuguacaucuccuuaauguuagagcaggagcuuuucaguugcaaaauauagaaaauucaccuuaaacacacacacacacacacacacacacaaaagaaugauuggcuauauaaguucuggaaaguccagaaguagccaacuucaggcauagcuggaucaaggcgaguaagcacugucaugagugcuuuguucccucucuugguucuguugucuucauucucuacuaacuucuccccucuugauggcagagauggucccauaguucuaacuuuaggucacauacgugguggcuagagaacaaaaucuuucccauuauuucuagccugaggccuagaauugacucucauugguucagcuggagucacaugcucaugucugaaccaaugagagccugagaaaugagcugcucucauuggucaggccugagucuugugccccacccuggggcuagagaagaggcucagccagccaugccugaaccacauagaccaagagucagggaagaggggauuuuccuuuggacaagugaguuaguauuaccagaaggugugggaaaggagacugagcugagauaaggcaacagaucgccucuaaugccugcgugaugauccuuauuugaggggcagccccacacuggaaaguguuguagaguaggccacucccagagagacauguacaguugugcagacuggguacugaacgagagcaccaccucucgggcaaugccauucccuuugucggucuuuauaauuguuccaguuuucuagugauagcagcaaagcaucucauucuuacagaaucuaucuauuaaaacaauccuacaauggauggaaauaaagugcuuuacagaagggaacuuuucuaguuuguacaaaagugcaccuguaggggugggggauagcagcuguguccacacuuaucaaugauaaagcauucucacaucacugcauuaauuuacugagucuuugcugaccugaguugcucuauguauugguccauguuccuggauauaugugacagaaauucaucaaggacaaauggcugucacugcugagccucuggguugccuagaggcugggcaugaaagcccccagggccucucuuccuccucuaucuuugcuucucuuccaccuaggaaggaaauggcucauguuauuugagccuccuagcucaaaacuuccagacuucaccuaggguuuuaaucugcucagguuacgauaacaaaauaccacagacuggauggcuuaaacaauaggaauucauuucucccgguucuggagaugggaaguccaagaucaaggugccagaaggguuggugucugucgagggcuccccuugggucacagacagccauucucuugcucugucuucaccauguccucuccaugugugggugggcuugugagcuugaaagcaagcucucuggugucuucuuauaagggcacuaaucccaucaugagggccccacccucaugauccuaucuaacccuaauuaccucccaaaggcccucgcuccaaaauaccaucacauggaauuuggugggguggauagaauucagucuauaguaccuagcugucacucaauaucccuacuugggauuucaaaggucucagggaaggaccagacugaggucacaagcuuccuuuuguagccuggguuauaacuggggaagggagggcaaugucuucccacaaagaaagggagagcuguuccagaaggaggaagagugcugagcagacaguaauagcaauggcugacuuuugcugagagcuuguucaugcugggcacugugcuaagcuucuguguauucagucauuugaugcuugugaucauccuguguggugggaacugucauuacucccauuuuacaggaaaaggaacugaggcccagagagguuacucagcuugcccuaggcaauacagccaagaguggcagaaccggaauuugaguccagacugucucaccccagggugcaugagcaccacacaccaguauggcuguccuucgcauuccuguggucucugccguggaucuggcuuauaccuuccucugggcaaugcauucccugaauaucuuguaauccuugguugccaguuccuauuuaggguguggggcacugagauaauuccagggaacuuggguuucacgagggagcuucucugucugcuggcuucuuguugaggccuccgauguggugugggggcacuucucagugcuugggggaggccuuuucuuuggagguacugauuuuuuuuuuuuuuucaagagaagaauccuuugguauuuucggucugggggcagaggugauauucagaauaguuuuguuguuguuguuguuuuugagacagaguguugcucuguugcccagacuggagugcaguggcgaaaucuuggcucacugcaaucuccaccucccgaguucaggcaauucuccugccucagccucccaaguaucugggauuacaggugugugccaccaggcccaguuaauuuuuguauuuuuaguagaggcgggguuucaccauguuggccagacuggucuugagcucuuggcuucaggugaucugcccgccucagucucccaaagugcugggguuuacagacaugagccacugcacccagccaauauucagaauguuuuacaaguuucuccagacuauguagcugggucagaguccuuggcagguguugcccuuucguuccuuuaucuccuggauuauagugugggccagaagguccuaggagaggggucuggagucccucggggauugaggcagaucagauagucgcaaccggggcuaugugcuuauuucagcauuucaaugccugucauuacuuauugccucuagguguggaguaggggggaugccugacccugcacaccagcuguguagaugugggagagggguuucuuccagaugcagacucucaguaauaucccuuguuucugccuccauggcucacuccugcccuccacugaucuggccacucucucagcucaucccacugaugacaccacgacgcucucugagagaccauccccaagcacagacguccagacagacccccagacccucaagccaucugguuaguaacugccuccccagacuggaaacaggcuauuuucuguucacuguguauuuccagcaccuggaguacagcccagcacagaauaguucucaguaaagacgugaugggaaaguaaaugacuucaagccaggcagagggugggcacaugauaaaugucugaauagauaagugaaugcauaaauuauugcugcauacaaaccaccuaaaaacucaguggcuuaaaaggauaaccauuuauuuagcucucauuucugcaauuuggaaaucuagggugugcucagcuggcugguucuucugguuucagcuggacuuacucaugcgucugaggucaguugugggucagcaaggaccucuguuucuaggggcaauuugauucuuucccuggugaucuuauccaccacuuccugcccagucagccccccagugaaugaauggaaaugauacgcccaugggucacauagagagcccauucauccauucauucaacaaauagucacugaguacuugugugcuaggcuaguucuaggggacagagauagaguggugaacaagccagaaaaaaucucugcccucauggaacuacuauucuagugguaagagaaacacaacaagaaauaaucauaauuauguaucaguugauuucaacuugcuaucaagaaaaguaaaguaggguuagagagugacuggggaguacagguugaguauuccuuauccaaaaugcuuuggaccaggagacuuucagauuucagauuuuagaauauuugcauuauacuuaccaguucaacuuuccugacccaaaaaucugaaguccaaaauguuccagugggcauuuccuuucggugucaugucagacuguuacuggaaagggguuccgauccagaccccaagaaagggcuguuggaucuugcacaaaaaaagaauucagagaguccauagaguuuauuuagaaaguaaaggaauaaagaauggcuacucuauaggcagagcagccccacaggcugcugguugccuguuuuuaugguuguuucuucguuauaugcuaaacaagggguggauuauucaugaguuuucugggaaaggggugggcaauucccagaacugaggauuccuccccuuuuuauacuguauaggguaacuuccugauguugccauggcauuugaaacugucauggugcugguaggagugccuuuuagcaugcuaauguauuauaacuaauguauaaugagcugugaggaugaccagaggucacugucauugccaucuugguuuugguggguuuuaacuggcuucuuuacugcaaccuguuuuaucagcaaggccuuuaugaccuguaucucgugccgaccuccuaucucauccugugacuaacaaugucuaaccucuggggaauacagcccaguaggucucagccuuauuuuacccuauucgagauggaguugcucugguucaaacaccccugacaugacaucaaaaagugucagauuuggggacauuuuggauuuuggauuuggggauuagggauagucaaccuguauuucauauacaaaaccagggagggccccacugggaagggagugaaggagggagccaugcggaugucuagggaaaguguguuccaggcagaggaaacagccagugcaaaggcccugaggugagaaggugucugcauguucaacagcagggaggccaguagggcuggagugcagggagugagggggauaggaaggaaaugagauuagaggaauaaugggagccagauugugugccauggugaagauuuuggguuuuguucuaaggguacccagguaucccccuuuccugacuuugccauucacguauucacuucacaaaccuuugcugaacccugacuugcucuuugucugccucuccagguuuucaugaggaugaccccuucuucuaugguaaguuauccacaggaagaugugggggaaggaaaggugagguccgucugacucuaccccuucauuuuucucucugcagaugaacacacccuccggaaacgggggcuguuggucgcagcugugcuguucaucacaggcaucaucauccucaccagugagaacugggguugggugggaaggacaccaagaccaggagggggacuuaugacggagggcuggguucucaaaggucccugggcaauuuuguuuuaaaugagguaucuauuagcugcauauacauacaaaccaccacagaauucagugguuuaaaauaaugaccauuuauugagcucucaauaccacaguuuggaaacauaggcugggcucagcugggugauucuucuggucucaacuggauuuacucuugcaucugaguucaguugugggucagcaggaaacuuuguuucuggggugccuuggcucuuugccacaucaucuuauccuucacuaagcuagccugggcuuguucgcauggugguggcagggaucuaagauagagugaaugcaugcaggcucagaacuggccauuaucacuucugccucauuccauaggucaaagcaagucaugaggcuggguuucauucaaggaaauagacuccaccucuugaugggaagauaggcaaagucacauggcaaaggacauggauacugacagggagggguagagacuaagggccauuuggcggucagcauaccaccccagcagucacaagcccacugcacccaggccuggcagggaacaagggcugaaaaaggcugugucaggaggagauaacugaggauuaaaugccucauggaacaaccccacccacucaauccagcaagaauagaggcuugaagcagccagaguaacuacucuuuuaagagcuuaauguuucuguaaaaucuuuugguacucaaauguugacagcuguguugaucagggucauggcagguggcagaaggaccugcaaacgauuaacuggagaaaguuuaauagagugauaucucuggagguacaggcagggcaaugagauggugcagugcccuaggacuagcaaggauggggaccuguuaucccccagccugagggacaagaggaggcacuggcuuugcaggaggccuggugagagauggaacuggagguggggcugcuggcaggagcuguggccucagaaagaggguuccagccacugccucacuugugaccaaaccaggagggagcaggggugguggggaucagauaccuaaaccucccucuccucccaccccccugucuccugccaaugcuuaaccagagggcaaggggcccagggccccaugcagggagaggaaguuguggggaaaggcagaauaacaagcagagaaacuaauuuuuuaaaaagguuuuuaaaauguugugggugaaauaaaacacgagcuaucaguuaaucuguauaaccaaugccaaguuucauuaccucucuuguccaacuuccucaucaagaaaaugagcauagccacaucuuuuuuugccuuaaggggagaggcagaauucuaacaaucauaagacaugauuccugaugugugcgugauccccacugaaucugagagucaagcacuguugccucggucauacaacauguauguguugauccugacuuugcaccagguccuauucucaccccaguggagaaguuaaggcucagagaguuaaggaguuugccuaaggucacacagcacagaagagucaguaaauucauuugcuggcgggacacgguggcucacuccuguaaucccaguacuuugggaggccaaggugggaggauggcuugagcccagggguucaagaccagcaugggcaaaauagcaagacccuaucucuacacaaauaauuuuuuuuacuuaaaaaaaaaaaagaaucagugaaggauuggacccagguuugugugagagcagagccugaacguuagcucuggggccauguauuuuuccaacagcaaauauuugugggcuccuagucugugccaaaccugugcugggugaugcugggggcaugguggugacaagcagcccuggucccuguccucaggagcucacaucuggucgaagaugauaagcaaauaaaugcaugaaugaguggauacagagaaagauauuugccaaauaaagcagagugacagggaagagagggguggggagagaagcccucccuggaguggugaaauuggaacugaucccugaugaugagaugaaucaccagguagagagagcagcaagugccaagcccuggaggcaggaaugagcugcgcccauugcuauagcagcagaggaggcaaaguagccaggacaggguagguugggggagaggagaagacgaggccagagagcugaggggcuggaggaggcaaggguggcagguguuuucuaaaguacccuuggcuucuaaguucccccucccucacucuggagcagccacagaugagucucuggaacccaucuguguccucguaccucaaggccuuugcgcugcuguucccucugccuguaacacccuuccuccaggugucucccuuacguccuucagaccuuuguucaaaugucaccuccuuggcaggccacagugguucacguauguaaucccaggacuuugggaggcugaggcagguggaucccuugaggccaggaguucaagaccagcuuggccaacauggugaaacccugucuuuacuaaaaauacaaaaauuagcugggcuugguggcacaugccugucaucccagcuacucgggaggcugaggcgggagaaucgcuugaauccaggagguggggguugcagugagcugagauugugccacugcauuccagccugggugacacagcaagacucugucucaaaaaaaaaaaaaaaaaguaaccuccucauugaagccccaguagccaucccugugaggaugagcccagcuccugggccuccaugccuccuuccuggccuuauuucccuuuguaggacuuaacacccucccacuuagcaccuucauacauuugauuuuguaauuuuucuccuuguuggucuuuccccauagaaagacaacucugccagggcagggauuuuuuucuuuguccucaacuguguucuuagugccugaaugaaugaauaagugagauacaaaauaaugggaguuuccaaacggcucaucugugagccugugugggaagggccucucgcagggccccagcacuggcuguucucgguguguuucuccaucauuuguuuauggaguugccuuugaguuucccgaggggcaggguugaucaaucugguuccccagccccacaacacacgauaagaaucaauaucacucuagcucgugacugaaucauuuccuucacccacagguggcaagugcaggcagcugucccgguuaugccggaaucguugcaggugaguccaucagaaacaggagcugacaaccugcugggcacccgaagaccaagcccccugccagcucaccgugcccagccuccugcauccccucgaagagccuggccagagagggaagacacagaugaugaagcuggagccagggcugccgguccgagucuccuaccucccccaacccugcccgccccugaaggcuaccuggcgccuugggggcugucccucaaguuaucuccucugcuaagacaaaaaguaaagcacuguggucuuugccccaggaucu

SEQ ID NO: 15117 - RNA, 11052 nt, Homo sapiens
cacaucgguccguccugcuuccagcugcugcagcgcgccuucgccgccaaagcauccagcagcccccugcuccggcccagcauggcgaccccgacccagacccccacaaagggugagcgucguuuggggaggggguugcaggggggcuccgggaucugagagccuaggagagagggugucgggagauucaagcaaugguaaggcaagggaguugggggagggagguccgcuccuccugugggcggaagccccuguaaugcgcccccccgaucgccccuccgggucucugggacacccccuccccggcaggcguccugugccagaccugcgguuggagaguggcagucccgggagaagggaugcucggacaggucgcuauggcaaccggguggcuggucccgcaccguggugguagcagacggggaagagaugagcuugcagggugggagcgggugggucugcgaccagagacguucuggaagauuucagggucccuggggugggcaagggaaggggaggagguucaugucccucuucuuuccagugcugucuccuagggugucuguuuccugaaacccuugacagccagguucagaggaaaggagugagagcugaaggaagagacagagagaagggauauagcaagagacagacagggagaaccuggaagagacagagaccaagagaggcaggagauccagagucacagauacaaagacccaggaagacaaauagauggacucagagagauucccaguggaggggagaggcugagagcaguagacagagaugcagagagagagagaaaaaaaaaugagagccugggagauagugggauugagaccgcuauggagagagaagcagagagacggagggagagagacggacccauggggagagaggggaguagaaagagaagaagggagccaugugggguggggcccaaaccacugcagugagacccuaugugugggaauggggcgaugggacccuccuuccagcccacagcagggguguuuuccaaucccagaggugcuguuggguauacaccuagcugccccuacugcccccauccagccacacacugauuuccauuccacaccaauuaacccaguuaugcacccacuuaaacacccacuucuaccgucgcccccuaauagcccccacugcuaauccugcuucugcagaugagcaaggcacagacugcuucaagagggagccagugcccagcaagggucuccagcacugagggcaggggaccaggggugcugagaagccccuggcagugaagggaacccgaauuccacuuggauggcucccucccuuccgcgcuucccagcaggcgggggcugcugcacugagccauaucugcagaauccgaagcagggcgggggguggggggggcugcagaggcuggaagcuacccuagggaggggggcagggcugaggcagcaggccuggcgggagcccagggcuucuuuuugcagagguggugguuagcaggaucgauggcagcagacgggcagaggugggaggacagacuccucaacccaaccuccucugccucccccuuucccagucacagcaugacaggggaccgcaggucucgggaaaccccgggggaggaaaagcauguugugcauugcaagcugcuuaaggaaacuaauuaaugaauuguuggggagcgaggggggaagaggggagagucucccuccacccugccagagaacaggagggagaguuaggagugaacagaagagggaugcaugagcacagcuggguccgggucccuaucccugaaauggacccuuagcuuggccagaagccaguccugcaggggcaacggcaggaggugcaaaaggaggggagagggucaagauugaaaccugcaucucacacaggaccucacaggggaccccacccagccugggguggcgggaccuaucaccucucuucaccucccaagaugccccaguugccauagcaaccaccuccuuccugauaucucuuuggcagcuggccaggaguagugcacauuccuuugccugacuccuggccccacccuuagcccagccacgccugagggcccagguugccggggcagcagggaccagaggaggaucuuccgcauggaggaggaucuuccacauggaacaccagauucugggacaggggcucacccagugggcucccgauaacuuuggggaaggacggguguguggaaaacagacaagugagacaauccaccuuuuacagccuccugcagccuaggacugccucauaaucauuccuucauucauucaucccagaaaacuugaagagccuuucauaaaugucaggaugaacagcagugaugagucaaacaaauuuacucucugguggggaaacuuacacagagcacaagggacccugaagcagcgucucaccaucuuggcgcuuuugaguacuaccgucacaauuuuugcuuuauucaaauauuccucacacugcuauuuauuuaauuuuuuuccuuaaaaggauuagcuuuuuuauuuuuauuuuuugagacaaggucucacucugucgccuaggcuggagugcaauggcacgaucacagcucacugcagccucaacauccugggcucaaucuauccuccugccucagccucccaaguagcugggacuacaaggcacuucugcuacacccagcuaauuuuuguauuuuucauagagacugcuuuugcuauguuucccagccuggucucaaacuucugggcucaagcaauucacccacuuuggcuucccaaagugcuuaggaugacaggcgugggccaccaugcccaacccaggauuagcuuuugaaaacaacgagcuuuauuuuauagcaccaucacaacuggaaaauuaaucuucuuuuuuuuuuugagacagagucucgcucugucauccaggcuggagugcaguggcacgaucuuggcuuacugcaaccucugccucccggguucaagcaauucuucugccucagccucccaaguagcugggacuagcagcggcacaccaccacacccagcuaauuuuuguauuguuaguacagaugggguuucaccauauuggccaggcuggucucaaacuccugaccucgugauccgcccaccuuguauucccaaagugcugggauuacaggcaugaaucacugugcccagcuggaaaauucaucuucuuuuugccuuaaguugaaggcagcauaagagcaaucugaagcaggugauuucgcuuuucugggucuggugucccccuuccaggaaauggggaugaagaucgcacccauaugaaagaguugcuaugaagauuaagaguaaaugcgcugauaucugucagaugcuuagcagggaggcuggaauggagucagggcuacccacugcugguuacaucaauaaauaaaggagaaaaccaaauaaugccacaaaauucugccuagauuuuauugccugcugaagacuuggagcccaaggccuguuuucucuuagguaaaggggggagauuaacaaggguuggaaggugguaaagauaccucagcaccaaccuaagccauccucuuugaagacuagacagagaccugggaaggguaaacuuacacauugugugaaccguggucuugcuuuggggccaccucuaucagucaguuucggcuacagcaugcugugguaacaaacagguguugcuuuggggccaccucuaucaaucaguuucagcuagaguaugcugugguaacaaauaguaccaaaagucucaggggcuuaugacaaccagguucacguauacguccaucacagguugaccagucaccaaagaaaacuagagcagucaccacugugaacauucaggccaccaggcuagaagugaaacagagcuuuggccuggaggccugaauguuccugaauguuuaaaugccccagccuggaagugacaaugcacuucuacucaccguuccuuggccagaauuagucacauggcccuacccaaccuccagggagccauccaucugagccuggaagggggaaggagaacaccaacgacaucaggcaucaccuggcaccccucacccucuccccauguggcagacagucugcugccaaauucugcucuagggaaggccaaauauaauaagaacugucagaggcauucgagaaccaucaggaugaacuuguugaaugggaaggauguucugagcucuccugcaggggaacaugauuaggguccaggaaggugggaaguggagaaaagugaauccagagacacacacacauuuuauccacaugugaacauuucugaaaucauuaugugucuucuaauggauggggacauuucacgugguagaguuccaaacauauuuacacauacacacacacacagggaaaacuauuacaaacucaauuuugaaucuuaaacuugauggugccuuagaaauaaguaauaaugggccaggcaugguggcucacaucuguaaucccagcacuaugggaggcugaggcgggcagaucaucggaggucaggaguuugagaccagcccagccaacauggugaaaucccgucuguacuaaaaauacaaaaauuagccagcagugguagugcacaccuauagucccgguccuugggaggcugaggcaggagaauugcuugaaccugggagauggagguuguagugagcugagaucgcgccacugcacuccagccugggugacagggcaaggcccugucucaaaaaaagaaagaaggaaagaaagaagaaagaaggaaagaaagaaagaaagaaagaaagaaagaaagaaagaaagaaagaaagaaagaaagaaagaaagaaagagagagagaaagaaagaggggagggagggagggagggaggaaagaaaaagaaauaaguaaugugggguaugaaucagcacagcuucccuguacuggauggaguaucaggagugaguggaugucagcaguagcagcaggugccugucggagcucucaggugacugagaaguuuuagggaguauucaggggaagcugagacauucauugguucaccaguggaaauggggucuguuuuaaccucaugacaucaugugcaagugggagugugucuguguuuuucagggaaugaguccauagcuugcaucagaccuccauagggguccagaaccaggacugccauguaguuugagaagauuguacacugcauagaggauggugcugacugauggagugaguaggggcuggaauccagcuugagcuaugcucuuccagccuugcggccugccaugaggccacaucauccaaaccaaggggucucuaucugacuuccacaaagaaaugauuaggccaguggcuccaucuggauccuaaaaaauauuaagaaauacacuguuaaguuuuuuuuuucuuucucuuuuucucugcuucuuucccucagcuccugaggaaccugacccauuuuacuauggugaguguuggauuuggggauagggcuggacuggggaguagcugcaggugcucacagaucacuccggacauggcuucagcuguggccacacgauacgugcugggccacuggccacgggaccauauaugugggugugguucacaucagcugaguucauggagggcagaaccagaugggggaguggggaugccucacacucucucugagcccccuucaggucucaccgggaucugggcuggugccuuggugucgccagagaagcagaugaaggaaaaccuuagaagcaaugacucugagcccaggcugccuggauuugaauccugccuuauccacucacuagcuguauggccuugggcaagcaacuuugccucucugggcccuucuguaaacaagggauaguaauaguucccaccuaugaggacugugggaaagauaccugacugguggcauuaaaucuccuccauggcacugaagcucaaauaagcuaccccaggccugguagaucgggcuccaguuuccccucugaacacccuccucuugcccccaccccaccccuuugcucauucauacuuuuucccuaggugucaauuucucucccaucucaggaccuuugcgugugcuaugauucugcaguaaugcuucuccuuuguacacgaccggcuaaggcucccccuuauucaggccucagaucaaacauagacuacucuacugggauaggcccuccugacucccuggcaaggaagagccacaccauacucagcuggugucgcaugacuuguuuuugagggggauuguuucuuuaauguuuuaucacaauacgaaagucaacuccuugcugguagaggccuggaccacuacugguacagagugagugcuccauaaauucauaucucaacaaauacuuagcgggcacaggcucuauuucuggcaauguuccaagcagcuggagacacugcaaugaaccacacagacaagaauucaagaaugcaagaauuccugcccuccuccuggaccuuccacucaaugggaaagggacagauacucaagaaaacaaaauaugaaaauuauauauuagacaagaauauuauuggccagguaugguggcucauaacuguaaugcuagugcuuugggaggcugaggcaggaggaucgcucaaguccaggaguuugaagcugcaaugaacuaugaucgugauuuuuuuuucuuuuuuuagacaaagucugacucuguggcucaggcuggagugcaguagcacaaucucggcucacugcaacucccgccucccagguucaagugcuucuccugccucagccucccgaguagcugggacuacaggcccacaccacugcaccuggcuaauuuucauauuuuuagaagagacaggauuucaccauguuggccaggcuggucuuggacuccugaccucaagugaucugccugccuuggccucccaaagugcugagauuacaggcucauuacaggcaugagccacugugcccagcucuacauaaaaaauuuaaaaauuagcugggcaugguggugugugccuguagucucagcuacuugggaggcugagcagggacaaucucuuggagcccaagagguagaggcugcagugagccaugauugcaccacugcaccccagccugggugacagagugacacuacaucucuuaaaaaaaaagacaagaauauuaugaggcaagaauauuaggcaagaauaauuccuaugaaguaaaauaaagaagggaaugagauuggaaaguguggaggagaggauggaaauucugaauaggacagccagagguuuugcucacaaucaaauaaagcccagacacuggugagggaaggagccacguggauauuugggggaagagcuuucaggcugcaggaacagccagugcaaaggccuugggauaggaucaugcuggauaugccccaggaacaguggggaggccacuguggcuggaguaggauugauggggagagugagguggggugagguccaagaaggaaaggaacuggaucauaugggacuuugagggcccuagugaggaaugugguuucuaccuugagggcaaugggcgggaggagggcucugagcagaggagaaaccagaucugacucaaauguugauggguccuuguggcuaucagaggugggagugcaggcaggccagcaagacccuagagaaggcugcugcagaggccagaugggcgacaaugguggacagaaccagggccagggaggaggugguagagggagaguauuauauauauauccaggguggaaagcgcagggggagagggcaagggaggaaaguagaggguacagagggcaaggggagcuaacggugcccaagcccacacccuacauccucacaucaacccccugaaggaguguccagcacaguccacagccucccugggcgauucuggguuccuggcugggccacccagagccaggacugggcuccaggugcagccaaggugcugucccugccucgaugucccccauuaucuuccccagacuacaacacggugcagacugugggcaugacucuggcaaccaucuuguuccugcuggguauccucaucgucaucaguaagugcgacccauuccugggcugccucagccuccgcuuccucugcuggcuuucauccauauccuacccgcuauguccugucuucuuguucugucucucucucccaacaggcaagaaggugaagugcaggaaggcggacuccaggucugagaggucuggcagcagugggcaaagagcgggagggggccucggggugccucccuagcagaugggcaggauccacugggccugccaugcguuuuccccaaagccuaugguuauugaaccucuuucuacuuuucucucucaucucugccuccacagcccaaccugcaaauccuguaagucugagcuucccucuucaggugagggugagaaacugugugguucugggagaguuuuagguggggcagggaagggaacccucagaagggaagucgcggggauggacuggacgcagggggcggaggggggguggugccugcagauaucacaggacaauucccuaggaagcugaggaaauuccgcagaugaaagaugcuaaaccuggcugggcgcgguggcucaugccuguaauuccaacacuuugggaggcugaggcaggcagaucaccugaggucaggagaucgagaucagcccggccaacauggugaaacaccgucucugcuaaaaaugcaaaaauuagccgggcaugguggugcgcaccuguaaucccagcuacucaggaggcugaggcaagagaaucaccugaaccugggagguggagguugcaaugagcugagguugugccacuccacuccagccugggugauagagugagacugucaaaaaaaaaaaaaaaaaaaaagaggaaggaagaaaugaaggaaggaagggagggagggagggaaaagaaagaugaugcuaaaccguggggaggcugugggaugugacaugucccagaguccacagagauucccagaaacaaaugcucaagccuauaaaagccaggacaagcugauuugccaggagaggaagacacaggccugugaagagaagggccccaugugggaggagcucugucaaucaggagggagagagagggagcacugaggaagacggggagaggcuuuccagacuugaucguucagccaggcagauccaggaugaaauagccgaggaagcgggacagagggagggagggaagguuucugaauaguugcaucaaaauaacaaaaagagagaugaauagaaugcagauuuuagaauucacauuggaaaagaacauaugggaugcagggaaugugaggauggagaagaaagcugggaagaacaggaggggagagaguggagaggacggagguguuggggagaaugugggaaggaggagcccaggaaggaaggggaggaggaugggaggaggagggcguggaggguggaggagggagaauggguguaagcauggaaaguguaaagggagagcgagagggaugcagggcaagcaugucaacgaaagacugaucucuuugaggcuguuaauuuuaauuauguaaaaauaacuugaccuguuuuuaguggaaaugcagccuuucuggagacuuguaaaagaacagaaaugggaauuucugugucucuuauaaaguucuuauaacuaaaaaaaaaaaaaaaaaaaaaaaaaaugcgggagggggacacggguuauucaaugguugagaaguauuugguguggaauuuguuucacguuccuuuuuuuuuuuuuuuuuuuuuuuuuuuuugagacagagucuugcuguguccucuguugcccaggcuggagugcaguggcacgaucucagcuuauuacaacacugcaaccucugcguccuggguucaagcgauucuccugccucagccucccaaauagcugggacuacaggcacacaccaccacacccggcuaauuuuuauaucuuuagcagagauggugguucaccauuuuggccaggcuggucucaaacuccugaccucaaacgauccgccauccucggccucccaaagugcuuggauuacaggcgugagccacagcgcuuggccuguuucauguuuauuuaaugaguuuuaaaacaugaacaaggcacuuauggaugcguggggcagcauggggguuggccuugucaccuggggcacagcugaagacuuugcacagguuucuggucuauccuaggugaaugauggucugcagcggguggggaaugggggacuucccguuguauccaaauguucaggacagggaguguaggaaaggagugaggguguaggaggagauugcaaaugggaagggagauggggacucccuuucuggcaggcggauagccccaaaagcccagguugggucuggggucgccagccccguagcagguguuucucuccaugacagcagccaggagguguccccaagggaacaagacauuagagugugggaggcaagacagcuccucaguguuagcucuggggugacagucccuggggucuggcuuccauggugccggggaauggagagccaacgagcuguggggagggaggcaguuuccaccuuucuaguggcucacgcacccccucucuccccagccccugguggcggcggcguguaacaccuucccgaggaaacuccgcugccgacccugccugagcgcgggagccugaggaccggguggaggcgguggggacccagccgcgcgccgggagcgcuccccggaaugagccgccccacccaccccaaggcuggagccgcugcacccugcugucccucuccaggccuuggcaaugacgaucccccaaagagcccgucugcaccccagacccagggccucaggccuccagcuccugggauccgggaguccaucccggcccagcacccccagcauccccguguauggccccccugcaccuccuugucucauccccgaagauccgucccccuggccccucaguguccaugucuugagcuuaauaaaugugcauuugguuuuuuccucuguuc

SEQ ID NO: 15118 - RNA, 4770 nt, Homo sapiens
cugucgagaggaacgcacguuuuauuggaagucuuggcggcagggggagucugcgggggcagggcuggggaaggggcggcggagggggcggugggcgcgcagguggagcgugggagaugucaggugccaggggaguccugugagggugaaaagggugagaggcgaggggggacguccagccccaccccucgccgcccuucaacucuggcacuuggcccccucccucucccgccuuuccuuccucccuccuucccucccaccgccgugucagagcugcagcaccuggccggauuccaucgcuccagguguuucuaccgccugcggguggacagaccuggggggaacacggagaucgggggucauucuggagaggcauccccagcuccugggcagguggggcccgcggcggggcaacuccccgcccuccgcuuucagauccagcccuucccucuacgcagccagggagggccgggaaaagcgguccuuggaaccagcccucuccccagaauacccgcagucuccccagacucacggcggauggagcugcggaaaguucccuccucuucaucggguuccccaguccugggaagacagaggcagagggauuucgggauggaaagggggagaggcugcccuucuaggaaccccccaguacaagccuccuuucccagauugguguaacuaggcccagauauggacgaagagcaggcucgggguccgccagaaaugaggagcacccaggagcagcuuaugugcuggcagggggcuucuaagcugguuaacagugaguaccuccgcggauuugggggcagggaugugaaguuggugggggagggauagucauggggacuuggcagacugccaugagauggccuggguuggaaacccagaaccccccaucuuccacuugagugaucuugaacaaagugacuuuaccucccugugccuuaguuuccucaucugucaaaugggguuaauaacagcaccucccucccagaggaagugaaaccguaucuaacacgugguacacacccaguaaauauuagcuacuacuuaugauaauaucuauaauuguucuaacauauucauacauuguccaugcuuuaacauuuuauucgaagaggaaucaaagagcuaggaacaagacucuaagcuaaacugggccgcgugugagaugaucucauuucaccgccguuucuucuuuccugcacuuuguguuaucacgcuuugugauuuuucuaucuguggggcuguuggaacccacggccaccgccuccacuaggcugggagcucggccaggaagggcgggagguuuuuuccucgcuuggucccagggccaggcuugggccauggcacauaguaggugcuuaauacauagucgcugacggggaucgggcugcgggucagggguacuccccgccucacccgcggcgcccuccagagcaggagcgggcgaaggagggcggggaggggcgucuuaccucugcugcugguugaacuugcaccggcaucuucugccugugggcguggagagguaggagaagcugaggcucccucccggcgggcgccaagcggcgcuguagcuccagcucgcccucgcgaggggcggggcuugggggacggggcggggcuagaggcgagaccgggggccggggaaccaaggcaggguaggcggggcaaggccugggagggguuggggcggggcggggccagggaggggcgggaccagggagaagcggggccagggagaggggggcuagggagaggcggggccagggagaggcggggccagagagagguggggccagggagaggcgggguagagggcgggagcuaggggcacucacucagcacgaugaggaugcccaggaugaagaggaucccggcgaugacgaggccuccgaucugcagggacugguagucugugagcagcagagcagggaaggugagggcagggaagacaggagggagaauaggagagggguaaauugggaaggagggaacagggagaaaggaccagcaggcagaaggggggaaguaagauaauuaagggggagcagauaugggaggaggaaagugggguaccagggagaggaaagggguguauaggaaagggagggaggggacagggaggaggaggacaggggggagagaagacgggaagaagcagaggaugggccacgagaugcugagacagacgcaggcaagagaaagagaaccagagagguaucacauagacagugacacagauagacacagacaggaaaagaugcagacagguggaaucagagaggaaggacaaaauagagggaaggagaaugacagagauaucaauacugggacucugggggagggcgagggggaaucaaaggaccagcaaagccaggcucucccccaggacucaaaauuagaccccccgcucaccguaagugaacgggucguguuccuuuggacuuucuggaaagagagagaaaucagggguugaaugcuuccugggguccuggcagggaggggcaugaggagaccacuggaggcucugccuugcugggcuuagagucugagggugucugggcaggcugcccacacucucugggucccagcugcccccucugcacugucccagauggggcagguggcaccuaacugccccagcucccugacucacggcaggcugucugugacccaguuaucccaucggggauucagccccaucccaccccaucuuugccugaucuggggcuuccucuccccucccccaaauaccagccugugacuggaccccacguggagacccccaaacuucuugguaccccagccgacuuagucuagguuggggucuccaacuugguucuucgguccccaccgccaccccuggggcugagguggguagcgggcagccuccccugcacucaccugccuuggccauggugaggagacccacacagaaaaccaagauguggccaagagacgccauuguccugggggggacaccacggauuaggcagugugugcccuugcucucccacauagggcuugaacccaagggauuaagucagagacagucuggggacugaaucacagaaguguuuguccucuaucuugguggcuccaagcuagagaaacggguauccccagcuucguggggacacagugucaccaaaacaaccuccacgaugggaucacacaacaacacaacguagcagggacgggggugagacacacaguccccggggggccucccuugggccuccaccucccgcagcaggcccccgauucccagaccuacccuggcagggcagaggaggcgcugccucacacaaacacagagcaggagacagcagggcacgcccaagucccaccugccuacaugcccggccucacugugccccgcgaaaucccagcucccugcccucuccgcccgcccgcucgcggccugaccccggguauaaauaucucccacuucacccuggaggaauucugcucgcucaggccaccauggcaacagccugccuucccccacucagggggucacgcacagcccugccggggugaggcccagcugccacaucgccacaggcugccccugugggaaaggucaccccgucuccucccugggcagcaacgagaaaaggaaaagacagccccucugcccgccucugggugacaucuuucacaaucggaugucaggcaagugacaugaggcccagcccagugggccuuagagauagaaaacacaugcuggggcagggauacacacacacacacacacacacacacacacacacacacacaguggggccggaauggacaugaacaacaaccucuccccaaacugcugguuggagcaggacgugggguguaaacaccgucaggcauccaauacuccuccucugggccuccggugcccccacgcagugacgcaaccagcccuacacacgugugugucccaacuccacacccugccagggugcacacgcaccagcagggcagggaggagucacccacaucccacccugcagaacccacugccucaaccacacucccucccucuuggguuggccugccugggaagccucgggcuggccacuccugcucccaaaauaggcggcccagccagaccaggggugaggccuggagggaaggagugggggacgcucaccccaaucgggcuguccccugcugaaagaaggcccccaaacguccugcugugccccgggggcugagcacuuuggacccccuggcccagagcuggacgcgccgcccccagcagccuccccucccagccccaccccacccaugcccuccccaaccagcagcugaaacuggagcuggggcuggaggggggccagggggcggcccccagcccagacugcccuggcccgcuugguuaacucucucaguucagagagagcagcagcaggcagccagcaggcaggcuggagaggcuaggaggauuguggaggacaggguugugaacacacacacacacaaacacacacgccuccaagagcuuuugggcugaggcggcugcccccugggaacuggguccagccagggccgaaggucacccagccugacugcccaggagcccacugacccccgaucccagugcuccgugagguccuuaacagggcuguuuuagaggacgggagggaggugugugugugugugugugugugcgcgcgcaugugcgcuaucugcuguggugagauccccagaaaugcaccacacacacacacccacacacaaucccaaagacccagauauaca

SEQ ID NO: 15119 - RNA, 31716 nt, Homo sapiens
ugccuggucuaccgcccuuccccugcaagucugaaugcuguguggacagaggaggaggacccaauaagguagggguauuggaguacucgggugccugggaagauccaagcccggccuauagggucaaggucuuuuccaaaacaggggaaacccuuucugguucccgaagguccucccuucccuauucgcugaacaggugggugccaagaagccccugucuugaggacagagagacugcggucuggccuccccagacccaggcagccucuaacaucacagccacagagcagaaacuggccuggcuuccucccaggcccagaaggccccagcuggccaccucccuuuguuugucuugggaggggcaacugcuaagcaaacagggaaggggaaucccgauucggccucucugucuguccggcuagccguuacccaggcccgggcucuggugcccacugaggccuggcuccuuccugacccuuuguguggaagggacacagggcaggaguggguacagagaacacccagggcuuuccgaaaaaaauagcccaggccucccacagaugagagaggagcuaugugguucgguaaaccucaguuccagcuacaggcaaaugggauuaacugagcacuuacuguguuggggcccuggccuagccccaugcaugccagagcccuccagauacugccuggccacccugcaggguccuaucagaucucgagucuccaaaagaggaaacaggcuuggggucauaagggaaugagguuagcaggggugguaaucccacccagaucucucugacucucagaucacggguuuuuuuuuuuuuuuuuuuuuuuuuucugagacagggucucgcucuguugcccaggcuggagugcaauggcacaaucauagcucacugcagccucaaauuccgggauucucaugugauccuaccgccucagccucccgaguagccagggcuauagggacgugccaccaugccuagcuaauuuuuaacuuuuuguagagauaaggucuugcuaugcugcccagacuggucucaaacuccuggcuucaagugauccuucugccucagccucccagagagcugggauuacaagcaugagccacugcgccugguccccaacugugcucuuaaucauagcucauuucucuuaguggagccacgggggaaggugguaagggggcuuaagcgggagcucuaucccucaucucuuuuuucucuuucccagagaccacaccgcuguuccagacccucuccauggaugauguccugccccugaugccuugggagacccuguuggcacagggcaguccccagggcucgccugaccucccagcagggcagcggaagcagcagccacagggugacagggcccagggccuggccucugaguccuggaagcuccuggaggugcccaucauucacauaacgccauccagugauggggagucccccgccugcaccccaaccccccgacgccggcagcagcagaggaugccagacccgcagagucugucccaggacaggucagaccugggcagugggacaggaaagagggucucucugucuagggaggguucucucugucaaggguggguuccuuguggcugcgggucagagcacaaccuuagccccacagagggcugacucaaagccacgaaacagaugcacaaacaaaagguaaaaacugagggugugcguugggacaaccagcuaugacugagcucagcugaguucugccuaguaagaguggaggggaagccgggcgugguggcucacgccuguaaucccagcacuuugggaggccgaagcugguggaucaccugaggucgacaguucaagaccagccuggccaacaugguaaaaccccaucuugacuaaaaacacaaaauuagccagcgauggugauggaugccuguaauccaagcuauucaggaggcuggggcaggcgguuugcuugaaccugguaggcggagguugcagugagccgagauugcgccacugcuccagccugggcgucagagcaagacucugucucaaaaaaaaaaaaaaaaaagaguggauggguggagagggaccccacccaguguuuuucaaacuguaggucaagacccauuuaagggccauaaaacuaauacagugaauugcaaucagcccuuguuuuuuguuuuuugucuuuuucuuuuugagacagcaucucucugucacccaggcugaagugcaguggcaugaucuuggcucacugcaacuuccauugcuccccccuccacccagcagcugggaccacagaugugcaccaccacaccugucuauuuuuuuuguauuuuuaguagagacgaggucugaccauguugcccaggcuggucuugaacuccugagcucaggugaugcacccuccucggccucccaaagugcugggauugugagaugaggcacccggccgcaaucagcacuucuuuauccaaaucaaaauaaaauagaauugcaaauaacaccaugcgugaggccuaaugaggguaagugugguuucuuacaacuucuguggcauuauguguauuucuaagugcgugcuggaagcccaugugaaagguauuuccugcuguagaucacaggccaaaaaaacaaaaaaaaaaaaaaaagaagaagaagaaaaacaaagaaaaaaagaaaguuuaaacaaaacuucugaaaagaaacacuaucucugguacaaggagacaggaaaugggagguucagggccauagggggaagaggaaagaacucuaccgacccugaauagaacaagcagccacugugguuucuuccaacaagggacacuccauaagcguuaaaguuuaggaagcagagcuuugugcauggauguggagaaaucgcagaaacaaugauaaugggggacagcaaguugcaaaugaaacagagggagccuaaucguguaucuuuuuaaaaagauacuggauaauaggugauaguguugguggaugccuccugauguagaaaaaggacagaaaaguacacaggguccaggcgugcuggcucaugccuguaaucccagcacuuugggaggccgaggcgggcagauuaaccugagaucaggaguucaagaccauccugaccaacacagugaaaccccaucucuacuaaaaauacaaaaauuagccaggcaugguggcgcaugccuguaaucccagcuauucaggaaguuggggcaagagaaucgcuugaaccgaggagguggaggcugcagugagccaagaucgagccacugcaccacuccagccugagcgacagagcaagaccuugucucaaaaaaaaaaaaaaaaaaaagcgcaggaaggaaacacaccaacugcauggcaggcagaaggcuccuuggggggcacgggaagggaaaggagggauggggagccaggccuuugguuguaaguguaaucauuuauuucuuuuaaaaaaaggaccugaagcaaaauggcaaaauguccacaucuauucuauauagguacaggggacauagaggacuguuauauuuucuuccuuuuuuuuuuuuuuuuuuuuuuugagauggagucuugcucuguuguccaggcuggagcgcaguggugcgauccuggcucacugcaacuuccaccucccggguucaagcaauucuccugccucagcuuccuggguagcugggauuacaggugcaagccacuacaccuggcuaauuuuuuuguauuuuugauagagaugggguuucacucuguuggccaggcuggucucgaacuccugauaggugauccacccuccuuggccucccaaagugcugggauuacaggcgugacccaacgcgccugaccugaaauaaauauuauuuaauuaaaaaacuaaaagcauuacacuagaagaaacagaccaaagagaaaucuaaagagaucaguuggacagaggaagguggugggaggagggccucucuuccauuggccggugggaggcagcaaaugucagaugguggauggggguuuuagagguggggguuagcaugagagguagggcacggcgauagggggggugcuguccaugcagagggaauaaccagugcaaaggucuugggguaggaggcaggaaggugccuggugaguuagaagaacagcggguaggcuggauggggggugugagccagggggagaugaggagcugaagucagagagcugacaggggccuugggugccaaggugaggacuuugcuuuuaccuggagugagguacagcuggggcagggcucugagccaggaggguaguuaacugacucagguggucccaggcucucucuggcugcaggugagaacagacaguaggggcagggaugggagcagggagaucaggcaggagaggauggaggcugggccagggcgugggcagcggaggaagaagaguuuagaauggagcgauugauuuuauacguggagcccacaguuugugacggauuggauguggugugaaggaaaagagagggucagaaaagacucugaaguucugggccugccauucaucaaaauggagaagucaggugggcuucuuuugcaggaggaggggaaggguugauggagaggguugggaagggaguuuuuucaaaagaggcggggacagcguacccuggagagcgcuggggagccacagccccggagcugugaggugggacucgcauuucugugugguugggccaggaguccaggacaccaccugacucugaccucuugcagacggggcgggggaggggggacgcagguuauggcgucagagcaggaucgaauccaacucugccgccuaccuaccaggugaccccaacaagucacuucccaucuuagaggccgggcuucuccuuccguaaaaggacugauuuugcccguuccugcgcuguccccgggaaaagcccuuaccaccgaguuagugggacucccagcacuggggugaugagcgcaaggucucagcacagauaagagccagggaggcuggauucugacuugguacuuggccuggcugaccaaaacugggaagucccuagaaacggaggcaccggaccuccugggaccaggaacccgggcucagagacugggagagggaaggaggaggcggccaaccggccccaccccuucccgccagcuucaggcccccucccccauacauacaccucgguuucccagcaucuccaguccucccccaccuucgccccggcucucagguuccucccugggagguccaggagcuucuggccaggggcauaguaguugcuagggacccuuuucuagguacuaggggagggggcuccccaaccugcgggcaggcagcugccuccacgauguuugguuuuaauaaagucucuuuguuuccuucucugucucucugccccucugcuuucccuucucuguccagucccucucuccccggcuucucccuccuucuaggccucugcggccccuccccgccuucccucccgggcugggggcggcgccgugacgcggcggggcgggggaaggaagggggugucgcugacgccgcggcggccuccggcggcuccggccuuuugugcgggcgguugggucgggugggggcggcggccgcggaaggccaggccggugcccugcggggacgcccagcgcagcccagccccgcgcagcccagcccugcccugcccugcccugcccugcgcccggggcgcgcccaccgcgccgcauccauguucgaguaaggaccgggcgacuagagcucagggaccgggcgcgcgggggaggccaccggagggagggggcgccgcgggcuuggggagggggcggagcggccgcugcagaggucgggggccucugcacauggcucuggccggggcgaucggggugggggcggggcagggggcccccgggcgaggggugcagcuggggaguggggcgcggacgcagggcagggcccggggucugggucgccacugccggcccgcgacgcacuggguugcgggguuuggcugggggcccgcggguucaucuggcggggagggcccucaggccuggcaacccccugccugguaagccaggggugagcgcgaggccgaacuggggcuccggccugggauggagacaggaucgggaccagcccaggcccacaggccgcggagcccugggcgcgccgggaguaggcagcccccuccugccugggcccccucccaccguccuuggcuguugcgggucucggggcugccgggggugggggcuuccugcgucucuccaggaccgcgugcuugaggucauggagggcgggggguccugugugcucggaauugacuucuuacuccccuuccgguccaggugggcgcaugugcuuccgacugugaauugucuugcaaguguguguacgugugucuggggcugcuagccugcagcagcuuugggccucugauagaguuccugcguguaacuuaaccacuaauucugaccgcggcucugugugucacuguaaguuaccugugugugucuggggcuccaaaucuguggcugugagcagcugguugugugcguguugugucucauuccaucuguagcucccugugcaaauauaaauuaccccugugugucugagugugacguuggaguguuuguacaugugucuggaguuaccguguguagcagcucugauccuucuugggcuguguguguuuuaccauuaauucuaucuguagcuccaagcguugcuguaaguuaccagugugcgucccauugugacuuagugguguguguacaagugugccuggggcucuggguucuaccaugacccucugugccugcauaugccuguaauuuagcucugaaacgcucuucuuuuuuuuuuuuucuuuugaaauagagucuggcucugucgcccaggcuagagugcaguggcacgaucucggcccacugcaaccuccuccugcuggguucaagcaauucuccugccucagccuccugaguagcugggauuacaggcgugugccaccacgccuggcuaaguuuuguauuuuuaguagagaugggguuucaccauguuggccaggcugaucucgaacuccugaccucaggugauccacccaccucggccucccaaagugcugggauuacaggcuuaagccaucgcgccuggcuugaaacucucauuuagcucugugugccaauguaaguuacauuugugacauuguugugugucuggggcucugugaguguggcuguaacuuaauuugauuccaucuuugugugaacauucccuuguguauuccuuugugacaguauugaguggugccuaggccucucuguguacagcugagacccucugugguuuugugugugugugaacagugugagaccccuuguggcucucuguaggcuuggaacccucccuucuaagacccugggaguacccagggcacuuuggaggcaauaaugauaacugacguuguccaccuguuacaguuaguauagcaugugccacgcauuauuccacuaccuggccacuguguccucgagauccacgcccugcucggcugcauuauucccaaguccugcuugacugugagcaucagggcucuccaccagcuacagccacugacaccuccaccccuugccacuuuacuuuuucuuuuccuuuuucucuuucuuuuagacgcagucucgcucugucgcccaggcuggacugcaguggcacgaucucggcucacugcaaccucugccuccuggguucaagcgauucuucugccucagccucccuaguagcugggauuacaggugcgugccaccacaccuggcuaauuuuuguauuuuuaguagagaugggguuucaccauguuggccaggcuggucucaaacuccuaaccucaggugauccacccgccucggccucccaaagugcugggauuacaggcaucagccacugcgcccagccccuugccacuuuagaaguagccuuuucucugucuucccugccagauggugagcccagugcgggcacgggaacaacucaguggggauguguuggcugaccgugggaccugauuuaccugggacuauguaugugucaccuggggucuuuugggacuggucuuucacuguauggcugucuuuggcucuuugcugagacuuccucguggcuaugugugugaauauaauuuauccgggacuuucuguggguugcuguauguuucugugacccucugcagcucugugucugugugcacacaugcaugugucuggauaacuuuucugggaaauugccaugugacuguagcagacuagcaaugcugcagguguguguguguguguguguguguguguguguaauuacucuguggcucucuguagcauaccuaugaugcuguugcucugugcgugugugugugugugugugugugugugugugugugcauaugagagagagagagaggaaagagacuccuugcaauuguagggaaaugcaguuuaccccugacaccuacugugugacaaucauugaguuucccuuuuaugcacaccuguggaugcauccgcccuuuucugaccagaggcugcucuggguccacuggggccuaggaaguuggaggucaggugucugcggaagcaaaacaacaucccuuccgagucuccucgccccuauaacagucccccaggcuccucccuucacucugccuucagcuauccugguugggcagccgcaggguccgcccuugaguacuuccucuuugcccagcccuggagcaaaaacugggggcguggucccugcccugucugugugccuugagccucucuucaggauuccggcccccaggcccugccccuagaucuguggcugcgggaaaguagggcaggucuguguuucaggcuagagggcugagaaaagcaggcaggggaggaugugguccugcugcuuaggagucucucccugcucaccagugcugucugggugaagccaaacuccugacuagggucaccaggccugugcaccuccgcuacucccucagccccacuggccaccucacucacacucagaccugccaggcucaguccugucccugagcuugauguucuccaccuggagucuucucccagccuuugccacauguguucuuuguccucaggugaacaagugggcuuuguucaggaaggcuuuugcugacuguuacuaaagaaauugguugggcacaguggcucaugccuguaaucccagcacuuugggaggccaaggugggaggaucacuugaggucaggaguuugagaccagccugggcaacauagcaagaccccaucacuacaaaaaaacuuuaaaaaucagcuaggcaugguggugugagacuguagucccagcuaucagggaagcuaaggcuggaggaucgcuugagcccaagaguucgggccuggagugaccugggaggcugaggauugagaauuccuugagcccaggaguucggagcugccguuaaccaugauuuugccacuguacugcagccugggugacagagugugaccgugucucuaaaaaaaauuuaaaaagcaucucugccccccuaguugucccaucccuuaucucugugguccucaaacuugaaugugcgucggaaucucuggccccaccccaguucugauucagaagguugggaguggguccuggacucugccuuuugaacacuuuccaaguccugccugcugcucucuggggcucauacugagcagcauugcuuuauggcguucaccagugucugaggucgccaucccugcucacuuguuuucuuacugacggucuauguuucccuguuucagcgucagguccuugcaggcaggggcuuguaugggcuuugcucacuuccuuguggcgggugcaggguauuuagaggugaaaggcuggaguugagggucagucauggaggcgccuaacaucaggcguagugcuugugaggucccugucagggucagcagagcgucaugggcaguggugcacugggcuggcagccgcgcuguacacuccaucuuaguccgccagucccugugggagggaaagcagcguaguuaaaccaggugcccuccagguacugggcuuuguggaucucaccucaccuccaucucugugcaacccuaggaggugggcacuaauucccaucauacccaagaggaaacugaggcacaggaggguucagacacuagcucagggucacacagaaaggacgcgguggcacuugacuggaagguccuuggacuguggggcccacacuccaggcugcugcccuggagaccugcaggguccaaggagucgugcaccugcuggaacccaaguucuauggggggcggggaaggagggccgaucacccaggccauccccaacaguaugugcucacggagcaccuccuguacgccaggcccugcucuaggugauggggacacucaacaucguggguggggguuggggguggggagagaaggauaagaacuagggggaaauacugaaggucccgggaggcagcagggagacuugcuuugcagaaagagagcagggagggggaucgggaggcgggguaggggguguuaaauagggagguagggaagguguccacugagcagagaccugagggaggugggggagcccuguggauguggauguggaugucugggaggaagggcauuuugagcagaggcaccgaccaaggcgggagcugggagagggagugcagggcugaugagggcagagagggaccacccaggaggacccugauggacucagaugaucccaggcucccucccacuacagguaugggcagggaugggaacagggagaccagggaggaggcugcugggauggcccaggggaaaagcaguggccugggccacuggcuguuuaauuauuuuauucacguauuuuauuccacaaauuuauuuuacaaguguuacaugagugccuacccugcauccugucccgcauugugcuggggacagagcagugacccacagacccgugaaggacuuggaccugucaucagacagugacggcccagaguaguccaggaugggagcugcccaggggacuguggggucacgcaugagccaaaguccugaaggacaaauaaggauuugcuaggcaaagaagaacuacgaucuggacagacagaauggcauauguuaaggcuuggagguaagagagacaacuuugaguugccccaggugguggagggaaucccaccugcaccccagaauacaucaaggccccuaaaugggaauccugccuugaaauaaaccaagcccauggccaggugcaguggcucacagcuguaaucuccuagcacuuugggaugcugaggcagguggauugccugagcucaggaguucgagaccagcaacgugguggaacccugucucuacuaaaauacaaaaaauuagcugggcaugguggugggugccuguaaucccagcuacugcggaggcugaggcaggagaaucacuugaaccugggaggcgcagguugcacugagcugagauagugccacugcacuccagccugggugacagcgcgacucuuugucuccaaaaaauaaagaaaaaagaaagaaaccaggcccguauccuauggcaagugguuugccgcuuugagcuaguuuccuccucuguaaagcagggauggugaaucauaucaaaggcaccggcuugagaaauaauacgguuaaucauacggagagcuugacauauuuccugauaaggagucaacaaagaauguccuuuuaaaguucccaacgccauccccacaguccuuauuacaguucguguuugcacagugaaguugggaguguccuguuuguucagugucugccuccccaccagaaggcucauuccccaagggcaggggccauguccugcgggcucuacugaugccagcuccagccagcgugcagauuauucauuuagccucuggugguuauugagcauucacuaugugccuagaguuuugggcucuagggacccggugguaaccaagaccugaaggucacagucuggguagacaguaaacaaacaguaaacaagcaggacacuccagauagccugggguguggcgacagaggugccugccuuaggcuggaugaugcggaaggagagcauuugagcugaaggggacagagcuggugaugccggggccauggaaggacauucaggcggagggacuacaaauguggaggccuuggcgugggaaugagauuggagagcuuagggacaaaagcaggcugggauggccaggggagaggaaggacagggagagggaggacaugaggucagugagguuccagggccaaaucaccacaccaaggugaggucuuugcuuuuaccuggagugaggugcacccagggcagggcucagaccugacucagauggucacaggucuccucugguuguaggacaccagugaagaggcugcugggguguccaggcuggaggugauggaggcuggagcagggagaaauggguauaauaaaaauaacggaugcugggugcgguggcucacgccuguaaucccagaauuuugggaggccgaggugggcggauaaccugaggucaggaaggaguucaagaccagccuggccaacauggugaaacccugucucuacaaaaaaugcaaaaauuagcggggcaugauggcgggugccuaugaucccagcuacuggggaggcuggggcggaagaaucgcuugaaccugggagguggagguugcagugagucgagaucaugccauugcacugcagccugggcgacagagagagaccccaucucaaaaaaauaaaaauaauagaaauagagcugggugcaguggcucacaccuguaauaccagcacuuugguagugcccaaggugggaggaucacuugaggucaggaguuugagaacagccugggcaacauagcuagaccccaucuguacaaaaauuuuuuaaaaauaaaaaagcugauaacagugguguguaccugcagucccagcuacccgggaggcugaggcaggaggaucacuuaagcccgggagcucgaggcugcagugagccgugauugugccacugcacuccagccugagugacagagcgagacccuaucucuaaaaagaaaauaaaaauaaauaauggaaauagauuuugaaaugagagaugaagaaaauaaagaaauuaagaaagaugcuuaggguuuuagcuccgacaacugaguggaaagucgcuguucaauaaauauuuguuguaugaaucaguaaguuaauuuuaaaaauaggagguauaggccaggcgcgguggcucacaccuguaaucccagcauuuugggaggcugaggugggcagaucacuugaggucaggaguucaagaccagccuggccaacauagugaacccccgucucuacuaaaaauacaaaaauuagccaggcaugguagugugauccuguaaucccagcuacucaggagguugaagcaggagaaucucuugaacccaggaggcgaagguuacagugagcugagaucacaccacugcacuccagccuaggugacagagugagagauuccgucuuaaaauaaaauaaaauaaaacagcaggugucuuugagagcucgcuaugugccaugcucuguuagaauuacuuuacaugggcugggcacggugguucaugccuguaaucccagcauuuugggaggcugaggccagaggaucacuugaggccaggauuuugagaccagcuugggcaacuuaggaagaccccgucucaaaaaaaauuaaaguaggcugggcacgguggcucccaccuguaaucccagcacuugggaggccaaggugggcagaucaugaggucaagaguuugagaccagcccagccaacaugguuaaaccccaucuacuaaaaauauaaaagcuagccaugugugguggcaggaaccuguagucccagcuacuugggaggcuaaggcaggagaaucaguugaacccaggaggcagaguuugcagugagccgagaucaugccacugacuccagccugggcaacagagcaagacucugucacaaaaaauaaauaaauaaaauaaaguaagauaaaggaagugcuuuacauguccugauuuguuuaagccccaaaacaacuggaugaggacauguauuuaucaucccuggauuacugaugaaguaaccguagcacagagacguuaaggagcauguucugagugucacugcugggaagagaaacaggauggcuggguggauggguguguauucggggaucaaugggugggccucugaaaauaggccuguccccgaaucccagccuguuuuuuccaguuaacacuucucuuccucuuccugcccccagcaccacaccccacucuggccggagcacgccaagcagcuccccaucgcuccggaaacggcugcagcuccugcccccaagccggcccccaccugagccagaaccaggcaccaugguggagaagggaucagauagcuccucagagaaggguggggugccugggacccccagcacccagagccuaggcagccggaacuucauccgcaacagcaagguuggugcaagcccaggugggguggggagagggcuagugggggcuggccggugaucuaggggcucauccugacuccucuccuuuucuuugcagaagaugcagagcugguacaguguaagugucugggcaaggggcuugcuggagggcugggaggaccgggugcugggccaggagccccaggcugcaacagucaaggagugcgugcugagauggagugggugcagaccuagggucacguucuaugcuauuauuuaugugcugugugaccuugggugaguuacuuaaccucucugggccucucucuguccuugagaaacagccccaccuuacaaggcugaagggaacauugaaugagucagugaugcuggugggugcuugguacggggcccggcuuacauaagaaaucuguaaauggcagcugucauuguggcuacugguguguugugugcguuggaaucugucagggacuuaagagacugaggggguuccaggagcuuuguggggcagcauugggagugugaacccccauccagguucucaccucucaaacuuccucagaugcugagccccacuuauaagcagcguaaugaggacuuccggaaacuguucagcaaacuccccgaagcagaacgccucauugugggugagucccggacccccagucccagcuccuagcccagcccugugacucuccgccagcccgcgggcgccggcugagccucgugacuuggguguccuccugucucuccccgccccucucagauuacuccugcgcccugcagcgugagauccugcuccagggccgccucuaccucucugagaacuggaucugcuucuacagcaacaucuuccgcugggagaccacggugagcccgcagcggggcaggguacaggggcgggggcccccauggccaggccccaccccgcuccuauugacccuccugcuguccucagaucuccauccagcugaaggaagugacaugucugaagaaggaaaagacggccaagcugauccccaacgccauccagaucugcacggagagcgagaaggugacggaggacccggugacgggaccacgcggucccccgcucagcaggccgccucccccaaacaugcaaagccccauuuguucugcacccugaguucucuccgagcuguccccuucucucuguucucccggcccaggcgcccaucaccccugaccugauccccgcaccagccucuccucucuuucccugcaaccuguuaccucacacagcugcucaggaacagcagaaauaguaaaacucuuccauguauguggcaccucagccgccccucccuucguaagucuccccgauguuguguccugucccugucauuguggccucauguccguugguugcaagauggcuuucucaccagcgguccaacaagaagggggacaggugugggggacacuucccagcagacuucucuuuguguuuuguugguuaaaaguggaucuggccagguguaguggcucaugccuguaacccuagcauuuuggggaggcugaggcaggaagauugcuugagcccaggagguugaggcuagccugggcaacauagugagacccugucucuuaaaaagcaaaaaauuaaccaggugugguggcacgcaccuguagucccagcuacucacucaggaggcugagacaggaggauggcuugagcccaggagguugaggcugcagugagccgugaucaugccacugcacuccagccugggugacaaagccagacccugucucaaaaaaaaaaaaaaaaaaaggaucaacugaccauucuuaguggcaaaggaggcugggcaaguucccugggcuccccccaucacaucccagccccucugggcugacccugucuagagaugcaucuguccccuccuuggacugggagcuccaaggacagggccaggggucgucuccccaucccagugauucuggaauuguccagggcagggccgggcgcaggacagacguuuuguggaacuaaugcaggggugaauuaguggauucauggggccaaagauguggcgucagcgcagaugaggguggcgcuuccccaccucuguccuggucgcuccccaaccugcucacaccucucucucucucucucccugacagcauuucuucacuuccuuuggggcccgugaccgcugcuuccuccucaucuuccgccucuggcagaaugcacugcuugaaaaggugggccugggugaggcccggguggggaugggggguuuccagggggaccauggagccagggaccccagaacuugcggagcuggaggcagcccuggcucuucuccaugggcaccaggcccagugccccugcagcuccucccugggccccaccugaccccgaagcugagucucuggcaaagggacaugaauugguguaaaccgucguaauucuucccuggggcugggaaugauuuucacccugaaggacauccagguuccacuggcagcgggggaguguggauagaggcugggaggucaucacaggaugccggcuauggcugguccacagcaccucagagagccccagccccauccuccggcugagcggcacucacgcgcugccuucucagaggcuccgaugucccuggagcaggcaggagugcugagggucccauucagcauccugagagagggacagcgcacagucaggcccuaaggaggacagggcagagccccgggauuccagccccauccccuggggcaagugauugaaccccaucugucaaaugggggccauccccacuucacagcacccagaauuuugcccagaauaaguacucagucaugucagcucuuaugagcagaguagcccagcgguuagcucccucgccacccccucugccccccggcuguagaccagcuccccuggggucacaucucagcacugcuacuuccuggcuggaccccagcaugucaccuugcacuucucagcaccauugucuuaaaaggaugaugagguuagcaccuacuuuccagaugguuuugaagauacagugaguuaguacaucuguaaagugguuagaagaaugcaccuaguugaccagguggcaaaugucugcugcuaucaucacuuacuguuaacugucaucacugucauucagccacucuggccauggguggcugaaagcucaaggcucccgaggacaccugggaaaagauucggggggccacgauggcauaggcaugggagacucagcccuggagucuggcagggcuugaccaagucacuuggugaccuugaacacaugacuuucccuacaugacuuccccuuccugggacuccguaugcucuguaaagaugggaacauucauggcugggcacgguggcucaugccuguaaucccagcacuuugguagacgaagacgggcggaucguggugcccacgaggucaggaguucgagaccagccuggccaacauggugaaaccccgucucuacuaaaauugcaaaaauuagcugggcgugguagcacgcaccuguaaucccagcuccuugggaagcugagguaggagaaucgcuugaacccaggagggagagguugcagugagcugagaucacaccacugcacuccagccugagcgacagagccagacuccaucuccaaaaaacaaacaaaaaaagauauaaaaaaaaugggaacauucucuggccagaguauuguggggacuugggaagcaggaaguuugaguccugggcgcaggcccuggaggggcuguagcaggggauuccccgcuugcugaggccaggucuggugcgggagaucguggcugccuccuuguggaagccaggggaacugcggaggccgagggcugguggggaaucuggcgggccgggcucuggcuggggugagauggaggccaaccccaggucccgccuccccagacgcugaguccccgcgagcucuggcaccuggugcaucagugcuacggcucagagcugggccucaccagugaggaugaggacuaugucucccccuugcagcugaacggucuggggugaguuggaggucaaaggagguugaaggguucgggggagaacaggacggucggcgugcagaguuccuggagugcuggggggccugagaugguuguaugacgucuggaggauucaggaggguguauggggucucaaggacacagcagucccgcuuccuccccuuucccacaggacccccaaggaagugggagaugugaucgcccugagcgacaucaccuccucgggggcagcugaccgcagccaggagccaagcccaguggguucgcgccguggccaugucacgcccaaccuuucccgagccagcagcgacgcagaccauggggugagcgguggguuggaagaggggugggauacugauaggaagagagaggagggcugggggugcagugggagaagaacagccugacagauuuggaggggaauggauagggggacaggggaggccuggauggaggaacaggacagggaggggaagacggacaugugacagggaaagagagacagggaagagaggggacagacagaaaggaugagagacagaagggaugggagauggguggauagaugaagcagcagacagacagacggacaggacagguaagaaagcuuauggcucaggcaucugagacaagccuggcaggggcugagaggggcccucaucuggguggccccaggcugcucgcagcucagccgugagcccucggugcacacaccaccccgggucugcacaggcucuggaauccuuguggccaguguggacuugggagcccuggggcugggauggagguggccaaggcugcaucgggccuuucuccacaggcagaggaggacaaggaggagcagguagacagccagccagacgccuccuccagccagacagugaccccgguggcugaacccccgagcacagagcccacccagccugacgggcccaccacccugggccccuuggaucugcugcccagugaggagcuauugacagacacaaguaacuccucuucauccacuggggaggaaggugaggcaggcgggcccaauucauucgccuccgguacuugcaagccucgcucagucuuaagcaagaggggauggauucgcccgcagcacugagaauccaggggcaggcgggauggcguucaggcgcuguugcuagaaaucucugucuuuacucuguuuugaaggcagcauggcagggugaacacaagcacagacugaaggcagcuugccgcgguucacauccuggucacaccacuuccugaccaugucacgugggcaaauuauguaacuucucugagcuugcuuuccuccucugaaaaugggguuaacaaugauaauacccacuucauaggauuguuguuaagagacuauaaaugaggcugggugugauggcucacaccuguaaucccagcacuuugggaggccaagguaggaaggauugcuagaggccaagaguuggagaacagccugggcagcaaagcaagaccccguuuuguacaaaaaagaaaaaaaagaaaaaacuaggugugguggugcacaccuauaguaccagcuacuuggcagaccaaggcaagaggaucacaugaggccaagaguuugagacaagccugggcaacauagugagaccccugucuuuacaaaaaauuuaaaaauuagccaggcauggggucaugcacccuauguagucucagcuacuggggaggcugaggcaggaggaucgcuugagcccaggaguuggaggcugcagugagcuaugauugcaccacugcacuucggccugagcaacagagcgagacccugucucuaaaacgaacaaagggagagaauuaagugauuucauacauuuaaagcacuugggccaguuaguaagcauugacuauuaguauuucuauuaucauuauuguauucauuuucucucuccacuaauuuucagcuagccucuauucuugucucuuauggggcagagauggccucagcccugccccagaccagcccaaugagagagagcagccuauuuuuccuagugucuacagcggacacccuaggguuggcucugauugggccaacuugagagugugccugccccugaaccaaucacugugguugaucggauagaccugggccacccacucaccccugaaccaauugcugugccccuagguugaugcucccaggaggcgugcuaucugguaaugaaucccugugauuuaaaucucagggccuagguguguucuccacccagaaccaagcacaguggcugucugucugggccuggagcacgugcccacccucaacccaucccugagucacaggagggcucugugucaguguccagcugugcuccaggaggugggguccgcccaugcacacuacaaggccugggaguggggaggcguggcccgcagagggagggaggaguggaggcagucaucauccucggcucuccucugucuccagcggacuuggcugcccugcuucccgaccucuccggccgccuccucaucaacucugucuuccaugugggcgcugagcggcuccagcagaugcucuucucggacucgcccuuccuccagggcuuccuacagcagugcaaguucacaggucagcgggcgcaugaaggagaggcugagguuacccaggugcaggggaggggugaggaaggguagcccaggacaggggaaggcacugcuagccaguggggcaaggcgagguggugaaaagcaaugucugucagaccagaagcagcucugccacuuacuagcuggguaggcuugggcagaguucugagaugcucugugccucaguuucuccuucuguauaauggggguaugauaauaguaccuggcuuauugguuaucaugagaacuaagugaguucauacuagaaaaguuccuagagcaauaccauauaguaagcguuuaauaaauacaaguuaagaggcugaggcggggcuggugcggugguucacaccuguaaucccagcacuuugggaggccgaggugggcagaucacuagaggucaggagugugagaccagccagggcaacauggugaaaccucaucucuacuaaaaauacaaaaaucagcuaggugugguggcacacaccuauagucccagcuacuugggaggcugaagugggagaauugcuugaaccucggaggcggagguugcagugagcugagaucacacugcacuccagccugggugacacagccaaacucugucucaaaaaaacaggggcgggggguggggugcugggcacaguggcucacgcuuauaaucccagcgcuuugggaggccgaggcagguggaucaccugaggucaggaguuugagaccagccuggccaacauggugaaaccccaucuccacuaaaaauacaaaaauauuuuagccaggcaugguggcgagcaccuguaaucccagcuacucaggaggcuaaggcaggagaaucacuugaacucgggaagcagagguugcagugagccaagaucgugccguugcgcuccagccugggcgacagagcgagacucugucucaaaaaaaaaaaaaaaaaaggugggaggagggccaaggugggaaguucaugucagcccagaaguuggagaccagccugggcaacauaaugagacucagucuuuacaaaaauaaaaaaaaaaauuagcugagcaugaugcugcccacccguaaucccagcuacucuggaggcucaggugagagaauugcuugaacccaggagguggagguugcagugagccaagaucaugccacugcaccucagccugggugacagagagagacuccauuaaaaaaaaaaaugcuccugaggccuccccagaagccgagcagaugucggcaucaugcuuccuauacagccuguggaacugugaacccauuaaaccucuuuucuuuauaaguuacugagccucagguauuuauaguaauguaagaauggccuaauacagagcuccucagccugacacgccagcccuuuuaggacauaagcauaguuuugggggccuuguagccccccaacacaaggcaccaucuuccugacugcaggggauacugcaugucucaucaauacagaaaaagaaacaaagagaaacucccaucugacacgcuccuccccugcuugaaucucuuuuguagccucccaaguuccuuggcuggucccaugucaacccuucagccucacccagagcuguggcugccccucuccauaccuggcugccccaucccagccucaggggacuucucucaauauuggccuccagccucagggccuuuacugguaucacgcggccuccugggcuccucugccccgaccccuuccuuccucaguuccuccuucaggccuugguuuugauuucacauccuccuggcagccuucccuuaccuuccucagaucccagauacccccagauacucacagcuucugcccuuaacucacaccaugccaguagugugugguuuuuauuuauagauauuuccuguuguucucaagagauucugggugcuaaggacaggaguucaucuauccuggucucccacuggccuccaagcccugcauaggccugacagaguggacauuaaauuugugaucauuaacacauauuuauuuauuuauuuauuuauuuuugagucagguucuugcugucgccccagcuggaaugcaguggcacagucuugagucacuguagccucugccuucuggguuuaagccauucuccugccucagccuccugaguagccgggauuauaggcgcccaccgucacgcccagcuaauuuuuguauuuuuaguagagacgggguuucaccguguuggccaggcugguuucaaacucuugaccucaggugauccuccugccucggccucccaaauuucccgaagugcugggauuacaggcgugagccacugugcccggcugccucagggagcuuuugaucaugcugaaaggcaaagggggagcaagugagagagaguggaggggaggugccacacacuuaaaugaccagaucucggaagaacucacuaucaugaagacagcagcaaaccaugagggauccgcccccaugauccaaacaccucucaccaggcccuaccuccggcauuggggauuacaauucaacaugagauuuggguggggacaaauauccaaacuauaccaaacucagacucuguucuagggguacuggggagccauggaguguucuaggcagagaagggauagagucaggcuuggcuuuaacaagaugccccuggaccagauggggagacugaggccagacacucaagggaaggcuggcaggggcacugggcaggcaaagaugggcugaaccaggagugacgcucaggagguuuggugaacacacaguguagguaaccaucuagggguuugaguaggggguguccagggcaaggccuaccgcuccagugggagccuggaggacccugggccaccccugagugggggccugggagaugcagcagguuuggggagaugcugaggcuguguggagcucgguggguucgagggguccagggaccuuccaggggaagguguucaaaagauuacagguccaaugcucagggcagaagccaagacgggugcagagggggaaacugaggcugcagcaguggaggagauggcccugccccaacagcuaagguuuuaggcuccuggaaggaagguggggacacagaggagugguggggauugggacagguccccagagagaccucccagaaggcugagucuccuguggccugugggcaaaggacugggguguggccuccucaugcugcuccucccuccucuagacgugacgcugagccccuggaguggggacagcaagugccaccagcgccgggugcugacguacaccauccccaucagcaacccacugggccccaagagcgccuccgugguggagacacaggugggccagguggggcagccgaguggguggggcagcugggugagugggguggcccugacuucuccggcucugucccugcagacgcuguuccggcgcggcccccaggccggcgggugugugguggacuccgaggugcugacgcagggcauccccuaccaggacuacuucuacacugcccaccgcuacugcauccugggucuggcccggaacaaggcgcggcuccggugagugguggcugggccccuccacccgaugcccugguggccccagggccuccuguccacuccucaagucagcagcagagccuugguucccacccugguggaggaacagaagcgugggguuccugaggcccuuguccuccgaauaguggaggguagaggaagaguggcccugggauggcuccucccaucuacagaggguguuugagccucaagacucugaggauacagcaaagccaggcaauaucaccucucucagggagcucauauucuaguggggaauuggacaauagagaaaugaucaggaaaaucugcagaacauucacuggcaguuaggccuauggagaaaaaugaggaaaacacggcaggcuaaagaagcaggguguggaggcuuuuacacccgacacgcuggucagggaagggccuacugggaaagaaauguuucaccaagaaccugaaggagcugagagcaacucauuugggacagcaggugcaaaggcccugaggcaggggugugggcaauggcuggaguggaguaagauugagugaguaggagcugagauuaaaguggugaaccggggcccggcacaguggcucacaccuguaaucccagcacuuugggaggcugaggcaggaguaucacuugagcccaggaguucaagaguagccuggguaacguacggaagcccugucucuacaaaaacaauuuuuuuuaaauuagccaggguccaggugcaguggcuuacgccuguaaucccagcaauuugggaggcugaggugggcggaucacuugaggucagggguucgagaccagccuggccaacauggugaaacccaucucuacuaaaaauacaaaaauuagucggggguagugaugcacgucuguaaucccuacuacuugggaggcuaaggcacaagaaucacuugaaccuaggagguggagguugcagugagccgagaucgggccacugcacuucagccugggugacagagugaaacucugucucaaacaaacaaacaaacaaacaaaaaacaaguuaaaaaauuagccagacaugguggagauuucagugagccaugaucacaccguugcacuucagccugggcgacagagcaagacccugucucaaaaaaaaaaaaaaaaaaaaaaaggugaaccagauguggcucauggugaagacuugacuuuaccuggagugaggugcaaccaggccagggcucugagccaggagggcgcugaccugacucagguggucccaggcuccuucuggcucccucuguucuggugggaacagacugcaaagacagguacaggagcagggaggccagggaggaggcugcugggacauccaggcuggaggggacggaggcugaaucagggugaggaaauggagggggaagaguuuagauucuggagagauuuugcagguuuagcugacaggauuugcugagagauuggauguggcggugagggaaagagagcucaaggaauaucccgaggcauuuggcccaaaucacuacaacuucggagcugcccuugacccagaugggggcggcagggaggaauggguuuggggaaagaccaggaggucaguuugggacucagcugucuauguugagcugagcccauguggagcuggggugcagcagccgaauggaagagguucaggggcauggucugguuaagacgucagucugugaguagacagggcucaggccgccgggagcguugcccagguagugggcauggguggagaaggaccgagggcugaguuggcuggcauuugggcugggcgggugguguaugggguauccagggaagccaugggggguagggaacccaucuguuuugucugugagugacaaggggcccucucugaauuaggggaaggaaaaaacucagcuugugggacggggcagccagggcuggagucagacccuuaccuccuuccccugaucucccaaccccagagugucuucugagauccgcuaccgaaagcagccguggagccuggugaagucgcucauugagaagaacucguggagcggcauugaagacuauuuccaccaucuggguagggacagaaggccggcuggggcguggguugggggauggccuggccagguauggacauccagagcccccucucuuuuacgcagagcgagagcucgccaaggcugagaagcugucucuggaggaaggcgggaaggaugcccggggcuugcuauccggccugcggcggcggaagcggccccugagcuggcgggcucacggggacgggccccagcacccagauccugaccccugugcccgggccggcauucacaccucggguacguuccguuggggccggguugggguaggcggaggaucggggguccuggacugggccaucugacuccaagcugcucuccugcaggcucccucagcucccgcuucuccgaaccaucuguggaccagggccccggggcaggcauccccagugcccugguucucaucagcauugugugaguaagagacaggagcaguggccacacaggccugaaccugccuccuggcugugugaccuugggcaaguguguggccucuuugagcucucugcuuaagugggagcguggguuugcucacagcaaggauuagacaaggcaauguuugggaugugccgguuugucauggagaagccuucccugcuagaacagcagagccggggggggcuaugggagaucagaggggccugaccucacccaaggaucaaggggggcuuucuggaggagcaggcacacaaagauucuggaauuaggugcacagggagaggugugccuaacaagugaggucauuuauggacauuauguucucugugcccacuccuaagcugggcgaugcugaggacaccgcagugaccuugaggaaaagauagaccucacaccagaccagagugauccgggcugggaugggggagguaugggcagagggguuggggcugggaguggggaagcccugggaggccagcggcggcuuccucccaggccagagggggcagucaggaugggcguccugagagaguggagaccgcguaggcuaagggcuugggcagggagaacccacacuccugcccagaagccugcaggaguuggcgggcaggacgcugggaggaaacagaagcaggaucccgggguugagcagacccugcgaggugagggucaggccagcuacaugcucagccucugagccucagcucucagcucucauccagugagggggcguggugcucucagccaagagcugccccgggugaggagggcugggggugucgggggcaggccaggcggcgcucaucucucugucuccccucacugcugcugcugcaggaucugugugagguagggucccgaguccucccccugcccuccccucccugcaccccaccccugcugcagccucuucuccccaccccaugccccccagcucccccagggagguggccuggcauggcagucaaggguaugggcaucagacagaccuggguuugaacacugacuucccugcuauggacugugcaacccuaggcaugucucucauccucucugagccuaauucuccuccucugcaaugggggauagaggugucccuacaagauguaguuguuuggggguguucagagcaucuagaccccaggaauccugaccucugaccccuguccccagccuuaucauccucaucgcccucaacguccugcucuucuaccgccucuggucccuggaaaggacagcccacaccuuugaguccuggcacagccuggcccuggccaaggggugaguggguagccuggggaaaugggggggcuugggcacaucgggggaggccaaggcccugcucaggccuggcauccccacagcaaguucccccagacggccacagagugggccgagauccuggcgcugcagaagcaauuccacagcguggaggugcacaaguggaggcagauccugcgggccuccguggagcuccuggaugagguaggaggcgccgcucgggcagggcucggggcugcggggcugcaggguccuguguugaaaccccaccgugcggcaggcacuuccccucuccggaucucaguguccuccucuguaaaaugaggaagccgcucagaguccccaccccacagcauugcaggggaaagcauggaagcauggauggaagacagaacugauuggcucacguccuggagaaaaguccagaggcgucucacauuaggcacggccggguuuggucacucaauggcaguaagagucagucucucgugcccacucugcccugugcccaucuccaggguuggcuucauuggaggccacccuuuuccccccacaggggaccacggagcuuacucucauuggcugcuggggucccaggccuaccccugacacaucacaacagccagggcaggccacguguggucccucuacccgcuaccccacucugggguaacuaaggggucacauggucugaaggggagagacucuccaaaggaccugaggucucaucuccaaaacggaguggacccagacacccaguguaguucagggacaaugucuacucagacaaccagguuccaauuccggugugugaccucgugcaagugauuuugccaugguggccguggacuccucugugcacaggauaaugacugaugcuaccucaaagacuguugugaggaugagacaaguugacauugggaguggugccaggccugcaggaaacacuggaugugggcuggcuguccugaguuugagccuagugccagggacaaagcagaugcccaauaaaugugaugucaucacacgacaauucccucaggccccaguagacucaggccagcaguugcggugggucagagcaagugucaggccagcaguugcggugggucagagcaagugucaggccagcaguuguggugggucagagcaaguguuaggcacucggggaaggugucgagggggaaagcggaugggaaacagagucuggcauugccugcauuuccaaggccaucagagcugaaguugugggugacggugaaaaucuugucucauuggacccuuccauaucagaaggcucaucuuuaggggucucauugccccccgaaaucaagcuugggagaggcucacacuggaaagggcggggcaggaugggguggggaggagaugaaggcugaggccccaucacucauagagaggguaggcagggccccccauccugcguuauuuuauuuuauucuuuugagacaggaucucauucuguugcccaggcuggagugcaguggcacgaucauggcucaucgcugccucgaacuccugacucaagugauccuccugccucagcauccugaguagcugggacuauaggcaggcaccaccacaccuggccaauuuuaaaauuuuuuguagagaccagagucucaccauguugcccaggcuggucucaaacuccuggccucaggcaauccucccgccucggccucccaaaguccugggauugcaggugugauccaccacgccuggcccugaguuaaauuuuuaucauuuuccucucugucaaacugcuaagggugcagaguugacgucacagauuggugcucacaguagauguagacugagcacuuaccugcagcugggcuguucuagguuuuaagcaugacugcuuuauccccacagccagccuuugagaagaugcucuuguuaucccaguuuuuuugagacagucucgaucugucacccaggcuggcgugcaguggugcgaccucugccuuccagguuaaagcgauucucgugccucagcuucccagguagcugggauuacaggcacccgccaccacgccuggcuaauuuuuguauuuuuaguagagacgggcuuucaccauguuggccaggcuggucuugaacuccugaccuuaagugauccaccggucucagccucccaaagugcugagauuacacgcaugaggcacugugcccggccguuaucccgguuuuauacauagguaggcgauaugaggcauccagagguucgaggagcucaggagcuugcccgaggucacagaguggguaauggugacagcuaacaugugcugagcacuuaguguacaccagguucucagugcucuucagaacccugaaauaauccuguggagcagauguguuauagacccguauuucaaaugaggggauuuuggcucagggugguuacgggacuugccugagguuaacugagguaacaagcagcagagccaggauuugaaccuaggccaucggggucacaggcacacacuaagccccuuccucugcugccucugagaaguuaaacugggugcagcauggcugugcucuuuucaccaagggacccugggguggggcaguauggccucuagaccguccucaguuucucaauggcaaggugggggugggcgacaucaccccccagccuccagcguucacccccgacccugcucaccuccuccccgcagaugaaguucucgcuggagaagcugcaccaaggcaucacagucucagacccucccuuugacacccagccccggcccgaugacagcuuuuccugaggaccccggccacgcagcuguucccccacauggacagauggacacacagagccucggcggccacugcuggcacggugugagcgccaggcaucucccacccgccccucccgacggcccaaccaggggcugugcagacguggggaccacggaaccgagaugcacuuuagaccagggagcuggcccggccucuggcaggccccccacuaacuuauuuugcccggcugagguuguggggggcgccuccuggggugcacgauucccucagcucuggguuuaauguauuauauuuauuuggggccgacagugccccaauaaagggucagaaguggcug

SEQ ID NO: 15120 - RNA, 1095 nt, Homo sapiens
uugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacugua

SEQ ID NO: 15121 - RNA, 35462 nt, Homo sapiens
agaaccaucgagugaacagaguauccaauuucugcagucacagaggugaggaguggaaaacagucuugggauuuggugacacaggccaaguugccguccugacugauugugcccccaccccacuauugucuucucagggcaccuugcuccacucuagacccgcucaccacuuaguguuaaguguccgcagaggcacagccugcguccugcugagcgcuccugcccucugcuacauaaagcaccaucacaggaaaaaaaaaaucagaggcugagccuacaaccuccuccguggcaucuuuauuuuucuacaugggaugugaacaacgugaacaugggucagaaaagucagcugcacaaaaacacuucagccaauucuaacacagagggagcauagacauggaggggcuggggguuaggcugggggagaccagccuucccugcuaagggcucgugguccaagcccacaaccagagggugcucugggugguguccaggaacaugcagugccggcuccggggaggagggacgagaagagaaaggggagucacagaggaggcugcagaugagcacgaguuuauuggacucuggccucgcgcugcugcuugaugaaguugaugagcccauugguagaagcgucgugagaggucacuugagcacugccaucaagcucaggcucuauuuucuuagccagcugcuuucccagcuccacucugccaagaagggaagggaagggaagagugguaugaggaaggcucuaacguugcuacugaaaucccugagccgacacaaagguauucccggcccuccccuaagugagcaacucacccccacuggucaaagcuguugaugucccagaugaugcccugaacgaagaucuugugcucauacauggcugcagaagugacagacagggcacaucagggcuccacaagcccauuccaaccuaccccaagccaggaccuuuccccuacucacucaccgaccaaggcuccaagcaugaauggugugagcuuggugaacacaauagaguugguugggcgauuuccuucaaagaccugcagaaaacaccaaggaaugucuccaagagaguccugaucccuaaaccccuugaagggaagcacacccugccccagaggcugagacgugcaggucugugaggacaggcccucccauucuguaggacaagccaggcacgccccaagccccugccuggugccauagcuucacaccuccaacuccagcaugcaccccaaagccaaaugcagaagugcugaccuuauguggcagcagccucucaagguccucuggacucuugcccgcagccuggagcuccuuucgggccuccuccgucgauuuuccccucaucagggccucugucugggccaagaaguuggccaggaggaucugaugagcgagacaucaguuaugcuugagagcacugucugggcuucaggcagagggacaagaccgccugguacuucucagcaggggucagucccagccugggucacucgcuguacagcucaguuggagcgagggggacacauccgaugacaccacaaggcagggaacagugauaacugcucuuuaagaacuacacaccaguggccaggcgcgguggcucacgccuguaaucccgacacuuugggaggccgaggcggauggaccacgaggucaggagcucgagaccagccugaccaacauggugaaacccgucucuacuaaaaauaccaaaaaaaaauuuagcugggcaugguggcgcaugccugucaucaggcaggaggcugaggcaggagaaucaccugaaccugggaggcagagggugcagugagccaagaucacgccacugcacuccagccugggcgacagaccuagacuccaucucaaaaaaaaaaaaagaacuacacaccacuugcuagggguccugcucacaauuuuaccaacaucuaucuuuuaagauccuaagaagguagcugggcgugguggugugcaacuguaauuccagcuacuccggaggcuuaagcacgagaaucacuugaacccaggaggcugagguugcagugagucaaggucacacuacugcacuccagccggggcaacaaagugaaacggugucucgaaaaaaaaauaauacuaagauccuaaggaggaaaggcaucaucgcccuguucuaguagagccuuggguuccacaaguccacagugcuggaucacagaacuauagacaggaacaaucagaauucaauccagcucacugacucccaagauugugcuaccguaacccugugcugcucugcacaccugagacaaagcacaguaaauucucugaaggaguucgagggcagcuugggcaacauacugagacuccaucucuacaaaaaauaaaaauaaaaaaaucagcugggugugguggcgugugccuguucccagcuacucaggaggcugagguaggaggauugcuugagcccaggagggugaggcugcagagagccugauugugccacugcaccccagccugggcaacagagcaagacucugucucuuuaaaaaaaaaaaaaaacuuagccaggcauguuguacaucuguggucccagcuacucaggaggcugagauaaaaggauugcuugagcccaggaguucaaggcuguagugagcuaugauugggccagugcacuccagccucagcaacagagugacaugcuaucucuaaaauaaaauaaauaaauaaaauaaacaaaaggggagauuuuccuggauuaucuaguagccccaaucuaaucacacuggcccuuaaaaguaaaagagggccaggcacgguagcucaugccuguaaucccaaaacuuugggaggccgaggcaggagaaucacuugagcccaggaguuggagaccagccuaggcaacauagugaaaucuggccucuacaaaaaguuuaacaguuagccaggcuguuagugccuguaagugccuguaagugccuguuagugccuguaagucucagcuauuugaggggccgaggcaggaagacugcuugagccugggacguugagaauacagugaacugugaucaugccacuguaaguccagccuagacaacacagcaugacacugucacuuagggaacaaaagcaaaauguagaagaggaagguaaacaagucagagagaugcaacagaaguggcaagacagaaucaaagcuucagagaaggauuuaaccugccauugcugguucugcagugaagaggcccacaagcuagaggaugcaggugaccucugagaaucugagaacgaccuucagcccacagcaaggaagcuggacuucaguuccacaaccauagagaaaugaauucugccaaccaccugacaagcaggucaaaggcuuuuccccuaaggucuccagaaagaaacacaguccugaugacaccuugauuucagccugcaagacucuaagcagagacacaucagggccugcuggauauuugagcuucagaaacucuucagauagcccaggaagguggcucaugccuauaaucccagcacuuagggaggccgaggcagguagauuacuugaggucaugaguucaagaccagccuggccaacauagugaaacccccccuuuaccaaaacuacaaaaauuagcuggccaugguggugagugccaguagucccagcuacuugggaggcugaggcauaagaaucacuugaggccgggaggggaagguugcagugagccaagaucgugccacugcacuccagccugggcgacagagcaagacucuguccccccuccccaccccacaaaagaagaguguuguuuuaagccuccauguuuguuaucauuuguuacggcaggaauagaaaacuaacgugauugccaaccaaugcaccagguuuucagaggucugggugcaaugugagccagaccccccagauggggccagaugggggcucuuaccuugugaugcagacccuuccguauggggugcugggucuggaccgggaugaggaagucacaggguaucaucuuggugccugugaagggcacuguggucacccacaugaccccagcccaugggagcuagccauauggccuagaggagggcacugaccuaagugagauaucucuucuggaagauccuuucccucccccaacaucacccuucccaggccacaggggccuaccuugguggaugagcugguaaaaagcaugcuggccauuggucccuggcuccccccacacaauggggccugucuggugguccacacggguuccagauuuggugauguauuucccauuggacuccaugucgcccuggaaaaggaacagaaacccaguucuuggcaaaaugaaagaacauuuaaaaagaaagaaagaggcugagcgcaguggcucaagccuguaauuccagcacuuugggaggccaaggcaggcggaucaccugagguuggaaguuugagaccagccugauuaacauggagaaacccugucucuacuaaaaauacaaaauuagccaggugugauggcgcaugccuguaaucccagcugcuugggaggcugaggcaggagaaucgcuugaacccgggaggcggagguuguggugagccgagaucaugccacugcacuccagacugggcaacaagagcaaaacuccaacucaaaaaaaaagaaaaaaaaaaaaaaaggaaaagaaaggaaaagaaagaaaaaaaacccaacccucuuccugcaagucuugauccuucacacacuguacgcaaauccugcuccuuccugcaccaugccaaaguccugcccagaugcuccaggcagacccacccugcccugacaccgugagguggaccugcacacguguccacaggcacgauccccuuccuccccacaccagugaggacacagccucccaaccuuuccugcuuaagccacugugcaggaaggacucaugcccaggaaaaggugggucuggaggucaggcaaggaccucccuaaagacaaaaucggucacaaaaucagcucauuucuuaagggagagcaggcugggguccagagugcacagcuucuuuuuuucccaaagagacagagucucacucugucacucaggcuggaguacagugguagaaucauugcucacugaagccucgaccucuugggcucaagcaagccucuugccucagccucccaaguagcugggacuauaggugccgcaccaccaugccuggcuacuguuaguuuuuguggguuuuuuuuguagagaccgggccucacuacguugcccaggcuggucuugaacuccugggcucaagcaauuccccccagccucugccucccaaggugcugggauugcaggcaucagccaccaugccuggcuaagaguacagccuuugagggcugucaccacaacuaaaugcuaggcuuuggguacccaccugggcccuggucauggcaacccucaccaaggcagcugggauuuggggaaccuuggccucuccuucagucacaggauuugcuuccagguguuggugaagccuucuguaccugcccagagcaacucaagagcugcuggacagggacuggcuuuguacuaaacaaaagcaaggauaggguugggcaugguggcucaugccuguaaucccagcacuuugggaggccaaggcagguggaucgcuugaggccaggaguucgaaaccagccugggcaacauagugaaaccccguuuccacuaaaaauacaaaaauuagccaggcaagguggugcaugccugcaaucccagcuacucgggaggcugaggcacaggaauugcuugaacucaggaagcggagguugcaaugagccgagaucgcgccacugcacuccugccugggaaacagagugagaaucuguucaaaaaaaaaaaagcagggacagguguggaaaagcuuucugggacauaaugugacuaggagagggccugcuaagccucucggggggcucuggagaucccaagggagaagagggccauguaguccaaagaggccaccacagacuagauacacacuugcuuuucuggagggauaaaggcagugcaggcuauaagggauuccagcuugcagccccacccuauggccaaaucccaccuccucagacauggacagacccagguccucauaccuguaccagauccuuccuccccagauacuaacagaccuagggccucauaccagggcuagauccuacguccucagacacuaugguaggcaugcauagugaugugcaagaaagaagugaccccagcugagaaacauccccugagucaagccaggaccucccuagccagggcaccaugaucaccagucaugccccucccauggugaucaaacucagaugacacucaaauggaaccaaccucaguuacaaagauucauccugagacaaggagcacagauggaccuuggccaggcccaagggcaauggggcaaagagcuccuggaggagcugaaacccagguuccuagaccucccagaccccccacaaaucuugcugacuccaaggccuggcuuggcagcugguaccugcuggaaguacgcagcaaagcggugcagguacuggucauagggcagcauggcgugugucucacacccaaagcaguugauguaccagauacccagcagggccagcaagacgggggcguucuucuccaggggcgucgugcggaagugcugguccugaaacaggagcaggaugagugggagcugagcagcugcacggggaggggagggacaggacagugggggagaaagcgggggaccaggaccaacacacgcgccucuggccagcacuuggcagagaaccagccucagcacucaccauccagugagcccccgagagcagcugcucgaaguugucaaaaccugugacacaaaagcagagucaacagaaguggccacacccugcguccugugggcagugggcacagcuccuucugcaacgaaggaaggcugcauggagagccagaagauacgacaugggaggacucggaccuagacaaagccccuccagugagagguggcccugagugcagggaucugacucugccuaggauaggagagaaacaggacugcaguugugaggggcaaagacgggggccaacuugcacacgcaaaaaaacccagaccuuccuucuggacaugaaauaaauaucccagccagcugcagagaggccagcagccugugaggacagcaugauguucagggacacaagcccccuaccccgaccuuagacugcaacacugucucccacaggggcugcaagacacagaaacacacucacccacgugcagggcaauggagaguccgauggccgaccacagcgaguagcguccucccacccacuaggagagacaggacaaggugcugagggagggccggcacaccccgccccccaccuccugccggaaacccugucccuggucuugcacaggggcgucucggagggcccuggcccaacccaccuccaggaagcaaggcagcaggcaggugcuggcaacacaugggaagaccaacagggcagacuacagaugacugaccacagccacaagacaaacugaagagcuuaccguggucuucccugagaugucgggcccugucucugcagacaccagcagacccaggaccucauaccugugccagggcccaccuccucagacacggacacacccagggccucauaccugcgccagggcccaccuccucagacacggacagaccccaggccucauaccugugccagggcccaccuccucagacacggacacacccagauccucauacucauaccagauccuaccuccucagauauggacagacccagggucucacacccaugcccagccucaccuccccagacacuggcagacccaaggccucauaccugcacacagcuucaacucuuuagacauggucagacccagaugcucaugccugugccagauccuaccuccucagacauugaaaaacccagauccucauaccuguaugagauccuaccuccucagauacugacagacccagauccucauaccagggccagauccuacuucuucagacacuagaagacacagacccuccuaccagggacagauccuaccuccucaaauacugacaaacccagauccucauaccagggccagauccaaccacuucagacacugacagacucaggucuucauaccuguaucagaugcuaccuccucagacauagacccagauccuaauaccuguaucagauccuacuuccucagauacagagacaugaagauccucacaccuguaccagauuccuaauuccucagacacugacacacacacagauccucauaccuguaccagauuccuaccucuucagauauugacagacucagauccucauaagggggccagauccaaccuccucagaaauugacagacugagaucuucuuacuagggccagauccuaccuccucagaaacugacagaugcagauccucuuaccagugccagauccuaccuccucagacauuaacagacccagauccucacaccuguaccagauccuaccuucucagacauugaaagacccagauccuuauaccugcaccagauccuaccuccucagacaugaacagaaccaaauccucauacucaugccagaucuuaccuccagacaugacagacccagauccucauaccuguaccagauacugccuccucagacauugacagacccagauccucaugcuuaugccagauccuaccuccucagucacugacagaaccagauucucauaauuaauaccagaucccaccuccucagacacuagaagauccagauucucauaccugugccaaaugccaccuccucagacacccgaagacccagauccucacaacuguaccagauccuaccuccucagauacugacagacccagauccucauacauguaccaaauucccaccucuucagaaauugacagacccggauccucauaccagggacacauccuaccugcucagacauggacagacccggauucucauaccagggccagauccuaccuccucagacauugacagacccagauccucauaccuauaagagaucguaccuccuaagucacuggaagacacaucuccucauuccuguaccagaugguaacuccucagacuuugacagacgcagauccucauaccuguaccagauuccuaccuccucugauauugacagacccagauccucauuccuguaccagaugguaacuccucagacauggacaguccuagauccucauaccagggccagaucuuaccuccuuagacauggacagacccagauccucauaccaggacccgaucccaccuccucagauacugauggacacagauccucauacuuguacccagccucacuuccccagacacuagaagacucagggcuucauaccugugccagaugcuaucuccucaggcacuggaagcccaagggccucaaaccugaguccaaacucaccuccucaaacacuggaagacgcagauccucauaucugugccaggugcuaccuccucagacauggaagacccauauccucauaccugugccaggugcuaccuacucagacacgggaagacccagauccucauaccugugccaggugcuaccuccucagacacaggaagacccagauccucauaccugugccaggugcuaccuccucagacacgggaagacccagauacucauaccugugccaggugcuaccuccucagacacuggaagacccagauucucauaccugugccaggugcuaccuccucagacauggaagacccauauccucauaccugugccagaugcuaccuccucaaacauugggaagacccagauccucauaccugugccaggugcuaccuucucagacacaggaagacccagauuucauaccuguacuagauguuaccuccucagacaccagcagacccagggccucauaccuguaaccugcuguuaucuccucagacaccagcagacccagggccucauacuuguaccagauccuaccuccucacacacuggaagacccagaugucauaccuguacuuagcccaccuccuuggauaccucuuccagcaccacauaccuguaccaggcccuacuuccauagacacuugcagacccagagccccuuaccggugccaggacccaccuucucagucucauacuugugcccagguaugcuuccuuggacaaugaaagacccagcagcucucugcuacacuuggcuaggucuccucagauauuaaaaacccacagcuacauuucuguuccccagcccaccugcuugaacaguggcccagugccucauacuugugccaggccccacauccucagauacugacaaacccagauccucacaccugugccauucuuuguugaacaaugaagacucaucacuuuguaccugugcccauucccaacuccucaggugguacugacagauccagaaccuuagaccugugccucaccccaccuccuggacacugacaggcccagugggucauaucugggcuugaccgaucuucucggccuaucaccuaggccuaucauucacacugcaccuucucaagccacaccugcaagcuccacuuggugccaucagaguccucagaacuucacggaugucuuccuaacagcuguuuauggagcaccucccacauuucuagcacaggcaacggacacagagugugggagagagacguacaucaaauaaucaugccaauaaaugugaaacugagaaacaagugcugaggagaaauuggaacauggugcugaggccacuuauaaaaggaaccugagggguacuugacccuugaucucaagaacgagcaggcaugacccagagaagcacugagggagcauuccagcagccauaacagcacaugcaaaggucccguggccaaagcagucuuucucaagcgugacagaauuaaggcccacagaaaaugaucugagugacuucucaguucucccaaggaugguccaagacuaguaaccuucuagacacgaaggagaggugcccacuuauuacauccaguagaugccuugggcugugagggcuuaauucucuccuggaagcccacugaggcagggggaagcauagcaccuuccagaggauaaaggaagggguggggaccgcaggguggaagcugagaggcacggugggaggacugagaacagucugcggcuaagacaaggacagaagcaaacaagccacuuugaagccccggagauggacuggggagugcagaggacucauucugggagcucuccaguguggccgagagguuucuggcuugggcaaugagaugaccgguggggccacucacuuggaaaggcucuggguuuccgggaaccuuaccugacagacgcaguccuacagacuacaucaugcuugacauaggcucucacaucucaucuaacagaugcaguucuauuuuuuucuuuuuuuuuuaagagacagggucuugcucuguugcccagguggagugcaguggcaugaucacagcucaccgcagccucaaacuccugggcucaagugauccucccaucucagccuccccaguagcugggacuacaggcacacaccaccaugcuugacuauuuuuuaaauuuuuuguagagauggggucuugcucuguuguccaggcagguuuugaacaccuggccucagccucccaucucagccucccgaagcucagggauuacagccaugagccaccacacccagcccagacucagcucuagaaacuaaacuucagcacacagccagcccucuggcugacagaguccaggcugcucaccuuggccgagaacagguccucagaucccaguuuugugacagcccagcaaugccaagcagugucugaccugagccuccgaacccucaaucugcagacaugggucucuagaccucaccuuuaagugcaguggccucugagaccauacauuauagaugcagcuccucagucaguucaauguccugggccuaaccugccccagugccccagaucucaccuuaucuaaccaucaucuaccuuuuuccucacuuuacucacuuucuuuuuuuuugagacagggucucucacucugucgcccaggccugaguguaguggcaugaucucagcucacugcaaccucugccugccagguucaagcaauucuccugccucagccuccugaguaacugggauuacagacaugugccaccaugcauggcuaauuuuuguauuuuuaggagaugggguuucaccguguugaccagacuggucucaaacuccugaccucaagugauccacccaccucggccucccaaagugcugggaugacaggcgugagccacugcgccuggcaacuuuccucacuuuuaacucagacccugugucaacuggagcacaaugccaucuuggaugcagaccaacaccauggacugguuacagauccucagcccucuguauuacccugagcucugucuaucauaccugaccagggugcugagaacagauaccugucccagcugaucuuuaggguucccuagacaucaccaggcagacccagguacaaacaccuacaaugacuacggcuuucccuugauauaagagcccacacuacucaccuaauugugucugacccuaccaccgaaggucucaccugugucugacccaccuuccccaggccuggccagccucaccauuaugcauuccugugcuagaccccacccacuucaccuaacaagcccagcaguacuuuugugcuugaacccaggugucaagaacccaccugagaccauguuuauacaaccucuguggaacugagccuggauccacagacucacugcuaaugucaggucaacauaccagcacugagccugaauccacagacucagugccaaugcuaggucaacauaccagcacugagccuggauccacagacucacugacaacaccaggucaacauaccagcacugagccuggauccauggacucacugccaaugucagcuaaacauaccagcacugacccuggauccacagacucacugacaacaccaggucaacaugccagcacugagccuggauccacagacucacgacaacaccagguaaacauaccaccauugagccuggauccguagacucacugacacaaccaaguaaauauaccagcacugagccuggauccacagacucacugacauaaucagguaaacauaccagcacugagccugcaucggcagacucacugacaacaccagauaaacauaccagcacugagcaucgaugcaaugguuucaccugggagaccuaguucugccuauuuguguccaacuccagugccucaggcuacagaguuauauaccugucaaagauggguuccagacaucucagcugauagaccaggcuucacauaaccugaccccucacaccuugacugacagacccgguucccuugccuaagcccaacucagauuccuuacagccucccaggguccagcuuuauuuaugugagccuggccucggcaguccacauccugugucuggcuuggcuuuucaugucucacagacagauccaaugcugccaaucucugcuuaacgucagcaccaaugagcucacugaggagccucagaccucaucaaauggaacaucucugccuaccugugcuccccagcugagaugcguaguucuaccaacuugugacuaacccacuguccccaggccuaagacugagucagcacaacuaagccagaaccacgcaccaaugaccucaccugcaagaccccagcuguaugucucucuagcuacaaaguccuugcuugagagagauacaucuaccuacccacgucuaacuuaggggccacagaccuccuaggaaacccacaauguucugccugccuguagagacccccaugcuaugggguugaccugggaggccgcucuauacaccuaggcucaacucugguucuucaggcuucaccucaaacacccaggggcacauuccugugccugaauccaacuccugaaagagccaacucuaucuaccugcauucaaccuaacuccucagcucuccuucaagagacuacuccuggcagaccaguuuugucuaccugccugacccuggcuccucagaccacacauggugggccagcucugccuaccugugcuugacccuggguucucagaccacaccugaaaggcuaucucuaccuaccugugcuugaaccuggguucucagaccacacgugaaaggcuaucucuaccuaccugugcuugaaccuggguucucagaccacaccugaaaggcuaucucuacauaccugugcuugacccuggguucucagaccacaccugaaaggcuaucucuaccuaccugagcuuuucgcuggguucucagaccacaccuagugacccagacuaccuaccuguacuugauccuggcucuucagaccauaccuggcaggcagcucuaccuaccugagucugacccuggcuccucagaccauaccuggugggccagcuuugccuaccugugcuuacccuggcuccucaaaccacacccagugggccagcucuaccuaccuguaguugaccuuggcuccuuaaaccacaccugaaagacuaucucuaccuaccuguguuugacucuggcucuuuggaguacaccuggcaugccagaucuaccuaccugagccugauguuggcucuucagaucauacuuggugggccaagucugccuaccugugcucaaugcuggcuccugggcuugugccugguggaccagcacccccuaccugcaugugaugaggguuccugagcuuguaccuugugggccagcucugccuaccucuacuucacaccucagcugcuuacaccucauccaacacacuugguucuucuuaccugggcuugacuaugacuuuuuaggucucaugaacacacucagcuuugugaagcugcccugauccuggcuccaaagaccuuaccugccaaacccuguucuacacaccuguguuuaacucccguucuucagaccugauagacccgaagauguaccugggccaggcuccaaagaccucacccaagaaacucaauuccacauaccuacauaccuguaccuggccacagcuccucaaccucacccaggagaagaacuucuacccacccaucuuuuuucuuuuuuuuuuuuuuuuguuuuuuguuugagacaaaguuucacucuuguugcccaaguugaagugcaguggcaugaucucggcucacugcaaaccccaccucccggguucaagcaauucuccugccucagccuccugaguagcugggauuacaggcgugugccaccacacccagcuaauuuuuguauuuuuuaguagaaaugggguuucaccccgucaccauguuggccaggcuggucuugaacuccugaccucagaugauccacccaccuuggccucccaaagugcugggauuacaggcaugagccaccacacccaacccccgcuuuuuuuuuuuuuuuuuuuuggagauagucucacugucacccaggcuggagugcaguagcaccaucuuggcucacucugccuccccaguucaagcaauucuggugccucagccucccaaguagcuaggacuguaggcaugcaccaccaugccuggcuaauuuuuguaguuuuaguagagacgggguuucgcuaugcuggccaggcuggucucgagcucuugacuucaacugaucugccugccuuggccuuccaaauugcugggauuauaggugugagccacugugccuggccuacccaucugucuugacaccaccugggaaauccagaccugcucacugugccagaucccagcuccucagaccuccugagagaccuggcucuauccaccugccuucacuucauauccucagaggucaucuaccacauccaggucuuucuagaugagccuaauccggacuccuugggccucaccugauagauccguucuaccugugccugaccucaacugcaggacaguuuaauugguuugaccauggcuguuccggucaaccuaucuuugcaugcuccugguuucauagaugucaccugacaaacucuacccaccaugcuuaacacagcuucucggucuugggauacaaaccagagccugaccucaguggcucagaccuuaaccugugagacccaaaaauacauaccugugucucaccuuaaccccugaaaccucgccugcuagaucugcucuacguaccucgaccagacccaggcuucauccaccuuucugauggaugcgguucgucaucccuuugucugaccccaucccuuugucuggucucuucccaggggacccaggcucacccaccagagcugcucagacaucgcccaaggacacagcuccaaccuggacccaaucacagauuuucagcccucacuugucagacccagcucgaccugucugccuaucuuuagcuccaacguccuuaccagacugguccaguucugccuaccugaguacagucuuggcuccucaggccuccccuagaaacccagccauacaaaccugucugauuccagcuccuaggaccucagacagacgcggcucugaaaggcugcauuauacacaccuaaccugaacagacacuuuccucacacaugacagaucccuggcugcugaccucggccugagggagccuggugagagcccaguguugacaaacacugucugacuggcucagccuugaugucugcccuguagacccaggucucuggcccuuuacccaaccugagccacucagaccgcacccacccagcacagcuccucaugccaccugccugccucaccugccccagcuccccuguccuugccucauaucaccagguacauuccuaccucucccgcaucugggcucugcagacccugaugccacagacuuggacuucagucacaaauucucagaggccucugacgcccugagcucugcccaucacacccagucaggaugcugagaagcaggugcugaccugugugucccuaauccuggguucuaaacuugugcaaucagccacccacuaccugauccucacuuuucggaaccggccagagaucccagcgugcacaccugucccaugccauaggucuacaccaccucccacagagcccggcugacauaugcacauacauagcuuuggcuccucagacuucaccugacagaaccaccucuaaauaccugccucuccucuggaauucacagaccuaugggucccucuccuguccuggcuccucuucagaacucaccuggaccugcucuggcucugcuucaggccucuccagccaaaacuggcccuguggcgugcgcugacccuggccgagcccugagagaccccaugguuucccaccacaccccugccugaucccgacacccauggcugccgcaaaacuggcccuggcggaccaagaauuaccucuucuacauaccccuaccagacgggacucuucugaucucaccugagggccggcacugcaucccuaggccugagcugauggcuguagcucacccgagaccccaccugcaggaacuucgccugcuccuaucccuggguucuucagauaucaccuucuugauucagcaggauacacucuaguaacucaggcaggucccuccuccagccguugugggcugucuagccuggcccaggaggccuccacuuaggucucaccagccagcccuggccccauguuccuguguccagcuaucauuccuaggccuuaccugggaggccagacccauccucuccuuaagccacacccuaacucaucucuacaugcuggguggugacaagcaaggacaccccgaucugcuuggcuccuuggcuggcagcagcacccacacaucccugcccaccaccugcucaggcuccagaucccaaggaggagguggaaggugccugcccuccauuaucagccaugcaacauuuauuagaagccgcacagucucucuugaccaguguuccgcaucugagccacaggaugcagaaaaugacuugagugauucucgucaauucuuccaaggaugguauguaacuagucucauucuagaaagaaguuaacucauuauacacaguggauggcuuaagggauuagggcuucauucucucccagacccugguaguaaaaggccuuuagagcuuucaaaggaaugagguuaugucuguggaugccaucaccaagcaaagggccucugguccaaaugccuggagacagccccaggugggaaaaccaccaaaugggcaaugcccucucugcugcgccugccacagcguuagagcccugcacguaagcccggccaugcccacagcauucacagugccugcaucacacccugcacugcaccccugcacccugggcuucacagucagagcccuccucacaccacugcugagcucaggcaagugcacaaggaaagcuguggcucacugcucggcuccagcagagguggucccauggaccaccuguugcuacagaggggucggcagcccugucacucaaggcaggguuugcucugcaagcugccccagccuggcgccuccucuacgccacccccccagcuccuccugcagcuccuguugcuccuuuccaggccuacccggucauaccucaugccucacccugcccuuggccuuuacagaugguggcugcaguucagagaaaggucaucacugagaauaacucacaaccucaacucugugagcguggcaagggggacucggguuaccccacaguggguguugcaggcaggcacccaagggagugucauguggcccugcaagcucagcccgcccucagguggaaguggagcccucauccugccuggguugcucuugcccuccaagccucucugagggccucucuaccuuuccccaagcuagguaugcagcagguacucaauaaacacugaccugaccucaugggccucucaacagccaugacuuggcaaaggacacuuaauucacccagugcagaagugcuuguacuuacaucccagaacucgaacauguuuugagggucaauuccaaacuccuucacuuuggucuacaaaaaaaaaaacaaagggagagaaaugcaaagaagcauuugcuagcgggaugggaacaggagcuccgggaggcagggagcugugcuccgugagcugagccucaccuuccccagagccagggauggggcagggcuggagcagccugugagucgagggcagggcccaggaucugcccaccccaagcuggacaccagaucaguccaugaccagcacgccagugacguugugccugcaaagcccccugcugagggcagcuguaaccccgugugaggaccuggcccacacacugcucugcaacagcucucacccaggccugccugggacaccagagcaugauaccccuggacaucugggaaccgaaccuaggacugggacccaagugugggcaggggccaccuaccaggccaggcaaacaaacacaggcugaacagccacccagcccuucccaugugugggagggugacugcaccaggaagcucugaggagccaucagguauucugguccccagggcagacagggccagcaauuccuuaccuauuccacauaggaggagaagcccuacugaccagucaguugcaggcaggcaacagugcuaugguuagccagccuuauggcguccugcugcagcuggguaggcacuggaggcagagauguggggaugaugguggagggggugggagggagauguggguguaguccccagcucugacacagcacagugcccacuggcugacugcugcugucacuccuggagcaucccucacucugucaugcccugcugagccugcacaaccucgaggccaggcagacugugagaacuuggagacaggagacccagguucuaauccuggcaucaccuacucauacagucacuaagugggccggguacaguggcucaugccuauaaucccaacacuuugguaggccgaggugggcagaucacuugaggucaagaauucgagaccagccuggccaccauggagaaaaccugucucuaccaaaaauacaaaaauuaccuggacgugguagugggcgccuguaaucccagaaucagcaggcugaggcauaaaaauuacuugaacccagaaggcagagguugcagugagccaagaucguaccacugcacucuagccugagugacagagugaccuugucucaaaaaauaagcuggacaugguggcacacaccuguaaucccagcacuuugggaggcugaggugggcagaucacuuaaggucaggagucagagaccagccuggccaacguggugaaaccccgucucuacuaaaaauacgaaaauagcugggcaugguggcgugcaccuguaaucccagcuacucgggaggcuaaggcaggagaaucgcuugaaccuggaaggcagagguugcagugagccaagaucacgccacugcacuccagccugggcaacagagugagacugucuuaaaaaaaaaaaaaaaaaaaaaaaaaacaaaaccacacacacuaaguagggggcaaaaugucaccucccuucauuggggcuuuauguccuuaagugaaaaauggaaugcauccucuaccccuaccuagcaugucacauuuggggagaugcugggcacaaaggccuaggaaggucauguguaugaaggguucuguguaucagucaggccugggagacggaagaagggguuaucgugaucccacugacuccaagccucccuccucaaagcugcagagguugaauggguaaaugcggaaaaggcaaggaaggcuugcagcccacaggcaaccaaaccuuccauaccaucagccaagccaagauccaccagaccuacgaaccgcgucucugagaggccaugaccuggacaugcugggcacucccaggaaggcaguacaggggaccacgggggcacuuacuguguuaguagacagggcaacaaagugcuucgccacugcagaaggcuacaagagacagagccaaguuaccacagccagcccagggagacaaaggguagucacuucccaucacuagaggaaccaaggcccugcaugggacugagauucccaguccuugguucugagacuguuggagaaggcccacaucgaggucaaggucaagaaagcagacgggucacaggccgccugcucaucccaucuuacaagcauacggggcucagggacgucccuccccuauaaaauagguguggccaagaguuccugcagcgccaagggccugcagagaaagggccaugcaagggcugucagccagcgagagcagguucugucacaucugcaaggcugggucugacaaagccaagaugaacaaucaucucaucuagcaaaggcaggcaccggcaaggccgccuucacuuccaacuucaggagaaacacggccagacuuggucacucaggggcccacccugcucuucccagcccagaggcuaaccacgaggaaggcccuauagcccacucacauccuuggccgccuggagaaaccacuccuucgccgucucugcauucgugauggucuccuggguaguaaaggucugcaaccaaagagaacagcagugggcgcccgagcuuaggggugggugcaggccuugagccaggguucagcaguagaggccaaggcaaugcccagcugucccauggagcaguauuugcaggucagugacagugacgccacauaaccuccugagauuccagcucuuuaaaaccagaggaggggggacgguaaacacaccccccaacccuaagccugcaggucaaaggccgcagcuucuccccugaggggcugcagucaaccugaggcucucuucggcccaggcuggaagguaucucagaauucagauggaauucuucauauuuuauguacauucaugugaguaaauagaacauaaauaaaaacaaacaaaaccccucuauuaucagggcauggcucugggaucagaaaggagcaagcauggcugggcauggcggcucaagacuguaaucccagcacuuugggaggccaagggggggugcaucaccugaggucaggaguucaagaccagcauggccaacauggcaaaagcccaucucuacuaaaaaauaauaauaauaaauaaauaaauaauaaaauuagccaggcgugguggugugugccuagucccagcuacuugggaggcugaggcaggagaaucgcuugaaaccugggagacggagauugcagugagccgagaucacgccacuacacuccagccugggugacagagccagacucugucucaaaaacaacaacaagaaaaggagcaggcauaaaggacagguuuguaagaaaguggcgagcagucccaggcugagcagagaugccgcaaggcgagcggguguggucaggacacaaagguucaaacugauguguucaggauuucaucagucaaccuuauuugcugcuaggcauggaaacagucuagggcagcuguacugaccugauccacaaaccaugguucacucggaacccaccaaaagggaccaauggccagggggauggcaagacagcugucccuccccaccccaacacacacagggccaggggccgggcaguuuucggcacucauaccuuggaggcaaugaugaacagggaggacucgggguucagcugggccaggguuuuggcaaugugaguuccaucaauguuggagacauaccagacgcggggaccuccugaagaguauggcuuaagggcuucagucaccaugaggggucccugcggggagacauagcaucagagaauaagaauucagggcccacgaaaaguggagacagccaggucccaucccuggagaaaguaaagaccugagugggaccaacagugcccagacucccacccuaccccaaggcaguuuucuccucaccaggucggagccgccaaugccaauguugaugacguccgugauggucuugccuguguaccccuuccagucaccgcuccggacacgcuggcacaggggcgaagaugccaucagcccaaacccccaggcauaauccgcugcucaaaaacaucauuacugccguguccugguaccucagucccagcuuucaggcccucgcaggugccucuauuuuuuuguuuuuaauuuaccauauauauauauauauauauauuuuuuuuuuuuuuuuuuuuuuuuuuuuuuuuuuuugagaugaagccuugcucuguugcccaggcuggagugcaguggcaugaucucggcucccugcaaucucugccucccagguucacgucauucuccugccucagccuccugaguagcugggacuacaggcgcccgccaccacacccagcuaguuuuuuguauuuuuaguagagacaggguuucaccguguuagccaggauggucucgaucuccugacccugugaucugcccgccucagccucccaaagugcugggauuacuggcuugagccaccgcacccagcuauuuauuuuuaauuuuuuuuuugagacagagucuccacuuucuggguucuaacaauucucaugccucagucuccugaguagcugggacuacaagccugcgccaccagcaugccuagcuaauuuuuuuguauuuuuaguagggacgagguuuugccauguuggccaggcuggucucgaauuacuggccucaagugaucugcccagcucggccucccaaagugcuggaauuacaggugugagccaccgcgccucgcuauuuacuuauuuuuaaaacugugccuuaggggccaggcaggguggcucaaggcugagacaggaggauugcuugaguccaggaaguugaggcugcagcaagccaagaucgcaacacugcaccuccagccuaggugacagaggaagacccugacuccaaaaacagaacaaaaugcucugcuuuagccuuuuuuuuuuuuuuuuugagacagggucucacuccgucgcccaggcuggaguacaacggcacgaucucagcucacugcagccuccgccuccaggcuccaggguucaagcaauucuccugccucagccucccaaguagcugggauuacaggcaccugccacccugcccagcuaauuuuuaguauuuccaguagagaugggguuucgccguguuggccacgcuggucucaaacuccugaccucaggugauccaccugccucggccucccaaagcgcuuggauuacaggcaugagccaccacgcaaagccuauuuuauuuuuuguagagacagcgucuugcuacguugcccagccuggucucuaacuccuggccucaaauaauccucccaucuugaccucccaaaguguugggauuacaggcgugagccacuacacaaggcauaggagucucuggagaccacacuggucccugccacacucaccaccaacuagacucuuuccugguuacaacagugagacaucccuaccuuacagcgacacugucagaauuugcaaaaccagggauaacucggcagaaucugcuaugccagagaccaagagaugugaaauguugaaaacugugacugggcuaugcuggggaaaggaguaucagacccgcagccagucuccaaucagacaccagugauccuugcuuccuggaauucaugccucugcauagcuuccgccugugcugggaggggugaccuaugcacccauccagagacugcaaaaaggggugaaaugugacuucagaagugaguucagagaacgugcaguuucugcuuugcucucuuggaugacucgcuuuggggaagcugucuaucauguugugaagacauucaaacaguuucauaaagaagcccacgcggcagcgaacuaaggccuuuuuccaaaagucacagccaacucgcuuccuguguaugggacacuuuagagggggguccuccaaacccaucaaaacuuccgauaacuggggcgcuggccaacauguugacuacagccuuaugagagauccccaaaccaagaccaaccagcuaagccgcucccaaacuucugacccacagacacugugagagguaauaaaaguuuacugcuaggccgggcaugguggcucacaccuguaauccuggcacuuugggagaccaaggcaggcagaucacaaggucaggaguucgagaccagccuagucaacauggugaaaccccgucucugcuaaaaaaaaaaaauacaaaaauuauccaggcaugguggcgugugccuguaaucucagcuacucgggaggcugaggcaggagaauugcuuaaauccaggaggcagagguugcagugaguggagaucacgccauugcacucuagccugggcgacagagcaagacuccgucuuaaaaaaaaaaaaaaaaguguauugcuguuuuaacccaaguuuugaugucauuuguuauacaaugauagauaacuaauacagauuuugguaucagaaguacaguguggucauaauaaaaaccuaaauaugcaggccggacucaguggcucaugccuauaaucccagcacuuacugggaaacugaggcaggaggaucacuugaggccaagaguuuaaaacuagccugggcaacauagcaagacgucaucucuacaaaaaauaaaaaaguagccaggcauggugacaugugccuguagucccagcaacuuagaagguugagguggggaauugcuugagcccaggaguucgaggcugcagugagcagugacugcaccacugcacuccagccugggcgacagugugagacccuaccucaaaaaaaaaaaaaacaaagaaaaaaagaaaaaagaaagaaaagaaaagaaauaauuaucccauacauaccagucaucccaugcccaccucaccauuguaugcugggugugugagggguaauuugucucuuuaaauucucaugucuucagauugaaaggaacuguacuaaaggaaaugcagguacuacuacaccuguacuugacaaaaugagguucuagacuucuaacagacuucuaauacuguaacagaauauggacuuaggagaaagugagugggguaucuguguguggaaggaacaaaaucaaucacuaggcgccagaagcgggacuaugauagucccccaccuucuaagauggugaccagugguccuugucuccuggcauuaacccacugaugcagucccuucccaugaugaccagagcugaucuguaacaccaacgggguauuauagaaaucaaagaguguagccgggcguggugguucacccuguaaucccagcauuuugggagggcaaggcaggcggaucacuugagaucaggaguucaagaccagccuggccaaaauggugaaaccccaucucuacuaaaaaaauuuaaaaaaaaaaaaaaaaaaaaaaaggcgggcaugguggcgggcaccuguaaucccagcuacucaggaggcuaaggcaggagaaucgcuugagccggggaccggagguugcagugagccaagaucacgccauuguacucuggccugggugacaagagugaaacucugucucaaaaaaauaaaaauaaaaaaaagaaagaaugugaauccugauauuaggucacaaaagaccuccaggcaucugccuuacucucuauuggaucacucacucugggagaaauaagcugccuugucaugaggacacucgaacugucugugccucccaaaggcagcacugcuagugagccaucuucaaagcagacccuccaacccccaugaagccuucaaaugaccacauccuuagccaacaucuugacugcaaccuuagaauaucagagccacuacaccaaacacagccacugcaaauuccccacauaaagagacggugauuguugcuucuaguugcuaaauuuuggaauaauuucccacacaucaauaaaaaauuacuauacacuaauaagauccagcaauuuucuuuuaauuuuuuuuuuuuuuuuuuuggagauggaaucuugcucugucacccaggcuggcaugcaguggugcuaucucagcuuacugaaaccuccaccucccggguucaagcgauucuccugccucagccucccaaguaacugggacuaccggcaugcaccaccaugcccaguuauaaauuuuuuuuuuuuuuuugagacagagucucgcucugucacccaggcuggagugcaguggcgccaucucagcucucaguaaccuccaccucauggguucaaaugauacugcugccucagucuccugaguagcuggaauuaugggcgccugccacuacuccuggcuaauuuuguuuguauuuuuaguagagacggguuuugccauguaggccaggcuggucucaaacuccugaccugaagugauccgcccaccucggccucccaaagugcuaggacuacaggugugagccacagcacccagacuauaaauuauuuuuuaauuaaaaaaaaaaaauaggcugggcacgguggcucacgccuauaaucccagcacuuugggaggcugagguggacagauuaugaagucaggaguucgagaccagccuagccaacauggugaaacuccaucucuacuaaaaacacaaaaauuagcugggugugguggcagguaccuguaaucccagcuacucgggaggcugaggcaggagaaucgcuugaaccugggaggcggagguugcagugaaccgagaucaggccauugcacuccagccugggugaaagagagagacucugucucaaaaaacaaacaaacaaaaaagagacagggucuagguugcccaagcuagucuugaacuccuggccugcagugauccgauucacccuuccaaaaugcugggauuauacaagagccacugcaccuugcuggguauuuuuuaguuuuguuuuaacgacagggucucgcucuguugcucgaccuggaauguaggaguaugaucauagcucacugcagcuucaaauuccugggcucaagcaauucucccgccucagccuccuaagcagccaggacuauagguacacaccaccacagcuggcuaauuuuuaaauuuuuguuaaaggcagggucuuguuauguugcccaggcugguauuauacuccuggccucaagcaauccucuugccucugccucccaaagugcugggauuacagaugugagcaacugugccuggcccuacuuuuucuuuaaauaaacugccaugggaaaauuuccaucaauacagaaagaaauaaaauaaguuguucaacuucucaacccucccucacaggcgugugacaaaagagguuagaaaaagcaagucuuggcugggugugguggcucaugccuguaaucccaggacucugggaggccaagguggguggaucaccugaggucaggaguucgagaccagccugaccaacauggugaaaccucaucucuacuaaaaauacaaaaauuagcugggugugguggcggaugccuguaaucccagcuacucaggaggcugaggcaggagaauugcuugaaccugggaggcggagguugcagugagccgagaacucgccauugcacuccagccugggcaacagaguaagacucugucucaaaaaaaaaaaagcaagucuccuuucccgacugucaaagguuuguuauaaugaagcaucccagaggaaaaaugugucuuuuuuuuuuucuuuuugagacaaagucucacucuguugcccaagcuggagugcaguggcgugaucuuggcucacugcaaccuccaccucugggguucaagugauucuccugccucagccucccgaguagcugggacuacaggcaugcaccaccaugccaggcuaacuuuuuuguauuuuuuuuuaguagagaugggguuucauuauguuggccaggcuugucuugaacuccugaccucgugauccacccaccucggccucccaaggugcugggauuacaggugugagccacugcaccaagccaaaugugucuaucuuuauuacaauuacacccagccuucauuugaccaaaugagucuuuaccauacccaccaauucugcaacuuccuuuuucaacuucccaguccauccugaacagcauggcagaucaauccaacuauagcucccuaaucccuauuggugcccaggaugacaguauaugaauaugugcugacucuacuuuguaaguccccugacaaaugaguacagcuugguuucagguuuugccacuacaaucaaggucacagugaacgucuucacccaaucuuggcaaacuuuggagagcacagccauggggaauguuccucaccaggggauuacugccauucagcaacuuuuuuugaacuauaaauaccuuaucagccugagucagguacuccaguggccagcuuuaagggaaggcuuuccuggaaacagcaccccagacggugcagugccauccucgccauguggcauggcugagcacacccagacugaucacacagcacuaggcuuuuaaugcacuucagcucugccacucacagcagauggcuggaaaggccccgccacacacccaaagaccaucacauggacugaucacccuaagugacauucaggaaauccagauucccaucaggaccccacaacuuccuugcccuggaggcgucucacucugucaccugagcuggaggacaguggcacaaucucagcucaguacagacucaaccucccgggcucaagcaauccucccaccccagccucccaaguagcugggauacaccaccacaccuagcugauuuauuuauuuuuuccagagauggguugguuuuuuuguugguuuuuuuuuuuugagacagagccucacucugucacccaggcuggagugcaguagcgugaucuuggcucacugcaaccucugccucccggguucaagagauucuccugccucagccuccccaguagcugauauuacaggugcucgccaccaugcccgcccagguaauuuuuuuguauuuuuaguacagacggcguuucaccauguugaucaggcugaucucaaacucccgaccucacaugauccaccugccucagccucccagagugcugggauuacaggcgugagccacugcacccagcccauuuucaggucugaaaguggcucuuggccaaaguaacuggacucugaccagccacacauggaggccacugcuccuaggacaagcagcaaaugaucacagcugacaagaguuuggacgaucacccucguagcaugcacagcccacacaggcacaccggcaucacccucguucuccagacgugaggaugucugccaacccaccccugcagaaucaccgcuaggguagacacugaggcaagugcuugauguggggaaacuuagcuggucucugaggcaaccccuaccacccuacacacaaggaaaagaaggcauguuacaugcacugucacugacacacggacacugcuuacauacuuccagguggaaauaagcuucagaggagcagggagaaaaccaaccugugugcaugugcacauguguacguguuucaaagaggagaugacagauguguaugugcacaggaacuuucuggaagacuucacaggaaaacuuuucuauuuuuuaaauuuauuuagagacacgaucuugcugucgcccaggcugcagugcaguggugucaccauggcucacugcagccucaacuucccaggcucaagccauccucccaccucagccuccugaauaguugggaauagagguaugagcugcugcgccuggcuacaggaaacuuuacaaaggcugcuucuggaggguuagcugggaauggggaugaggaaauuuuuuuuuuuuuuugacagagucucccucugucgcccaggcuggagugcaguggcgcaaucgcagcucacugcaaccucugccgcacggguucaagcgauucuccugccucagucucccaaguagcugggauugcaggcguaugucaccaaaacuggcuaauuuuuguauuuuuaguggagaugggguuucaccaugauggccaggcuggucucgaacuccuuaccucaagugauccacccaccccggccucucaaaguucaggaaucacaggcaugagccaucgcgcccagccaggguugaggaaauuuuacaauguuuuaucuguuucuagacugggugauaagggcguaugacaaaagagauuagaaaaagcuccuuccggccaggcgcaguggcucaugccuguaaucccaggugaggcaggcagaucaccugaggucagggguuugagaccagccuggccaacauggugaaaucccgucucuacuaaaaauacaaaaauuagcugagcaggguggcgcauaauuguaauuccagcuacucgggaggcugagguaggagaauagcuugaauccaggaggcggaaguugcagugagcugagauagcacgacugcaguccacucugggcgagagagugagacuccaucucaaaaaaaaaaaaagaaaaaagaaaaagcuccuuccuuuccugacuguccugucucucaggggccccacuuuucauuugaagccucugugguuugucaccaugaguccauaggugucuacaauucaggaaagaaacuggccccacuucugccagcagcagauuccuucagagcagagccaggagaaauucaggccucagcagagacuccagggucagcgaucacacaggcaaccccucccuuaagcugcagugagaaccugaguccugccuacaagaagagggaagagcugccccuuagggcucccagauucccaaauaacucacacacacggccaagggugaguccggcccaguagccacuuaccuggcagaaagacuucaucuuguccagaaccuuguugaccucuggcaucacauccuugccgucuaccaggauggguguguuugaccgguuccgcagagccacgugcagcacggcucgacccuggggauuacggucaggauauaaagacugccccccccaaccccaggcagccaugcucccagcugggcauggugccauagcucggcccucuauccacuagacaggcaggcccugaggucucuguuagcaccauaaccuuguuccaagaacccacuguaugcuuagaggaguaggagcuccccaaggacuuaugugcugcagacagucaggaggagaggaggggacccauauaugccuaggacaggccccgaaggccugccagagaugcucagggcaugaacagugagagaaaagaggaacagugagcaaaggcagagaauggcaacaauacaugucagaaacaagcaauaaaugcuuucagaggccgggcgccauggcucacgccuguaaucccggaacucugggaggccauggcagguggauaacuugaggucaugaauucgagaccagccuggccaacauggugacauccugucucuacuaaaaauacaaaaaucagccagguggggguggcacacaccuguaguuccagcuacucaggaaucugaggcagagaaucgccugaacccauuagacagagguugcagugagccaagaucgcaccacugcacuccagccugggcgacagagcaagacuccaucucaaaauaaauaaauaaauaaacgcuuuccgaagaugagugcucaugaagccugaaguaaccucauccucccaauguguguccaugguguuugcuggcacguuuuaggcaguguccucagcuccuuggauuugcagcaaggcaugcaacucaagcuucccucaccaagcagcccgauaacuaccaacugccaggaaccaaaccagacuugaagucugugacgggugccaggcggcuggcccagccacgugagugaaauggccugaagucagcagaggaguccuugagggaaggucuaacgaccccaggugggcaggaaaaggaucaucuugggauuccgacccagugagaggcuugcuaagguggagggcuucaugccaccccacccucacccugccagaccccacuccugcgccacauuuuauuggcaaaugcacuccuccagaaagccuuccuugauugcauccucucucagcuuagacccacaaugcaagacagguugagugugaaucuccauucugccucuuacagcuaugacaucuuagauaagugaugugaccucugaaccucagacuccucacauguaagaggaggauaaugacaucaugaggacagagucugggugcucaguguccauuauaccuccaggcugggcucccauacugagucaggaacaggggcccccaggccuggccucaccacugcuuccuauugacuccuacugcuugaguaggcugaagucuuuggugaucuaagauucuucuugucgcuacuaaaacuugcauugaggauauauuagaguuaacuucuccaagaaaaugucagccuugagaaacucucccuguggguaugagauaugcuccucccaggcagacacugggaaccauuccaaggagcucaccaaaccaaucuuguggaaggcacaccccaaagcccugcuacaagcaggaggaaaaaggccuucaggccccucauuaagcaaaagcauugcccaagagaaggggugaagacacagggugaugcggcuaacagucagauaaaccccaaagggaaggaaggaggccccagaggguauguggggccugcucaccucgguguaguugaucuucucaccauugaacauccgcucccgggcggccuccacgccccuggacuuggccuaggaagagacgauacugaggccuggucccacccacacuggccaccccaagugucagcccccaaacacaaggcuuggugcuguccccaaugagacagacagacggcugcugucugguucccuccccugcugucugggaagggucuacucagacaucagacacuggggucccugggaugcugcuuagaaccuaagccagggacaggugccucaccagcacagaggaggugacugaggucuaaugagaggaagaacucaagauacucaagguccuggggacucccaggagcccagcucacccaccacucugucgguuaccaguuaugccuccccaagcagaacauuaccaaguccaccagcauccgcaucacguccuccgucaccagguucuuggaguaauccaccaggauaugcccaugguugguguugagggucaagcugcagaaagauggagaugcugcugaccacacccuggucucccuagcggggagccaugcccuaagcaggagcuguucccagaagaaacauccucccugacccacgccccacaagggccgcggccacccagcacagugguggugucugucaccugcuggcccaccaggaugaucugcaacagcagcccagagaaagaagccauccucacagaccguagaugcaggcagacccuggaugaggagcccggacugaagugggggaccaccccuucccagggcuuccacuuucugccguaaguuacucaggcacccauccagaugacagggauggccaucgggacgucuagcccggagccacagucgcuccccucccccgccuccaccaguaucagugaucagagcucccuuggccgcacucccgcccaugauuugcucaaacacuccuucccacuucccggucgugcacaggugucuucugcaggaaucacgcccgacgucuccauccuuccacccagcucccucaaacacccccgcccgggcugcccgcccugcagacgcucccaagcucauguggccaggagcggauggaaagggacagcccuuucccgcuugcugcgucagccaaggccucucuucacaacugcgaaaggagccccugcucaaauggccagagcugcacggggaggaggaggggaaauguccccacggaggggcccguuuuuccucguaacgaagcagacccggggccgagacucccggcgaggcugcaagcccccaggaacgcacuccaaggagacuccaaggacgaagugcggacucggccugggccccaguccguggccuggaggucggggacugggguccccgggcaccgcugcccccgccuccagaccccaggcccgcgugcccgguuccgggcgccgcgcguggcagcccccgccuccggcccgcccgcaccugaagugguugaagcgguccuuguuggcaucgaagaggcggcgcagguucagcucggagcggugcucgcgguaccauugcugcagcuucuggaacugggggucccgggugagagcggccauggcgggacuagaagguacacugagugagacgcgagccgaggaggaaggagcgccggcagcgcgcagcaagcgaggcgcgugggcgcgcggcggccuuuauggcgcaggcgcccggccc

SEQ ID NO: 15122 - RNA, 18509 nt, Homo sapiens
cguccggggcgcggaccucggccgcggggagucuuggcugccgccgucuccaucgcgccgcgcgcguaaaggaaauggcgcgucuagccgcgagcggucggcccggugccccagcgcgucccucccccgcggcggccgaccgcguguccgcagacgucacgggagaggggcagcggggcagagacccugggagggcggccagggagcgggggaggggcggccuggcccccggcuccgcuccagccccgaccgacuggcagcccaguuucuucccaagucccgcccccagccccgggcgccgcggcggcggcugcucuccucuuuguaaccgaggagucaagaaaugugagaaacgugcccuguguuacuuauuugggagccgaaaauuuaugcccagcugaaagcgcccggggaaauauuacaucagaugaaaugacaaugauuaaaaucagccucucccccgcccccuccccgagcccggaggaggcccgggcgccgcguggccggccggcggggggcggggggcugggccgcggagggcgcuggggccugggcgcaccgcucccgggaggguccuggccgcggccccggcgggaaggcgcgggcuucgggagaggcggguggggaucgcccggcgaaaggaggggaaacggcgcguuuuugucgccaggcgcgggcgcgcggagcuaauugcgacucuaauccucugccccgcggcgcagccgagccccgagccaggagucgccgcgcgcgcccguucgcgcuggguaauuuggggccggaucgcugcccuuuacguccgggcugggccgcggcgaggcgcuggcuaggggcuggaguggggggcugguuuucucuccagcaaucgagggaggccgccggagagagaggagggaggagaggaggugggagcggcgggagggcagccggagagcggcgcgaggaggaggcggcggcggcggaggcggcggccgcgaagaggggaggaggcgaggggaggguggggaggggaggccccggcgcgccgcgccgcgaggggccgcgugaagcgggggccggggcgggagggguggguggggggaggguugggggcgagagagaaaguaacuccaggacgagaccggagcgacccgcgcagcgagcauaggcggcgaagcugcgcccggcgcccgagaccggcagcugcguggggcgggggcugcgcccgagcccgaucugccggcuccgagguaagcucagcgcgggcggccaccgcucagagccgcgcaacccugccccgaaguggcugcgauaccgagaaagucgcccggccagggucuggaccugggcgggggcggccgcuuugucccucugcugggcggcgggggcuggcggcgcgggggugcccagcacaaaggccuggugcaagagugggguugcccacgugggcugguccuggccgcggguggacccuccccacgcgggcggucucggagcuuccugccgcgcggugugugugugugugugugugugugugugugugugugcgcgcgcgcgcgcgcgcgcuuguggagguccccgcacucuggccccuguucugggccgagcgcccugcagagcuggcgaguuuccggggucagaaacgggcucacgcaacuggggcuucgggaugcacaagucccggcuuggcgcccaaaaucagagaaagucuccagugggacagaugugcguccucugacgcccaccccacgaguccgaaaccuggcaggaggggcugucgcgcuggugguggucccgggcgcgcaggguuuggggcugggagaggggccgcgaugggagggaucgccgccugcagauccgguuccccgcugcccgcccgcacccccugaccuggacgcgcgcacccggcacacacucgcaaacacacccgggggcggacccccgccucugcagcgccuuucugucuuccggcggcccccacccgcgacugcagaaagauaagcuucaaguuuucgcuccguaucucaaaugugcaugaaggaauuuaacugcacgagugaauaacagcauuaguuucaauuaauuuuuuuuuaaucccggcaacaauaaacuuugagaacaaaagcgcuuuuacguccuuaauuaggcgagcuucccaucuguggucuccaagugucugccucuugauuuaacuuuguccccgccccgccuccgcggcaaccccucccagcccagccccgcgcuucgggugccgcggccaccccgccccgcggcgccuccagccuuggcccaagcccucucccgucgccccuaaguucacaccggccggcuggcuccgcggcggaggcgggaggggggggguggggaggcuggcgcgcaccagguggcccgccugccucuccggggccaccccugggacaauugugcaggcccccaggacuuucgccccgggccagcgcccugagugcggagccgaggggagcucgagaggcgccuucuguuuaccuuuuaugguuaaaauaacagcuuagcaaagaagcgacuucagaagaagcgauuuagugaaaucgucucaagcugccgcagcucagccaguuuaaucacccccagagagccgaacaacugcgagcgcaaugggacacaaaaucauuuuguguguaaaugagcguggcauucugcucacuucucucugcucgggcgggcggggcucggcggcgggcgggcagggacccgggucucccgccgcagcuggagaagcgggucacuaccgggccaguuuggaaaccugugggcccucccgaccgcuaucgcugaggccccugcaacaggcgggccagggcgcacuggggcugggugcuggguuugaugcuggugcugguggaaugaacuuguaucucucacugcacccacuuuugugcuucugacuuaagcaguggucucggaaagagggucguggucccgcacggaugcgcuuguugggagaaaccuuggagauucacggcaaggcguaaagccuggggcuuccaacgguaaguuucuggcuugccaugaacaucagguuguucuugggagggaaaaggggcuaagaacagaguggagcggcuucugugauggaggcuugguguucacgucacuuuggaauaguguccugguauuggggaaaacaucuugcaguccgcuuugauagaauuucagccagaauuccuuccuguucaguuuauccucagcgcgucuucccuucugacuccucccccagcagagccuccuagggcaggauaauccauuccugaggucuguuuugguucucagaacuccuugagcuaagugaccugguuuuguuuuuuuaagcuuguagaacucaggaaugccaaaagcaguggauucugaguccacaggccccagugaggguauauauuaaacaucacugucugcccauugcaaccucccaccccaguuuuaugucaggaaacuugcccgggcacucagggagagcaaccuugcuuacauuugcaggauuugauucugguuggauuaaaauuggauauugaauuucaaggcacaaauuuugaucccagaguuuuaaugggaaaaagcaaucccaugggucccaagaauuucaagugguuucucucuuaaagguuaaaccuucgagagacguccaggguagguuuguggaagccagugucuguggaugugugaaggggggugacuauucacgugcaaaucuccucuuuccucccuuuugagacagcuguaaaucagugaacggggcugcagaauucugccccuccugcauagggccugcaaagcgccccuggguguggcuuccagggacugagggacaaucuuauuucaggugacuacggcacagaggagaguuacugagugccucuggggaggagcaguagaaaggguccauuggcugaucugcuugcucugugcuuccuccuggccaccuggccaucuccugaugccucggggguaugugauccugaggggucuggaaugcauuaggcauagacaacaccacucugggagucuggggagaaacugugagguacagacuaggcaaacaaagacagguuuucucugcuauugggagccacagagaagaggcggcuucccaagugacuugcccucauccaugugccuggacuucugcugaacggcuucccugugucuggccagaugcaagcuguaucuuaucaccauggggaugguauuaagagagguccuagguucccuggcccauggagggugaggggugcuuucugagccuugguccacaaggcuguugcaagaggagacacgcuugguaacauggcuugaaaggaaaauaccaggaaaaucugguuuguucugaaauauuuuggggcaauaauggugagcauauguuucagugcugucauuagccgaauuagcagacauggagcugcccagaaaacacaugugugagugugacugugugugugugcauguaugugugugucaucugcuacagccuggaggccugcuuugggguguggagacagauagagagauaguggcgguggagucaaucagggagggcugcauggaccucgcagggucucagagagcaugcagaaaggacaauucuaagugucuuugaccccaugguacaugacuaggaggaauaagccuucucugguuuugucgaugccucccgcagauacucugggcagggauggaagccuagaugccucaccgcaaggagcggccgagcggguccucgcuucacacacacggcagcaccggcaccgcggugagccugcagggugggcugggucccugccgggaguucccucuuucccuucuuccccagugccuguuuacuggcuguccuuccuugggaccaugacacuccagguggcuguugacuggcuguaggauuauguauuuuugaaacaaaaaugcucuuaauuugaugugaaauuuacuacauguauaaaacucaacgccuuaggugcugaggaagucacuaauuuagaggugucucguuacugagacaaacuugcaaaaaaccccugaaucccaauucacaaauuggugauucguuugucaggggauauuucacaucuaacacauaagcccacgaccuuuaauuagaauuuugcaguuuguuuuaugccccuggaggcugacaccuugaaaaauuuuuuuucuugauuucuuauugcuaauaagcaucuuucuuuuucccucugguacuuugaagaaaaugaugcaaauacacuuaauuacagugguggccauaauuugucagcugaauauaugaucaggcacgggcagaagugaucugauuagaucugugaucacacucucaauaaagggagugcauggcuguguuguggagaaacucuuguguuccgcuuugaaacucuuguguuccgcuuuguuuccaucucuaggagggaggaaacaugucccggcugucucucacccggucgccugugucuccccuggcugcccagggcaucccccugccagcccagcucaccaaguccaaugcaccugugcacaucgaugugggcggccacauguacaccagcagccuggccacgcucaccaaguacccugacuccagguaagaguaagccccuugaaacaucaggcaugugugggucagggcagcaucuguaaucugcugccuaggggguggggucucuccccacugucacuccacccaccagggucuccagggugcacaagcugacacagccugagggagcuaggguuggggaguccaagucugccuguugaaagcugcuaugcacagaggcuugugacccugacuuggcggcauugguagugcaagguggagcuccugacccaccugcaggggacuagggcuuauucagagccagcccagccugagccugccggcagcgggcaggggagucucacguaccuucaagguuccucuggagggagacuuaggcccggccccugcagggggucauuugugagugauacugaguagguaagucuugggggcauggggguggguauuuaauccuauuuucuauuccaccccugggaaauucacaaggggagggaagaggagcuguggugagcugcagugugccaucuuugucauuuuccguggccacugcugggcccuagaggcuagcagcaggcuucccuuggagcuggugcugcagugacuagcuaggaaugaaucacauaccucaucaguggauaaagggucucuggccaggacccugguugggggcucacaggcacccuccaugcugcugaacuuauaggcugcccaggcccuugggccugcgagagguuuggggugcugggugcugccagcucuccugcucuuccuugcaggguguuucucuccugggugagggaccugcuuuccccguuggcacggcagcagggcugacccgaguagggugggucuugagcagcuugcucagccgaggauguuugcuccuggcacagagaggcggucaucgcuccccuggggcugcugaaggcugagcgugggagggccaaggcugugggcaucaccccuguguuaugcauuugaaauaacaggaggaguuaauuaaucccccagauacugagggaucaucucuggggagcauacacggcaggcugcauugucaccggugugguuccucagagcagggaggaugguagugcgcagagguggcuuuccaagccuguuggggcugcaggggagccugugcaggugcaggcauggucccuugaggaggaaaaacuggaaaugggugcagugucuaguuccaaauuuggagagucuaggguacagauggugacugguguuccaguaccccagguggacagagacucagccuggggcccuguggccuuggggcuugugggguggggacaagagccacggggccaggucagcaguguuggccugugugcucacucacagagcccugucuaggaugggagauagauucugcuuauuuaauuuccauuuugccuucugcggcauuucugaguuguuugagauagaucaucccuuaaucgguugacgacguuugugagugaaauucauaaaaccuuugcccacaacccucucugaagaguuuccugaaaucagagaguugccugucuggaguaaucacagcccaggcccugggggaggcgggugggagaggcuucucauucugggcucuuggcugcugccugagagcaggagggcagggggccaucuccccccacccagccccacugugcugcucacccauugcuuuguucugcugugggaugugcucucauggggagcuagggccccuguggcccugugaucuggcacuugggacccuccuggugugcccaagggguggcagucuauguuuauucuuccccagggcuggggcucaaggugaaucuguuguucugccuggauggccucuggcugcugugggggugcucuguaggccugaagcuuuggacuagaggccagggauggcugaccugcaggacaaucaggggacaggaggccagggggccugagaagugggucaggcagcugugcuggcaagagccccucagaucucucuuguccuuccuguaguggauuauuauaauauaagcaguuuucuaccaauucuggaaaaaaucaaucucaccuagugucacugaucuaggagacaccuggagauggaggacuaagagugcugugguccucaggggguuucuggauggugaagaugaccugcccuaggcagcauuguaaaagcugggaccucuacccucggcuccccugagaacucugccugagccucugggucucggcgguugggguggccugggugcuggagagucucgugcugggugacuccucuggucugccuaggagcagucacugguccucacccgagacagccaagcacagccggggcugggaguggauucccugggccggcccccuugcugguguccugccugcuugacccccguuagcugccgccaucacagccacacucugacauccauccugacuaugggaagcaucaaaugaagauggccaggagcuucagaacucuuaaaaccuggugccugaaacagccaggaaauuggagccagagcuuaaaaaaaaaaaggaaauaaacgagaagacgaaggccauccugaugcucccccuugugcacacagggcaggugguuggaggcaucuuuucugccccugagggucccaccugcugcagcgugaacuggccaccucauuccauggaggacuucggaagccggccccucaaacccugcauccucucucagaggguggccugggccauuuuccacagggaacguggagccccugacagagcugggaacucauaccugcagggcugagaauggcugagggcuccuccauggugauuauccucaccuuuccucaaccugcucacguccuuggcagccucagacgcugagggcaugaaaggccucuguccugggagaggcgguacagcugccgcuugauccaggagccuauacugaaccauggaaagaucuagaaucagccuguccugaaauaaggcagauggaaaaccuucuaaacuuggaccgaugagacaaccuagaacccauccagcccuggaaugugggugcaucaggagucuucuagaccaacaggaccagcuagagccucagccagaccugacgucagaaggguugggaacucagccaggccuagaaugcugccugcuuacauggacuuuggagcuccacugggaaggguggggagaguucccaggaggcugaggguuuggaucugcugacucaccuuggauguagcucuuacuucccaccggugccacacauggaccucagccaccugccaaccacugcccaugguaucuggcagccugggacagacccaucugucuccaggaaugcuggguggcccucacucugacaucuggaugcccacgcucuacuaggccagguccuagggccuuuguaacuggagccagccguggaacccacagccuuuccagcaggggcugugaccugcagugccauugucaccaggccuaggggguugacagggcucaucggccuuuggagcucugagaugaguuguaucuggguggcugcagcucuggguccacagacucgggcucacagcagacucugaccuccccaugcccauccacgagacagccuugcccuuuucuuucuuucuuuuaagcgacagcguuugucuuucuuggccaggcuggaguacguggugugaucucggcucauugcaaccucaaacgcauggacucaagugauccucccaccucagccucccaaguggacuacaagugcaugccaccauacccagcuaauuuuuaaauuuuuuguagagauggggucuugcugcguugccuaggcuggucucgaaccccuggccucaagcaguccuccaccuuagcuucccaaagugcugggauuacaggugugagccacggugcccagcuaaaccgugcccuuuauacuacccugcuaggagagaaaccugcaccguguucccagagacuccauacccgggcagaccaucauggcugaugcauugagugugcugggccaucagagcauaggaugguguggacgggaggcccugagggcagacuugggggcucugacucccucagcuccugcccagcuaguguguccugggugcaaguggcaguggggcagggcccuggagacggcugacuuggaguggacagaggagugggcugcuguuagaacagggggcaucccugcaggggucccugcuggugcaggcagagagugaggggcuuaggcuccagauugugugcaggccgggcugggaagccuaggucccaaguuggagcuacuguucucccagcugugcagagaagcugccaccuuggcaggguccagcugggcaggaguguggcccugccugcugaaggaugugguggugcugcccuuggggaaaugaugccaacuucccuccuguucccaaaccaagcccuuggcuacucccaccccucuuuaggguuccuaguuaucccuagcucgaccuggggucugccagggcaguugccaaaccagagcuggccacccugggcacuggggaggugguaucagcccuggcucugaggccuggcuccuucuccccggaguggacagggacaggcaucaggggcuccccaagacccuucuccuggucuugcauuuguuagaaccauugcccuucagaggacaggguaccggcaccugccuucucuccaguccccauccgccaccacuagguguggugugcauacgcucuggcaugugugcacauauguaugcacuguggugcaugugugugcaugguuucugugugcguguguguaugccuguguuguggcaugugugcaagggcccuguugcaugugugugcuguggcacacuugccaucccuccugucugccucuguuucucccugugggcucccugagugagcggcaguaggggauuugugccgucaugucucugggugccugguguugacagguguguguccuuuccuggaugugucuggaucugcaugauauguguguguugggaaggaagggaccaugugacccugugccuguugcacaggccugugugucucacacucguuuacauggguuggguggggaggauguauguccuggcucguuuacuggguguguggcuguuggccgggguguuggaugguucaugugcauuuucugggugggucuaucuggcaagggugugugcaccaggccugugaccagcugguuuguguguaggggguaaggugccugugucuugcuauaccuuuccaggccuguaacauaacguguguuggcaggcugguguguacagcugggugugucccucucuggcugugacuugcggguguaggcaggaugugugguguguccuguuaacuguagccuggcugccccaggugugugcagauguugucaggccuggaacaguuccagagucacccaugucaggucccucgccccuccagccgugugggcccucaggagugggggcggggugugggaagacaggcagacuuguccccaucccuucagacaucccaccucgccugucucucccaggauaagccgccucuucaauggcacugaacccaucguccuggacaguuugaagcaacauuauuucauugaccgggauggggagauuuuccgcuacguccugagcuuccugcggacguccaagcugcugcuuccggaugacuuuaagguaaguccauggcugguggccccccugcacugccugugugauggcauuacacaggggacgcugugacuuaauaaguggaccccugguugucaugguaaccauaaaaaguuaaacgaugaagccgagggcuaaaucaguuuuucuaaacuaauuuuguuuucucacauuuuuagcuuauuuaucaggguauauaacaacaaucaagcugcagaacguaucccagcugaacauuugucguguuuaaggaugggcgcgugccagcguuauaguaguuagagguucauaaaucuguuccaucggcugggugcagugguucaugccuguaaucccagcacuuugggaggccaagguggguggaucacuugaggucaggaguucaagaccaacuuggccaacuugaugaaaccccaucucuacugaaaaugcaaaaauuaggccuggagcgguggcucacgccuguaaucccagcacuuugggaggccgaggcggguggaucaccaggucaggaguuugagaccagccuggccaagauggugaaacaccgucucugcuaaaaauagaaaaauuagccaggcgugguggcaggccuguaaucccagcuacucgggaggcugagacaggagaaccacuugaacccaggaggcagagguuacagugggccgagauugcgccacugcacucuagccugggcgacagagcaagacuccgucucaaaaaagagaaagaaaaggacggcuguaauuagacuucaaaaaauaaaguauaaaaagaaaaaugcaaaaauuagccgggcauggugacaggugccuguaauaccagccacuugggaagcugaggcaggagaaucucuugaacccaggagguggaggcggagguugcagugagccgagaucacgucacugcacuccagccuggaugacggagcaagacucugucucaaaaaaaaaaaaaaaucuguucuguguugggcaauuugcagggagaaaagcccugaugaccaaacagauacccuuuaaacaaaagguuaacccccaggucuccgggugagcccgucagggcaggugaccugguucccugggucaugccucagugcugagccccucccacaugucagggacucugggaggaaggaaacucaggccugggguacacuggcauguauuaauacuagcaaaugucuguccuuccuuccuucauuccuuccucuauccagaggaccaguagcccuggggccuugucuuucauccagcucaguuacugagugccagccucugaauucaggcugaaaacagugaaacacacacacuaggaccugccccacaacacuuaacagucuagcgggcagacagauacugaacuugaaguccaugugaccugggcugggcggguuugaaagaaaugauguucaucuggguggugaaggcagaacggggccaaacaggugugagggccuuggugcaggggauggggguggcagauggcuugaugcauuccagaacuggaaagaaggugucaagccuggagcuuuauggacugggaggggaaggucaggaaaggaggcugcuguuugaugucaggaccuugguggguggcccagugccuggcauuuaacucugaaugcaguggaaggggugugugcaggggaagggcagucagaucugcaaauugggaagaucucucuggcuguuggguggggaagaaggcagagaggggugggggugggugcagugaggcaauuauggaugaggccccuuccccaggccaagggaggcuggguggaggcuuuggauggaccaggauggagauagagaagauggagcaagguggcacaucagacuucuguuuaguacaggcacaguggcucacuuggucaucccagcacuuugggaggccgaauggggaggauccuuugaggccuggaguucaagaccagccuggacaacauagcaagaugcugucuauacaaauuuguuuuuuaauuaaaaaaggccgggugcgguggcucacaccuguaauucuagcgcuuugggaggccgauuuagguggaucaccugaggucaggaguucgagaccagccugaccaauauggugaaaccccaucucucuuaaaaauacaaaaaugagccgggcgugguggugugcaccuguagucccagcuacucgggagacugagacaggagaauugcuugaacccaggagguggauguugcagugagcugaggucacaccacugcacuccagccugggcaacagagcaagguuucauaaguaaauaaauaaacuuuacuuuuaaaguuuuuuaagaguaauuuauuuacuuuucauaaguaaauaaauaaacaagcaagcaagcugcaaaagcacguggcugugguaguguaaagggccucuugcaggugccccgggacuuguggcuugaauucugaguugguaaguugaggcccgggguggaccaggcugugggagugggguuucugccccugcaugggagagcugguggggcaucagauggagaaauccugggccaugacaaaagaugggguugucugucaugcaguugucauuuaaaaucucaggagaauggccaggagagguggcucacaccuguaaucccagugcuuugggaggccaagcaggaggaucauuugaucccaggaauuccagaccagccuggaccuugugucuacaaauaauuauuauuguuauuauuauuauuauccuggcaugauggcucaugccuguagucucagcugcucgggaggcugagucaggaggaucccuugagccugggaguucaaggcugcagugagcuaugaucacaucacugcacuccagucugggcuacagaaugagacccugucuaaagaaaauaaaauaaaaaucucaggagcaagugagaguggagagagcagaggcccaggauagagcccugaggagcccuugcauggggcaggagaggcaggaugggccacugacccaugacaggcccagaggucaggguuagaaucuaggccucccuccaggcggccagcagguggaagggacuuagggccuguaggucagggggcugggcuuccuugccucuuccucaggcaugagucauggggaccuaugggaccuuggccauucccaguggggugggugugugugagcguguauagugugcauauguggcccagggcauggggccaguaucagcgccugagggacagucugugcgaggcugcuuagcccagaagggggcugcguggcagggggcgggcuuccccucccuggacacuuuaucacacucugccuguuugggcaggggcuggaccaggcacuuggcacaucuugcauccuuugauccucacuuucauucucugagcugguuguuuauguccauuuuauacauaagggaacugaggccgggcgcaguggcucacgccuugggaggccgaggcagguggaucacaugagggcaggaguucaagaccagccuggccaacaugggaaaaccccaucucuacuaaaaacauaaaaguuagccgggugugguggcaggcaccuguagucccagcuacucgggaggcugaggcacgagaauuguggaguuugcugugagccaaaaucgagccacugcacuccagccugggugacagagagagucugucucaaaaaacaaaaacaaaaaaaaaaaacaaaaaaaaacgaaaaaaaaaccaagaggcucaguuagugagguauagagguuuagaggucucagggcagguugaugaugaagcugaaaaucugacccaggcaggcuuggcuggagaagaacuuuuuuugcuuccggguaggcugugagcuccuaggcccggcugcccugugcccagcaugaucucuucucucggugggauucuaaggcagcagcagguccccaggcauaggcacagccucguccuuuaguggagcuuccaggucuuuccauggggaggcuucacugcccagugccuggggccagauggaagggcucaggggggcuggcacaggugcacaucagcggcugcccuugggacaaggcuagguucuuuauacuugcaaaccacucaguugccccaucuguacaaugggugcaaccggcccaguccacacaauacccugcgagucgcaguuccugcagaauugguuggaaccggcaggccgccuccccucucccccuucccccaccaccccuacuccgacacccacaucaacacccugugcgccuguccccaggacuucagucugcuguacgaggaggcgcgcuacuaucagcuccagcccauggugcgcgagcuggagcgcuggcagcaggagcaggagcagcggcgccgcagccgggccugugacugccugguggugcgcgucacgcccgacuugggcgagcggaucgcacucagcggcgagaaggcccucaucgaggaggucuuccccgagaccggagacgucaugugcaacuccgucaacgccggcuggaaccaggaccccacgcacgucauccgcuucccgcucaauggcuacugccggcucaacucgguacaggugagggcugcacgcugcccccuccccgccgcacccccggcguccgcggagcccuccaggggcagagugagcuggagggaggcgcgaucccugaaacggugaagccccccgugccauccuacaaaaaaggcaacaaugugucgaugcauaauuuaugucccucucauaauuaaaugauggcgccugggggauggacuuaaaaaaaucgaucuguacuuuuuuuuuuuuuuuccaaaaggauguucuauaaaaauggcccagaguauuuucaacaaagcgugcuucauuugacacccagagucugacuuuggauucgaacuaaacccaggcaacaggcgaggcaggacagaggcugaguggaaagguggucuggagccccuucccucucccugcugaccugggagucgcaggcacccaccagcugccaagagaaucccuggaccggcucuuccuggauggguccaagaauuggacagcucagauggagugagggccuauuuuccaacagcucuucgcagacccaagagcuuggcacauuuccggguuaggguggaaugggcuuugcagggaagagggcccccugugcacgcauuccacagccugucggucagaacuugcuaguugcaggagacggguguuacacgcagucaucagaccucacccucacagaggcacaaacccacauaguuguggacgccugcagagacucaaauauugagaggacuucuccuuuuucucucccuccagagcucccacgagcugaugcacccccaggcuucaaaccaccuggaaugcacagcucagggaagcugguggaugccuagaggcugaaggacagggaacucuccauuauuggggcaggacucagggaggacacuuggggccaugugucuggagagagggcauagguuacacccuacagaauaaagaagggacccaaagccucuuuuugccucccggaaucaaggcccugagggcagcaggaugguggccuggguggggucguccaacuagguuugcuaaccugaggggucacugggccuggccacuucugucccucuggugguggaacccagcacgugguucuguagggaccuuugucagugagcaagacugagaucgucacaggagaaggugcccuugcuggcugccccagcaggcacccaccucccugccaggccaagccagguguccucuugcagcuuggccuugaugaccucuguuucuuccugggcagguccuggagcggcuguuccagagggguuucagcguggcugcguccugugggggcgguguggacuccucccaguucagcgaguaugugcuuugccgggaggagcggcggccgcagcccacccccacugcuguucgaaucaagcaggaaccccuggacuaggcccugcuucagugcccaccugggcccccccagggaccuggaaacagugcuggggaguucugccuguguauacuuggccgugggcaugagaccgagggugaggcuggaggguccaaagcuggcccagcgagcaccagggucccaggugucauggcaacagaacgugggaugcuggaggcaugccugcagaaggacuguugaugcgacccaaagauacagcggugggaucucugcugccagcucucccagccccucagcuucgcagccuggcgcagcauccucugaggccccggggccuguuggggcgggguuggaagagccgucugcagcuacuucagaggagcuguuuaucccucuccacgcggggcagacucuggcgggucuccuagcguccgagagauggcuuauuuucuacaguauuuaaaauggaugcagcccuaacugcaaaagucagagaggcugacaaggaccaaugcuucuuuaucuggugcucaguucucagucagacgugcagcauggcugcaggguggaccagcugccuggcauucaggcccagaugccugcagggcuggggcucucgggacagaugcagggaugugugcugcagggcugcugggaggagaguggugggggccugagggcugagugauucuguaaccaccugagaccuucacguuugcugccguugggggcucaggcugcacuccccgggucaccugaccugcugcccaggggcuuccaguccugucuguguggacuggcaccugggcugcuggagaagucuccucccguucggaccagccucagggcugcacguuaccucaggaaugggccccaccaugaaggggcccaucugucagcagcgucuucuagguccccagcucagggagccauccccagcuccaguuuucucaugcgaauaugcacaguuuuaauucacguuguuacacuagccugccgaugagacccagacacaggcagaccuggcgcucuugaccccugauuccagugaggacuggcccugaggaguccuugcagaccugcugccucccccacgacaggcccaaagauggacccccccuggccuugugacagcuccccaaguguucuccgguggagaaacugcagaggacuggugggcggggcuccccagccaucaccauccuguguacaauggcuguagacuuguauauggcuccuuuaauauuguaaagaugcugauguacaauugucgugcauuugugugaacacauugcguucccaguccaugccauaaaugaugcucucaagcaaaagacuggaggcucuguccugugcag

SEQ ID NO: 15123 - RNA, 9775 nt, Homo sapiens
gcuggucuaaaagugcuuuugucagaaaaagaccggccccccucacaaagaugucaucacucgguaaaauuccccaagacacguuauuggauucuaaaucacaacuaauucaaaaaagugaaacgggccacacuucccauagaaauaauuccugaccuccacuuuucauuaagaugcagcaagcagagauuuauuucccaagacaugaaaauaauugaggcaucagagaagaaaagcauuuaaauggcauucccuugaaauauucaauucacaucagcucccuggacucaacaguuuaugaaaucagcaaauucaucucuacagacacucuaugacguaaaugaggacaguguccacauguacuacaaaacuccagauggggaaaggccuuacuuuaaauucuugacuaucuaucucgaaacauaagaauuucuucccucucuaaauggaaaccauguucugagacacuaggugauuaagcgggaacccauuuauucaguuauuccuuucccuauucugguauaauuuuuaguuuagaccaagugacuaaaaauauaacuaaagauguaucccauguucagagaaaacuauuuuccuauccacuaagggcaaacggggagaucuagacuuggacacaaauaccucugccugucuccccacuuuccccaccccuacccccagccguccagugugggaacaggaaagacagcaaggcaccugccugggcuucccagcuguuuaacaucuggacugcuuuuugguaucuaauauaaagaaagccacgaugaaagacaagucauuguuccaaaguuguuuuuuauuuuauauuuguugaaagaaauaaaauuauauuuaaaaaaaauagagaaaucucacaaacugaugaaagccaggaacaaaaagaacaaguuaguacuuuuuccugagaggcagaucuaacagcugcagaauggacuucuuccuucccagcuuuugugaaacaaaacaauucuccuaaggcaucagaaagcacugagugcaaaauggguuguucagguacaaggucucaagcccucuaauggggacugggaaacgugaaaagcugcuacaauuuccucuccuuuaauaccaaauguuaaacugucuauacuucuacuuuuuauguaaauuugagaauuucacacucaugaccugcauuucggaccuggucguguuugauuaaaaucuuacuacuuagugaucugcacuggcaucccaacaacugauugcaggggccagcagcaggaagagcugcucugaucucaccauccgcagccaaaaccagccaaagagcacccaucccaggagacucagaugcagcuagaaauuuaugcuaaagccuaacuccuaacuaugcuggaccugcccacaagggcagaucacauccuagugguucacaggucacacacagaacaaaaguuacaaaagucaccucacaauucccgaagcucuaaauugauucauuccccacacgugguuucccuaauuuuauacugauaaaucuaucaaauuaaaagcuuucauuuccaaccacuucaauaagauagacaacaccaugcuuaacauuuuuguucucugccuaauugcuugcuucugcuaaacuuugcauuuccauggcuaauaggaaagcuugaacccauuuuuccaaaaguuccaaucuuguguucugauuugaaauacugaguacacaccccugaugcuuucucuaaaguuucuuuuucaagauacuuaagucaauucauauaacugguauaaauuccaugggagcaucgaauucccaagagauuuaaaugucuguagcgccuaccauaggugcuugcuuauacauucaagugaccuaaugcaucuccaauuaaguuaauuauguaacaccaaucagcugcuaaggagccaguaggauccuguggguguguccuggcuaguuuuucaaaacaucucucauccuucauggguagauucauacuccaagguaagcugguguuggacccuagaaaccccuauccugucuccuggcucuauagggaguuaacagcccuccugggacagcuucuccugggcuccaguuuuacauucagaaggaccucacgacucuuaagaauggcuuugcugaguugcuggacaccaugaugucuucuccugcccagaaacggcacggucagcaaucuuccaccaaccggagggugcaacuugaguuuuauucuggcuacaucaucccaaguccuaguaugaaacagcaauguggccaaaaaugaccauguucaaauaagauaccugauaacacaaacuuuuaaaucaguuaugacucagucucucaucuccagcccaggcacacaaaaaauacacaaauuugagcuagaacugugcuaagaaaaaaagagaaagaaaagaaagcaaaagagagaagaaaaaacguugacaaagacaaucuaaacuaccaacacugacguaagccagacucuagagucccuacuuuagcgacugccauuuuuuagucucaacaaaaaugucaauauccugaguuuuaucagcauuuucugaaauaauuuaugggacacaaaagcauauaaaugaauaaacagaagcagugguacaaagucuggaaagcccacuaaccagaaaaagaaaugucacaacaacaauaucaaaagauguauuuaagagaaauaaauuaaagguuaaaaccuuacacuuucaaguuuucuuagacaauuauuuugggagauggcauggaguugauacauuucucuaauaaucacuugguuaagaucaaauaccaaaaugagccuucagaagaaaauuuugacuuuaaaaguaacagccccauggcagcuauuuugaacacaagagaaacuaccuucugaauuaauauuccaaacccucaucaguagcuugugucaucaaacuguuaagauauuuuguuuacuaacuugguugucaaaauuguauccaaaaaaacacuagcaucugcagaaacuaaaauuuugguacacaaguuucucuacaccacugaguuggguuuuuagaauaaaacaaugccaaucuaagcccaaagguaucucaaaaacauaauuccuaugcuuuaguuuuauuuuuguguuuaaucuauuugcuuccuaaauguuauuuguauuuuuuaagucaauuggccacacacuaccuauaagaugugaugaaguuucuuuacuuaaccugacauugcuacucaaaaacuuguacuuuugggggaaaacaguacuaauuauguuaaaacaaaguuuaugccauauauaaaaucacuccaaauuacacacucauugcuuucuauagcucuacgaauuuauaauacauaauuuagaagaaaaucacaaauagauuaccauagguggcauucaacuuuucuuaauccaauucagccuauccauuaaaaccaagaaccuucugcgcggccugccaguuccccauuccuuuugucaacuuaaaaaagaagcauuucuugggaagucaggauuuauuaagaacaucgggaucccagauauuucuuuuuuuaccauauaccuuaacauuugggggauuuugauucccacaaaaaccucuaucauuuaaaaccagauauucgaauuacaaggcuaacauuuuuagcuaaucaacucuucagugcugaucccagaaaauagccuccaaugggucuuugagucauggaaauggacaacuuucagccauugacaugaguggugucgguggucacaccuuuaacauucaagccacaagcucuaaagucuggaaagggugaggucuacuguccugcauugucgccaucugcugucguauuuucagugcuaauggacuguacguugucugcaagguugugugcaugcucaagaaacaaaucuuugaguacacuuaauuccuuggucagcaauuugauuuuugcuuccaaccguucauucucuucuuugagcugauugacucucugcagugugucuugugcuuucugcuugcuuuucaaccggcucuuuuucacagccauguuguuccucucucggcguugccgauacucgucacuguuucgauccaugggcgaacucuuuuugcucugcuugcugggagccacagcuuugccuccucccccagggccagcaggcaccagcugaggaaccugcuguaagccgcuggcaugugccuggguauggauaacacuaauuccguucaccccuggagugcuguuuugcugcgauaucuugcucauuugggcacucucccuugccaacacagaacagguagaaaugagagcagggugaucaaugguuuccacgcuaagcugccaaaaaaucuucacauguaccuaguuaaaaaauaaauugcauuaaaauauuugaaaugacaggaucaaaugagaucaaacuuguacguaccuaacaucaggccaacauuaauugauucugcugagaaaagucuacagcaacugccaacuguuccaauguuucugaagucuaaaucauuucacuuagaaagguaaguaagcacagaagcaccaucaggcgaaacucagcccaccuggaucccugagggcacugccccucugcgauuguuaucaaaaaugggaggaaaacaaaagacuuccacuaauuagguggcgcaugugaacuaacagcacuugacaaucucccagggaggagcugcagcugacuguaguaggagagacaccugcaaugaaaggggggaaaaguuuccauuguugguucaagucaaaacagaaggcugggguugcgcacccugucuccagcgcucucaugcuaucaccccugcggguuccauguucuaauaugcagagagggagucaucgaggacuugaguucucucccagagcucucuucaucggauauuuugaaaagguaguuuuuugcuuuauuuuuuuaaugaccucaaaugauaauuccacaguuuaaccaaauuuacugagucaguuucuugaauuuaggagcucugacacucaauuugcuccccaucccaccaagcuuguaaaaaguguguuuuuucuucuugacauaauuaguaaaacucaaaacacacucaaccugaaaccacaaggaaagaaacagaagcccucaugaugcauccaaggaagugcggguccugggacccaggcuggacaaaggagcugagcagcugccgugccuguggccacuucgugcuaccaaaugagcucgugugagcucggaggacgcaccagcucugaagcaucccugugcugcugccugcagaaaugaaggcacgguuucgaaaagcagucacauguggauuacucugaauccaauuaagucccuacagcugccccaagaaguguaaaagugugacuauccuaucaacaugaggccacuucaagacaaacuaaguucagugaacgguguccaccaaggaaucagggcacucuuagaaauuuagaaagcaguguuaggaacauaaaacuauccuguucucuuuucacaaaacugcuaaaaucacaucaguggaaaaaaucuggagucagauuuaugcagugaucccacaaugagggaaagcucaguuagcaaacaccaguagcuacacccaaaccuucagccaggcaauucuguacacuguuuauuggucucuuuuuaaaaaacaucuuugcuuugaaaaguccaugugucauuacuuuccauuguuuucaaagccacacagccgacucugagcuaguaggucaucuguucucacgccaacacuaaggcaagacaaaaagcaucccuccaaaccaugagggcgauccacuccaagccuaucuucaguaauggacaguucacaauuucccuuggucaucauuagguugccucauuuuucuuccaguagaaaaguggcuguuuaguauuaaucugagccacauuuagugccaccuaacauuauuauuauccauuuggugucaagugagaggugcuuuacucaauuuuuaagaacuuguuuaacaccuccccugagacugucuuaacaaucauaaucauguucaccuuauuucucuacuuuuuuuuuaauauaccaauuauauuuuuagccuuuaaagcucucuacagucaacuuguccaugcucagagauagcaaugauccaaagcgguagagaccagugaccaggccaguucuugucuuggcuguggcucccccuauuuuaguuugggcaaaucucuuuucuuccauggcugucuguuccccacaugcaaaugagggauguggaauaguaagacacuuuccuacagacaacacaccacgaccuucagucacuaacaaacagcucuuacucacuacaggguccacguucagcaacguucacgccuguuuccguauccaaagauacaggaacagggaagggcuuuuucaccucugccugacucaucuugcaagguacuaggcugaacgugugugguaggugagguuuuaaagguaagcccuuuggccugaaaagaguauucacugaaccuacaaacuggugaaaauguaagaaagagaaacuuggagauaaucaaaauaacuccaagaauguuuuguuuaguaaguucuuuaaccauauaaauagcucuuaaagugaagauuaaccaaguaaaaggggaucaaagagcuaagugauuuuacacugaaaaggccacucucauuuacgcuuuguuccuccacacacauuuacugaacaccuacaacaggcaaaaaguguuuauuugaaagcuggacacucaguccuaaauucaagucuggcuccucuguggacaaacacuauuccaaaguucaggcuacaggaugcagggcggcgccuggcuuccuuccaugugaaucacucaaggaggaaacagcaggaaagcugaagagcagugguucucaaaguguggucccuggaccagcaucaucaucauccaggaacucuuuagaaauguaacuucucaggcugccccagacuuagaaucaggaguucuaagaacagagcugaguaaucuuuucauaaggagaccuccaaguaacucugaauacacugaagucugagggccucugcugcugauucccaaugaauauugagaaugguggacuaaguggguaauaggcuuuguuuuaauucaaacuuaauucaaguaauguucauucacgucagucacacugaaagcgcagaauguuagaaugaguaaaacaaaaucaaauuuuucucaaguuucaccugggaaaauaaaccuaucaagaauuuuccuaacccuuuugucccuuuucuccacagaccuagaacccaauauuccuccccuugcccaccaaaauaaauuuuucacucgauuuccucaaugaaggucaacauuucaaaauagucacagauguuucuccuugguccuaacucuguuuagucucugggauuugacaauuccaccuaaaacaaacaaaaaaaaaacuucccaucuacucuuccucuccaucccaaucccaucgaaaucaccuuaggccacuaucaucucucagggacacuggucucuggucuagccugcuuccuccaaccucugucuccagagcaauugaacacucaaaccugagugagucauucuccuggugaaaauucaucucuggcuccagucuacaggaucaaauccaagguccugacccucucuccucccucacaccacaucuugacaguacuaaaccacuaucuguauccuaaauggucugugcuuucucuuuucuuugggcaucugggaaaauuuguucccuaggucugucaacuccagccgcaucgugucucccugcagaucuucacaagcaucuagcgcaggguccaugaggaaggggacguccccuuucugggaguacagaagugggucacuggagcauuagaagaacaucaacaucaucuuucuaacccaauccuuuugaagugauuuacaacacacaaaacaaauagacuauuuguaaaugaacauccauuaggaggucaugcucauuuuugucuuuuuuuuacugauagagcuagaaagccacaaacgcaggaggccaguguaccuaucaauauaacaacccauggaaccaacccucccaagaacgcacaauacagcuggaaucguggcuaccuguauuuaccauuacugugaccaagugaggcaaucuuagaccacgagaccaaauucagccccacgagguccuauuugucuuuaccaggggcucagcacauaguguuuaauuucccagggaugaaaccaucucuccaagaucagacagccuugcagacagacaugaugugaucuugagaauuuaaaggauauucucaaugaaguuuuguuuccaucuacuuuuuuuaaaagcagguauuaaaaauaacugaaccagccaagugugcccaccaaaagcaggaaucaagaagcugaaauaugcuucagcucccuuguacccuguaauuauuuagccuuguuuacagcaacuuuuuccagaagcagaaucgaccuuaugaacagcuuaucccaaauacuacucaagggcuaacagaugaccacaucuuaaauaucaagagcuucuagguguagaaugucuucguaaagcaagcccuuauaggauuuucuuuuaaaauuuucucugggagucacauuucuuugggagaagucugccuuaagugacaaccuauucauauaagcagucaauucugacacaacuaccaauuuuggugucacccaucaacauugagaccuuucuaaaucuuauacauuucaggaugccagauuacaguauaaacuucaaacaagaggaaaacccaacacguaaaccugcggaagagaagcaacacaccagcugcccuggaaaacacucuccuccccccgcgacacaugcauuuccauccuucgcaucuggucaccuccgcuggcugucggcccugcuccgcucccuccaacuaugccugcgaagugcuucauuucuucucuauucgacccguagguguugcguguucuucuaaacuacguucaacaguaaagugcaggacauuccaacagcuccacaaagaagcaaaauauuaucucugcaaagucaugcauuuaaaaaccaguugcuuucccuauuuuauugaucagucuuugaacuucugaacagauuuucgaucaccgcaagcugagcccuucuagaagaucaggauucuaaagcucgacucgguccaccuucugcuauucugggaacacccuucauccccaggggccaaugcgagccuggcgggucacagcgcccguuucaccgagagggggccgggcuccgcagggggcauuccccggccguucgcgcgcucccggcccgccgcgaggggcgccccgggcagcgcgggggucgacgggcggcgccgcagcgcugggccgcggccaggaaugagcucagcguccccgccggguguugccggcagguugcaucagacgccgcgcggcgccgccgcccgcgccuccagccucgcguggccuucccgggccagcgggccgucuggggccggggcuggguuuccccgagccgggcccgcacccagucgagcggccggcgucgccgcggccuccuccuccccguucucagggcgcccgccgcagccuccuuaccugcuccucuagcccgccugcccccaggcggccuccacuccgagcggccccgcgcggugcggcccgagccgacccaggccucacagcccgcgagucagcgaggaggagcgacgguuacgaaaccggcagccuccgcccguuccgcagccgcggccaccggcuuccccugcucgccggggccgcgcgcg

SEQ ID NO: 15124 - RNA, 2603 nt, Homo sapiens
cauucgcgacccggaggugcgcgggcgcgggcgagcagggucuccgggugggcggcggcgacgccccgcgcaggcuggaggccgccgaggcucgccaugccgggagaacucuaacucccccauggagucggccgacuucuacgaggcggagccgcggcccccgaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggcgcgcggcugugggaccgcccugggccagccuccggcggggacccagggagugguuuggggucgccggaucucgaggcuugcccgagccgugcgagccaggacuaggagauuccggugccuccugaaagccuggccugcuccgcguguccccucccuuccucugcgccggacuuggugcgucuaagaugagggggccaggcgguggcuucucccugcgaggaggggagaauucuuggggcugagcugggagcccggcaacucuaguauuuaggauaaccuugugccuuggaaaugcaaacucaccgcuccaaugccuacugaguagggggagcaaaucgugccuugucauuuuauuuggagguuuccugccuccuucccgaggcuacagcagacccccaugagagaaggaggggagcaggcccguggcaggaggagggcucagggagcugagaucccgacaagcccgccagccccagccgcuccuccacgccuguccuuagaaagggguggaaacauagggacuuggggcuuggaaccuaagguuguuccccuaguucuacaugaagguggagggucucuaguuccacgccucucccaccucccuccgcacacaccccaccccagccugcuauaggcugggcuuccccuuggggcggaacucacugcgaugggggucaccaggugaccagugggagcccccaccccgagucacaccagaaagcuaggucgugggucagcucugaggauguauaccccuggugggagagggagaccuagagaucuggcuguggggcgggcauggggggugaagggccacugggacccucagccuuguuuguacuguaugccuucagcauugccuaggaacacgaagcacgaucaguccaucccagagggaccggaguuaugacaagcuuuccaaauauuuugcuuuaucagccgauaucaacacuuguaucuggccucugugccccagcagugccuugugcaaugugaaugugcgcgucucugcuaaaccaccauuuuauuugguuuuuguuuuguuuugguuuugcucggauacuugccaaaaugagacucuccgucggcagcugggggaagggucugagacucccuuuccuuuugguuuugggauuacuuuugauccugggggaccaaugaggugagggggguucuccuuugcccucagcuuuccccagccccuccggccugggcugcccacaaggcuugucccccagaggcccuggcuccuggucgggaagggagguggccucccgccaacgcaucacuggggcugggagcagggaaggacggcuugguucucuucuuuuggggagaacguagagucucacucuagauguuuuauguauuauaucuauaauauaaacauaucaaagucaau

SEQ ID NO: 15125 - RNA, 2603 nt, Homo sapiens
auugacuuugauauguuuauauuauagauauaauacauaaaacaucuagagugagacucuacguucuccccaaaagaagagaaccaagccguccuucccugcucccagccccagugaugcguuggcgggaggccaccucccuucccgaccaggagccagggccucugggggacaagccuugugggcagcccaggccggaggggcuggggaaagcugagggcaaaggagaaccccccucaccucauuggucccccaggaucaaaaguaaucccaaaaccaaaaggaaagggagucucagacccuucccccagcugccgacggagagucucauuuuggcaaguauccgagcaaaaccaaaacaaaacaaaaaccaaauaaaauggugguuuagcagagacgcgcacauucacauugcacaaggcacugcuggggcacagaggccagauacaaguguugauaucggcugauaaagcaaaauauuuggaaagcuugucauaacuccggucccucugggauggacugaucgugcuucguguuccuaggcaaugcugaaggcauacaguacaaacaaggcugagggucccaguggcccuucaccccccaugcccgccccacagccagaucucuaggucucccucucccaccagggguauacauccucagagcugacccacgaccuagcuuucuggugugacucggggugggggcucccacuggucaccuggugacccccaucgcagugaguuccgccccaaggggaagcccagccuauagcaggcugggguggggugugugcggagggaggugggagaggcguggaacuagagacccuccaccuucauguagaacuaggggaacaaccuuagguuccaagccccaagucccuauguuuccaccccuuucuaaggacaggcguggaggagcggcuggggcuggcgggcuugucgggaucucagcucccugagcccuccuccugccacgggccugcuccccuccuucucucaugggggucugcuguagccucgggaaggaggcaggaaaccuccaaauaaaaugacaaggcacgauuugcucccccuacucaguaggcauuggagcggugaguuugcauuuccaaggcacaagguuauccuaaauacuagaguugccgggcucccagcucagccccaagaauucuccccuccucgcagggagaagccaccgccuggcccccucaucuuagacgcaccaaguccggcgcagaggaagggaggggacacgcggagcaggccaggcuuucaggaggcaccggaaucuccuaguccuggcucgcacggcucgggcaagccucgagauccggcgaccccaaaccacucccuggguccccgccggaggcuggcccagggcggucccacagccgcgcgccucacgcgcaguugcccauggccuugaccaaggagcucucuggcagcuggcggaagaugccccgcagcguguccaguucgcggcucagcuguuccacccgcuugcgcaggcggucauugucacuggucagcuccagcaccuucugcugcgucuccacguugcgcugcuuggccuugucgcggcucuugcgcaccgcgauguuguugcgcucgcgccgcacccgguacucguugcuguucuuguccaccgacuucuuggccuugcccgcgccgcugccgccacucgcgcggaggucggggugcgcggcgcccagccccuugagcgcgcugccagggcccggcaggccggcggcaccgagcgcgggcgcggggugcgggcugggcacgggcgugggcggcggcguggggugaccgggcugcaggugcaugguggucuggccgcagugcgcgaucuggaacugcaggugcggggcggccaggugcgcgggcggcgggugcgggugcgggugcgagggcggcggcggcggcggcggcugguaagggaagaggccggccagcgccagcugcuuggcuucauccuccucgcggggcuccugcuugaucaccagcggccgcagcgccggcgccccgacgcgcucguacaggggcuccagccugccguccagguagccggcggccgcgcagccguagccgggcgggggcccgugcgcucccccgggcaugacggcgccgccggggcccgcgggcgcgcccggguagucaaagucgccgccgccgccgccgcccguggggcccacggccgccuuggccuucuccugcugccggcugugcuggaacaggucggccaggaacucgucguugaaggcggccgggucgauguaggcgcugaugucgauggacgucucgugcucgcagaugccgcccagcggcuccggggcggcagguggggcgggaggcugcgcggggcccgcgccccggggaaagccgaaggcggcgcugcugggcgcgugcggggggcucugcagguggcugcucaucgggggccgcggcuccgccucguagaagucggccgacuccaugggggaguuagaguucucccggcauggcgagccucggcggccuccagccugcgcggggcgucgccgccgcccacccggagacccugcucgcccgcgcccgcgcaccuccgggucgcgaaug

SEQ ID NO: 15126 - RNA, 16183 nt, Homo sapiens
agcgcggggagcgcggcggggggcgcgggcggggcggggcuggugcgcagagcuguccagcaccccgaggcggggcgugcgcccccggcccgccccagccgccuccgcccgcccagccagcgccacugcggcucggcgggcgcgucacguggcuggcgcagcgcggccuccaggcuccgggcgcgggcgaggggccgggcgggaggacugacagacccacggacgcucuaccggcggcacccggccgggcgggcugggcgcagcgcggggcggcccggggacgccggggccgggcgggcugcgcgccgcggggcaugggcgcgccggggguccccgggcccaggccggccgcggcggggcucccggggcgcgggggcagcggcgggcgggggucuucccuggcggccgccgcugagcccccgcagggcccgugacgccgcggccgauguggccgcgcgcgcccuacgggccugcaccgccaccgcacaaagacgccucgggagccgccgccugcacccgggccgcagcagccacgccagccggagcccgagcccuagcccgagcccgagcccgagccgcagccagagccagagccggagccgcagccggaaccggagccggagccgcggggcaggaggcggcgcccgcgggcggccgggcccggcauggagaagcgcgcggccgcggggcuggagggcgcgccgggcgcccgggcgcagcuggccgucgucugucugggugagugggccgcgcgggccgggcagguccgggucccccgcauggcaguccgcgccgcgcccugaccgaccuccucuccggccgcggcaucccgagccccccaccgcgguggcucccgcgcggagacccagagaggggccagcaccgcuugcccgccuggccccgggccugggagggcgacucugguggcgcagccccggcucccgccccgcucggaguagcgcccggagcccgggcugagcgcuggcaggaggcccuucgugcaggcggcagccuucaacccggcccgcccgcgcugagccuggagacgagggggccccgggagcuggggacaaaggccaggccggcuguccccugaagaagaaacuguuuccggcccggaguuggggugggggcugguguaagccgcagauggggacucggggugcggggcagggcuggaggagggugccaguguggaggcggcuuccaggggacuccuguuuucccuuugugucucucagcccccaggcaggccuguucaguuuaggagggugcuuggguugggccagggaccggucaaggccaggcauggggugggaggggcucccgcccuguccgggaguuuuucuguccagcuuuccagcgcucuguguaggcgagaggaggaguuaaauccccaacccacauggcuccuuuauuuacugugaugaaggagggaggccauuauaagaacugggggucauuaggggacacccugugaugucaccagugagggcucuguaaccugacagguuugcugaagccacugaaaugacaaaguaaucacccccaggccucagggagcuccgaggcucuggcaggcccuugccccagcugugugagccuggcucagugggaaugugccauuggggagcauugaggguguaaccccagcgcgcccaccccaaccucagugcggggucaugugugcugggcucugagcugcugggugcuggcaucccuggugagcagagcagggggacaggcgcuccaugcuuaggagcuuuggccuggcucuguccagggggccuggguguccugggugggggcagcgguuccugcuuccuggccaggcgggaucugacacacauccugaaccccgggaaguuggguuuccccccaccccccgacucugggcccguaaccccccgggccagagcagaaggugaaaguaagggccaaaccccacggaggugggugcuugagggguggcuggggaguucugcuuuccuccucaaagucagcuuggcacgggggaagaggaugguuccgucacuagcugcgugcccuguaaauggggauuaucagaacugccuccccuccugccucugcugcugcugggcgagcaaagccccuugguagggggaagcccuucaaaguuguaggagcaggccagggugcgguggcaggugccuguaaucccagcacuuugggagaccaaggcaagagaauugcuggaggccaggaguuuaagaccagccugagcaacacagugagaccucaucucuacaaaaauaaaaaauaaaaaaauaaccaggcauaguggugcacaccuguaguuccagcuacuugggaggcucaggugggaggauugcuugagcucgggaguuugaagcugcagugagcuaugcacuccagccuggauaacagaacauggaggcagggaggugggggugaggugguagggacccucuugaugggcagucuugggcugcgcucugggccuugcccuguaagaggaaggggaccagcgggccagccuuggguuuagcuguggugucccucaugggcugcugcugguccccagcagguaugugggaccccugacccuuucuuuguaucucccacagugaacaucuuucucaccgggagacucagcagugcgguuccugccuuagguaaguaagcacuuucucuccuuccuccacuccuucagucccuuuugggugaguggucccugaagacaggccuucaggguccuggcacuaccccgaguuccugugugcaucuuuucuacaucacaaaggagcuguuuggcuuuggacaggcuucaacuugucugagccucaguuuccucaucuguaaagugggugaaauaacaaggucuacucaaaaccugucucuuaguauuccaugagccagugaggcaagcucuuaguguggugccuggcacgugguggcuuuauaccaccggcaagcugccgagggucccguggaauugacaucuugugccucauugcaggccaugagcuuccuaggauuuaauuuauaggaguaugacugaggggugacacagagaggcccaugccagggaaagaaggcuuuauuaauuuucuugaaaggaggggacaugccacgccaugcagggccaccugggaauuacuagauuuggacaagcaggagcagggguggaagaaagguguaaguuagaagcugcaucacagcuuccgugggaaagucucgacauccaggugcuguggcucacgccugugaucccagcauuugggaggcugaggcaagagaaugcuugagcccuggaguuugagaccagccugagcaacauagugaaacuccaucucuacaaaaaaaaucugaaaauuagcugggcacgguggcaugugccuguagucuuagcuacucgggagacugaggcaggaugauugcuugagcccaggaguuugagauuguagugggcuaugacggcuccaccgugcuccagccugggugacagagcgagacccugucuguaaaaccaaaaccaaaaccugaggucaaggugcagcccgggagaacaaugggggccucugacuuguucguugccugcugcucugcucgguggggcaggaggugccuggguuucuaguucugugcagggcccggcuugcuggagaaaggacccggagcugucaggcagcgggaccccugcuguggucaaaggggaggcccagggugcacagaagcugugcucacuggcuccucuggcaggcuugggccucuuucccucucucucugcccugagcugugcucucaggagcccggccuccucugaugcuucgggcuggcucaaggccgggccuugcucagcgcugaccuagccccagcccugucugcuguccugguccacacaacugauggaggcccagucucccaucccaauuuccaggaaaaggcugacuggcccagccugggucagaugucuguggccaugguagagucaggggaagggggaaugagggugucacagcuuaugaaugugagccccaggacacccuccugcuggugggugugucaccccaaauguguauauacuccacuuucagaaaagugcuucccuggggacuagggccagucauggagcuugggcgaggaggacacuguccagguccuugcguuugguuguccuuagcugucaagaccucaggccccagcaggguccacguugccaaacuccaacggcugcuguucaccccuggugcccucugugaugggagcugcacgcccagcgcgcaaggccauggguggugaucugggacccuagcuguccuagaguccacuucugacaccuccagcauuacugaccaccugcagguggcccaagguacccaccucccaccacagcuccaugacucugcauuuccagagcuuucccugggauuccugcugugugggacccuggauugggaaacauucccccagccccuucuccacccuaacuaggcucaguugcuccagagggucuagcagggcuaccuggggaccucacagguuuuuaccccucagcaaaccccauccuaagcccagguauguugggcccugacuggucagaacaccuccugcauccccccagccucugggcucagcccugaagcuacuguggcuccaacggggagggccugggcaggggcuucaugcaguuugcaggcagcuggcagcuuccccggcacgucuggggugggacucccagcuccccgucgucggauuacaccaggcagguuggcggggguauugaucaacuuuggaaauuggaucugcaaauugugcuuucucaggccuugcaguguccucucaggaauauuugaugacucuuuggaccaggaaaggacacuggcccgaaaguaccuggucauuccuucccuacuugugugggccaccauggcuccgagggcccaggccaucuucugccugagagaagucaggucaccuccagcugaagcucagacagaccucuugacagcccccaacaccuccgaaccccucccucuuccccauuaucccgcaaaucaugcaguccucccaucugcccucacugccugcccgcugcuacacagccugucaugaaccucaccuccauggagcauuccuggagaucccccuccucauuggcaaccccugacccugugcccuaccacaugcacgucugccucaggucaagcaggguucuugccuaggcugggcaugguggggcacaccuguagucucagcacuuugggaggcugaggugggaggaucacuugagccuggaaguuaaggcugcagugagcugugaucgcaccacugcacuccagccugggagacagagcaagaucuugucucagaaaaaaaaaaaaaaaaaggagucccugccuagaacuugcagcucccugcacagagcccagccucccuccugccucccauccccucugcaugaggcugggcugcugcugcacccaccauggucucugccaacccgcuuuggagaagagcaaacaguuuaaccaaguuucccugauguggaaauuuccggggggcccccaggggugaggcuguuuggaggcacccguugucaggguuuugcugagaggcagggcagcuggcaguugucccuuccucugcuccugauguggcugguggccucccaaccccugaugaaggggucagacauaggucuaugagggagaaggguucuggcugaagugagugggaagagagaaagguggcaggugacaccuggcuuuucccagaaagcgugggugagacaccuggcccccaagggccccaaggagaggggcaggucuaugucuguccccuaggggaggccucuggggcugaguaggaauggacagcgccuugcccugccccuggccuuguccuccaggacaggggaccucacagguuuuuaccccucagcaaaaaggugaacaugggagguucccagccacgcugacucagaggcugacacuucagcuuagcaugcgcuuuagagaugcaaugugggggaccauaccacuucagccucacugggccuucccuucuguggaaccuccuguucggcccccuccaaugggaaagaucucuucuuuuggauuuccuucuuuuuuuuaauuuuuuuuggagaaaaagucuugcugugucacccaggcuggagugcaguggugugaucuugguucaccacaacauccgccuccuggguucaagcgauucuccugccucggccuccugaguagcugggaucacagacgcccaguaccacgccuggcuaauuuuauacuuuuaguagagacaggguuuugccauguuggucaggcugaucucaaacuccugaccucaaauuauccccccgccuuggccucccaaagugcugagacugcaggugugagccacugcacccggucucuuuuggauuucuucacccuacaccucccaaggaaucccaguucaggaccucagggcucugugagguccucauggccaguagccucacccggcaaagggaaccaggcuggggccggggccacuuugcauguuuggguggcugcacccugagacuccuuucugauaguuuaucuccugcccuuccuggcugggagcaggguguacagugcccuauuucuggggcaggaucagaggcucauugugggggcugccucccagggccaugcaugaguuccagguggagaggugcuggcuugcaccucacugaccugggacugucaagggucugauggugacgcagugguggccagccuugcuuuaggaccaagaguucuguucuuauccuugaugcucucacgagcuguccguggggguuacuggcucccuauuugucacagucccgacucaccugggccuucaugguccuaguaggcccccaggggaaggggcuucagcucucagcucauggcuccagcugcccagcagguccucagauggacccguccacucagggacccacaucucuggagcaccugccaugcauuaggcacugugcagggcccugggacauggcacggcccuaccugccugugugauguucauccaucagucccaacaacaaaagggaaaugcucuguggccgaggcuggggggagggauggaggguuggagcucugugggggcuaucccggagggcuucccugggaagggaccuuggagcuagggguggaagcugaggaguccgugaaugggauaagaagguggggauagcacccacuagggaccaccagggccuccagggcaaaguccccuccaaugugagagaucggagagguccggggggcuagggguuaugggagggaugaggcagaguguggggcagggagggggcuggcgcugcuguagugaauugugguuuuguccuaagagcaugggaggcagccagagggcucuccuuccuuuccugcagcugggugccagagagucuugcugagaaccagagagaacuuggcuugcaaggucacggugccaggggccagccaugggagagugaggagagagugucacugggcucgggaaaggggucgucccucaccucaguuuuuccaucugcaaaaugggcccugccuucaucucaggcuguugugagaaucagauggaccagcguggggaagggucagggugcuguggggugggagguguggucaagugcaggggccagccgccugguccugggagggucagggcacagcggggcagggcaggcucaccacacugcccuggaugguuuagaagcagagagcauggagaauggauggauuaaagcgaggcccauggggcugggcauggagggcuccuccuuugagcuggcgggcgugaugcuuugcucaaccugagcgguauacaguuggcacuccaugagugcaugcuggcucagugcugcagcaagaagcugaggcccccagaggccuacagugauuccugacucugccccucccuaacuguguggccccaggcaagucgcugacccucucugagccuguuuccucaccugguuccgagaucuaccuuuggcggcuuugcacuuguacucaggauaaaacucaaauucugcacaaggugugaucagauccagguggcguuuccagccacagcuggacuuugccaccucucuucaggccuguuguaguaucuucauuccacugagggguucugcguaaaguucgucugcucccacccccagccuaugaguuccauagagcaggccuuauucccaccuuacucagugugccuaccaugcaugcuuggcauguaguaggugcucaguaaauacuuguugagugagcaaagccucagggaaggcaggcagggggccaucgcaggaugggcuaugccggcugggcaggccuaggggugugggauucuccacugacccgaggccacgaggcuacaccuuggaggugccggcuggcaggacggguuguugguggguuuucucccagcucugccagagaugcgggggacaggaccuaggcuguaguccacugcauaggguugggggcuacagcugccucaagucuagggggcccuccuuggccucccguacacaccaccuccaugaagucacaaguuguggccuugcccuuggccauggccacccuuggcuggacucgaucccaccaugggggaggccugugcugaagcccccuuccccccacugcaacccgcaucccaaccaaagaugggccggccuuucucggccuccucucccgacagcggccugcagugggaagcuggagcagcacacggagcggcguggggucaucuacagcccggccuggccccucaacuacccgccaggcaccaacugcagcugguacauccagggcgaccguggugacaugauuaccaucagguaggggcacccgggggugucggaaggaaucaaugugggcccacgugcauggggugggugagaaugugugugugugagcagguguggagggcacacgccugaggguguacaugugugugagcaggugugggaucaugugcaugugugugagcauaugagugaggcgugugugagcacucgugugaacagguguaugggugugugcaugugugugagcauuugugaguaggugugugugcaugcagaugugugugugugagguaggcguguguagguauuugagcagguauguggugugugcaugcaugugaacacauguaaguaggugugugugcauaugugugugugugcauguaugugaacacaugugugcuuguguacauggaaaagcccaugucggagaagacauaaaggacacaugugagagacugcaugugugagcacauguaugugcacgagccaugccugcaaaggugcagagagcguguaugugcgcaugcauguaagauaacagguguaaccaugugugaaccguaagcauguaugugcacaugugaaugcaugcacgcaaguguguccagugcucugggucuccacgggccucuguggcgaggugcccaagcuggaccucuuccugguuugagccucguucaugggguguggggggucucagucacucagcucugccaggaaggcagggccagcacacaggccacugggaacacagccugggacuggugggcauggucugaugucucugagguggcagagguguccucucuguccugcagggguggcugggggccaggcuggcacugagcccagagcaugguuucuggagggggccuuggggaggggagugaaucaggcaaagcccgggugcuugagcugcagggacaugcagagggaaagggggccaggcagugagcggugguccuggccagggguggucacagggacauuuggcuggggagucacuauagguuccaucugccauaguuuuccuaaaugccagagcccaaaaagcgcaaccccugacuuacuccauagcugcaaugcgugaggaugugaugggcaugggcagggucuauccuagucucugugccucaguuuccccaagggccaggugguucagggccaguguaucuccggagaugacaagcugucaaccugcugcagccuuagccagccccgugggcagucucacccucacuucccaugccugggacuuugugcugggcccaucccaguggucccgagguggaggguucugggcccuugggccacugcccuuuuggggagggugucggggcagggggcucuugacuuccugcuccacuucggcuucgggcuggggguacugugugcacugauggagggaaggggagccgcagcagagcuggaaaugaccugcguggaugucgcaauucuucauggagccucccgugcacaccuggauggggacaguguggggacagaguggcugggaguggaggaaccaggcagucuggaacaugaggagugggggcagccggccgggacagggcuggcuguccuggccguggcuccagccugaccacucccugcugguccucggccauggagaucccaccuacugccucaugucuggguccucuccgcccccccgcagcuuccgcaacuuugacguggaggagucccaccagugcucccuggacuggcuccugcugggcccagcagccccaccccgccaggaggccuuccgccucuguggcuccgccaucccaccugccuucaucucugcccgcgaccaugucuggauuuucuuccacucagacgccuccagcuccggccaggcccagggcuuccgucugucuuacauccgaggugauggaggcugcagggcaggcaggacaccacggagcacaccgugcaugcccacaggcucccggcccacaggggcggcacccuccacagggccccggcucccugugggauguccccugaccgcccugucaaucucaggacaguggcaggacugggcaugcggaugccuuggaccucucaaggucacuggccccacuucccagucuuggcuaguccugggaacucaccccuaaccccaggcucaggucagggacagagcccacccugguguuggaggggucucugcugccacagugauggggaaccaccugcccgcuuuuggccccaggcccccuggccgaagggaggcucuucugucuccugacuguccccugcuacgucuccaccccacagggaagcugggccaggcauccugccaggcagaugaguuccgcugugacaacggcaagugccugcccggcccguggcagugcaacacgguggacgaguguggagacggcucugaugagggcaacugcucggcgcccgccuccgagccuccaggcagccugugccccggggggaccuucccaugcagcggggcgcgcuccacgcgcugccugccuguggagcggcgcugugacggcuugcaggacugcggcgacggcucggaugaggcgggcugccccgaccuggcgugcggccggcggcugggcagcuucuacggcuccuuugccuccccagaccuguucggcgccgcucgcgggcccucagaccuucacugcacguggcugguggacacacaggacucccggcgggugcugcugcagcuggaacugcggcugggcuaugacgacuacgugcagguauacgagggccugggcgagcgcggggaccgccugcugcagacgcuguccuaccgcagcaaccaccggcccgugagccuggaggccgcccagggccgccucacuguggccuaccacgcgcgcgcccgcagcgccggccacggcuucaaugccaccuaccaggugaagggcuauugccuccccugggagcagccgugcgggagcaguagugacagugacgggggcagccugggcgaccagggcugcuucucagagccacagcgcugugauggcugguggcauugugccagcggccgagacgagcagggcugcccugccugcccgcccgaccaguaccccugcgaggguggcaguggucugugcuacacgccugccgaccgcugcaacaaccagaaaagcugucccgacggcgccgacgagaagaacugcuucuccugccagcccggcaccuuccacugcgguaccaaccugugcaucuucgagacguggcgcugugacggccaggaagacugccaggacggcagcgaugagcaugggugccuggccgccgugccccgcaaggucaucacggcggcgcucauuggcagccugguguguggccugcugcuggucaucgcgcugggcugcgccuucaagcucuacucacugcgcacgcaggaauacaggugggcgcugugcccgcagccaggggaccgggcuucuucaucacccaggcuugcuguccccguagcuguggguuugcaaacgggggccuggacuagcuacauggaggcugcccuggugcacacuggggucccuauaucuuggggugucuggguggagggucguccuggaauccuguuguuguuccugcugcaggucccgggcagcccagucaugucgcccuccgcccacugcuucuagggccuucgagacccagaugacgcgccuggaggcugaguucgugcggcgggaggcacccccauccuauggucagcucaucgcccagggccucauuccacccguggaggacuuuccugucuacagugcgucccaggugagcccccggagggcgugaggccccuccggggccacuugggacagugugcggaggaggcugguccaggggucacaggagcaggaggcaaggccugcgcagggugaccugagggcccauggccaggugggggggguggacaagguggucucucgggucucaggucccuugggggugugcugucuccugccccugagcagccugucugcccccucagccgcauccccccgccccuacccugcuccaccccacaggccucugugcugcagaaucuucgcacagccaugcggagacagaugcgucggcacgccucccgccgggggcccucccgccgccgccucggccgccucuggaaccggcucuuucaccggccgcgggcgccccgaggccagaucccacugcugaccgcagcacgccccucacagaccgugcugggcgauggcuuccuccagccugcuccaggggcugcccccgaccccccagcaccgcucauggacacaggcagcaccagggcggccggagacaggccccccagugcccccggccgugcaccggaggugggaccuucagggccacccuugcccucgggccugcgagacccagagugcaggcccguggacaaggacagaaaggucugcagggagccacugguagacggcccagcuccugcagaugcaccucgggagcccugcucagcccaggacccgcacccccaggucuccacugccagcagcacccugggcccccacucgccagagccacugggggucugcaggaaccccccgccccccugcuccccaaugcuggaggccagcgaugaugaggcccuguuggucuguugaccgcugggcucgcuggugaccgccacagccccgcuuuguaaccagggaauacacagucauuucuacccugccucugcguccuuucuuauggagaggcccuccggggaccccagcggaggggcuggccccuaagccagcuggcugcacuggugggcgggagcugugggacugaacggcgggggggagaagaguggaguggugagcccgucugcagggucccauuguacacaagcacccuggggucucacuucucuccccccacuccauucugggaacccauuuccagagaagcaggggaccagagccuuuuugcuucaucugcccugcaguggcaacagcugccccuagagcugggaguugucaugaggauggggccgggccauggggacgcugggucucauccguggugacuauuuugcucacgccucacccucuuccuguccagcaaggccucuggaggaccuggguuggguggcuccugccaaacccucaugccccuggccaggcaggcgcccuuugcccucccugaagguccaaucuccugggcaccguggaagggcuggggugugugccugcuguacaugaagccccuggaguucccugcaggccucaaagcccccaggacaugcugcucugugcuuucuggggacagagaggccgaggcaccaacagcaguggccacgucuguuccauccuaucucagggccucgguuuccccaccuguaagccagggugagacugugggcucugaaguccugaccuucacucuguggugauuuacgggaagaaagacaaucccagccuggagccccugagcucuccuggguggccgagcucagacuggcaucgaggggccugggguaggggcggacugagcugcuaccccauccucgacaucccuuuagggcagggggacucugggugccaugguagggagcgccugugucaagcagcaaagcccccuaaugucaagagccuccuccagggccugccacggcaucuuccuggccagcaacaugugugcacccaccgagguacgccccagccacucccaucugugcccaucagggacuccccauagcacgagcgaacagccagcccuguuuauuuauaggccuuuucaggaagagcuagcagggcagugcuaagacaggaaacccaguccacauuuuagggcuuccuuaaacaggcuucugagagucguaucuuuuuucuuuuuuuuccagaaaaaaacaaaacaaaacuuuuuugccaaaacaccuccucaauaaacaacauguaaacagaaacaacugcuucagucucuacaaaaaucucauuguggcuucgagggcuugucuguggcaggcagcagggagggugggcaggggccauucuccuccucuucgggggcguccuggggguagaccacgaaacacagcuccuggccccagugugucauggacucugaggacagacagauggaccuuggggccugaccucucgggauaggggugacccccagcuccggacaccuccccuugggcaggggucuucagggaguugcuccgucgguacccgugguucuggaaacuuuggguacaucuugggaagagacauuugguggcggcugggcccuguguucccaccucagcugcuaggacacccugcucuggggugagccucuaagagggaggucuggucuccaggccccggcccccugugcugggugaccugcagcugcccggcucaccugugagucugugcacacacuuugguuugcuucuccagaacacucccagaaagaaaaugggcacccccguaaggaugaugaugacgccgaccccacagaccauaggcucugagaugaagcugaagaccagcaggaaggcccagaagaccaaguacgccacggggaugagaagguucaccuggggaagggggagcagaaacaccgauggugcagggccuccagcugucuguacccccgaccccugggggucuggggaauuuuccucccuucccugggagcugaggccugaagggcaauugcacccacuacacccccucuuggcgacagcccaguguguuggaggccaauucaugggucaggccguuggccaguuuugcugaggauuuuucaaagucucagcggcaccgagcuccacacagcgguugcguguggacuugaggcuugcacuuggcuggaggucagugauuuuuugguguuucacauuucaggcacugagcacuucuccacuuaaggauuuauacacacauggggggcuuugcuuuuagcucaggcuauggucuucuguuuuugugugggcucaugaaauccuggcagccuuugugaccuugaacaguuccugagucucauuuucuuuaauuuuuuuuuuuuuuugagacagggucucccucugucacccagguuggaguacgguggcccuagcaccgcucacugcagccucaaccucccgggcucaagcgauccucccauuucagccucucaaguagcugggaccacaggugcgcaccaccacaccaggcuaacccuuuuauuuuuaacuuuuugcagagaggaagucucguuauguugcccaggcuggucucaaacuccugggcuccagcaauccucccaccucggccucccaaagugcuggaauaggcaugagccccugugcccaguccugagccucauuuucgccaucuguacacugggagcauucaaagcucuguccucaugggg

SEQ ID NO: 15127 - RNA, 3748 nt, Homo sapiens
ccccaugggggaggugagaauauuccucagcauuuuauacucaaagaggacagagcaaggcuugcagccuucugaggguggucugcccaagaugagcugcuggugcuggcuccuggaagagaagacccacucaagucaugggucacacaggaaaugaugaaauugaguccccaaggaaauccgggcagagcaaugacaucaugucucuguggggaaggugccugaaaccgagcagaugagggcccuggggcagggggcacagggagaggugggcugccucucccuggacguccacuugucuccuuugccaagcaccuaaucccaaggaucugcagagcaauggagggggcagccgagaggaagggcggacagcagagugagaauagaggcugugccccugcagagcacuuuuccacggauguguuuuucuuucagacuuuaugguuaauuuauuuaucugaccacucgggaagggaagaaaaguaccauuuuaugagcgcaggacaaaauaaaaaacaauagcacauuuaggugccuuaauuuuucuguuccuagagauuuauuucauuguauuauauuugacagcagucaacaaacagcaaauaggcagccaagugcaguucucuuagccguaaugguuuguauucucugcacaaggcagaguuuuuuuuuuuuuuuuaccgcauacaucauuuggaacuugauacauugaucccaaaaaguaauauacauuacuuuuguucuccugacauaaaccagcaaaacaaauccaguggacggagugggguggggccagacauaagggugugacucccuuugggaggggauugcugugaguuuagcacguguguggggacuacccgagaaugucagggcuggugaggcgcaagcaugugauuaggugagggcguugugugaguguucaacugugcagugugaugggguucaggauugcuugucugugggucuagugggaagcaaagugauguuaacuuuucuaguagauaugagaauaugcagccugggaagucuuuguguucgggugcauccaagcacccugaaucuguuaaagcuuacaucaaugucgaacaaguguucuggcuuuaagggaguggucauaauuugggcaacccuuaugccccaagauugucagccuggaagucacaugggggccacaucuccauucauauuuuaauuccuccuguuccaugcucugggauuccagucccuaccuuagaacuccuuugguuaucucagcaaguuccuagggugcuaguauuucucauggguuucugcacccacaaguccuuacugcugucguugcuuggauccauguggaugaugucuucucugcacauugacuccucuggcaucucagagacuacucaccuuccacagcuaaugcugggcuggccaccaggaagggaauggguccuuucacuaaugaccuccaaugcagcugaaaccaggcugcaacuucuggcaagacuugacugaggggaugacagcaucaggaaaugaagucacagcauggcaaguagaugcggcugucuccauagcccacaggcucaggcccauucugcccuaagaggcugguuggugcagccugccaacuuccugccagugugucucccugugccaggaacuggcuucuuuuguccugacaguggcaaauccacaugcaugacuccauuuuuuuggaguccagguucaguuugcaaagaggccagagaagaaaacuguucuugggcuaaggccaguugcugcuucuugacgcccucucuuaugacgguugacagugggugaguccaguuccuucaaaggaaagucuuccuccucccaccuccagcuuccuugaauuauggccacagaggaucaauggcaugagagugacagagacuacuugggagacugcauuguuugaucuguccccccgacaauaauaacacauaacacgcuagucuucguccugccuggucagggaggaaagcuuugaccaucugcucccugcaauuggagugcccccagcuaugauccaccagcaaucgcuuaucccugccacucagccauuuaucaguacuguccugucuaaaucccaaaauacaaaagcuguacucccccuagaggaacaaaaccuucugagauucggugcuggauugaucccaaauaccaauuuacuuccccugaacgaaccucgagcucugcuugcccaacaauggugaguucugcuuucuccaaaacacugggagaggaugugcuuuccauucacacccugcagggccauucagguggauuuaccccaaaggaaagcagauggagucuucuucauaggcauuuucaaaugucuuccuauucugagagagaaaacuuauggaacuauugagggaacaguuauuccaaugcuuuuuuuguucccagggaaaacugaaacaaaccuuguaagucuuauccugggaaccaugugaugugucaauuggcuuaggcaggaauuuaacuuucagaugguauagagcagccacaguuuggcugguacugugccuggccuuugaggcuacagagauaaccgggaagggucccagcccacaggguacgagugccaaggagagcacgggugagguaggaggugggauuugacuuuggaggcagggcucaggcacuggaccaaauugaugacuaagggcuggggcagaagcagcuuuccauaagacacacccacuaaugugccaugucaguuuaccauugccauggcaacaccuggaaguuuccacccuuuuccacagcaaugacccaaugaccuagaaguuaccuccauuuuccuagaaauuucugcauaggucaccccuuaauuugcacguaauuaaaaguagguauaaauaugagugcagaacugccucugagcugcugcucugggcacacugccugugggguagcccugcuucacauggagaaguaccucugcugcugcuguauacugcagcuucaauaaaaguugcuaagaccaccugcuagcccuugaauucuuuucuaggugaagccaagaacccuccugggcuaagcuccaguguggaggcuugccugccuucauuacaagcuuauccucagagaccccacagugaguggccccugacaaaugccagaaccaggaucccagagagugacaaggaaagggggaggcagagauagacccuggcuggggagguagcuguuugucaugaaucuuauuuauugcucucuacuuuaggaaaaagagguacagaacaagcugucuguguacgucaaagaacuuaaagggccaacaaguaccucugaguccaguugggagugaaaagaacccaaacacugaucccacuucuuuuuuuuuuuuuuuuuuuugagacagaguuuugcucuugucgcccaggcuggagugcaguggugugaucucggcucacugcaacauccgccucccaaguucaagcgauucuccugccucagccuccugaguagcugggauuacaggugcccgccaccaugcccaguuaauuuuuuuguauuuuuagaaaagacaggguuucaccauguugggcaggcuggucucgaauuccugaccucaggugauccacgugccuugggcucccaaagugcugggauuacaggcaugagccaccacaccuggcccccacuucuuuuuaaacgagcauguggaaaugaccagaacuuccuuuauucucugcagguaccacuagaggucagcuguggaggguuacag

SEQ ID NO: 15128 - RNA, 92988 nt, Homo sapiens
aaucaagucugugaacaugaaaaauuauuuaaugacacgcaucuugaaauuacaaaucuguuaagaacaccacaauaguccuacaguaaaguuuguuucugagaaaaaaaucuagcacagaaagccucaugugaauagcaauuccuaacgggagcaucuuuguguguguaauuucugcuuugguuuuggugaggguuggggcauggacugaaagauuuaccuacaaaauauaugcauaguugaucuaaauuuacuaaagaacaaaucuacauuuuuaggugaucuuucaaaaucaguccucgguuugaauuauccauuaacuaguggggaugcaagcucgcccccuugucauuaaaauacauauucauaaaacuuuaaaguugcacugcucuaguuacgaauagcuucuacuuuucuaggacauaauuucacuuuguuuaagaagaauucauuaaagaagcuauaaauaaccuuuaaauauuuagccaugaauagagaggguggacuggcauugauggcuuauuuuaguacuaaugcagaaugcuuuuuaaaagcuacauuuuagcaugcaucaagcuaaugauuaacuuguaauguuauuuucaauguuagaauaaauuuauuuugaggaauugugguaaaaguaaauguguuauuucaguuaguaggaaaguagccuuaaagaaugaaaauguugggaagaugaaacuguaaggaauuuuuauuuaaaauguuuaagcaucuagaccuuuccuuguuucccaaaacauaaucccagugaaacugcaaaaacuaagggagaaguaucugaggaacugaaagaauuccagaucuguugugugauacauguagcauacauaugaaucaaggacauaucuguacucaauuuugaaucauaaaguucacaacauuuuugagaccaaguuucauaaaguuuuuacuuggaaaaaaaaguuuuacaaaauaucuuuccaaagaaauuuucccauagaguacaauuaauucauguagcuuucuuccuuaaagauuacaguaugacauucagaggggcgagguuucuugaauagccaacuagccgcaaaaccuacaagagaaguagauuuuuuuaaagugccuuuaaaaugugaaagcaaguaauguaauuguugaaucuauuugaaauuuuaaaauuuucuuuaaaaugguccauaugguaugcacaauaucacagcuggcacaaaacugccuguauuuaguuugaaacacaaaaacaaugcauaugaacaguauucuuugaaaaguaauucaaaaugcugccacugcaucauaaaggcaaacuuagauaagaguguugacaguauucagagaauucacaaaacaagcugauauuaaaguauucagacaguuaccuugauuuuuuucaaauaccacggguaaggguaaaagaacuuguugccaaaguaacucaggauaccuuauuucaaacuacauguaaccuauuuugcuauagauacucuaaacaaaugaacaacuagguuuuaggauguaaauucccauuuccuagacagggccuagucuuucuguugcaaucuggcagcuuuaaacuuugaaacccucuuuccaguuucuucagaugcuuccaacagaacuuccuuucguucuggaauaguggguagugcgggaugagcaauggcugggggugguguuaaggaaggugauacaaauucuuuuucuauaacaguuccagaaaaagccuagaaaacaaaagucagguuaugguaauaaaaugcaaauaagacacccacaaaaucuucccauucacucauuuggcaauucuuuucauuaaaaguaaauucacgagauuuuuggcuagacaacacuacuacaccaaaauacuaauuguucagagaaaccaacaccauuaaguuuuaauuucaccaccaaacagaaguaauuuuuacaguauacaugcaagaaaacaaaauguaaaauguaaauuuuaucugggaaaaaaaagaaauggauaaauaaaaggucuucaaacuuucauacauuccauucauguccagcccaugcugugaaaaauaauguauuaaaauaaaaaugcuauuagggugucaaacucugacuuuuguacaucaguugaugaaugagcuauccuaugauggccuugcugccugcuagccaauagcuuaguuucaccaguacugacauuucuaacugauaucucuuuggugguguuuaugcaauuauuuaaauauuuuacugcauauugccucaauuuuaaaagaucaguggaaguugaaaaauaaaagugcugauacuaguaggaauaaguacagguuucaaaauuuuaauauaauuaacucaaugacagaaaucagaaguuccacaaaaaaagaaaugacucaauuucaccuggauguuugcugcauuuaaucuggucaacuauauguucaacuggaacagaauuaaagaaugugcauaaauugcuggaaauaucuguacaugucguuuuauacaaaaauagguaagacacaaggaguuaauuuuuuuuuuuuuuuuaagauugcugguauuuagaaccuccauccuucccucuacaaaugaaaauuugacaggugaacuuuaauguacauuuuguucuccucugucuaccaagugcucaaaauuaguuaaaacaacguaacaccuaaauaauuuaaaaagccaccuucuucuaccuugccccaccacugaaacaaaaacaaagaaagccaucucucuccuacauuauuuuuggaguucaacugguaaaagcagcuuaaagcuuacuuuccuaaaaacuccacuuuaucacgaugagcauagagccuucuucuccuucuucuauuuaaaaugccuuugaaaaagagguauuuuagcauuuaaaaagauacugaaaaggauaucuuccaaaguacuuaccauaaucaugaacuauuucuuugauguuaaaaaauguauagcaacuacuauuaaacauuuccauacaaaaugcaaagcuacuaagggugaaauaaaaaauagguuccacacucuagcuguaccaugauacacuaaguccuuacaaaaaacuaauuuucaaacauuuaucagcaauuaccugauaacauccauuaccuguuuucuaacaguauggaagacuaucaaauaagguaagauacuuuccaggucaccuaagaucauuauacuaagaagaggggaagaaaacauucuagucauauguacugucccuaaaugcuaccaaucuccauccccaauuaccauuuaauacacugaguauaauaccauuuaguaaaagcaauggaauuuuuagauaagguuauauauaugcauguaucuuauuguauauacaaauguguacacugguuugauccaggcauggguuccccaaucuuccuaaauacuuuuuaaauugaaaacuucaaauacgcaccaaaacacaagaaugaagaaaucaauagccuuauauuucacagacauccuuauuuggggauuuccuaaccuccccugcaccaccaccaaaaacuguaagaaguguggugggugaaaguguauugagugugcacuauuuuuucuauggacagggucuacagcuuucaucagauuauaaaacaauuccauaaucccccaagaguuaaguuucacugguacaagguaaaauauuagacuuuagguaauuaucugcuaugcaugcauuauuuuucuuuaacuuagccaagguauuuaaaagagaauaauguaaucugcuccuuacacuaucagaaaaugaccuacugguaauuuauuuaaaauaaacugcgaaauaauuuccuagcuacaaauguaauacauaaugccaaguaagacauuuuaaauuucccauuuugcugaaauagaacguuaagacaaguaauguguuuaucaaaaaauaaacuauuugauuaucacaauauuuguacuguuugugacuauuaauuuuuuauuaauuaguaccaagaaaguauaaaaccuagaauuaauuuaaucuuaugacuuuucagauuaaauagcuaaaacuggucaaagauacuauaugaaauaaagaauuaaaagauacacacacacaccucagguguuacugauaagggcaaaaguuucuuuugauuuucuugugguuccucuuccaaaaugcucucacuggugucacugcaaguggcuucuucgcagcugauacuccucaaaacuccccgccuaucaucaaauucagcagcacugcuuucacuagugucgcuacacacacuauucucucuacuucgagacuucaggauggauuugcgagggacauauucuccauucacaacaucaacaaaggcucugugauauucaaaacacauaugcauucacuauacguaacucauaaaacugagaacaacuuuuugaaaauuuccuugaaucuauucuagaaauuaaucugaaaauuuuuauuacaaucuuauaucuaaaauagucacaaucacaauaauuuuauagccucaaaugguaucuucauacuauuuugaaagcuauuucucuggccuaauaauaaaacacagcauguuauuuauuuauuuuauuauacuuuaaguucuaggguacaugugcacaacgugcagguuuguuacauauguauacaugugccauguuggugugcugcacccauuaacucaucauuuacauuagguguaucuccuaaugcuauccuuccccccuccccccaccccaugacagaccccggugugugguguuccccacccuguguccaaguguucucauuguucaauucccaccuaugagugagaacaaaaacacagcauguuauuuuuaagcauguccuagguggcaauagcaugguuugccaaaauucuacauaaaguuuuagacccacguauacauuuagcaauuuucacugauuuauaaauaagggucauaaaaacaguagguauuuucaagugauaguuuucucaacaaacaauuccaaaaaaaaggaaaaaaaaaaaaaaccugcaacaguauaauuucuacucugaaaagguaaacugcaugccaagcauguuacggcugugguagaaacguagggaccuagcccacuggaaacaaaaaugcuuucugaagauacaagauuuucugacuagaccauuuggaaauguuucaaaagcacuggugaagaggagaaagugaaaaaaaaaaaaaauccuccauucccacugcucuggacugggaagcuacagccggucagccuaucagauccuaaguuaacuccucagaacacuucacuuuucagugagggucuucuguguuacagucaacuuucuccaguaaagguucaguggcagaaagagaggcaagcccagcagacugcccugcagcugugagcgccucccaccuguaaaugucugcaggcguccugauggucggcagcuccugggcagaguggccacugccagugcuguucuuucguuuacguuuggcuucuucuuucuuuucacugaauuuuaaagugguauucuuuccaguauuuauucggaccuaaaauuucagagcaagaaauuaagaaucuuuugacaaauuaaaucaaagugaaaccaaaacaaauaaacucuauaacuaaaaaaauaauaguaagagaggcagcugaaauuuucugaugcugaaaugaugugcauuaucagauggaauuuuuuaaaaaguccuuaucucauagaucuaugacaucuaaagaaaaucuucuuuauuaacaaauccuagucuucagugucuuuauuauuguagagaaagcaaaauacauuugaacuaaaugcuagauuucuuauaaacuucccaucaccccauuccuuugauauaaguguuuggcuugaauuauguauuucaaaagaaagaguauaaacaaaaauucaguaagaauacaaccuuuaagucauaaaaguacuauuaaauaaugccuauuuagaauuuuuaaaacaucucuaauuuuuagaaauugaaggaguaaaaaaauaaaaaccaagccuguucaggguucacaugggguuaacauguuauuuuucuaucccuagucagcacuuagagcauacuuuccacaauaaugaccacuauuaccuguaacguuccugcaaauaauauuuguucuuucuguuuuaucuaaaugaaaacaggaaaaaaguaaaagccuggcaaaagauuaaaaagcgaccuuuuuuucuggcuaaucaucucagucaacuuuucccgaagaaucaggggaagaccccuucagucugacauauuagaauauaaaaacacaaacaauuauuucacuucauauaggagcaggaauaacuuuaggaagcuaagaaauaucaaauauguuuuaaacauauuucacuaaauaauaaucacacacacuuaagaaugauaccacagacccuuaacugauacaggcaaucgggauauuguguagaaagggcacucagaggcgaaagaguuccuguuuuguuaccaaccagaucuaugucuucuaggccuuaaauuucccugagaaagacgaauuagacgaauucccaguguccccuuagagcaguacauggagcagagagagggcaaagauggacuuaaggcagccuauccuuccuucaaucagagccaagcugcuuugaucuauuuuaaauacugggauucuacaguaaguauggagggaacaaaaggcuuuucauacuagagaaaagcuuuaaaacucuguauuagaaaaucuccagucacccccagcucuaaaaugccaaaauucuaagucaugauuauccacagauguuuauauuuacuuugucagaaaagaaacuaauuuuuacuuccuccuacauuuucccuuugugccuaugaaguauucauuuuauguccauagaaaacaaccuggcauaauuaaaaauuuaacuaaugcagucacuuucaacauccuaagcacaccaaaauguccacaauauaauuaacuccaggauucuuaagaaaacucucugaaugaaggacaggugaaguuacaguaguugccacucaaaucugauccccuuccagaccccaaacaaugcauuguuucagagaacaauggaccaauaccagcuaacuaaauuuuuuuucccuuuuucuucuuaaauuggucagaacaagaggcaaaagaugauuuuccugucuggcacuauccacaaugauaaugauuguuaauauugcucuucuaaaaaauaucauaaugcuuaauguucaaauuauaugcaaaauuaguaaaguuaaaaguauacaaacccucuuaggcucaacaguaugugaaaaauauauuguugguauagaauuaucuccaaccccuaaagccucauggucguuaucaccaucaucgucgucaauguugucgucgucgucgucaucaucaucaucaucaucaucaucacugugguaagaacuggaaccauucacugaacaguucaacugacuauucacuugaccacugaaugguucugaacuugcaacauccuuaugacaaggaguaugagagucuguuacuugaugcaucgcauucacauuuguguuacgaucuuccuuuuccucuucagaagaugucguaucuucuccauuugcaaucacaguaucaggcuuacuagcaaggaagaaaauuaacaagaucaaacaaacauacuagaauuuuacauuauuuaaauuuccaguuaguuuccauggguaaauacuaagaucuugaauaaaguauuuuuaaaacuagaauucuaaguucaaaaacaaaaaaauguuuugaaauaaauuaacaaaaaacaguuccuaugcugcuucuauauauugagguuauucagacauaaguagaauauagaagauaauuuuuuuaucuuugcaagaaagauauuggccauaugcaauauaaauauaguaucaauaauaauaaaguuguaagaaauucagagaacauuuaucucuaaagaccagaaauugaaaccacauaauacacacuuauuuucuacuccuauacucagaauauuuuacaaugagcauguauuauuguaauuuuuaaaaauaaaggauuuauacauaugcacacgaauauaucuauaugcaugagugaacauuuaucauacuugauucuauaaaagaugugaggaccuuacaaaaauaacaaaauugaaaaugcaacagaacugaaauaacaucauacaaaaaauagaaagagaaucaugaccaagaaaaaucacaagauccaaaacugguuuuaaaaaaugaauaguauuaguuaaucaaaaagaccuaagaauuuauaggugaaacacuaggaaaaagaaacuuuuaugcuuccugcccuauuuuucacagaaacuaauuauugcauaugguacaucauuuaagcaaaauaauauagaacuucucgaguagcagauuucauuuagcauuuuaacaauucuaagugugugcuaauguguauuucaaacagcaauuucguaaaguuucucauacauauagcuaucugaccagauuacaaauuaccugcuccaaaguuuauaaaaggaaagcaagaauaaacauuuuacuguaucaaauuuaaauucaaaguguauuuuuguuuuucacaacacauucaaagauagagcacuauccuggguguggcauaaaaauacuucauuuaaaauuuaacauuauauauauuaaauccaugauuauuaaaagucaacuaucugguauaauuaauuauauaaaauaggccauaauaaaaaaugaagauguugaucuuaaguauuuaaguacauguacaugcaugggaauaugcacaaacacacaauccuauaagaaaauauuccagagaauuaauguucaucuugaggugaaaggauuauugauaauauauuaugcuucccugcauuuucuucaaugaacacauauuauuuuauuaaugaagaaaaagauuaaugaggaaauguguauagaaacaaauuaucuuggaaagauaauuugucaucaaguaccuaucaaguucacccagcaauucuuccugucucucuaguucuucaagucgagcccacaguucuuuaucagcuagcaaauccuuggauuucacaucauuugcaauaucugcuucaaaaauaucugaaguuuuugguuuggaaugcgguuuaugagcaauucgguguuuugcuauuuagaaaaaggaaaagacguggcuguuaauagccaacauaaaaaaggcacaaacccagacuuaaugagacuuucuuuuggggcaagggaaauauugaaacagaggggucacaauuuuuaagccaaacagaacuccaaggaugaaugucucuuacagccuugcuacucaaagugugguccauggaucaacagcacuggcguccuuggggaacacuucagaaguguaagcucuaaggacacccuagacccacugaaucagaaucuguauuucaacaagagccccagagaaccugcauacacauucaagguugugagaagagcuucaaaaaugcauaagaaauggccacaaugcacccugguuauaaggcgaaaugcaacacauaaaugauaaauuuccauuuaccauccuuacucaaggaaaucuaguuacuacaguaacgugcaaaagccuugugacaggauacuuuaaacuccagggcacugccaaggaaugaguacccuacaaggaaacaacggcggcucaucucuguaaaguucuauuaucauuuuacauaugaacaucucuacuuuuuaaacugcuucauuuguaaucuucaugugaggaaaaaagaugggucaaaucugaacucagagguaucugcuuuucauuuuaaaaaauagauuauuuuuuaauaaagcaaauuaaggcuuuauuugcuuuauuaaagcaaaguaaugggaaaguaaugggaagaagucuaagaugcguccuguuaugagauauggcacuaccagaugaccucgaguccaucauauauucaaauuugcugcauuguugcauacaucugaaaauaucaaauuauguuucacagccuuauucucuguaacuauuauugauaagacaguaguuaacaauuuuuauuucagaccuguagcgcucauaauuugucacuggucaccacaaacaaaaaucuugucuuucuguucaacuuuaauauacauauccuuuauuucaccuucuaaagccacuuccuguuacuugugauguggcuucuuucaaccaguaaguuaucuuaagaguucaucaccaaaauaugagugcugaaagucaaaacgaaugcucaguacauuuguuuaagacacuguacagucuucuacaguagcaaauaauaagccaucuguaauacuuuuuacaauuucacuaccguuaacacuuuacaacugacgaaggaaccauuggcuuuacagaaguaaacccaaacacauaagccagccuuggcaaaagaaaucuacuggguggagaugggaacaaccugcgcagggaaagccacugcaggcaccauaagaggaauggcugaaauacacccacauucauucauucuuccaaaaacagcuuacaaagcugcaguuuuaaaagaagaaaaacuagcaaaagauaucuuaggacuucaccauggucagagaacaaauuaggagcagauccaugucuagaauauacaucuucugaguuuuagagguuuggagcacuggagaacuuugggagaaaaaagccauguaaucccaccacuaaaacagaccagucaggaaucacauuuuuaaccaaaaguuauuuauccauuaauguuucacauaaaaaaaaaucaaugaguagaaaaauguuggcauccuaugaauuuaaaaguguauucuaaaucccaaauaucucacagaaagcccacugaaaaucaacaaaaaucaaaauaucuaaacagcuacacauaaaacaaucuuacugcuuaccuuuaaauucgaagucacauuuaauuucuucucguaugucaacaauaucaccugcagccugguuuuuaaacaaaaaaaaagcguauuaacaacacaaaucuccagcauacuaaaauuauccaaagagcaacuauucaaccuaagaugucugaaagcauuuuaaacuucaauuaauuuguuccuuggcuguaagauagcuucauauuucuuugaaaauauuuucuaaaaauauagaagacuaaaaacaaauacucacaucgcucauuuucugcaaaucuucugugaauucaacucuggauucaaaauuuuucaucacuuuuuuuaagucaucuauuguuuuucuuacaucugaaacaaugaacacaaccauuauguaaagcauggcauauauacgaccuguaggaauauuuuaacuguaguccuaucacacuacaaguaugauuuaacaguaaugcuuuucaaaaaucuuacacuauuuuccuuuuaaauggacuuuuaauaaguuauacuguguauuuuugugcuauauauauagcacauuacuuuguucguaauaaaaugucuaacauauuuucucucuauuacagaguacagaacuagauuguagaugcugccuggugcuaccagguuucuauaggauaaauaucuaguuggaucaucacauaaaaugcaguauuucauaacaguuuuguugcacagguaauuuuuguccagcuggauaaugcauagauaacauagauuaagacaaguuauucuguuccugaacagaaaauauuccuaaauuagaugacugaaaauacaacacauuuuuuacgguauauaaucaaccauuuccaaguuaaacugcauaacaacacaacacacagccuuucaacaucuccuaaauaccacccucuauuaaccuauuugaggaaaaauuuuaauuugagaauagacacaaacauuucucuacccaauacuggacaaaugcaacaaguaauucauguuucuguaaucagaguagaaaucucugcuaagcaguaaauggcaccaucuaaaaaauacaugggguuucuaacuauaauuauaugcugaacaauauccuacuuuucuccaaauacagaauuuuuauggccaagcgcugauaaagaauaauagacagugauaugauaccuccucccccagaugcucugugauuuccuacuguuuuacaacaggcacucaaucaguaagcagaucagaagaggauggaggagaaaaguacauaguucuuucucuaccaaugaugaaugcaggucuggcaaaggucuaagcaguuaaaauaucuuuuaaaagaaugaaaauaaggaagggaguuaaaagugaaauaucaccacauaugaagggcuucucgagaguggcacauguucuccgauacggcucucaugcuaugcaaugcuauuuuaaauaaaacacaaucacuuaugcucuagccaugaauggguuacaaaaaaaagacugcauuaacaaaaugaaaauuacgguguaaacaguucauaaaaucucacagcccugaugucgcucuagaucauuaaauuucugcaacaauuagaccuuuucucacggcagcaaauuggaccgguugccauggcaaaucugagcccuuaagucauauaucuuugauugcagaaaggucagacucagacagccuaauaacucaaggagcuguuugacagauuucauccgagcauggucacauaacagcauaaaacuaugucggcaguuguuaaaagcagggggucagggaaaagguuaagguuauggaauguuuuugcuucaguaaacucagucagauaaugugucuaaccagcuuuagaucuaaagaacauuauuuuagguaggaggucaaaucaauaacuuuuuucaagaagacuggaaaauauuaaaaauggcagguagguaagcuaaguacauuuuuaaaagucuauccacauauaaauacugugcaacuaagcuaaagguaucagugaaagccuuggguugucaauguguaaagaauugauuguucacugauguuauaggaguuacuuucaaucaacuauuguugacuuuaaaaaaaauucaucauaacucacgcauguaagaaaaaguugugugaauauuccauuuaagaaacaaaguguuuuggaaauaggguaauuaugaaaaacugaaauacgauugcacaguuccauuuuuaaauucaagaaagcuuucugaaucauacauuaauauaaaccacuaucacaagguuaagaaaucagaucucaaaagcauauacuuuauaucagaaucucagaaauaccacaaacugauaagcaccaacaccgucacauacacauuauauaugcagauauauaucucuauuaaauuaucauaaguccuauguccuagagcaacaaaaaauuagauagcuauacagaaaauuuaagacaagacaaaagaaagcugggcaaccgcaaggcaaacgaaccuggugcucacaauaacauaaaauacagcagaaugguaagcaccuauuucgauuuuguacaaaguaaauaacaagucuaaauucguaucuacagguuguuucaaaagaacaacaguuaaaaaagcagaaugagaauuuaauuccauuucuuucuauaacucugagauuuaacauuagaaaccaugcuauuacauuuuucacuaaagcuuuuguacucuauucuccaaaaauuuauuuuaagaggugaaauauacaugucacuaaaaauggaucauuuaaacagacucaaucaauuuuaacgcuccaaacauggcuaaguugaaaucuaauuaagcaaaauuucaaaccacacugaaauuauagcaaauaacacuacugagagaaaaagaaauauacuuugugauauagacaauaucuguauucauuuuaaucucaaacauuuuaguuaccaauuauuauagaaaaaagaaaacaaauucaaugggaucaaagaaauagcugugaaaauguacaaaagacaguucuccacagauacuuccccccaccccaaaaaauaaaaacuaaaauugaagaaaaaaauuaguaauuugaaggacagaagauuguuuucaaacacagguuauuuuaacuaaaaaucagaaguuaaauuuucuaggauuucagaaguauagaaugagguauaguuuuuauuuauuuagcugacaaaaccaggcugcagguuaaaugugcagcaagcauaagcuaauauuuuaaagucuucacuaauucagaaucuuuguccagaacuggcugaaauccuuugaguuagcuaugaaaaaggagacuuaaagcaaauuaacagugcaaauuccaaagacauguuuaaaccaaaaaagaaaauuuaaaaccucauaagaacuuaagcagucauuuucaccuaaagauaaacgauaugccuacucacuaaguaagaccaaauauuuagaaacauuuaguuaacaguuuguagaauuguauauauuugaaaggaacagaaaugcagauguaauaaaaauuauuugcaaaacacuaauaaaaguuaugaacaucauucgugaaaggagucuuuuuuacuuagccauauauucauauguacugaauaguaugaagccuguaaauaugcaauucucuacugaauccuuugugaccacucuauucucaaccucguuucuuuugugugcuggaauuuuuaaauauucuuucgacagcuucaacaggacgugcccccugguggaaauacucacaaaccucuggacaggauguacuccuucuuaaaccaguacaaagguuuggacuucugcuuuaaaauagcacauugaauacauguacuuaguauuugccuuuccccuauaccuuagguaaaguaacaacuaagaaauuuuuaaaggcauaaacccauaaagacaaauacauuugaagagaaaauagacaagaaaugucaaccaaauuuuggaaacugcacaacugauaauggacuuugcacaacagaaaaaaauggaaccuaacuguggcugggaaaagcuacuacaagucgaucugggauaucggaccuggaaaaggcaauucacuugagaguauuuccaaaagaagagugaacuuuaaccaaagaucuagauaaaaguuugaaaagaacagguccccaaacccuaaucucacaagaaagguuucuccuuucuugcuuaaacaaaagauucacagcuuagagugguuuguagagaugguagggaauagggaaguggaaagagaauagaaaaugucuuagugaaaccaggaggauuaauuccaagugaacauacugaaccuugaaacgcccagccugguucucagaacacuagaugaagaagaucagaagacucuuuuguagaaucugcugauacuuaaagauugcucaauuuaaaaaaaauaaauaaaucagcuugcuaccuuaaaucccuacaaaaaauaccuaucagucaacaaaccuugccuaugcacacagagcuuccugacaguacucaacgcaaguauaaaugguuagccaaggaucaccagacauuugaagaaauucuugaacauuaaugcuagagaccaaaaaaagagagcaagagagaaaagagggagaagaaaaaagaaacauggaggaaauguuuaaagaugaaaacuuuaaaagaaaaaacaaauacuccuuaaaaaaagacccuccauccaugaaacaagaacaggaugcuguaacaaagaaacagccaaagaacaaaaaaaaagugcuuccagaaaugaaacuauguacaggaaaauuuuaaagucaauacaugauuuaaaagaguaugcagaagaaaucacuucaaaaauuacaacaaggacaaacaaauaggcaacaagaaaaggaaauuuucaaauuacuaauauaaauuucccacggcuggaggacuuaagccuccacucaaaaaaggccuacuaagcacuagcaaacaaauuuuaaaggauccauagcacggcuucaagguguaccacuguuguauuccagaucauggggaauaaggaccaaaaaggaaucucaaagcuuuaaaaacaaaaaaacaaguuauauacaaagaaaacgaaaauagcaucaagauuuucaauagcaacacuuaaagacaggagguaacagaauaauguauccaaaauucugagggcaacaguuacuuaagaccuagaauucuaaacagucuacuuaacaauaagaagcaggaguauaaggaauauaagaguuauucagauacauaaaaauucaaagaaguaccuccgagcagguucccaaaaguuacuuaaagcaauauuccaacaaacuaaauagaaccugaaaaaagggugcuuugggaaacagaaaacaggaaauaaauaaaaggcaaaaacaggguaagaagacaccaggaagacggcucuccuuugaucaggagagaagccaguccaaauugaagcaagacaaugaaagacuccagcaguaaaauuuuuaacaacaaaaaaaguaucugacugaauuaaugacagacacauagaaaacuaugcaacaaaaaaagcaguuaaauucaacuaaaagccuguacaagaacaaaauggaauuacauaauaucuaagcaugaauacugauucaacaaaaauugugauacaacaauagcaaaaagauuagagaagcagagacagggaggacauguaaaaaugcuacaugguccucuuaaauuauagacagguaguuaauaauacauaaaauuaaaaaaaaaagaaguaaacaaaaacaggauaugccaaccacuggaaaauaugaauaaaaagagcagaguaaaaauagccaaaaacagaaaguaauuacaucugaggaaugggaacugugagccaaaagggauaagugaaugcugcucuuuuuuuuaaauaacgucuuaagaugguuugugguuauuuaaagcuauauacaucuaucauaaacuaaaaucauaaauuuguauuuugaaaugccuuauuggagauacucaagagcauacacauugcuugauaagguacgaaucuacaaauccaagaagcucaacgaaauccaaguaggauaaacccagacccacaccaagacacacuauaaucaaacuguugaacaacaacaaagagagaaucuugaaagcaucaagagaaaaaccacucaucacaaacaagaaaucuucaacaagauuaucagauuucucagcagaaacccugaagcacagaagguuaugggaugacauauauuuaaaaagugcugagagagaaacaaaauacuucauccaagaauucuauguuuagcaaaacaacagucuuuuaaaaaugaggggaaauuuaagauauucccagauaaacaagaguugagggcauuccucaccacuagaccugcaauccaagaaaugcuaaaggaaguucuucggguagaaaugaaaagacaguaacucaaagcuauaugaaaacacagaucucugauaaagguaaacacauaggcaaaaauaaguauuacugucauuuugguuuguaacuccacuuuuuucuuuucuaugugauaaagaaaaaugaauacacaucacuggacaucuauauuaauggagacacaauauauaaagauauaauuugugacacaaauaauauaaagaggugaaggagcugaacaggaauaaagccucuguaugugauugaaguuaaguugguauaaauucaaaauacauuuuauaaccuuaggauguucuauguaaucgccaugguaaccacaaagaaaauaccuauauuuuaaaaagaagugaaaaggagaucaaaaccauucaccauaaaaaaaaaucaaacacaaaggaaggcaguaauauagaaaugagucaaaaaaaagcuauaaaacaugcagaaaauaacaaaacagcgaaagucuuucccccaucaguaauuacuauacauguaaacagauuaaacuucccaaucaaaaagcauaaauuggcagaaucaauuguuuuaaaaaaaggauccaacuauauacugucuauaagagacucacuuguagaucuaagggcacaaauagguugaaagugaaggaaugaaaaagauauuccauaccaauaguaaccaaaaaagaaaugaaguagcuauaguaguaucagacaaaauagacuuuaaauuaaaaaagucacaagagacaaaggauauuucacacugauaaaagguucaaucuaucaagauacaacaauuauaaauacauacauaccuaacagagcucaaauguacaaagcaaaaauguacagaacagaagggagaaauuauuucaccauaauagcuggaggagacaugaauauccccuuuucaauaaaggacagaacagccagaaggaaauaaagaacaugaacaccacuaaagaccaauuagaccuaauagacauauauagaaaccuccacccaacaacaggaaaaauacacaccuucuaagggaaacauggaacagucaccaggauaggucauaugagaggccacaaaauaagucucgaaaaauuuaacaagauugaaaucauauaaaguaucuuuucuaacuggaaugcucaauaacauuaaaaaucauuaauagaaggaaaauuggaaaaagucauaaauauaugaaaauuuuacaaaauaaucugucaaugggucaaagaagaaaucauaggcauaauuaaaaaauauggcugggcacaguggcucccagcacuuuaggaggccgaggcaggcagauugcuugaggccaggaauucaagacuagccuggacaacauggugaaaccccgacucuacuaaaaauacaaaaauuagccaggcaugguagcccucaccuguagucccaacuacuagggaggcugaggcagaagaaucccuucaacgcgggagauggaaguuacagugagccgauauugcaccacugcacuccagccagggcaacagagugagugagacucugucucaaaagaaaagagaaaauacccugagaccaacaaaaaugaaaacucaacgaaaauuuaugggaugcagcaaagcaaugcuaagaaagauauuuauagcuguaaauaccuacaucaaaaaaaaagaaauacuucaaaucaguaacuucacuguacacuuuaagaaacuggaaaaaaaagaaagaguaaacugaacccaaagcuaacagaagaaaggaauaacaaagauuagagaaugauaaacaaaacagaauuuuuauaaaaugcugaaaaauuaaugcaaccaaaaguugguuuuuuacaagaucaacaaaauugacaaaucuuuauuagacugucuaagaaaaaaagagaagauucaaaucacuaaaaucacaaacaaaaguggaacaauaaaaacuauuacagaaauuaaugggauuauacagaaauaguacaaacaacugacugccaacaaguuugauaauuuagauaaaauagacaaauuccuagaaaaacacaaacuaccaaaacugaaaucugaauagacuuguaacaaguagcauauugaaucaguaaucaaaaaccucccaacaaagaaaggaccaagaagagaugcuuucacagaugaauucuaccaaacauucaaagaauuaacaccaauccucucaaacucuucuaaacaaugaaaagggagggaacacauucugugagccagccagauaaaaauaugaaaacuacaggcuaauuucucuuaugaauauacauauaaaaauccucaacaaaaugcuggcaaacuaaauacgguagcacauuaaaagaaugauacaucaugaccaagaaugaucucugccacacccuggaaugcaaggauggguucaacauauaaaaaucaauguaauauacuacauuagcagaaugaagaggaaaaaacaugguaaucucgauugaauccaaaaaagccuuugacaaaauccaacaaccuuucaugauuaaaaaaaaaaacucaauaaauuagaaacagaagggaacuuccauaacauaauaaaggccauauaugaaaaccccacacugacaucacacucuaugaugaaagacugcgagucucuccccuaagauugggaauaagacaaggaugcucacuaugaacaugucuauucaacaacauacuagaaguucuagcuagagcaauuaagcaagaaaaacaaauaaaaagccuccaaauuggaaagaagucaaguucucucuacuaccaacauaugauacaaucuuauauguaauaugcagaaaacccuaaagaauacacacacacacacacacacaaaacacccuuguaaagcuaauaaaaaaaauucagcaaaguugcaggaugcaaaaucaacacacaaaaaucaacugcauuucuaugcacuaacaaugagcaaucuaaaaaggaaauuuguaagcaauucauuuaaacuagaaccaaaaggacuaaacucuuaagaaggugcaagacuugcacacuaaaaacuauaaaguguugcuaaaacaaauaagacacaaauaaauagauauccuauguucacggagugaauauauuuaauaauuaggaugucaauacuacccauggcaaccaacagacucagugcaacucccaguaaaauccaguaauuuuuuuuuugcaaaaacagaaaagcccauucuaaaauucacauggagucucaaggguuccccaauaaccaaaacaauauuuaaaaagaaaaacuaaguuguaagucucaucuuucuguuuucaaaacuuacuauaaagcuacccucaucaaaauaaugugguaccaacauaaauacagacuuacggaccaaaaaauagaauacaaagcucagacauaagaccucauaaauguaugaccaaaugauuuuugacaagaguguaaaaaccauucaaaaagguaaggacaguguuuucagcaaaucguguugagaaaacuggaaccacaugcaaaagaauaaaguuggacccuuaccuuacaagcauauauaaaauggauacagcaaccuaaaugaaagcuaaaucuaggaaacucaaaaaaaaaaacacagggaagcugcuucaugacauuuggcaacaauuucuuagauaugacaugaaaagcauaggcaaaaacaaaaaaacacuaacuggacagugaaaauuaaaaauuuuugugcaucaaacaacauuaucaagaaaguaaaagggcacucuaccuggcagcuauuuuuuuuuuuaaguaagacaaaauaaaagaagaaaguaaaagggcaaccaacagaccaggagaaaauauuugcaaauuacacuucugauaagggacuaauauccagaauauauaaagaacuacaacugaacaagaaaaacaaacaacccaaauaaaaaaugggcaaaagacuugaauagacauuucuccaaagaugauauacauguggccaauaaacacaugaaaagaugcucaacauaauuaaucacugaagaaauacaaaucaaaacccugcugauacuucacuucaaauccacuucaaacuauauuccuugaugauaugccacuucaaaauauauuuauuuuauauauaaaaaauauaguaacaaguguugacaagaaugugggaaaacuggauuccuuguauuuugguguugagaauauaaaaugguacagcugcugugaaagacagaauggagguuccuuaaaaaauacaacauagggccgggcgugguggcucacaccuguaaucccagcacuuugggagacugaggcagaugcaucaccugaggucaggaguucaagaucagccuggccaacauggugaaacccugucucuacuaaaaauacaaaaaauuagucgggcaugguggugcacaccuguagucccagcuacucaggaggcugaggcaggaaggcucuugaaccugggaggcggaggcugcagugagccaagauugcaccacugcacucccagccugggcaacagagugagacccugccucaaaaaaaaaaaaaaaaauccacagaauuuccauaugauccagcaauuccacuuucagauauacaccccaaauaauuuaaagcagggaacuaaauaaauauuuguauaccuauauucauagcagcacuauucacaauagcgaacagaauaauucacauuauucacaaaauaaaauauuguucauccuuaaaaaaaaggaaauucugacacgugcuacaacacagaugaaccuagaaaacauuaugcuaugugaaauaauccagacacaaaaggacaaaugcuguaggauuccacuuauguaagguaucuagaauagccaaauucauauggaaaguagaauagugguuaccaggggauggggggaggaaggaaaaaauggggaguuaucaccuaacugguacaguuuuaauuugagaagaugaaaaauaucuggagauggauggugguuauagcugaccaaccaugugaaugaggggaagggaagggaggggaggggaggaaaaggaggaaaagacaguaaguuagcuaguuagcagugccagggggccuacaauaagguaucaguuucaaaacaaguuugcaaacacauuggguuggcaaagguguagucagucuguuaaagccagcacugucaaaguuaaaaaucuacuucacuucaugccagcaauuguaucuuaagucauuuauacuacagauacacacaaguacaaaugauacacacacacacacacacacauacacacagagguuauucacugcagcauugauuuuaacagcaaaaaaaaaggaagacgaucuaaaggccuaucaguaaaggacuggcuaaauagaguacaauauaauacuauauagccaugaaaagaauaagacagcaagcugccaaaacaaaaaaauaaaagugugccuacaauuugaguggagguguauagggugggguaggaaugcauaagucuauggcuguaaaugcacagaauaucccuggaauaaugaguaagauacugauaacagcgaugccuccagggagguaaacuggauguuaaagaacaagaaaaggaagcauaguuguuuuuuaauaaauauccuuuagauuuuguaucauguccauauauaaccuacuaaaaaaauaauuuuuaaaaaagcccaucuugugaaugaccugaugcaccucauacaaucuuucuucuccuaucacuuaaaaaaaaaagcuguauucggugcuaacgucuuaucacccacuuucuucugaaaucugccuaaaaauguauuccuaaaucaagauuuucuuuagaaugcucuguaagauaacagacauuacauuuuaaaaguuucucaaaaucaaguaaguuugggaaccacaacauuaaacaagacuaaagggauauuuuucauuacagggcuucuaaguaacgugccuaugugcauuuuacucucugguagagggaaaguagugugcagugaucuacaaacuuacuugauuaugucaacaacauugccucuaggucaccacucauccaaugcuuccccucaaccuucacauucaaucaguugccaaguccuaucaggcucagaaauucuuccugcuucugaucucuucucuaagccuauagccauuaccccuaguucaugcucuuaucccuucauguccacucuuccauuuaauaaaaauaacuuuauuguaaaaaugaagacuaaguaugcauuuuuaagacaaaaguaaaaauaagauaaaauaaaugugucagauacaauucugaacaaaagacacacgguaaaauaauucuccccauauuaucuuugaaaggaaaaucuauuaagaucauccuauaaguaaaacuguuuaacauuaaucacuggacuaaugacuagaaauguggccaaaugccuguugucacagccaaaaauucuaagacauggugccuagauacuagaauuucaagucauucuauauaccgguguucaaaaguagauuacagagacaugcagaaacaaaauuaccaaaaacuugucuauacuguagaaaccucugauuaaauccuggucuuuucacuuagucucauugaagauguacuccuuucuaagccaaaaauugcucucuaacguaaaaaagaauucagcaaaucucaaagcaaguauuuagaguaaaacuuuuaaguucacgugaaauacauuaaucccuaauuuguaacauuaaaaauacuuuaagaaguuccuauuucagcaacaacagaguaauaagauacuaaaaauauuaaauaaucuaaaagaggacaagaaaggguaacaagaggaacaaaaacgggggaaugccaaaccugaauccaaacauauuacauuaaauguaaauggucuaaguacaucaauuaaaagacugaaauuaucagaaucaauuaaaaaggaaagauccaugcugccuauaagaaacucacuuuaggccaggcacaguggcucacgccuguaaaccuagcacuuugggaggccaagguaggcagaucacuugaggucaaggguucgagaucagccuagccaacauggugaaaccccaucucuauaaaaaauacaaagauuagcugggcaugguggcacucgccuguaauccccacuacucgggaggcugaggcgggagaaccacuugaacuugggagguggagguugcagugagucaagaucaggccacugcacuccagccugggcaauagagcaagacucugucucaaaagaacaaaaaaaagaaacccacuuuaaauaugauauaguuagcauaaaaguaaaagaaauggaaaaauauacgccaugcaaauauuaaacaaaaaaagcucaauguaucaaauccaguaauacaugaaagaauacaccaugaucaaaugcgguucauccagggaagaaaaaucaaucaauauaauccaccacauuaacagauacagaagaaaaacuacaagaucauaucaauagaugcagaaaauacacuggacaaaauucaacauauuuucauuuaaaaaauccgcaaauuagaaccagguagaaaguucccuaaacuuauagggaguauuaauuuuuuuaaaaaaccuacagcuaacacacacuuaacaauaaaaugccaaauuuuuccccagaagaucaguuucaagacaaagacaccuaccuacucuuaccacuccuauucaauauuauacugcaaguccuagccaaggaaguaaggcaagaaaaagaaaugaaguguauacaccuuggaaaggaauaaaaaaaaauaggagcuauuuacaaaaggcaugauugucuacauagaaaaucccauggaaucuaccccaaaaaaguucagagaacaaauguggucagcaugaauggaggauacaauguuaauucuuuuuuaaaaagaguuauuucuauauacuagaacacuugaaaaacaagauuuuaaaaugccaucauuuacaacagcuccacaaaaggugaaacacuuagauauaaaccuaacaaaacgcauaugaccuguaugcucaaaaacuacaaaacugauuaaagaaguccuaaauacagagauacacuguauuuacaggcuguaaguauuuacacacuggaagauuuaauaguuaagaggucaauucuccccaaauuaauguguugauuuagugcgauuccaaucaaaaucccacuaggaguuuuuguaaacauaagcgagugguuucuaaaauguauauggaaaggcaaaggagguagaacagccaaaacaauuuggaaagaauaaacuuagagcacccguacuaccaacuuuaaggaacacuguaaggaacacuauaaugcuacaguaaucaaaacagaguggcaucagcaaagagacagacacauagauaaagaaacagaacagaugguccaaaaacacaauuacacaaaauggcucauucauuuguuuuuuaacaauuuaaguuauaauucacauaacauacaauucacccauuuaaaauguacaauuugaugguuuucguauauucaaaggguugugcaaccauuaccaaaaucuguauuuuuguauuuucauugccccuaaaaaucuccauacucuuuagcagucacucuccauucucucucacaccuuccuggcccuaagcagccacuacucuccuuucuuuuauaaauuuaccuuuucugaauauuucauguaaauggaaucauacaauauauggucuuuugugacugguuucuuuaauuuauucuaauguuuucaagguacacaucuuuuuauugccaaacaacauuccacugcauggauguacgacacuuauucaccuguuauuaguugauagacauuuagguuguuuccauguuucggcuacuauaagcagugcugcucuuaauauucauguacaaguauuuguggacauacauuuuuauuucccuuggguagaauacuaucuagguguggaacugcuagaucacaguaaaacacaauguuuaacuugcugaaaaauuccaaacuguucuccaaaguggcuuccccaguuuacagucccaccagcaaugaaugaggguuccaauuuuuucacauccucaccaacaaguguuacugucuuuuuuauuauaaccauccuagugugguaucuaagauggucuuguugccaauucauuuugacaaaggugcaaagucauuucaauggagacagaacaguauuuucaacauaguauuggagcaacuggacauccauaugcaagaaaaaugaaccgugaccuaaaccccacaccucaaacaaaaauuaacuuaaaaucaaucacagaucuaauuguaaaauaucaaaguauaaaacuuucagaagaaaacacagaagaaaaucuucaacaacuaagguuagguaaagcguucuuagauaugacaccacacauaugauccauuaaaaaaagcuaaaagcugaacuucauaauuaaaaacuugcucuggaaagacacuguuaagagaaugaaaagacaagaugcaaagugggagaaaauauuugcacaucaccuauuuaacauaaauccagaauauauuaaaaaaaaaaaaacucucaaaacgacaguaagaaaauauacaaugcagcggggugcgguggcucauaccuguaaucucagcacuuugggaggccaagguggguggaccacaaggcggacagaucaugaggucaggaguucaagaccagccugaccaacauggugaaacccugucucuacuaaaaauacaaaaauuagccgggcguggugguacgcaccuguaaucucagcuacucaggaggcugagcaggagaaucacuugaacccgggaggcggagguugcgaugaacugacaucgcgccacugcacuccagccugggcgacagagugagacuccaucucaaaaaaaaagaaagaaaauauauaacccaggccaggugcaauggcacacgccuguaaucgcagcacuuucagaggcugaggcggguggaucaccugaggucaggaguucaagaccagccugaccaacauggugaaaccccaucucuacuaaaaguacaaaaaaauuagccgggcaugguggcgcaugucuguaaucccagcuacucaggaggcugaggcaggagaauugcucgaaccucggaggcuaagguugcagugagccaagaucgccccacugcacuccagccuaggcgacagagugagacuccaucucaaaaaauaaaaaaaaaaaagcauauauaacccaauauuuuaaaaugggcaaaagaguucaacagguaaaagaggacacaaagauaaaauaagugcaugaaucaaugcucaacaucauuaggcaaugaugcaaacuaaaaucacuauacaccuauucaaauggcuacacuucuuaaacugacaauauugagggcugguagagacgcaaagauaccacuaucacacacugcugaaagagauguaaaucauacagccacuuuggaaaacagcuugguagucucuuaaaaauugaacauacauuuaucauaugaucuaacaaucucacuuguagguauuuaccaacagcaauaaaaauguauguucgcacaaaaaccuguacacaaaggcuuacagcagcucuguuccuaaccgccaaaaaauggaagcacccaaaugucccucaaaaggugaauggaaaaacugcuguacgugcauuuaauagauaugcauguaacggaacacuccucagcaauaaaagaaaugaacuuugaauacacagaaccaccuggaugaggcguuacagcaagugaagaagcuaaucucaaaagacacagacgugaagucgucaauccuucagcaguaggcagccguagggugugaccaccaaggggcagugugagggagguuuugauaggagcugaguccugagagcaguaucuuguauccuauuccguguccugacuguggugcuggcuaaacaaaucaugacccguguuguaacucagaccuuccccaauuaccccaaucaaccaugacauagaugacuauguguuuaacugguuauauuuccucugccuuaagaaaaauaaaguaccuuuucuuaauaaaugugaaguacaacaauauaccuaaguauuuucuucagguauaaauuauaaaaccaugugaauaaaagagcuuuacguaauuuuuuuuuuuuuuuugagacaaaauuucgcuuuguugcccaggcuggagugcaguggcacaaucucagcucacugcaaccuccaccuccuggguucaagugauucuccugucucagccucccaaguagcugggacuacaggcacacaccaccacgcccggcuaauuuuuguauuuuuaguagagacgagguuuuaccacguuggucgggcuggucucggacuccugaccucaggugauccaccugccuuguccucccaaagugcugggauuacaggcaugagccccugcgcccggcccagaauuuauuguaacaggaaauauguacuuugaaaauuauuuuagauaaauauugaucccaaaagucaucuauguuuggucacuuuccaaaaccauauuuaacuacuagaaagugauuuacaaaaacauguuucucuacucuagagcucuauucuauuguaguauaaguauucccauuaauauuuuaaguuauaacuaauuauaaagauuuuuuucacugaaauaugaaaaucaaugugaacaaacuucaacaggcuauggauucauuucauaacaucagagcuacuucaguauauaaagagaggcuucgucuucaguaaggucuuuaagaaaaaaguaugcccauucucuuucgcuaauauacaugacaaaaauaaugcagcaaagccaaaagauuuaucauugccagaaauuacauacaggccuaacaauaagauucugauuagugucacaaaagaucaaaauauauaucaauuauaaacuuauaggaguugauuugcaauuagagucuccaaauauaguucccagaauuucacugaguaaaugaguucucuaguacucauucauguauaagugaaaucaaguucagcuuuagaaaacucagcuguuuucuguuuaguaugaccuuauuuauaaaaaaggaucuucccaucauuuauuuucaaauacacauuuaacuaaaagguuaaaaagcagguagggcggauauuauacucucaaucuaaauacguauuacagaaauaacaacagauuauaaacugaaccuaauuuuaaaauauaacuaagcuagaacccaagcuagcucauccaacugcaaaauguguaguguguguuguguguguguauguaggcuucuauacaccuacagauaauagcacggauaaacaaaacucaagagcugcccuaauaaagggaugcagagaacucaaacaacugaaaaaggauaagggugcuguuuuagguagcaccuuuucacaccuggucuccucuaucaaaugaaaauaugguuuuuuuuccaaaccaaaaagcauuuuuaagaauugucuacuuauguaaacagguauuucucuuaguucacuaaggagaaaacacauuauuucuguguacuaaaguauuaagugcaaaaauaagucuauaauagcaacuaaaaaaaaauuauaagguauaaaaugacuccaauuuuuaugucuucccaacuucuaacuacaaaaucacauaaugacuuugaaacuuuguaacuucugaaaacaugccaauguaggugacauuuccaacccggaugcuccauucuccagcucauucucaaauguugguucuacucaaacuaccuacaauucaacagaaucacaaacagccuggauucauagaucacggaagguacuuuugguaagaaacagcccuucagcuuggcaaucugugaauggauacauauacaacaaagaaacaucauuuaaaauggguaccuacguucuuuccggugcucaacuaaaccuacagccugcuuugcugagcacuuugcaaaccaguugucccccaguaaaacagugacuucauuaguauggacaaguuuuccuggcaugaaggcaaaagggccaaaugguaccuauuguuuaaaaaaaaagaaaaaagggaaaaaacauaaaacacugaaaaguacauuuuauaaaacacuucgcauuaaaagccuuacauaacugaauuuuuuuauuuauacauugggaaaaauaaaaugccagcuucacagaaauucaacacuauauuaaaauuuuacuaggaaaaucuaaagaaaauugcuuuauguucauaaaucaauguuaaaacaggaaaauaaauccacaccauauuuacauauagcucuuaaagaaaguaguacugucucggcauguuuauacuuuucauucacuugcaaaucuaagugaaagcaacuaguagugaaacauugucaaugcaaaauacuuuugauaaagaaaacuaaaaauuauuuucaauaaaguagacacuuuugcaaagcaggaauuaguaaacaaauagcuuuaauggaucuaucuagcuauauauacaaaauacuuggacuaguauaaaagaacaaagucuucauaagaaagaacauucaugcaaugaaaggcucuaauccagggcucaugaacagaucacuaugucgaugugaagaucauuaaaacaaaaauuagcagcacguuuuuauauaaaaaucaauguccuaagguuuaauucugugaauuacaaaacauuauggccuauuccugcucuggcuaacaagaaacgacuuaguaccauauuucugucauaauuacauuuuuuauauaguaaguuuccauuugaaauauguccaauuuugugcuaauauuuaugucauuugugucaccauauauauucugaaaaaaaaagguaaauaccaacaauuacuacaauuacuguguucuuauaaaguaaaacaaaacaaaucuuccuugcuacauaguuaccuuggacacaguccaucagccugacauucugugaaccgacacauaguuaauauguuuacaagaaacaacuauuacuuuaaaagaaacacaccaaacauaccauuauauuauaagacaauuuaucaggcaaggugcugagucuuucucgaagggcauuauagucauuaucuaccuucuuccuguugacagaaaacaccaaauacacacauuauuaacgauuuuucuuuuuuuuuuuuuuuuuuuuuuuuuuuuuuuuuuuuuuuuuuuuuuuuuuuuuuuuuugagacagagugucgcuccgucgcccaggcuaaagugcaguggcgugaucucggcucacugcacccuccaccucccggguucaagcaauucuccugccucagccuccugaguagcugggauuacaagugugcgccaccaugcaaggcuaguuuuuguauuuucaguagagaggagguuucaccauguuggucaggcuggucuugaacuccugaccucaugauccucccacuucagccuccugaagugcuagaguuacaggcgugagccacugcaccuggccucacucaaaagcuuuauuaaaucucuucuuucagucgugugugguggcucacgccuguaaucccagcaauuugggaggcccaguaggccagguaucauaaaacaagcuaaucaaaaacauaauuuuagcaaauucaagauuaaugugguuuuauuuuuaguuuuaaaauccuguuuuuauacaguuuagcaauggcauuauucuaccauacauuuauugaagaauuaagacucuucagggacucuggcauuuagaagcagaauacucaaauuuugagaauuacuguuuuuuaagauacaagacuaucuggaccaaauaaaaugugaaaauuaagggagacaguaaaagagggccugauauuuggagagaagaagggacucaagaugaaaaaagaagagauuuauuuauuuuaagacagagucucucucuguugcccaggcuggagugcaguggcacaaucucagcucacugcaaccuccaccuccuggguucaagugauuccccugccuuagccuccugaguagcugagacuacagacgcaugacaccacgcccagcuaauuuuuguaucuuccauagagauuagguuucuucgccacguuggccaggcuggucucgaacuccuggcuucaagcgauccccccaccgcagccucccaaagugcugggauuacaggcaugagccaccacacccggccgaaagaagagauuuaauaaagcuuuugagugaauagauacuggcugugaaguugaaaucaugaacaugaaauuugaucagaugcuuuaguccucaucagaaaaccuuaggcugaaaaaugcaucaucagcucuucaauuauucauaauaaugugauuaagguaagagagaaucaacuggggguagaagaaauuaaguagagauaauacaaaaggcguuucaauuuggccuaggagucuguuucuuguuacaucaaacagagcuaccaaauaaguaauuucaaacaaccaaaagguauauguaacucuguaggggcagagaugaucguauuuccaugcuaugggccuuacucagcucuuaacaccugcuggaaaugaacagcccuucuuuuugaguaauaccaggcagcagccuaugccaagaugcccgucaaacuuucucuggagacuggguuuccaaaggguucccugcuaagauacaggcugcaagcaaaacuacagcacugaauuuuuuuuaagcagaaggauguugucaguuuuuaaaaauaacagaaacaaaaauucaccaacucagcaaguaauuuaaaagaacauguagacauugucaaauugaaaucaggauaaacugcaauguagguaacaacucuccagauaauauaaaugacaaacaucacagaauugguuucagcuuacugcuuaguucccugaagcaacaguagcauaauuaauaaaaaaaaauuagcucagucuuaagaucuuaaggaauuucacauauauauuauuuuacauaaccuauaauaaaugucacuuaucaguauuuuucucuuacagaagacaaaguagaaggaagauggaaaaaccacauagcaagaagccagaucuccucuaucaagaugagguaagcaaugaguuuaaccuagcuaggucuucugaccugcauuccuucaugaaagcuuucucauuuucuagugugcaacugcuuuauaacuuuccccaaaaaaaauccuuuucuauaaauaaauacgaaacauguuuuauucuuuuguuuaaggcaaaaauccuccuccuggaaaauuuuuauauggauaaaauggcaaaaaaacuucaugcacaaggcuauguaccagaaagaacauggcuuugaagucagaccagagagugaaucccaagcucuacaugcaauuuacacaaauucaccuuagucuuaguaacuucaauggcaaaauuggacuaauacuuaucucacagguucaacagaauuaaauauaaaaggucuaacacacugcccagcauggagcaacuacuauuuugguuccaaaacucaaaacucauuuuuuucaugaagcaucaaaaaacaucaauuccaaaacuuucaagaaagacuauuaccuacaagauuucacuaaccaauuugauacaaauaguauaacuugcugaaagacaguacagcugaauguaaccauucaggggcuuuggaaacaggacuggugugagcaaucaaugggagaaugucuccauaggacugacugguacagugccuagacagucaacacucacuauuaauaacauaacacuaacagcuuauuuauguuucagauaaguaauucugcaaaugcucaaggacuaaauacaccagccuagauaucuaaauauuucuaugaauauuaagaagcuaguauuaaagucaccauucaauaagucuuauuuugguaacaaugcuuaggagaaaaaaaaacaacuuccucacaaaaaacaucuauuuuguacauuaaaagaacaguacguucaaaaacaggcaauaccagagaucaaugucaauauuucaagucaaauauaaucaguuuucaacuuauuaauaauucucucuggaauaaaaaugcggacauacuggagagcaguuuaagauuagaguugcuauuuauaaauuuugaauuauuuucuaaaaauacaaaaguagaagaucacuuaaaaugcagcccauguagaaauccuuuaugaagggaggccaggaggagucaagcaaugucucuggaagaaacuacagcuugaggaacccucucucucuaaaggcuacauucguggaaauguucagggcuuagucaaacagugaucuccaaauaguaucucuauuauuucaggcuuaaauaauccuguuaaagaucacaaagccuaugcaacagaaaaugcaaaaguuaugcuaagaacuaaugcauuacugagguuaagucuggggucuuuauuuauaacaaaauuugaacagauuuuuuuuucuauuuuaauaauuagaaacguaauuaauuuuuggacacaggagucauuacaguaaucaaaaaugguaauugcuuaaaauaauuuuucuucaaauggaaaacaaaacccagauagaguuaagaaacaccucuccagccuacuuacuuagaauagcuagaccugcuucuuuggcuucaacauaauggauccuuauagaucagguuccgccuucaacucuuaauuuuaaauuuuuuuccaauauccucaugcaacauuccuuauacaaaacaagaacuaaaagcauagguauaaggcauguaagaaacuuuaaccacuuccuucugaaucuugcuaaucaugugcaauaugccuuuugagaguaccuuuuguuuuaaggaaauuaaaaaaaaaaaauaggcagcagcgaugaagaccauuaacacaaccacaaguuagcccuuacccuuaaaggauuaagaucaagacagaaccuaugggaaacagcucauuugcauaaaauuguagaaaguaagagagaaaucaaguuaaaugagggauaugcucaaguauuuaggggugaaauacacagauguccacaacuuaauuugaaauucaucagaaaaaaauggauuaacggauuaggguacagacagauaggugaucaagauucacucuuccauauguuugaaauuugucauaauagaauauuuuuaaagggacgaggaaauaugaaagggaucaacauuuuuaauccucuuaaaagugacugacaaaaauaaaaaucucuauuaaaaaaaaaaagucuacauccuuugaggccagugauaaagacuccaaccuuuaaauaauaaaaaagggagauaaaauuuaaaucagguugaaacaauaagacuuugcuaauuuuacuuuaaaguaagaaguuaaaauagacagcaaauacuaacauugaacuuuuuuuuuuuuuuuuuuuuuuggagauggagucucacucuuucacccagccuggagugccguggcgugaucucggcucacugcaaccuccaccucccagguucaagcgauucuccugccucagccuccugaguagcugagauuauaggcacgcgccaccgcacccggcuaauuuuuguauuuuuaguagagacgggguuucaccauguuggucaggcuggucucgaacccugaccuugugaucuacccgcuucggccucccagagugcugggauuacaggugugagccaccaugccuggcccaguuuuuuuuuuuuuuuuuuuuuuuuuuuaagaaaaaaaaucuucuaucacucucuuuuccucuaccuaacauccuaaacagacaagcagaaaauacugugagaugccuaacggggaaagaggaaaaaaauuucuauauaaguguuaacaucugaguuaaccugggacagaguuaaauuuuuauuuuuuaauuuaagaaacgauaaaaacggaagauucuggaauauauacaauauauaaccuucuuuagaaauaauuuuuaguccaucauacccacccuacaacuucccauuaagcauccaaaaaagacuuguuucaauugaauccaccauuuacugagcagcuccucuacaacaagccuauggcauaugcugcagggaucaucacucacacauagcaugccuuucugauuguuuguugauuguuuugcaaugcaucuuugucaaagauccacuagcuugaaggaugccuggcuuuucaccucuaaaaucaagaaaauagaggaauauuaaguuugggcauggauucuauauagauaaagagauguccuccaguuacuaaagcaagaaauaaugauuuuuuucaaaguauccuuuuaaacaaucuaaacaaauugauaaaaguuacauuuuauuuaaaaauucuugaaaaagggaucuauacuguuaugcuuuaugcaauuuggugggaaaaggaacacuccucauggaaaauuuaaauguacuugaauuaaaucaauagcauuacacuuuuuuucuaaauggucauggcaaaauauucaguaauuucaauugauauaaguaacugaaauguaccacaaaauucaggcagaauggugguauauuccuuuuuuauaacucuauuauaccaaggaauuuaugucaucagaagaugcugaugaaauaaucuauguucuuuauauuuuaugaguccaucagaaaacuuuacuauuagacauagauaccaagauuaacccgcauauaaaaacauaauuuuucaagucaaugaaacaaaauuaucuaaagagagaugcagcuaacauucuacuagauuucuucaauuuaacuuuucaacaaugagaaaacagugcaauggauauauauauauaguaagccuggacagaaaaaucuguucuacuguucucucuacaacaaccauacacauguguuugaagacuugucaguuaucacaggugccuguuucuucacucauuacuaaucuuuugcucuaagaaaaugagaugugaauucaaagcaaaaaaccuuuaaaauuauguaaaaacacauucaucuacguuugaaagaaauauccuaaagugccuaguuaauuuuuacugaugaguuuauauguaauuuuuguucuuuuuauuuuccaaauuuucuauaacuaauauaaauuccuauuacaaaucaaaggaaaggaccuuuuagaaaaggugugaugaguuuauagcugacuuaagcuuugaaaguuugugcaaauuucuacuuaaaucuuaccguaauucauagguuuugcuacuuuacacuuucuauauuuucuuucuaaagcauauuuuagaaaaaaguaauuuuguggguuuucuuaauuacaguagcaauuaaaaaacccuuuuaggucacugaucccuaugagaaacuagaaaaacucuaggcucuucccugagaaaagaacucauauuuuacauauaguuucagcagaggcccaaucauagauaccuccggguuaaaguuucucaagagguuuuacaacagugaaaaauggcaauccugguuuugaaccuaccaaauauuuaaaaaccucaaaauuaucaacugacuuaaaaauaaaagaaaaaugugaaaacccucaccaauuugaucaugaguucaauaugaauuaguaaaaaguaaauuauaggcaugccuccauuuuucacagccuacauuucucucaggucuuacacugauacccaccccaaucugucuuugguauaguggaaucuggacuuauauuucucaaaauaagaacaagcacucaggauuaucaccaagugaugcacuucucagacaagcacugugguuguugcaauauucacaucuucauccucaaacaggacucugugcuuaagaguuuuauuggauguuacucuucauaaaaaaaaauggaaaaugaaaaaaaaguacaaagaaguacaguuuucaaaccuaauacaguugagacaaagauaaaaaaucaugaggugugcccaaagcaguaagcccuaagcccuuugccucagucagauacuggacuugagcuggucaugggaaacugaaccaaaccauauugacacuggaaacacgucgucaucaaggacuauucuaggugaugaaaugugauuagggauuuuuuuuaauaauaguuuaaaacucuucaggggaaaaaaacucuccuauaacauguaaguuuuccuuucauuuucagaagugcguuaaacuagcugguugcuuccaaaaacaugauauaaaagcuugaggacuccuacaaguaauaaauucuaauuacaaguuaaaaaucauuuaacucuuuaaaaagagaaggaaaagaaaaaugcauuuacaguuugaccuuagucacauaaauacacauacagaauuaagaagcuagagggaauaaaagggaauguuuuaaaaacagggagagaauuagcuucucuuuacaauuaugaguaaauuuaucuuuauuccuuucuuauuucaacuuuuccauaacuaagcaugcauucauuuuauauucagaauaaacauuuaaaaaccuaacucagauuuaaaaaaaauucuuuaaacauucaacuugaaucuuuuuuuuugccucuuaauuugcuuugaaacauuacacacgaguuccaaacucacuuaaucacuagcgcauguacuaacucacaccauuuuuuaaaacugugcagaaacuuaaugacaagauuugacauauaugauucuucccccuuaucccuaagacuuucauaaacaacuacagaaacuccaacaacaaaaacaugcaaaauuuccagaaaguuuggcaguugcucucugcucaagaggagggaaaaaaaaaaaaaaaaagaaaaaauaacauaaagaaaaagcccaaacagaaggcccucuacaaaacagugacugaaaacuuuguagucaguaaaauacagacucugaaaaacacaguuuacaaaucuaccuaacacuguagaaaaaagucauuggcuuuuacaaguuuuaaagguaugcagaucaauauuucacauauuauacauaauaaaauaaauuuuauauagcaugugaaggcaacucaagaaaacaguuucagguauucauaugaaauauacuguaaaccauggcauuguuacaaugauauaguucagugcuucugugcacaaggaaugccucaaaaacaugagacauauagacagauauacaaugugugcauaaagcagguaucuccaucccgacugauaggaaagaguagcuccaacaggaaaaaaaaaaaagagagagagaaaaucaaaucuucaccugagauuuuuagcuauacagguaugcuuucuugguuauuuccuacuauauacuuuaacuauaaauucuaauggaagcuaguuacucuuuuccucugaacaauuauuuuuguccaguuuccuuugaaaaauaaaaaaauguugaguauuugcuuuagacucucucaaaacucacaugccaaaguguuuuagaacuuuuaugucuaaauuuaaaguauucuuuccaaaauuaaacaccugaacaaaguaucuucuucuauauuuaagucuguuucauguaauuucaaagauaccuuuaccaaaaauccuuuuaaaauaaaggaagcaaggcaauaaauuuuuuacaacucacaugcauacgauuuacgauuguaaguaaugccuaacauaaagaugaacugccaggcaucacauguacuauuucauuucauucucaccagucaacauaaaggacggagacuuccuuuuuguguguguaggaccuauucaauaaagucauugcagugcauuaaaaaugaccauuaauucuuuuucacgccuccucucaacagguggguguuaucuucccaccuugugaaucugcgcuggcccuuccuuugaccaacauaacguggccuugcagcuuccauucuugcugcugagaugcccauagaaaguaagcuggacaaaagagcacauggaggcagaggcucaaccaacagcacuaaccaccagacuugagggugaggucauucuggacaacaaagcugacccagccaccaacuggcugcaaccaaagcagugagcccacacaagacuagcagaagaaccacacaggugagcccagcuuaauaugcacacccacugaaucaugugcaaguaaauggugguuguuucaagccacuaaguuuugcaguaauuuuacuaaggagcaguaaaauaacagauauaucaucuuagcaaggauauauuuugaguucagagcuauacucucagucauguagcaauuauuuauuuaaaaaaaaauaguuccaggucucauuuaguaauccuaaaaguuaaaugucugacauacagcaaaauguauggaaugagguaaagaggaacuguuaguuaaugauacaggguagguauaguauuaaaugaacagguacaaucugauuucauuuuuguccaaaaggaugggagccguauauaaacauguagaugaauacacacacacaacacacacacauacauacacaaacacuuacauuaugcaaaccauuucugaaaagauuuaugagaaauugguaaaaaacugcuguuuccagaaaacagaacugaggggccgggugcgguggcucacaccuguaauccuagcacuuuaggaggcggaggagggugcauugccugagcucaggaguucgagaccagccugggcaacacggugaaaccccgucuuuacuaaaauacuaaaaaaauuagcugggcauggcggcacgcgccuguaaucucagcuacuucggaggcugagucaggagaauagcuugaacccgcgaggcagaaguugcagugagccgaaaccaugccauugcacucuagccuggaugacagagugagacuccaucucaaaaaaaaaaaaaaaaaaaaaguaaacagaacugagaauuaggggacaaaguuaggaggaaccuauacaucauuuacauccuuucauaccuccuaaauuuugaaacauguaaauguauugucucauuaaauauuuuuuauuuaaaucuuaaaaaguuaauauauagucuuucuugucucuuaaagauauauacugaaauauuuccagauggaaugauacggcuuagauucauuucaaaacuggagaugggauaggcaaaauaguuuuuauuaaaaagucaaaaaagaacagauguuggcaggacugcaaagaaaaggaaugcuuuuacacuguuagugggaauguccagccacuguggacagcaguuuggagauuucugaaagaacuaaacugaacaaccauucaacccagcaauccauuacugaauacagaccacccaaaaaaaaaaagcauucugccaaaaagauacaugcaccuguauguucacuaccacaaugaucacaauagcaaagccauggaaucaauccaagugcccaucaacagugaacuggauaacaaaaaugugauacauauauacuauggacuacuacacacccauaaaaaagaagaaauauuugcaguaacauggaugcagcaggaggccacuauccuaagcgaacuaaugcagaaacagaaaaccaaauacuguauauucucacuuauaagugggagcuaaccacuggggacacauggacauaaagaugggaacaaauaaacacuggggaauacaagagcggugagaaagggcaggggcaagggcugaauaacugccuacuggguacuaugcuaucugggugauggguucaauuguaccucaaaucucagcaucaugcaaugcaccuuugcaacaaaccucuacauguaccucccaaaucuaaaauaaaaguuaaaaaaaaauuggagguaggaguagauggcaagauaagauguugaaaugaacaguuuagagaaaaucaugaguugaugauuaucaaagccgacugaugaguacaugaggauucacuauacuacucuaucaccuuucauuugaaauucuucauaccaaaaagugauuuaaaaauauuaauguaaagcuguaacaguaauucacagaaacccaacucucucuccaucaugacaaaaaaacagaaugaacacuaaauauucacgaauauuuacaaagcacuggcuuuuuuuuuuauuugucugacaauuaaaauuuucaaaagagguauauggguuccuauuaauacuuauugagugccgggcaggguguucuacagacaugaucucauuugaucuucacuacaacccugugaguuaaguaguaucaucaucacuuuacaagaaaaaacugagacucugagcauaauuguucaaggucaaaacgcuaguaaaugacaggauucaaauauaggucugugacuccaaaugccaugcucuuuaaggaagaauuaaaaagaaaauuacaaauaauccacaaacaaaauaaucagccacuaguggaccaaacagugggaaguauccucauacuuuaaggagguaacaguguguggauuucauaauaccuuauuuccugaguuaguuaaaaaggauuauaaagaaaaaaaguuugauucaaaaacauuuuuuaaauccucacuaaacugaaaaccauuauuauuagcucuaaaauaauguacaaauucucauccaauaggcuugaaucuuuccuuuuuaucuguuauuaacuaaacaaauauuauaaauuucuucguucaccaaaguucuaggauuuaaauuaauuuucucaaagauuuuuuuggguagauccuguggucccagaccauuuucacuccuauuuuucuauaaauauuuuuacucccuguccuacauuuuuuuuuaaacaaaaaccaauuuagauuauuucugagccuagaauacauauacuuguuccuuaaagaaucccuuaaaaauuauacaaacaagcauaaacaucaccagcauaagaaugcauuuuucaaaccauauauuuuguucuucuuuacuauacuggugcguacucauaaagaauaggggcuuaacagaaauuauauuuuagacuaggcuaauaccaaggguuaaguaggaauuaaagcaacaugcuuuuaaaaguagugugugagacacccuaagaacggcuccagccucugaacuccuguaguugcuucauaucuccgcaaauagcacaaaauuaucgugauuucccuguuauaugucuggcuaugaauucuucuauggcagggucuuucaauuccaaacagcagcacaauacuggcauaugguagaaacucaacuauuguuugaggaauuaagagaaugcaaaaauaucacaagaauuccacgacucucccaaacagcaauuuccuugcuuucagggaaauggugacacuuugguuucaauuuuuugauauaaugaauugauuaauuuacuggccauucagauuugagcaauauaccauguauagaucuucauuaaaagcaaagagaaaagucuguuuccugaaccaaaccagaaaugauucagaggaaaaugcaaauuuuaacuggaaaaaaauaauuuuuuaaauguauaaaguacuauauuacuucaagauauguguaggcaaauaugcuaagcuucuacaguuuagaggguuuuacaaaacugaaaagugaaauugagggucacaugaaccugccaugaaguaaaugucacauuucugucacugcucacuagacuugugcacuacuagaguauuuguaaacuaaaauguuauauagaaaauaaccacauauuuggucauuuacucaaacauuuaucaagugccuauuuugugccaaacauagcaguaggggcugugaauaaaaggaugaaaacgugcccuuauccuuaaagaacucuaauaagaaucuuauaaaacaaaccagaagcaaguuaccauucacccauuuauguaaacuagcaucuauuuccagugaauaccuuucuaauuuccugaacuucuuaccaaaaccaauagacagaaguccacguuaauaaacuuccucuggaaauuauuuguaaaaugggccacucugacuaaaugugcaggggaaaaaauucuuuggccaacgacuuguauuucaaguuuuaaccugaacugaauguauaaugaaaggcgaaugguccauuauggaaaugcuaacacacuuacaccaccaguggaagcaacuacaacgaugcauuuauugaaaauuaaugaaguccugaauuuuuacuuauaaaguggauauuauuaguuuuagauuauuuucugcaagccaauagucaaaauuuaauaagaugauguguacagauugcaccaauuuucacucuuauccacugccugcagccuaugugcauuuaaaccaaaaaacauuugauauacacuaacuauaaauuauuuccuuggagaucucucaggcaugaagaaaaagccucuuaaaauaaauuuaaaauauuauaugcuugaugguguauaaccgaagguuuaaucucaccacuaaaggggcaguuaccaugauuuuugcaauaacccugcagacaauaaucaagacagcuccuguuguucucucaguaaaaccuucguaagcacagcauggauauauuguaauuugauaucuguaagaucaacagcuauacuucaugacaacucauaauauaagauuuuauucaccauuaaaucgagcauuuuccucagaagccaaaggaaaguguguuauuuaccaaacaugguccuauuaacuauagauuagcacauuaaaauagauaugcucucucuuaaaaaaaaaaaaaguacagucaauaaaacaagcucugaaaaguagaaaauuagauuuuuuuuucaaacuuugggaaaacauuucugugcccuauuuccaucauuauuuuaaaguaacugauucccauuauuuuucuacuaaaauguaagaaauauccccaaaauagagcuaagucacauucaaaaaugucucagucuccaauucauaaugauauuaauauuauucuuagaaaagaaaaggcacuuagaauaaauacaagugguaacacaacgucaggaaaucagaaauguguaauucagaaaagggucaaagacaauauaaauuaguauuaaaggcauucaaaauggagacuacuagaagaauucaauuacuagucauacauacacacacacgcaaacaguaaacacauuauuugaacacaaguagguuaccccaucaguauuucagaaguguaauaaaaccaucuuucacucaccaaugcuggauucucucuuggcaguuagugaccaccugucaugaaaacagauaacuacucaugaaaaaacagagcuaugcacagagcuacaaaaaucaguguaucugaaaacuagaacauuggcuuuacagauuuaauagcaucucaguauacauuuuuauuugucaaaugcacagagaugugaacguuaguuuuuaagcagcacacuuuaucauaacccucuaaugcaggcugauaacugcagaacaaauuacagcuuucugauucauacuuugguacaaaacccgcuucauaacuauuaggugacauaugauauaagauaacuaguauuuuguacaaucuacagaccuguuuucaauauuacauauuuuguagaauacauaaauguuauaaauaacaagaaaccaauguaacauccacguuucgucaguuaaaaaaaaugacuguagugacaauauuuuauuuugucaguauaucuccaaacauuuucaccuguaauuuuuauucugacgcauuaaaaaaugaauucagugauauuuuucuacuacauuuucaagaagaaauacuugggauaaggagaugcucugaacagcucauuuguuccccagugaauuaugaucaagacuguaagcacuucacagccaguuuaaacuauguuuauaauacuaaaacaaugaauuuaaguacaaaaguuauuuguuuuccuuggagauaugucaguagauucucaaaaugcucagaaaauaagaagacuagacaauaaagaaaaaugcaauuuaaaaaaauaacacuauuuuugaaugacaauuuaagaauuaacacuguuuucaaggauugcuaauuaucuacuuuuaaauuaccuauuaauaaaaauuuuaaacagcagucuagaauaccauauaccauuuuagagacagagaaacuaggggaugaaagccaaaaugcuuaagacuaggccaugagaaaaagagagcagcauuaucugguuugcaaaacgcugcucuaguucacugcucuaaauaccaauauugucucuuguauaugcucaauguuucaccaucccgucccagcaaaaaaaaaaaaaaaaaaaaaaaaaaaauacacacgauuuuuuuuagaccugucacuaaauuccucuauuguaacauuuaauuccugaaauaaauguccucuuuugggacauuuuaaauacuaagacagaaauucuguaccaaaauacaugcuauaaucagaaacccaaccauacuacacauuaacucagcauaaaaaguccauuuuagaaugaagaucucucaguaaguaucaaucacauagcaacacuuaauaacaguggcaauauauaauagaguacugacuuuacaucuggaagagccaagcuaaaacuacaucaauccauuucacuguuucugauuuggcaguaauuacaaaauagacaaauagaauuaaauguaaauugaaaaaggaaaaaaaugcucaugaaauccuuuucauaaaguuccuauuuaacaaccccauuaaaagaugagacccaagaacagucaggauguuuuccaaucccaaugcauguguuuccaagcaugaagagagccaaaagcacagaaagcaaagcccugcaaaccauaagagcagaauguucauuaaccucuacaugauaauccuuucguagcugcauauuaacuaguuacacauucauaaucauuuacauuauuuaaaggaccuucgaggaaaucuucuaagcuauauccauuagugacgguguuaaagguuauagaagauagucuaccuaauguuuccaggaagccuuuuuaauuaguaaauaugcaaauuuggcacauaugcuuuuuauguuuaagaaacaagucacugguagaauggcauguguucuugccaucacuccccauagucuacccuccacuucguuccggccauucuugcccuguuccuuuuacuucccuuaaacagucucccuaggaagauagacgaacaacaaaauccauuucacaauguacaagagaaauuuucacuaccaaaaugcugccuuacauuuuaaagucuuuauuaguuacauauaguguguagaauaucagagacuucaaauaagcacuauccaaauguaaacuaaagaagugacauuugggaaaucagaaauaaggggaaagaugaaagagguagauauaaaaauauauagacuagccuucugauggcaugucuagguuaucuuuguuuauaugauuuaugguccaccuacuugcagaaaagauuuaagcccaagcaguucuauuauauuuagaggguuuuuuuuuuaguugucuucuauuucacagcaaguuauucaaaagaaaaaauuaguaaauuuuggucagacgcgguggcucacgccuguaaucccagcacuuugggaggcugagguggguggaucacgaggucaggagaucgagaccauccuggcuaacacagugaaaccccaucucuacuaaaaauacaaaaaaauggccgggcaugguggcaggugccuguaguccuggcuacucgggaggcugagguaggagaauggcaugaaccugggaggcagagcuugcagugagccgagaucgcgccacugcacuccagccuggacaacagaaggagacuccaucucaaaaaaaaaaaaaaaaaaaaaaaagaaaaaauuaguaaauuucuacaacuuagaaauuuuagaagguguuauaaaaacaaauauuuuucccuuaaguuaaauuauucuaaauaaucuuauuucuccugaaaggggacucagauuaauuacuuuaaguauuaaauuuuaaaaguaaccauaaggcagcgagccuuguucuacaagcaacacuugaaaaacacagcaaaagaaacaaaaacauuucauuacuuuguuguccuccacaaaaguaagaccacaauggaagaacaaaacuaguuuuuguuuauuuuuuaaaccugccaaaacaugcaaauagugccccuaaagaaaaaaaacuuauuguauuauuuucauuuuucuuaaaaauaguuacuaggcuucaacuuuaaaauaccugaacuaguaaauucuuuaacauaaugaccucguuuacacucaagaauuuauaauaaaguauguaccuacauagaaguacagcaguaaguccacaguaaagaaaaagaacuaugagcugauuuaccacuauuuaggagucuuuaccaacaacccaguggcuacaaagucauaugguauccauucuuugcaacacaaaacugucuuuaaccuaugagcaauaacaacaggaguauaugccaacacugcaugugacaaaacgaacugcaaagaguucaauggaggcgguuuaaaucuuuauuuggagaggaaaccuguauucagagaugaaguaacuuacuuaauauuacacaacuguccaggaacugguaagagaugagaccaguuuuaaaaccaagucuuucuaucagggauucuaucuaauccuaaagugcacagucccuauacuggccugcuuccaaccaucaugcggcuuacuggauaacagcagaaaaacacugguuacagcugcagucuuaaaacacugacugcuauugcuguuucuccuccacuaguuaguuccucagucccacacucacaaauaagaccuugccaaucaugucaguaaaagcaaauucuguaagcuuaaguucaccaauucacuaacauuauaauccuuauuucuuccaaugccuccuacagcuccugacccuuucagaugaaacaaguauaaacacauuucccaagcaucauuuacuaguauaucuguguauguuuaggugaagguagaaggguaaugugcuagcccuacaauuacuaucacaccucaucauauuuuuaagacacuuauaaauuaauaggguuagacaccuagaaggacaaugauggacagcccauccaaaaauauuuuucuguucauuaguguccaccuaacauacacauacauuuuguuaccaaggguuaaaauaacauuugguaacuuuuaagcuccacacauuauauggaagacaggaauaauaauuucuuagcuguuguuccucagaagcugcuuuuuaaaaauuauuuuauaaaggagagcaguaacaugcaguaagaucuccaguacuuaaaauuuucauuugugcuauuuauauuggugacagaccacaagagggcauaaaccuaugaguuucuaaggcaaguuaaauacaaugccacacuaaaacuagacuggaacagaaagccuaaaaggucaagaguacuucuucaucuuugauacuuuucucaaaaaugcuucacuucuaaaacuugucucaccauacugcaauuuuaaauucuuccuguauggguuaaugcauaauauaacaguuugggaacugugcuaaucagagcugucuaaauuuauauaguuugcuucuccugcuagacuguggcuucaagacagaucuuacuauuuugguuuuaaagcugcugagucaaaaagaaaauaguaucagugggagcugaagccaauggauacuggacauacauguuaugugacaguuacuuaaaagcugaaaauaauuucuuaaaagauagauuugucaaguagauguauaaauaucauuaccaaaguauacaaauaguguacuuucaacaaaauuuacaaaaauuacaaaucuuuuaaguaaaccccuuugcaaauaagggaggaauugacuacagguuccuaacagaaaaaaaugcaauaagcacugggauaaacuguaauaaacugaguguugcuguauaaaaaccaccauagccugagcagaguggcucacgccuguaaucuuagcacuuugaggcccaggccaguagaucacaugaugccaggaguucagaccagccuagccaacauggugaaaccccgucucuaccaaaaauacaaaaauuagccaggugugguggugcaugccuguaauuccagcuacucagguagcuugaauugcuugaaccaaggagguggagguugcagugagccgagaucacaccacugcacuccagccugggagacagacagagacccuguccccaaaaauaaauaaauaaauaaauaaaucaaccaccauaaaaguaaagaaaaccauuucaauuuuaaacaaauuauguuccaaauaugcugcaaagcaaaacugcuaaugaaagcuaaguccaauuauauggagccacuucugaaaacacuuacauguucuuauuuaaaauguuagcuaagauggaaucaaaagucuccuuaaucuuuaccuuuauguuuuagccagauuccuccuacacaggcuucuaagcauuuuuuccuguaugccaaucuagucucguuuuacacaaauaucggacuaugucuaacgugcucuggcacuauacaucucccucccuuguuggcuuuaccuacaaacugggcucuuuuuuucuuucaguaaucauuacucacuaucuuaaguauucuauuacaguuuucuccuauuggaaauauuuuaagaguggugacacauacauucaguaauacuucuaagaaugaagacguuuacauguuuggaggguuuugggggugacuugaacuagagauccaggaacucuaacuguucuggcugaaagcuccaugagguagggccauguaguaaacauaacauuugcaaugaaacauaugaauauucaaaauguaauaaaugccucacccauauaaguuccaguuuugucaacaaugaauaugccauaaacuuaagaauaacuguguuuucagugcuuuucaggcuuccgaacugcagauaagaaauugugaccuacauuucugaaucugaaauacugccugaauuccaccuugcaugcccacuguuuuaucagagauuaucaaucauuucuucuccauucacaugccuuccucguagaaacccugcccuucucccauaaagaauggguaaagaaucccauuucuccgucuguagccacaauaaagggagaggauagauaccugcugcuaacuggaccaaccucauuuacuuuggacaucagagccugaggugauuacagauucugguccuaaaagaaagaccacuauaggaucugcacaagcuaaccaaccaucuaaagcagcugguacaggaaacaacauaaauguacaagaaaacaaaacacagagacccaaaaaacuccuacccuugacucccuccugacuucuuacaguaaauuauuucauaauuuccuaagcaucuguaugauuugcaacuaagaaaacuuuagaguagcaaacuugccacacagguuaggaggagaaugugccugugaaaggcucaaaggaaacaaacaguccacugaagaguaaauacaaguagaagaaaaaaaaaaaaaaacaggaaaauauacucccagguaacaaaaaagucaaauuaaagcaaucuuauuuagcauuaauuaaagaaguacauuuuuauuuuaaacaccacuggccgggugugguggcucacaccuguaaucccagcacuuugggaggccgagacagguggaucaccuaagaucaggaguuugagaucagccuggccaagauggugaagcccuaucucuacgaaaaauacaaaaaauuggccaggcguuguggcaggcgccuguaaucccagcuacucaggaggcugaggcaggaaaaucaaacccggaaagcagagguugcagugagccaaggucacgccauugcacuccagccugggcaacgagagcaaaacuccgucucaaaaaaaaaaaaaaaaacaaaacaaaaaacaaaaacaaaagaaaccaccacugucagugagacuguaguaaaaaucucaaaucacacuaaaucacugcaaguagcuauguaaauucaaaacucagucuagacuugcguaauaccuccaaguaggacaaaaaaagcuuguaacucucagaaaguagaagagacagacagauaaauacaaaaauuaucucuuuaaaggcacccaagagcugccaaagcagugaggacaagagggaccaaggauucagagaggggagaacuguggagaagugagcugaucaucugaagccacuuuuuucucagacaacaggaggcacaggcaagaggcugagaauuauguugggcccugaggagacagccauggcuagcagaaagaaacaagcagaacuugcgcagucugacaaggcuauaugguaguaaaaugagagcacaagagaggucuuaagcauacaacugcuuucccucccaugguaucugucaaauucugagcugcgaaggccaaaaagauaaacuaaaacucugaaaagcagagcucaggaucaaacaaaaauuaguucagaagccuccaaggaaauaugguguagugagcaaaaucaagcuuccagaugaaagccugaagaaaccagaagcagcagauggcuuacuaaaacaacaaccuggccuucacuccacccagcaccugcccggaguaaggugaccagcucccacugcaucugcuucaguagaagaaaggacgcgccuuuuccagaggaaguuaucaccuucaggaauaucuacaaucuuuaaagacacaaucccaggauuuagucaaaaauaacuaggaugccaagaaacaggaucauaugaccaaaagucaaaagaaaaaauauauaaaacagaaccaaacacacaugcaaucuagauacugguguuaacaaacauaaugauuaauauguucaaggaaauagaggaaaagauaaaaggaauauauuuuaaaaauagcaauuuucacuagagaacugaaaucuacaggaagaaaccaaugaaaauuguacaacugaagaaccaaaaauuaaaauaaauggcauuaaaagaagauuaaacagcagaaaucaggauuuuugaacuugacaggucaaaagaaaacaccaaauuaaagcccagagauucaaaaauaaaacauggaaaauacagaaaagaccaauaagagacaugugaaacacaguguaagugcaagauccagaaagggaagagagaaugcagcagaagcaauauugaaaagaucuugaauucuggauuuucuaaaacugauaucaaaguaucagccgauagacugaagaaacuccaagaaucccaagcaagagaagcacaaagaaaauuucaaggcacaacauaguuaacagugaugaaaaccaaagaaaaagggaaaacuuuaugugcagcuggggguaggcggaggaggcacaggggagauucacagccuucaaaggagugacaagacuuagagcuagagcuaacuucaacaucaaugacagaaagugaaagauaacagaguaucuugaaaugcuggaaaaaauaacugaaaaucuauagugacauacacagcaaauagauccuccaacaugaaggaaaaaauaacauuuucaacagaaacagaauucugcaccagcagacuuucauuaaaagaaauacgguuuauuaaacuagacauguuguuaauaaaaugucuuaucaaaaaaauuauuaaacuagauauuguuauuaaauaagugugaucgguuaaaaaaaagacagcaacaacaacaaaaaggacucuucagaguaauauaaaugcagaaagaauugaagaguaaagguacaggauaaaaaaaaaaaaagauggguaaagauaaaucaauauugaccacacagaacaauuaaauacaguguugugguguuuaaaauacguagaauuaaaaugcaugggagcaaucaugcaagaggugggcuggauaaaugaaugaaugcuaugaucucuagagacaccagagacuuacuuagugaaaaggaauuguaaaaaaaaaaaaaaaaaaagauacuauaaauacauauuauauuuaguacuaaaccauaaguacaguauaaaaguaguaaaaaauaauguaucacaaacaaguuaauaggaggaaauaacaauacaaaauguuugauccaaaggaaggaaaaaaaaaaagcagagaaaaaagaacauaaaaguacaucaauuagaacuauaauggggaaccauuugacacuccaguaaugaggaugguccuuacagaaaacaaaaacagccaaugcaaaugccaaaaguugcccaguauguggacuggaacccuugugaauuuguccgggaauguaaaaugguacagucaccggagaaagcaguguggcaguuccuuaaaaauuaaacacagaauuaccauaugauccagaaauuccaccucugagcauacccagaagaaucgaaagcagccgggcgcaguggcacacgccuguaaucccagcacuuugggaggccgagguggguggaucacccgaggucaggaguucgagaccagccugaccaacauggugaaaccccaacucuacuaaacacaaaaaauuagccaggggugguggugcaugccuguaaucucagcuacuugggaggcugaggcaggagaaucacuugaacccaggagauagagguugcagugagccgagauugugccauugcacuccagccugggcaacaagagugaaacuccaucucaaaacaaacaacaaaaaaaaaaaaaaacaaaaaaaaaagaaucaaaagcagauacuuaaaccaaacacccauguucacagcagcauuacucaaaaucaccauaagguagaggcaacccaaguauccauggaugcuaaaauaaacaaaaacguauaauacacugcauaauacauucuauaauacaauggaauauuauucagccuuaaaaaggaagaaauucugauaugugccacaacguggacgaaccuugagacauuaugguaagugaaauaacccaaucacaaaaggacaaauacucuaugauuccacuuaaagguacuuagaguaaucaaauucauagagacaaaaaguauaauagaaugcuggcagccagaucaggaaggggaagaauagagaguuauuguuuaaugaacagaguuucaguuuugcaagauuuaaaaaaaaaaaaaaaaaaaggccuggagauggaugguaauuacgguugaucaacaacgugaauauacccaaugccacugaacuguauacuuaaaaaugauuaaaaugggcuggucaugguagcucaugccuauuucccagcacuuugagaggccaaggcaggacgaccgcuugaggccaggaguucgagaccacccugggcaacauagugagucccugucuauacaaaaaaaaaaauuuuuuuuuuuaauuagcuaggcccaauggcaugcaccuguagucccagcuacucaggagacucaggcaggaucacuugagcucaggaguucaagguugcagugagcuaugaccauaccacugcacuccagccugggugacaaagcaagacacagucucuuaaaauaaaauuauuaaaaugguaaauuuuguuauauuuacuacaauuuuuugaauaaaaaauaaauacaauguacgucuaauagaaaggugauaaaauuaaauauaucaggaauccuacuacauauaauggcuuaaaauacucuaaauaaaaggaaaagauaucuagacugaauauuaaaaccacaacaauaugcuguuuauaagacacacuucgaacccaaaagacugaaguuaagaagauuuuuuuuaaagauagacaaaacaaacaaauuuagcuggugugaccauacuaauacuaauauccaacaaaggagacuugaaggcaaguagcauuacuagagauaaaaauaucucagaauggugaaaaggucaacugaccaggaaguuuuuacaauuuuaaauuuguauacaaugaauaacauagcuguaaaauauauaaagcaaagguuaaaaaaagagagaaaaauaaaucuauaauccuagugacuauuuuaauacauaucucaauaaaugauagaauuagcagacaaaaaaauuaacaaggacauaaaauacuggaacaacauauucaagcagccugaacuaacagacacauacugaacccaaaaacugcaggauuaacauuuuuuuccaaguaaauuaugaaaaauuuaccaagaaaaagaaaacauuaggucaaaaggcaagacuuaaauuucaauuaugcagaauguguacucugaccacacuagagaaacagaaaaauaaguagaaaauaauguuugaaaaggaauguauuuccaauuuaugggucaaugagcaaaucacaauagaaauuagaaacuauuuuuaaaugacugauaaggaaaaugacauacaaaaugugugcaguaccuaaggcaaugauuaagagaaaaauuuaaagcucaaaaugcauaucuuauaauaaggaaagguuaauauuaguaaccucaaccaucaucucuaagggcuagaaaaauuacaggcaaaggaaaaucuuaaacaggaaaaaagagagaagaaaucaguaaaguagaaagcagacuuagaaaagaggaaaaaaaucaaaggcaaaaauauaaaauauaaaauugauaaacccuuaagaagagaaaucaagggaggaaaaaacccacaaauuaaaaauuacaguaauuaaaaagaggacaucaccaccaaaucuacugauaauaaaaagauaacaggauauuaugauaacucggagggacaacaagcuugaaaacuuagaaaggacaauuccuugaaaaucacauuuucuaaaaugauauaacuagaaacagaaaaucuggauagucuuugaacuuucaaagaaauugaggucguaucuuaaaaucuccauacaaaauguccaagaaaaauauugggcccagacggcuuuguugaugaacucuuccaaacauuuaaguuagaaacaguacgagccaggcacaguggcugacuagccuguaguccaucauuuugggaagccaaggcagauggauagcuugaucccagaaguucaagaccagccugggcaacauagugagacucugucucuacaaaaaauacagaaaaauuagccaggcaugguggcgcauuccuauagccccagcuacucggggagacugaggcgagaggaucaccugagccugggaguuccaggaugcaaugagccaggauuggccacugcacuccagccuggaugagagcgagauucuguuucaaaaaaacaaaaacaaaacacacacacaaaaaccaauaacaacaguguauaaacuuuuauaggauauacaaaaaugggaguuguuucaugagaccagccuaauucugaagccaaauccuuacgucgacauuacaagaaaagaaaaucauagguuuaagguaguguuaauguuuuuuguuguuuuuuuuuugagacggagucucacuugcccaggcuggagugcaguggcgugaucucaacucacugcaaccuccaccucccggguucaagcaauucucaugccucaaccuuccgaguagcugggauuacaggcccccgccaccacacccagcuuauuuuuguauuuuuuguagagaugggguuucaccauguuggccaggcugaucucaaaccccugaccucacgugauccgcccaccucagcuucccaaagugcugggauuacaggugugagccgcagcacccugguagaguuaaucaaaaaaaaagaaaaaagaaaagaaaagaaagaauuacagaauuuugccucauguaacagaacaaaauaccuuaauaaaauauuaucaaauuuaaucuagcaauauacaacaagguaaacacauccucuacaaauggguuugcugcaggaaugcaauggcauuugaauauuuuuaaagaaucaaaguaauuuaccauauuguuaucucaagaaacauagaaaauacauuugauaaaauucagcauccauuaaugauaaaauuagcaacaggagaaaauguccuuauuuucauaacgaguagcuacaaaaagccaacuacgaacaucuguauggugaaauacuuaaaacugcccuccugguauguaaagcccaauguccuaacuuuuauuuuacauuauauuaaagguucuagcccauacaauagggcaaaaaacaaaacaaaacaaacaaccauaaaaaaaaacuuaagaacuggaaugaauaaaacugucaguauuuacaaacaacaugccuguauguaacuacacagauacuaucagaauguacaggcaaguaauuagaauucaaauaaauuuaggccaggcaugguggcucacacuuguuguggucccagcacuuugggaagcagaggcggguggaucacuugaggccuggaguuggagacuagucuggccaacacagcaaacucaucucuauuuuuuaacaacaacaaaaaauuuuagaacaaagucaauauguaaaaaucaaguauguuaccagcaaaaaaaaaaaaaaaaaugaauagcaaguaaauuacaaaaggcaacaaaaaauaguaucuagaaauaaaucuaacacaugaagauuuauauacuuuuaaaagcuaauacuaaaaaguuauagaaguaaauaaauugauauaccauguucauagauuuuaaaacuuaauauuguaaacaucuuaauucuccucaaaccgaucuuuagauccagugcacuccaagcaaaaccccaguaauguuauuuuuugaguauuggaaaggugauccuaaaauauauacaaaaaagcaaagggucagaauaguaaagacaaucuugaagaacaaagugcuagaggaauuuuacuacuagauaucaagaccuauuauaaagcuaaaauaguaagagugugauacuggugcaauuacaggcaaauaauccaauggaacagaauagagaaacagagcuacacacaaauaaucacauaauuuaugaaacagacaacauacuccauaaggauuacucuggcugcuaaaagaaagcuuaacccccuccagaaucccuagaauuuuuuguuacaauaucuggcauccaguucaaaauuacaagguacaaggcaaucuauaaaaacaaaagcggcuauaaagaaaccaaggggaaggaauaaaagcagaccuucauuugauugacauauugcauuuauaaaauauaauagacuuuaugauuaauacauucaugaaaacagaagaaaaguugcagaugucaacagaaacuuggaauccauuuuaaaauuucaaaacauaaauuguauuucuuuuacgguuuuccugcugauaaauccaaaagaauuauaagcaggaaaaugacaaaaugacaucauccaauuugcauucuuaaaaagacuacucugggccacuuuuuuuugcugcguuuacugugagaaugaagaccauucucagcaaucagacuguugacauuccagaaaaugucaacguuacucugaagggacgcacaguuaucauaaagggccccagaggaacccugcggaaggacuucaaucacaucaacguagaacucagacuccuuggaaagaaaaaaaagaggcuccggguugacaaauggucggguaacagaaaggaacuggcuaccguucggacuauuuguagucauguacagaacaugaucaaggguguuacacugggcuuccauuacaagaugaggucuguguaugcucacuucccccaucaacgucguuauccagaaugggucucuuguugaaauccgaaauuucuugggugaaaaauacauccgcaggguucagaugagaccagguguugccuguucaguaccucaagcccagaaagaugaauuaauccuugaaggaaaugacacugagcuuguuucaaauucagcagcuuugauucagcaacccacaacaguuaaaaacaaggauaucaggaaauuuuuggaugguaucuaugucucugaaaaaggaacuguucagcagguugaugaaucagaucuaagaguuauccagcuacagaaagaagaugccagaugacuccuaagacauacuugugauauuucaaugaugcaauaaaagaccuauugauuuggaccuucuuaaaaaaaaaaaaaaaaaaaagacuacucugggccaggcgccguggcucaugccuguaaaauuuugggaggccgaagacagguggaucaccugaggucaggaguuugagaccagacugaccaacauggcgcucaucucuacuaaaaauacaaaaauuagcugggugugguggcgggcaccuguaaucccagcaacaugggaggcugaggcaggagaaucgcuugaacccaggauguggagguugcaaugagccaagaccacuccauugcacuccagccugggcaacaagagcgaaacuccaucucaaaaaauaaaaaaaaaaaaagacuacucugggaaauagacagaagaggaacaaaguggaacuaccaaggccagccaggaauuacugccucuuuuguaagaaaugauaacugggccaggcacgguggcucacgccuguaaucccagcacuuuggggggccaaggagggcacaucaccugaggucaggaguuugagaccugccuggucaacauggugaaauccugucucaacuaaaaauauaaaaauuagcugggcacgguggugggugccuguuaaucccagcuacuugggaggcugaggcaggagaaucacuugaacccaggaagaaagaaaaaaaaaaagaaaagaaaaaaaugguaacugggaaaauggcaaugaagaucacaggaaacagccaauucaaggaauuccuaguuuucagauauaauauucuucuauuucucuuauguauuuuuauuucacauuauaaauuaaauuaaacauaauaguucauugagagggugguuauaaauauggauaaagcuaaacaaauuuacccuuugacucaguaauccaacucuaggacuuuacccaaaguuacuucacaaaugagaaacaacauaugcauaaagugauuuacugaggcauuaucuauacuaucaagagacuaaaaaacaccaaaugcccaucaauaagauaucagcugaauaucugaugacacagacauaaagcacuaugcaaccacaaaauaugauaaggaggccgggcacgguggcucacgccuguaaucucagcacuuugggaggccgaggcaggcggaucacgaggucaggagaucgagaccauccuggcuaacacagugaaaccccgucucuacuaaaaaauuaaaaaaaaaaaaaaaauuagcuuggcugaggcaggagaauagcaugaacccgggaggcggagccgagaaugcaccgcugcacuccagccugagcaacagagcgagacuccaucuccaaaaaaauaaaaaaaaaaugaugaggaauaucucuaugaaccagaguaauucccagguuuaucauuuaaugagaugaacaaaaggcaaaauaagcugccuuuuguauaagaaagcaguauggaggggagauaaagugaacacauguauuuuugaagaagaaacagaggaaggacaggucaaaagugaauguaaaugguuaucuaggccggcuguggugguucacaccuguaauccuagcacuuugggaggcugaggcgggcagaucaccugaggucaggaguuugaaaccacccuggcgaacauggucaaacuccauuucuacuaaaaauauuuuuuaaauuagccgggcaugguggugggcgccuguaauuccaguuacuugggaggcugaggcaggagaauugcuugaaccugggauguggagguugcagugagccgagauugcgccacugcacuccagccugggcaacaagagugaaacucugucucaaaaaaaaaaaaaaaaaaaaguuuaucuguagggguaaguaagagcaggaaugggaaugaaucagaauuaccucaguagggauaacuuuugauuuaguugugauuuugaaccaugcaaauguuuucauguauucauaaaaugcaauuaagugaaaaagauaaaaaacaaauacuaagauucaauauaaauaaaaauccaagguauaacugcacagaaaaaaaguaauucaagugacuuuugggaucaguacccuaacuguacaccccaaaagcauuaauuacacaaaagccaaugaaacugcaaagacauuuugaacuuuacuucagguuugccauuggcagugguauuaaugcaguaauucugaagcuauuuuguauauauuguaggauagagcaaaugaauaaaugcagauguugagaaccaagguuuucacuaugaaagaaggggaguuucaaauauagacuggggaaaauuuaagaagaaccuugugguaauggauuugaauucaaaguaucaggguauacagucaggguccauugaacccaguuuuauuuuuuuaguuucuuucuugaguaguucuaacuauuugcaaggauuaauauuucaugccuuuuaucuucucuuagaggccuuccaaggaaucaaaagaaaauuuuccuauuaagaaaaaaaaaacucauuuuauucugcaauuaccauaugaauacaguggcuuuguaagucuaagauacacuacaggauccuagugauuauguuuuuccugcaucuugccauuucaucaucaccuuaguaauuauuuuaugaucaacuauuccuaacuacgcucuaaaaaaaaaaaacuaauaagaaaaugagaaaauggaagaauuauggaaucacucagaaggauaaugcaaucaacagcaaaauaucauccuuccauugucuacugcauugccuaggauauugcaucaucuuucaagacaguauaaaugauaacagacaccaucuuuguacucugcuuuucgcuuucaauaaacacaguugagaauucagauuguuuuuacuuucugccuauaauggaaagaggaaaaaagugauggaaagauacuucacaauuauuaaaugaaucagauuaugaauauaaagagcuaguagcacucuugaccaaugaaguccaauaaauuuuuuuuuugaugaagggaaucuucaucagcacagaccaauacaacagucaauagccaaaugugacuaaugagcacuugagauguggccauuguaaccaaaaaacugaauuuuuauuuuacuuaauuuuaauuaauuugaauuuugaauuuaaguauaauagccacaugugguuaauggcuaccacauugguuagcgcagaaagacacucgugauggugaaaugagagcauaaauuaaaucucagauuaugagccuucagaugaaaauauccuagaugaauuuucucaaaaucaacaaucaaugaauauacagaaauuaacucaaaacggaucaaugaccuaaauauaagcgcuaaaaucaugaaaucccuagaaggaaacauagguauaaaucuucaagaccuuggaucuggcaauggauucuuagauaugacaccaaaaaacacaagcaacaaaauguauagucauaaaugacuugggguuugggggaggggagaaugacagcguuauugcuuaauggguagagaguuucuguuuggggugacgaaaaaguuuuagaaagaauagugaugguuaccuaacagugaauguaaucaaugucacugaaaaguauacacacaagaaauguuaaauggcagauuuuauuaaauauauuuaguuuaccauaauaaaacaagauugcuagaauaaaagaucucuaaacucuauuuccucuucuacuccuguaaguuuuuuaaauucuugaggucagaggcuaggagaaaaaaacccugaagacaccagaaauagguucuuaaagcaggcauucuguaaugguuuaucuuuguauuguuuuaaguccuagaagaaaccaugccaauggaggaagaaaacuacaugcaucugaacuuagugaauguuaaaaaagaguugacugauuagaauaaggaaaaauuaagaauccgugagugaacacuauacuuguaagaacaaaaaggaaauaggauauucccauccagucagucauucaacaggaaagacuucaugaugcaagaaccuggauaaucucauuguucuaagaggacauguggcaguauucuuaaaucucuuauaaucuuugugcaucaagauuugcuuaauauaaagagaacugcuguguuuaaauucugauuaaacuuuccaauaaaauuguuuuucacuaacccuuauucuuagaccuguaaauuauuugcaaaaauuacuuaaaaauauaaacaguaaacaggauccacuggaccuagaugguaaauggugaugacugcuuuuucugguauauugaagguuaauauauuuccuuaguacugucugcuugaugcaauuaacaccccagcagcaaucagcacuacuuguguccauaucuugguuucuaagcauuucuuauuuuauaaggcucuuggaagaaacagucaauuucaggacuaaggcaaacuacagggcaagccuggaacauccugugccagaaagcaagguaacgaucaaauaaugaaaaaagaaugcacaagccaggcacgguggcucacgccuguaaucccagcacuuugggaggccaaggcagguggaucaccugaggucaggagaucgagaccagccuggccaacauggugaaaccucgucucuacuaaaaauacaaaaaaguagcugggcgugguggcagaggccuguaaucccagcuacuugggaggcugaggcaggagagucacucgaacccaggaggcggagguugcagugagccaagaucgugccaccgcacuccagccuaggcaacaagaaacucugucucaaaaaaaaaaaaaaagaaugcaugcuugagccagcuugaaggggcucccauuggccaaauuuagaacaauuugaacaucaaaaggaaugaagaaaucacaucacucucaacuugaaacaacaaaaaaaugaguuuauugugaaacuaaaggggggggugcuagaguucuuguugcucgaaaaacauaaacuaauaaauacauuguuagaaaaucacuaauuagcaaacaccaauauaacugauuuaggcaaggaucauccauggcaaaaggcuuuugaggaauaggauauuuacacugucuucaaguacuauaccauuuaaagguaacuuuaugauggagagacuugacaucuuaaacaagugguuagcaacacuaauaaugggacaaaaaugacauuaugugucuccugaugugaugcaauggaaagucaucaucaucuauguaaucacgcguguauguguguguguguuuuuagagacaggaccuuaccacuuuguugcccaggcuggacuccaccuccugccucagccuucggagcuuuuggaguaacugggacuauaggcuugugccaccaaccagcuaucuacguaguauucuugccaaaaauguuuguuucuucaugauuauguucauuagacaucuccaaauugugggacguucuacaagaaaacugaucuaacgcuucaaaaaugccaauuucauaaagacagaagguggcggggaauaauuuuagaugaaagaagauuaaggagcuaagagagucaaaugccauaguaaucucugauuggcucuugcauugaaagagaguuauaaaggacauuuuuagaaaaacugagaaaaugugaauaugguacaugucaauguuaauuucuugaguguaaaaaaagauaugguuauguagaagaaugaccuugauguaaaaugauaagugcuucaguauuauugaugugaugaugucugcaauucacuuuugaaugguucugcagggggaaaagggaaaaaaaaggaauauauaaagagaaaagcaaauaggacaaaaugcuaacugauuacucuaaacaguggucaucauauuguucuuucaccuuuccuguacuuuuauaauuuuucaaauaaacaguuguaguuuaaggggggaaaauugcauaugacagacuaaaaagauugagacaucacucuggagauaagggcaagugauacaagcuaaaagguucuuaaacuaaaaaugauaacaacagguaaaacaaaauaaagcaguuauggccaaaucacagauuccacgcaccuucuucccccuuuccccccaguguuuugggaccauuaccaucuuuucuuccaaucuagagaagccuaaaacaaugaaauggguuuuuuccuccuugaaauacuguuuuauguuuauugacaacuuccaaagaacuaaaaccaaaguugucucuucuuauggcacauuacuggcacaauacuaagugccaacaacaagaaguuuaucuaaaauaaaacuuacaaguaaugaguucugaaaacucaccuaccuacaaaacggaaugugccuucggcuauacaagcaaacauauucuuacaacugugccuuucuuaaaaaauaaguaaccucucccucccccucccccucccgucuccccacagucucccucucccucugucuccauggucucccucugaugccaagccgaagcuggacuguacugccgccaucucggcucacugcaaccucccugccugauucuccugccucagccugcagagugccugggauugcaggcgcgcgccgccacgccugagugguuuucguauuuuuuugguggagacaggguuucgcuguguuggccgggcuggucuccagcuccuaaccgcgagugaucugccagccuuggccccccgacgugccgggauugcagacggagucucguucacucagugcucaauguugcccaggcuggagugcaguggcgugaucucggcuggcuacaaccuccaccucccagccgccugccuugaccucccaaagugccgagauugcagccucugcccagccaccaccccgucugggaagugaggagugucucugccuggccgcccaucgucugggaugugaggagccccucugcccggcugcccagucugggaaguggggagcgccucuucccggccgccaucccgucuaggaagugaggagcgucucugcccagccgcccaucgucugagauguggggagcaccuccgccccgccgccccgucugggauguggggagcgccucugcccggccacgaccccgucugggagaugaggagcgucucugcccggccgccccgucugaaaagugaggagccccuccgcccggcagccgccccaucugggaagucaggagcccccucugccccacagccgccccaucugggaggugaggagccccuccgcccggcagcugccccgucugggaagugaggagcgucuccgcccggcagaagccccguccgggaggcggggggcagcccccgcccggccagcugccccguccgggagggaggcggggggcagcccccgccuggccagccgccccguccgggagguggggggcgccuccgcccggccgcggucccgucugggagguggggggugccucugcccggccgccccuucugggaagugaggacucccucugccuggccgccaccccguguggcagguguacccaacagcucacugagaacaggccaugaugacgauggcgguuuugucgaauagaaaagggggaaauguggggaaaagauaaaggaaucggauuguugcugucuguguggaaagaaguagacauaggagacuacauuuuguucuguacuaagaaaaauucuucugccuugggaugcuguuaaucuauaaccuuacccccagccccgugcucucugaaacaugugcuguguccacucaggguuaaauggauuaaggguggugcaagaugugcuuuguuaaacagaugcuugaaggcaaaaaaaaguaacuucaacauuacuuauugaaguuacagaacuuacagaacaaauauacucuuuucaauaaauuaccauaauuaaaucaauuuagaaaaagcauuucuaaaauucaacacccacucauaaaaacucauagcaaacuuggaauauaaggaaauuuccuuaaucugauaaaagcaaauacaaaaauuacucacaguaaauaccacacuuaaugguaaauguuuaaaaguugaccccugaugcccacuaccagcacuugaacuggccaguaucaaaagcaagaaaaagaaagaaacagcauacggacuggaaaggagaaaauaaaggcaaucuugaggaaccacaacuaaaacuacaccaccauguaccagguaccaagauaacacaaagucauaaugauuuagacaguguagguuugcugcaagaacagacaagccaacagaacagucaagaaacugaucuacuuacacagucaccugauuuaugacaaagaugacaaugcgguggagacaugacacucuuuccaauaaaugcugaugggacaacuagguauccauacaguaaaaaugaaaccugaccucaaucucccccauauacaaagccaauuccagguagaauguagauucucaaugugaaaagcaaagcaguaaagcuucuauuagacaauauaagaggauaucuucagaaaaguaguaagaaagaccucuuaaaaauaagacaaaaaacacuaaccaugaaggaaacaauuguuaaaauuaaaaaugucuguugaucaaaggacagacaccacuguaagugcuccaagucaagccacagaccagggaagaaacuuacaauauauaauuggaaaggcagucauuacuaugaaucaauuagaauauaacuaacaucccaauagaaaguaguuaacagaugagcagguauuucacaaaaacaaaacacaaaaauccaaguagccaauaaacaucugaaaaggucaucaaccucauuacucaucacuagauuggcuagcaaauaugaaaagacacauggugguaaagacugaagcagggagaacuucuguccacugcuagcaagcgguaaacugguauaaccaccuuagaaaaagcauucuaaguggaacugaagacacaaacacgccaugagaaaguuccaggcaaaaacuagaaacaaacuguucaucugaaaaauaaacaguauuaaugaaaauucuaagaucggaucuguaaacaucuaucacaaugcguggcacacagaguugcucccuauaauguaauuccauccguccauuucuucacauaugcaugacaaauggauauaauuuaagaucagccucaaaacacauuccaaucguuucccaucucacaaauaugaaaaccaaaacucuuacaaugaucugguacugcucucauacuggcuagaaagcucuucucuaaaauauccuccauauauccacacagcucacuccccacuuauuucaaguuucugcucaaauggaaccuaacagagaagcccucucugauggcuuacagaagacaccaucccuccacucacaucccucauucucuacacgccucuuaccuuccuguuuuucuacuuagccuuaccuaccaaacacccaagguaaggcuauguaacugcaugccuucaccccuagaguguaaccaugaaagaaagaacuugcuguauuuuguucauuacugcacacucagcagaacaugccuggcauguaguagauacucauuaaauauuuguuacauaaauucuauggcauggauucuaggcuuggaaagaauagcuguuauauggccuacguggcugacaguucuuuaaacuaugugcaguuuaguuuaucacaagaaauaugaaaacccuccauuaaguuaaauuagcuguucugcuuuauaaaaaauuuaaaauauuuacucuuaaugcauuuaauuccccaaggaucuauaucaggaaguauaagcuauuccaaaauuccaagugagaacuacaugaggcacucaauuauaaauauauuauccuaaugaauuuucuaaucuuacuauuauccugcaaauaagccuauaaaaacgauacuggauccaccacuuuuuaaaauauuacaauaaaaucucaguaguucugcuaauaaaagcuaauaguaucuagagauaaaauacagguaucucagaaacaucaccuuagccaagaaacaaaaauuucaacauaaugcaauucuuagaaucagauuuaacaagaucuuaguacaaggaaaccucccugaacagcccaagacacuccacaacaguccuagaccacacauuuuaugguauaggucacagucuagacagguuaagcuuccauuuuuccaacaaauauuuuacugcuguuaguaaaaacagauuuaguuaaagacaaaaaaaggaugaucugaauuucucuccucucccuguaucuuauaacaaaugaagauuaaauaaaaccuuugggggggggaaggaaaucaacuggaagaugguuguuugaauaaauuauauauaucagcucugaaguaaccaagaaauaaaccugccuaaccggcauucaaaccagccaagagccauuuuucaggcucagaaaguguuuugcaauuaaaguaacauuccaauuuucguuaaaauuaaaauaaguuuuaucaauagcuuuuuuuggaaaaaaaaaaaucccauccaauuuuacaaacuuuuagguaaaauaauaaaauuguguacuuuuaaaacaaugguguuuuccuauguaaaauguguaaauauuuauauaaacguaacuggaaccacccuauacauacuguccuaguuuucaaugccuacguaacagcuccugauuuauuuaaccaaucccccaaugucagacuuuuaguuuuucucuuuauaaacaaagcugcagggaauguuucuuacauguuuuauugcuagaucaaaauagaaacaaaccgaaguucuaacuaaaauaaauuguuuuggaaauguuucaccauugacuguaagugaaagcaauguuaaaauauuugauccuaaccgcugacuacagauauugucacuuagagguuguggcuuguucaugccccuugucuguccucuuccucagguugccaauuuuuuguccuuuuuauuccauguuccagagaacauacaagaaaaaaagagagagagagcguaaaacuuguuauacuccuuagcugaauuuggaaaaaaagaaagagcaaaacuaaugagcaacauuuaagccacauuaccuaccagccccucucaaucaaggcucccagagaagauuaugcccuaagccuaaggcacccacuguguguaaggaacucauuucucucucugcaucuacagccaacuagguagguacccucucagggaaaacugagaacagucauucaaaucauuuucugcagaguuuaacucugucucacaaaacccauguagggaaaggccaagagcuuaaaagcauguuugauucaucuuucauaaaggaauacuaagugccacauaugaagcuacuaugacauuuuccccuucuacacucaggaugucacuacgcuucuacuuuacuagaacucacuguacucccacaacugggccagcuuuaaagccuaaauaaauugcuucacaaaaaauuuucacugccgauuuacuggguaguuuuccuguacuacacuauaauuacagugcagcuaucuaaucaguuuauuuuguggccuugugggucuccuguccacugaagcaaaugcuucuauuaaauaaagauagauuaaauacugacgcgcuuuuuccugaacuggggauaauuuuacacacccaugacagauauacgugguuauuuugugugccgaauuaacauuaacacaacacagaaaaauaauuugguagcacagucaaugucuacagaaaacagucauucaguuugccacaagacuguaacugaaaaagcaguuacucucucuuccaauguaacucaacacgauaccagaaagcuguucagagcaccccaaaaaguauccuuugcauuucagucacacuaacaucagaauaaaacuaaggauaucuuuuuaauaugccaaauggcagaaaacauaucaagucagcauuaugcacguauuauacacugaaggaggugaaauuaacccacugcagcagaggaaaggcaauagaaacaccauccucugagggucugugucacauucucugaaagaauaaaaaaugccaaguuuuggcaaaaggaguaagauuucaugaggggcuguuuuuucuuucuucuuuuucuaucuuucucuuuuaaaaaaauacauuaaugucuucuaauuuaaagacgccaaacuaguuaaguuuuauauauauauauauauauauauauauauauauauauauauauauauauauaugaaugacagggucucacucugucgcccagggugaagugcaguugcaugaccauggcccacugcagccucaaacgccugagcucaagugauccucucaccucagccucccaaguacgugggacuacaagcgugcaccaccauggcccggcuaauuuuuuguauuuuuuuguauagacggaggucucccuguguugcccaggcugaucucgaacuccuuggcuucaagcaauuccacgaccuugacaucccaagcagcugggauuacagguuugagucaccacccuagccacuggauuuuuaaaccuucaucuugaaaacauggcuuccaaaccuaacaguugcguuauuagagaaaaauggcugagaaaugaaaauccaacccacaaaauaauuuaaaccaaccagaacaaagaaagauucccgcaguucaucccaacaggugguuuccaagcaaacgaggguuuuuuaaguucuaucaaaacccccaucuaguagaacugaguauauuuuuguaucuauguaaacagucguucuuauacaggaauguucaauuaaaaaguuaagaacuuuuaaacugcuuauaguguugaagcaacuuccuaacccuuuauaauccaugcucuuccaaacaugacauaaaauauuuuaagcaaauuaaauacugcuuuucaaaguaacaauuucaagacacuugaggggacagaaucaaucugaaagaccacagaauccacagaaaaaucagauuuaacaauaaaacuauuucuuaaauugggaauacuucuuuauauaaagucccacuaggaaacacaaaacuuuguacccuuuucaccaguaguuuaaaacucauuuauuauacgaugaaauuaaaauuuguaaaaaugagccgggugcggugacucaggccuauaaucccaacacuuugggaggcgagguggggaaggguaggagggggaggaucgcuugaggccagaaguucgagauuagccugggcaacauagugagacucucuuuuuuuuuuaauguuuaaauggcauuauauugugacaaauauuaaauaaccaaauauugcacaggaagcauuaucaugacaaacgcgguaaaacuuuuccgugcaaucaaagagcaacaaacaguacacauuuuaagcaauguuuaggucauuacaagcuacaaauauuaaggcgaacgcuuccguugacagcgugcugcccccgcccccaaauucccacgcgcugccgcacgccuucagcucagaagcccccuuuccugggcaggcgaacgggcugcacaccccucacuccgcugcgaagucaaagggcugcagacaaagacaacagaagcacgugacaaaaguuuauccccguucccuccgggggcccgggcagcugggccuaggccacgcggggcggcggcccagagcacaggcaggggcagcccggcgggcggaggcggaagcggcgcggggcugcuaguuaccuuuuccugcuccucgcgcagccgcgccacauccggggcgcgcaacggaaccagggcaggggccggggccgaagggggcgaggggucggggggcgucuccacggugggcgccuccaugacgggcccgcgggccucagcgcggcgugugaguccugaaccagcgccugcgcaggcggcgcggccggcaguugcccagcgcccgcgcgcccgcccucaggcaccgcgcgccccgcgcccaggaggccgcgcccgccgccgccgcugcuguucgcguccgcgccgcccgcugccgcaucucacacgugcauguccccgccgccgccgccccgcagcgggcuccgaguagcaggccgccugccagguaccgagacgccucuccggugcgggcccagccaggcgucgcguggcggccgcgccuccccacacgccccgccucucgcggcacgccggaagcaagcgcgcaggccccgcccccgacacgcccagcucgcgcaggccccgcccccaggggagugcgcuugaugcgaaccgcguggcuggggcuggcgguguccgcgcugggcugcguuuguaucccucuggaagcuuacauuuuaugccgauauuucuuucuuuuuuuuuuuuugagauuacguauaugaaagcacuaaauauaggcuuuggaaccuuaaaaaaaaaaagcuuacauucuauagaagcuccacgcccaggaaacgcucggcaacaagagccgcgugucgccuugagugccccaucucccuccccgucguuuggcgcugcaucuguaucuaggagcuuaauucauguacuagagcuguuucauaagcacauuuaauuuuagcaaauucaacucuuucugugccuuuuuagugaguugaaauauacaauuauauuuugcauguucauuaauuacuguacacauuguauuuucucuuauauaaauuaagcuacuguacuaauuuuaauaugcugcuaugaauggacuaagaaauuuuccaaggauaacuuugcccccacuuuucuuuuuuuuuuuuuuuuuuuuaagagacugagucuuggucugucgcccgggcuggagugcaguagugccaucauuucucacugcagccucaaacuccuagacucaagcgaucuucccaccucagccucaggaguagcugggaccacuggcccgcaccaacacauccuguuaauuuuucuauuuuuuguagaggcggggucucccuauguugcccaggcuggucuugacauuaagcgagccuccugucuuagcuaaccuccugucuuggauucccugaagugcuaggauuacaggugugagcuaccacaccuggccguuccaauuauuuuagaacuccugugcccacuuccuccuacagcccuuuguacagccuccuauuaaccuaacugcgugaaaguggccuugccuuaucugcugcagucgcuagcaguaaagaugggucguguucguuccacaucauacagacaagucuaggcagagagaugccugcagagucacagccuggugugccugcuugcucugcuucucuucccucacuccugcccagcucccaaguccagauccacccuuuuuuuccuuuuuauggcuucaaaggaagaaagcaaggacaacuugggaaaagauaaauguucauuccugucuuuuccucacugcauauccaaccaucaucaccucuggaacagccaggaccugaccauuguuaccaucucuucuaccaccaccauccucucuccauccccagccaccucagcaaccauugaucuggccuugcugccccuacucuugucccuuguaauggagaucggcugcugcccaccccacuuccccucguuuaggggcuuaacccgcgaccacauaguccugugccuguaggaagcugacccacccccuagcuccaggcaaagggggugaugcaucucccuucuaaauaguugguucaagaaugggugugcgaugucguccaaacagagacuuccuggaggcuucugggaagguucuuuuuuuuuuccucuguugcccaggcuggagugcaauggugccaucuuggcucacugcacccucugccucuuggguucaagcgauucuccugccucagccuccugaguagcugggacuacaggcgcgugccaccacaccuggcuaauuuuuguauuuuuaguagaaacaggguuucaccauguuggccaggcuggucucaaacuccuggccucaagugauccacccgccuuggccuccuaaagugcugggauuacaggcaagagccaccacgccucuccugagaagguucuuccucauucuucaaaagugcucccauaaggaaucagucuauccccuuggccaggaagugcaaagcagguagccccauguguaucagacagccccccagaccaccuagacacuccaguacucagaaugaagugcgaucuguggucagcagagcugagaacagaacccaauccuugacagcaucacagaacuugauccagggcugaaucaaccagcucuggagucugcaucacuucugaacuucccguuuaaaaggccaguaaauuuucuaaaugaccaggacaauuuucuaucaugagcagccaaagacauccaauucgcacaccucuaaacuauuauccacucagcagucugggugagcuuuucaaaggggaucaggucaugucagucucccuucuagggcccuccauggcuucccacagcaaccagaaucaaauccagacauccuacuagaauucagcauugucggacccaccuuccccaccuccaaccaagcccccuaccacucaagccaaccacaacaauuucucucuucuucagauacuccagacuaguuccugccucagggccuuugcaccugcugaucucucugccugcaauauuucucccauaucuuuccaugguugccuccuugccauuacucaggccucaguucaaauaauaacagggcuuucuugaucuccuguccacaaaagccccuccccucuccucuaggcaucugcccucaccucacuuuuuaaauuuucuuuguagcacuuaucacacuuucaaaugaucagcuuuggccgggcgcaguggcucaugccuguaaucccagcacuuugggagguggaggcaggcggaucauuugaggucaggaguuugagaccagccuggccaacaugaugaaaccccaucucuacuaaaaauacaaaaauuagccgccgugguggcacacaccuguaaucccagcuacucgggaggcugagguaggagaaucgcuugaaccugggaggcagagguugcagugagcagagaucaugccacugcacuccugccugggcaacagaaugacacuucgucuaaaaaaaaaaaaaaauuggcaaggcgcaguggcucacgccuguaaucccagcacuuugggaggccaaggcaggcaaaucaccucaggucgggaguucaagaccagccugaccaacauggauaaaccccaccucuacuaaaaauacaaaauuagccaggugugguggugcaugccuguaaucccagcuacuggggaggcugaggcaggagaaucacuugaacccuggaaguggagguugcagugagccgagaucaugccauugcaccccagccugggcaacaagagugaaacuccucucagaaaaaaaaaaaaaugguaggccaggcacaguggcucaugucuguaaucccagcacuuugggaggcugaggugggcagauccugaggucaggagaucgagaucauccuggcuaacauggugaaaccccaucucuacuaaaaacacaaaaaauuagccaggugugguggcagucaccuguagucccagcuacucaggaggcugaggcaggagaauggcaugaacccgggaggcagagcuugcagugagccgagauggugccacugcacuccagccugggugacagagugagacucugucucaaaaaaaaaaaguaaauauuauuuuauuaccuuauuacuuuauuacuuauuauugguuaaucccuucuucaugugccaggccccccacugggaaugggagacaagaguugaccaaggcaagcaccagcccuguucauagauguuggagucaauagagggccacuaacaugguuuggauauuguucccucaaaaucucauguugaaacgugaucccuaauguuggaaguggggccuagugggagguguuugggucuugggggcggaucccucaugaaugguuugcugcucuucugcaguaaugaguucacaugaaagcugguuguuuaaaagagccuggcaccuccuccuuccucucuugcucccuagcucuuacuuccacuugccaugugacgugcagcuccccauuugccuuccaccaugauuggaagcuuccugaggccucaccagaaaccgagcagguguuggugccacaugcuuguauggcccacagaacugcgagccaaauaaaccuccuuucuuuacaaauuacccagccuuggcugggcacaauaauucacaucuguaaucccaaaacuuugggagcccaaagcagauggaucuccugaggucaggauuucgagaccagccuggccaauauggugaaaccccaucucuacuaaagauacaaaaaauuagacaggcaaaccucaugagacaugaauaaacagccaggggaguucuugaugaaaaaagaggcugcugguuguugguaagagaacagcaacaggguggaugcaaaacagcugccaugccccauuucucagcccucacccuaccaugaggcugcaggaauagcuuuccuggaauggcuggcugguugcaaggugggcaagaugacccuuguccuccaaaaauuggggcauuuuugaguccugagggauuagcacagacuccuguauugguuucagcccucuugugcuuccuauggcagcauccaucaggagauuugaaaguaaagaacaccuuuuuguagccagaaauuuacagauaucauuuccaggucacugguugccuguaaagauuaugaaacaaaaacaucaguaaccacaugcaauaaggacuacacacuuugcaaacauaguuuggaaaagucucuaaacaaacagauggcugcaacccucaacaagcaaaaaucagcaaucccugaagaggaggagaaucugauuuucagaguuacuacaauaauacccaaaaugccaagugcucaacaaaauauuacaaagcauacaaagaaaaaggaaaguauagccuauucacagggggaaaaaaagaauucaauagaagccauccccaaggaagccuuuacauuggaaacauuagucaaagacauuaaaucaacugucuuacacccaaugagcuaaaggaaaccaaaauaauauaugaacaaauagggaaggccaaugaagagauaguuuaaucuuauaaaaaggaacaaaauagaaauccuggagccgaaaaguacaauagcuugaacuuagaaauucacuagagagaucaaaaagcugaucugaagaaucaggaagaagaaagaaccagugaacuugaagauaaggcaauugaaauuguccaguuguaaagagagaaaaauaaauaacgaaaaauaggcuggccaugguggcucaugccuguaaucccagcacuuugggaggccgaggaggguggaucacuugaauucaggaguuugagaucagccuggccaacauggugaaaccccaucucuacuaaaauacaaaaauuagccaggcauugugacgcgcaccuguaacccuagcugcuggggaggcugaggccagagaaucacuugaaucaagaaggaggagguugcagugagccaagaucaugccacugcacuccagccugggcaauagagugagacucuaucucaaaaaaaagaaaaggaaaaaugaacagagccugauagauccaugugaugccaucaagcauauaucaacauaugcauaguagaaguuccugaaggagaagaggaacaggaagggacagaaaaagaaauuugaagaaauaauggcugaaaacuucccaaauuugaugaaggauaugaacauacacguccaagaagcuuaacaaauuacaagcgcgagaaacucagagauucauacugaaacucacagccagauugucaaaaaucagaaacaaaaagagaaucuugaaagcagcaagagaggaacaacuuguaagguacaaggaguccucaguaacauuaauagcuaagcuuucaucagaaaccauagaggggcugggugcaguggcucaggccuguaauuccagcacuuugggaggccgaggugggcagaucgccugaggucaggaguucgagaccagccugaccaauauggcgaaaccccauucuacuaaaaauacaaaaauuagccagaugcgguggugggcaccuguaauccuaucuacuugggaggcugaggcuggagaauugcuugaaccugggaaguggagguuucagugagccaagauugcaccacugcacuccagccugggcacaagagcaaaacucuaaaaaagcaaaacuccaucucaaaaaaaaauuuuuuuuaagugccgggcacaguggcucacgccuauaaucccagcacuuugggaggccaaggcagguggaucaugaggucaggcauucuagaccagccuggucaacauagugaaacccugucucuacuaaaaauacaaaaaacuagccaggcgugguggcgggugccuguagucccagcuacuugggagacugaggcaggagaauugcuugaaccuggaaggcagagguugcagugagccaagacggcaccauuucacuccagccuggaugacagugugagacuccaucucaaaaaaaaagaaaagagaaaagaaaagaaaagaaaagaaaaggaaccagaggcccagaggcaguggaauaacacaguuaaaguccuggggaaaaaaaaaaaaaagacugucaaccaagaauuuccuaccagacaaacuauccuucaggaauaaaggagaaauuaagacauuuucagauaaauaaacgcagagaaagcucauugcuaguagcccugcucuacaagagcugcuaaaaugaauccaucaggcugaaaugaaaggaaacuugauaguaauucaaagccaugaugagaaaaaaaaagaacacugauaaaaauaguaacuacauacaucaguaaauauaaaagccaguauuauuguagguuuuguucauaauacuuuguuuuucaccuaucauuuaaagggcaaaugcaugaaacaauaauuauaaaucuauguuaaugggcacagaauguauaaagauaugaucugggacaauaauaauauaaagagggagggaaagagauguauaggagcaaaguauuuguauacucuuaaaacuaaguuaguauuauucaaauuaggguguuauaaauuuaagaugcuaauugugauccccaaggcaaccgcuaagaaaauaacuaaaaaauauacagacagggaaagaaaaaaggaaucaaaaugauacacuaaaaucuauuaaauaccaaaaaaauguaguaguggaggaauugaggaacaaaauuuaaaaaauguacagaaaagcaaauagcuauuaaauaaauggcagaauuaaauccuuuauugguaauuacuuuaaauguaaauggacuaaacugucuaauuaaagggcagagauugauagaauggauuucuaaaaauuauuaauuuauaugcugucugcaagagacuuacuuuggaucaaaagauucgaaaggauggaaaguaagaaaauaauaugggcauguuggcuuaugccuguaaucccagcacuuaugcuaccaaucccugggaagccaaagcagguggaucacuugagcccaggauucaagacuauccugagcaacauagugagaccuggucucuaaaaauaaauaaauaaauaaauaaaauuaaaaaaaaauaagccagguuugguggcacaugccuguagucacagcgacuugggaggcuaaggcaggaggauugcuugagcccaagaggucgaagcugcagugagcuaugagcucaccacugcacuacagccugggcuacagagcaagaccucaugucauaacagagaagaagagaucugaacaguagcauguguguacacauaagaaaaaccacgugggauuguagugagaaggcagcaucugcaagccaaggggugaggccugagaaaauaucaacccugcugacaccuugaucuuggacuuccagccuccagaauugugagaaaauaaauuucuauuguuuaagcuacucacuucgugauaaaguguuaucauggcccuagcaaacuaacauaucaauaaccuaacuauguggcuuagguaacuagaaaaagaagaguaaacuaaaaccaaagcuagcagaaagauggaauaaggccaggcaugguggcugaugccuguaauccuagcaauuugugaggccaaggcagguggaucaccuaaggucagaaguucaagaccagccuggccaacauggugaaaccccgucucuucuaauaauacaaaaauuagccgggcgugguggcaggcaccuguaaucccagcuacuugggaggcugaggcaggagaaucacuggaaccugggaggcagagguugcacugagccgagauggcaccacugcacuccagccugggugacagagcaagacuucaucucaaaaaaaaaaaaagggaagaaaagaaaaagaaagaaggaauaacaaagauuagaguggagaaaaacaaaacagaaaacagaaaaaugauagaggaaaucaaugaaaauaaaaguugauuuuuuuuuuuuaaagagaucgagucucacucuguugcccaggcuggagugcaguagcacagucucggcucacugcaaccuccgccucccggguucuagcaaugcuccugccucggccuccugaguagcugggauuacagguacacgccaucaugccuggcuaauuuuuuuguauuuuaguagagauaggguuucaccguguugcccaagcugaucuugaacuccugggcucaggcaauccacccaccucagccuccaaaagugcuaggauuacaggagugagccaccacacccagugaaaaguugauguuuuuaaagaucaacaaaauugacuaagaaaaaaagagaaaagagucaaauuacuaaaaucagaaaugaaagugagacaguacuguuuugcagaaauaaauuggauaauacuauaaacaauuguacuccaaaaaaucagaaaaccuuagaugaaauguacaaauuuuuagaaaaacacaaacuaccaaaacuaacucaagaagaaauagaaaaucugauuggaucuauaacaaguaaggauauugaaucaguaaucaaaaaguuuccaacaaaaaagcgcaggaacagauuguuucaagaugaauucuacuaaacauuuaaagaaguaacacaaauccuucucaaacucuucuaaagauugaagaggaaagaacacauucuaugaggccagcaagacaaagacacugagagaaaagaaaacugcagaccacugcuccuuaugaacauaaacacaaaaauucucaacaaaauacuaacgaauuuggcagcguauuuguaagauuauauaccaugaacaaguggaauuuauuccagagacacaauggugauucaccauauaaaaauaaaucgauguaguccgggugugguggcucacaccuguaaucccagcacuuugggaggcugaggcggguggaucaccugaggucaggaguucgagaccagccuggccaacauggugaaauucugucucuacuaaaaauacaaaaaauuagcuggauguggugaugggcaccugcaaucccagcuacucaggaggcugaggcaggagaauugcuugaacccgggaggcagagguugcagugaaccaagaucgugccacugcacuccagcccgggcaacaagagggaaacucagucuaaaaaaaaaaaaaaaggaaugaaggggggaaaaccacauaauaaucucaaaugggccuggcacgguggcucacgccuguaaucccagcacuuugggaggccgaggcaggugaaucaccugaggucaggaguucaagacaagccuggccauuauggugaaaccccaucucuacuaaaaauacaaaaauuagccgggugcgguggcagacaccuguaaucccaguuacuugggaggcugaggcaggagagucacuugagcccgggaggcggagguugcaguaagcugagaucacaccacugcacuccagccugggugacagaccaagacugugucucaaauaauaauaauaaucaucaucaucaucauaaucaucaucucaaaugaugccgaaaaagcauuugacaauauccaacaucaagauaaaacacuuaguaaaguaggaauagaaacgaaccucuucaacguuauuaggaccauauaagaaaagcccauaacuaacauaauaaugagagacugaagauuuuuuuccucuaaauugggaacaagacaaggaugcccacuuuuaccacuacuauuuagcguaguacuaagaguucuagucacagcaacuaggcaagauaaagaaaugaaaggcagccaaguuagaaaagaagaaguaauauuaucucucuugguagaugauauaaucuuauauguagaaaauccuaaugaauacccacccaacacacacacacacacacacacacacacacacacacaacuguuagagcuaauaaauucagcaaagcugcaggauacaaaaucaacacacaagaaucaguuucuauauaguaggauauauauuucuaaguaguaggaaacaacaaucugaaaagaaaauugagaaaacaauuccauguacaguaacaucaagaauaaaauauuuaguaaaaaaauuaaccaaggaggagcaaguuuguacaucgaaaacuacaaaacacugcugaaagaaauuaaacagaaauauacagaagaacaucuugccuucauggauuggaagacaauauuguuaagaugacaauuguuaugggcugaauguuaguguucuuccaaaaugcauaugucagugcccuaaccaccaaugggacuguuucugaagauagggccuuuauggaaguaauuaauguuaaaugaagguggggccuugguucaauaggauuagugucccuauccuggcagagauaccagagagcuuucucuugcucugcaugcaaggaaagaccauccaaggacauaguaagaagguggucauggacaagccaggaagagaaacuucaugagaaacuggcuuuuccaacaccuucaucauggauccuuaguuuccagagcugugaggaauauaaauuucuauuguuuaagccaccugucaugguauuuuguuauagcaguucaagcagacuaauacaacaauguucuccaaagccauccacagauucagugcaauuccuauccaaucccaauggcauuuuuuuugcagaaguaggcaaacugguccuaaaauuuguauggaauuucaagagaccccaaauaaccaaaauaaccgaaaaagaagaacaaaguuggaggucucauacuuccugauuucaaaacuuacuacaaagcuacaguaaucaaaauacuaugaagccaggcagauggcucaugccuguaaucccaacacauugggaagccaaggcagguagaucacuugaggucaggaauucgaggccagccuggccaacauggugaaacccugucuguacuaaaacuacagaaaaaaaaaaaaaaaagacaggcaugguggcaguuaguaguauuccugucuacuacuugggaggcugaggcacgagaaucacuugaaugcaggaggcagagguugcagugagccgagaucgcaccacugcacuccagccuggaugacagagcaagacuuugucucaaaaaacaaaaaaaacaaaaaacauuguggucucagauagucauauaguccaauaggcuagaauaaagagcccagaaaauaaacccucucgcguacugauuuuugacgagaauuucaagaccauucaauaagaaaaggacagucucuuuaauaaauggugccuuacauaagaagaauauauauggaaaaggaaaaaaaaaacacaaauggugccaaggaagcuggauauccacaugcaaaagaaugaaguugaacccuugccuuacacuaugaauaaaaauuaacucaagauugaucaaagaccugaacguaagaccuaaagucaaacacagaagaaaccauaggggcaaucaugaucuuagauuuggcaaugguuucucaaauaggccaccaaaagcacagguagcaaaagaaaaaaacuguaaauuggaugucaucaaaauuaaaaacuuuuaugcaucaaaggacacuaucaaccgggcucauugguucaugcguguaaucccagcacuuugggaggaugaggugggcagaucacuugaggucaggaguucaagaccagccuggccaacauggugaaaccccaucucuacuaaaaauacaaaaaauuagccugguguuggguggcaccuguaguaccagcuacuugggaggcugaggcaggauagucacuugaacccuggaggcagagguugcagugagcugagaucacaccacugcacuccacccugggagacagagcaaaacucagucucaaaaaaaaaaaaaaaaagagacacugucaagagagugaaaagauaacacacagaacgagaagaaacacuugcaaaucuuguaucuuauauauaaggguuuaauaucaagcauauauauauugcacuguuuuuuuguugucauugaguuguaggaguuucauggaaaaccccaaaaugagcaaagaacuugcauagcuauuucuccaaagaagauauacaaauggccaauaggcacaugaaaagaugcucaauaucacuaauuauuagggaaaugcaaaucugaaucacaaugacagaccaucucacagcugcuaggauagcuauuauuuuuuauuuuuuuauuuuauuucuuuaauuuuuugagauggagucucacucuguggcccaggauggagugcaguggcacuaucucagcucacugcaaccuccaccuccuggguucaagccauucuccugccucagccucccaaguagcugggauuacaggcaccugccaccacaccccgcuaauuuuuguauuuuuaguagagaugggguuucaccauguuggccaggcuggucuccaacuccugaccucaaguaaucugcccaccucaaucucccaaagugcugggauuacaggcaugagucaccgcacccagccuuaaauuuuuuuuuaauuaauggaaaauaaauguuggcaaggauguagagaaauugaaacucucuuucauuccuggugggaagauaaaaugguacagccauucuggaagacaguuuggcaguuucuuacaaagucaaacauagacuuauacaacccagcaaucacaaucccaggcauuacccaacugaguugaaaauuugugucaauacaaaaaccucuaugcaaauauucauagcagcaaagcaagaacacgguuucaguauacauguguuuagugaccaugauaaugugcaaaccaagaauugccuguuuugaauguguuacuuccugucuuggagccucacuuucucuaaauaagaggaagagccugaggauuccugagagguuuccuacuuugcuggugaaggaacuugggagucugcaaaugucccuaaaugaguucugggugucaccuugaccuggcuucacacuuagaguugccagguuuagcaaauacaaauauaggucauucgauuaaauuugaauuucagauaaacaacaaguaaucuuuuaguauaaguauguccauguaauauuuggagcacccuucuaccgaaaagaaaauucaugguuuaucugaaauucaaauuuaauacagccucuuguauuuuaucuggcaauccuauucccacuacugcccuugagagccuccccgcuuccccuccacauccauucuccuauguugcuuugaaaauaaacaagcaucagggacugacacacugauuucaaagucccugccacuuaaauggaucccuuucaucuaccaggaacugaagauggaaacaagugggcggagacaaaagagagcugagugaagggaggugguggaaaggaaaggggcguuucgugacaucggcccagacugcugucuccacugaggcucaggggccucaggguuggccuccugcacuccuucucagccuuggaugcauguugggagcuccgaaaaauaaugcuugggcgugaccugggcggugggaaguuuuuaagcuucucuagugauuccucgaaacagccuaggcugcuguuuucuugcugcuagcaaaccagccaaacucaguggcaaaaaucaccgcucccagccaggcagccgggcagcucucauucagaggcucaugcagcugcggucaucuugaaaacuucugcuugcacauaucuggacuugagauuaacugucaccugggaucucaguagggcagucaaccagaucaccuguauguggccuugccuuauagccugggcuucuuugcagcacgccuguugaguuccaagggagccagacagaaguggcauggccuuuucuaaucuagccuggagugucguguaguaucccuucagccacauucuacucaucagaagcaagucacuaaggccagcucacauucaagagggauggaauuaggccgggcaccguaggucacgccuaaucccagcauuuugggaggccgaggugggcagaucacuugaggucaggaguuugagaccagccugaccaacauaacaaaaccccaucucuacuaaaaauacaaaaauuagcugggcaugauggcaggcgucuguaaucccagcuacuggggaggcugaggcaugagaauugguugaacccaggagguggagguugcagugagcugagaucacgccauugcacuccagcacucuagccugggcgacagagugagacucugucucaaaaaaaaaaaaaaaaaaaaaaaaaagccgggugcaguggcucaugcuuguaaucccaguacuuugggaggccgagacagguggaucaccugaggucaggaguucaaaaccagccuggccaauauggugaaaccccgugucuacuaaaauaaaagauuagccgggugugguggcaugugccuguaaucccagcuacucaggaggcugagggagaagaaucacuugaaccugggaggcagagguugcagugagccgagauugcaccacugcacuccagccugagcaagacagcaagacuccauuucagaaaaaaaaaaaaaaaaaagagggaugaaauuagacuucaucucuugaugggacaaaugccaaggaauuugugauccuaugugaagaccaccacagcuaccacuggaauaaagucuccagaauccauucuccugucuacacucccccagcccaagacaccaucacugcucaccugggaaguccaguagccucugcagggucucccugccucccaucucccaccccaggcuguccuccacacugcagcuggagucucgagcccagagaguggaguccacggcccccacaagcuggucuuugugucuccaauucauucgcauccucaagcucccaggcagagccagacucaguacaagcaggugcucucccgagccaugcaugagccuagcuccugccagacaggcacgucaucccuugguagggagccacaaaacuucccaacccccaucccuugcuccuccuucaggaccugacccagaccccucuccagggaagccuucucugagcauccccaaggugggucaagcucaacacccuggccuuuccuuugcaauguauaggucguuucacacauuuucuuuuaaccuuguacugcaguuuaacacauaugcagaaaagugcacaaauccuuagcgaauuuucacaaagugagcaauccuguauauccagcucucaggucaagaaacagaacauuucuaaggcugggugagguggcucaugccugcaaucccagcacuuuggaagacugaugcagaaagaucacuugagggaaggaguucaagucuagucugggcaacauagugagaccucuucucuauaaaaaauuuuuuaaaauuagccaggcauguuggcacauuccuguaguccuggcuacucaggaggcuggggcaggaagaucacuugagcccaggagguugaggcugcaaaaagcuauaauuguaccacugcacuccagccugggcaacagaauaagauucuguugaaggaaagaagguaggaaggaaggaaggaaggaaggaaggaaggaaggaaggaaggaaggaaggagagaggaagaaagagagaagauuuuuauucggguaaugggugcaccaaaauaucagaaaucacugcuaaagaacuuauucauguaaccaacaccaccuguuccuuaaaaaccuauugaaauaaaaacagaaagaaagagagaaagaggaaggaaggaaggaaggaaagaaggaagauugauuccuagaaccccaggagcccuccaagguccuuuuguucaccauccaccaucccuuccuccccccaguccugguaaccacuauuccaacuuccaauccuuuggacuagugccaucuguuuuuaaacuucauaccaauggacucauacgguaugugcucuggggucugguuucuguguccaguuucauguuaguucuuguagcauuuuaaucagagccggucacauaauuuguagugcccagugcaaaaugaaaguguggaccauccccuccaaccccacccccaacaccauucaaaaguuauuaagaauuucaagauggcagcugcagagccuaagucagucacgggauucuucugagugcacagcccuguguaagucacacacgcccacgaagccauccuguuuccaguugccuguuuggucgagugucucuuccuugagggcaagagcugugcugggggaaagucaccaucucuguggaguuucuucagccuucauucauuaaaaccucacagaggcccugaggccaagaaggagggugaucauuauaagcaucacaccuguuuaauugaugcaaugucuagacugaaaaugccgcgggacucagccaaggucccccagugagugagugcaggggcggaccucacacacaagcccucuggcucuaggcagccucccccugccuccagcucugcccuagaaucuacugcaugccaaguaccggacccaggacaaagggaaaaaagaguuccugcccaaaaggaacucucaauucaacuggaaaacaaaaacaggacuuacacacaugaagacauuauuaaccaaaacauuuuguccuucaugugcgggccuuguagcugcaagaauuggaggcugucucugccuaaccaagcaagaaggaucaacaagagagggugcagcaaggugugguggcucacgccuguaaucccagcacuuugggaggccaaggcagggggaucaccuaaggucaguaguucgagaccagccuggccaacauggugaaaccccgucucuaccaaaaauacaaaaauuagccgggcgugguggugcaugccugugaucccagcuaccugggaggcugaggcaggagaaccacuugaauccaggaggcggagguugcagugaaccgagaucacacuguugcacuccagcuugggcaacaaagggagacuucaucuaaaaaaaauuaaaaauuaaacaaaauaauaagaggggguucagagagccuggacaggaagcugagggcaggcagagcuccugggagcccuagggagcaguggagccccaccccggcucucacaggggcauggucuggucagugugcugcuguugcaucugugcaacacacacuccagccaucccaucagucccgguaucacuugcucacaggacagccucugauuggcugagcucuggccuggggcucaaccccuggcucuccuagagcugggagacagacggagggccuggccccucuguucucacagugggagggagggaauuccucagaaagaaaucaaggggucaugaggaccagggaugaaagcgagguggcuaaaaaaugacagaaacccccuauaaugcacguguuuguuuagaucgccaguacaccgagcaacaauggggggcuccuguccuugaaacugacuuugccugugcuuguggaggaggcugguaaaaccauuguaaaaggugaguccgcaagcacccagguguuugugaaaguguggugugaugguuacuuuuagcugucagcuugacuggguuaagggauacccagauagcaggugcaacauuauuucugggugcaucugggaggguguuuucaaagagauugguacucgaaucaguagaccgaguaaaaaacaucugcccucaccaauguaggugggcaacauucaauccacugagggcccaaauagaacaaaaagacagaggaaaagcaaauucacucucuucuggaccugggacauccaccuucuccugcccugggacguugaagcuccugguucucagaacuucaggcucaaacugaaugauaccaucagcuuccguggcucuucaaccugcagaugacauacugugggacuucuuaggcuccuaaucacucaggccaaucuccauuauaaagccccucuuccaggucuauagcuaugucuacagcgccaucuguaucuuguucauucuguuucucugacuaauccaugugguuaaaguaaaauccucaaaccucacacuaacagcagagaagcuauaacacugucaagcuucaacucaccaaugcauaugccagagcccucuuagaaacguggcuuccuugaagggaagaccauguugucaucagggcagugaccuccaaggagccuggaaaagagugagaagacccacugggaauaaugug

SEQ ID NO: 15129 - RNA, 92988 nt, Homo sapiens
cacauuauucccagugggucuucucacucuuuuccaggcuccuuggaggucacugcccugaugacaacauggucuucccuucaaggaagccacguuucuaagagggcucuggcauaugcauuggugaguugaagcuugacaguguuauagcuucucugcuguuagugugagguuugaggauuuuacuuuaaccacauggauuagucagagaaacagaaugaacaagauacagauggcgcuguagacauagcuauagaccuggaagaggggcuuuauaauggagauuggccugagugauuaggagccuaagaagucccacaguaugucaucugcagguugaagagccacggaagcugaugguaucauucaguuugagccugaaguucugagaaccaggagcuucaacgucccagggcaggagaagguggaugucccagguccagaagagagugaauuugcuuuuccucugucuuuuuguucuauuugggcccucaguggauugaauguugcccaccuacauuggugagggcagauguuuuuuacucggucuacugauucgaguaccaaucucuuugaaaacacccucccagaugcacccagaaauaauguugcaccugcuaucuggguaucccuuaacccagucaagcugacagcuaaaaguaaccaucacaccacacuuucacaaacaccugggugcuugcggacucaccuuuuacaaugguuuuaccagccuccuccacaagcacaggcaaagucaguuucaaggacaggagccccccauuguugcucgguguacuggcgaucuaaacaaacacgugcauuauaggggguuucugucauuuuuuagccaccucgcuuucaucccugguccucaugaccccuugauuucuuucugaggaauucccucccucccacugugagaacagaggggccaggcccuccgucugucucccagcucuaggagagccagggguugagccccaggccagagcucagccaaucagaggcuguccugugagcaagugauaccgggacugaugggauggcuggaguguguguugcacagaugcaacagcagcacacugaccagaccaugccccugugagagccgggguggggcuccacugcucccuagggcucccaggagcucugccugcccucagcuuccuguccaggcucucugaacccccucuuauuauuuuguuuaauuuuuaauuuuuuuuagaugaagucucccuuuguugcccaagcuggagugcaacagugugaucucgguucacugcaaccuccgccuccuggauucaagugguucuccugccucagccucccagguagcugggaucacaggcaugcaccaccacgcccggcuaauuuuuguauuuuugguagagacgggguuucaccauguuggccaggcuggucucgaacuacugaccuuaggugaucccccugccuuggccucccaaagugcugggauuacaggcgugagccaccacaccuugcugcacccucucuuguugauccuucuugcuugguuaggcagagacagccuccaauucuugcagcuacaaggcccgcacaugaaggacaaaauguuuugguuaauaaugucuucauguguguaaguccuguuuuuguuuuccaguugaauugagaguuccuuuugggcaggaacucuuuuuucccuuuguccuggguccgguacuuggcaugcaguagauucuagggcagagcuggaggcagggggaggcugccuagagccagagggcuugugugugagguccgccccugcacucacucacugggggaccuuggcugagucccgcggcauuuucagucuagacauugcaucaauuaaacaggugugaugcuuauaaugaucacccuccuucuuggccucagggccucugugagguuuuaaugaaugaaggcugaagaaacuccacagagauggugacuuucccccagcacagcucuugcccucaaggaagagacacucgaccaaacaggcaacuggaaacaggauggcuucgugggcgugugugacuuacacagggcugugcacucagaagaaucccgugacugacuuaggcucugcagcugccaucuugaaauucuuaauaacuuuugaaugguguugggggugggguuggaggggaugguccacacuuucauuuugcacugggcacuacaaauuaugugaccggcucugauuaaaaugcuacaagaacuaacaugaaacuggacacagaaaccagaccccagagcacauaccguaugaguccauugguaugaaguuuaaaaacagauggcacuaguccaaaggauuggaaguuggaauagugguuaccaggacuggggggaggaagggaugguggauggugaacaaaaggaccuuggagggcuccugggguucuaggaaucaaucuuccuucuuuccuuccuuccuuccuuccucuuucucucuuucuuucuguuuuuauuucaauagguuuuuaaggaacaggugguguugguuacaugaauaaguucuuuagcagugauuucugauauuuuggugcacccauuacccgaauaaaaaucuucucucuuucuuccucucuccuuccuuccuuccuuccuuccuuccuuccuuccuuccuuccuuccuuccuaccuucuuuccuucaacagaaucuuauucuguugcccaggcuggagugcagugguacaauuauagcuuuuugcagccucaaccuccugggcucaagugaucuuccugccccagccuccugaguagccaggacuacaggaaugugccaacaugccuggcuaauuuuaaaaaauuuuuuauagagaagaggucucacuauguugcccagacuagacuugaacuccuucccucaagugaucuuucugcaucagucuuccaaagugcugggauugcaggcaugagccaccucacccagccuuagaaauguucuguuucuugaccugagagcuggauauacaggauugcucacuuugugaaaauucgcuaaggauuugugcacuuuucugcauauguguuaaacugcaguacaagguuaaaagaaaaugugugaaacgaccuauacauugcaaaggaaaggccaggguguugagcuugacccaccuuggggaugcucagagaaggcuucccuggagaggggucugggucagguccugaaggaggagcaagggauggggguugggaaguuuuguggcucccuaccaagggaugacgugccugucuggcaggagcuaggcucaugcauggcucgggagagcaccugcuuguacugagucuggcucugccugggagcuugaggaugcgaaugaauuggagacacaaagaccagcuugugggggccguggacuccacucucugggcucgagacuccagcugcaguguggaggacagccuggggugggagaugggaggcagggagacccugcagaggcuacuggacuucccaggugagcagugauggugucuugggcugggggaguguagacaggagaauggauucuggagacuuuauuccagugguagcugugguggucuucacauaggaucacaaauuccuuggcauuugucccaucaagagaugaagucuaauuucaucccucuuuuuuuuuuuuuuuuuucugaaauggagucuugcugucuugcucaggcuggagugcaguggugcaaucucggcucacugcaaccucugccucccagguucaagugauucuucucccucagccuccugaguagcugggauuacaggcacaugccaccacacccggcuaaucuuuuauuuuaguagacacgggguuucaccauauuggccaggcugguuuugaacuccugaccucaggugauccaccugucucggccucccaaaguacugggauuacaagcaugagccacugcacccggcuuuuuuuuuuuuuuuuuuuuuuuuuugagacagagucucacucugucgcccaggcuagagugcuggagugcaauggcgugaucucagcucacugcaaccuccaccuccuggguucaaccaauucucaugccucagccuccccaguagcugggauuacagacgccugccaucaugcccagcuaauuuuuguauuuuuaguagagaugggguuuuguuauguuggucaggcuggucucaaacuccugaccucaagugaucugcccaccucggccucccaaaaugcugggauuaggcgugaccuacggugcccggccuaauuccaucccucuugaaugugagcuggccuuagugacuugcuucugaugaguagaauguggcugaagggauacuacacgacacuccaggcuagauuagaaaaggccaugccacuucugucuggcucccuuggaacucaacaggcgugcugcaaagaagcccaggcuauaaggcaaggccacauacaggugaucugguugacugcccuacugagaucccaggugacaguuaaucucaaguccagauaugugcaagcagaaguuuucaagaugaccgcagcugcaugagccucugaaugagagcugcccggcugccuggcugggagcggugauuuuugccacugaguuuggcugguuugcuagcagcaagaaaacagcagccuaggcuguuucgaggaaucacuagagaagcuuaaaaacuucccaccgcccaggucacgcccaagcauuauuuuucggagcucccaacaugcauccaaggcugagaaggagugcaggaggccaacccugaggccccugagccucaguggagacagcagucugggccgaugucacgaaacgccccuuuccuuuccaccaccucccuucacucagcucucuuuugucuccgcccacuuguuuccaucuucaguuccugguagaugaaagggauccauuuaaguggcagggacuuugaaaucagugugucagucccugaugcuuguuuauuuucaaagcaacauaggagaauggauguggaggggaagcggggaggcucucaagggcaguagugggaauaggauugccagauaaaauacaagaggcuguauuaaauuugaauuucagauaaaccaugaauuuucuuuucgguagaagggugcuccaaauauuacauggacauacuuauacuaaaagauuacuuguuguuuaucugaaauucaaauuuaaucgaaugaccuauauuuguauuugcuaaaccuggcaacucuaagugugaagccaggucaaggugacacccagaacucauuuagggacauuugcagacucccaaguuccuucaccagcaaaguaggaaaccucucaggaauccucaggcucuuccucuuauuuagagaaagugaggcuccaagacaggaaguaacacauucaaaacaggcaauucuugguuugcacauuaucauggucacuaaacacauguauacugaaaccguguucuugcuuugcugcuaugaauauuugcauagagguuuuuguauugacacaaauuuucaacucaguuggguaaugccugggauugugauugcuggguuguauaagucuauguuugacuuuguaagaaacugccaaacugucuuccagaauggcuguaccauuuuaucuucccaccaggaaugaaagagaguuucaauuucucuacauccuugccaacauuuauuuuccauuaauuaaaaaaaaauuuaaggcugggugcggugacucaugccuguaaucccagcacuuugggagauugaggugggcagauuacuugaggucaggaguuggagaccagccuggccaacauggugaaaccccaucucuacuaaaaauacaaaaauuagcggggugugguggcaggugccuguaaucccagcuacuugggaggcugaggcaggagaauggcuugaacccaggagguggagguugcagugagcugagauagugccacugcacuccauccugggccacagagugagacuccaucucaaaaaauuaaagaaauaaaauaaaaaaauaaaaaauaauagcuauccuagcagcugugagauggucugucauugugauucagauuugcauuucccuaauaauuagugauauugagcaucuuuucaugugccuauuggccauuuguauaucuucuuuggagaaauagcuaugcaaguucuuugcucauuuugggguuuuccaugaaacuccuacaacucaaugacaacaaaaaaacagugcaauauauauaugcuugauauuaaacccuuauauauaagauacaagauuugcaaguguuucuucucguucuguguguuaucuuuucacucucuugacagugucucuuuuuuuuuuuuuuuuugagacugaguuuugcucugucucccaggguggagugcaguggugugaucucagcucacugcaaccucugccuccaggguucaagugacuauccugccucagccucccaaguagcugguacuacaggugccacccaacaccaggcuaauuuuuuguauuuuuaguagagaugggguuucaccauguuggccaggcuggucuugaacuccugaccucaagugaucugcccaccucauccucccaaagugcugggauuacacgcaugaaccaaugagcccgguugauaguguccuuugaugcauaaaaguuuuuaauuuugaugacauccaauuuacaguuuuuuucuuuugcuaccugugcuuuugguggccuauuugagaaaccauugccaaaucuaagaucaugauugccccuaugguuucuucuguguuugacuuuaggucuuacguucaggucuuugaucaaucuugaguuaauuuuuauucauaguguaaggcaaggguucaacuucauucuuuugcauguggauauccagcuuccuuggcaccauuuguguuuuuuuuuuccuuuuccauauauauucuucuuauguaaggcaccauuuauuaaagagacuguccuuuucuuauugaauggucuugaaauucucgucaaaaaucaguacgcgagaggguuuauuuucugggcucuuuauucuagccuauuggacuauaugacuaucugagaccacaauguuuuuuguuuuuuuuguuuuuugagacaaagucuugcucugucauccaggcuggagugcaguggugcgaucucggcucacugcaaccucugccuccugcauucaagugauucucgugccucagccucccaaguaguagacaggaauacuacuaacugccaccaugccugucuuuuuuuuuuuuuuuucuguaguuuuaguacagacaggguuucaccauguuggccaggcuggccucgaauuccugaccucaagugaucuaccugccuuggcuucccaauguguugggauuacaggcaugagccaucugccuggcuucauaguauuuugauuacuguagcuuuguaguaaguuuugaaaucaggaaguaugagaccuccaacuuuguucuucuuuuucgguuauuuugguuauuuggggucucuugaaauuccauacaaauuuuaggaccaguuugccuacuucugcaaaaaaaaugccauugggauuggauaggaauugcacugaaucuguggauggcuuuggagaacauuguuguauuagucugcuugaacugcuauaacaaaauaccaugacagguggcuuaaacaauagaaauuuauauuccucacagcucuggaaacuaaggauccaugaugaagguguuggaaaagccaguuucucaugaaguuucucuuccuggcuuguccaugaccaccuucuuacuauguccuuggauggucuuuccuugcaugcagagcaagagaaagcucucugguaucucugccaggauagggacacuaauccuauugaaccaaggccccaccuucauuuaacauuaauuacuuccauaaaggcccuaucuucagaaacagucccauuggugguuagggcacugacauaugcauuuuggaagaacacuaacauucagcccauaacaauugucaucuuaacaauauugucuuccaauccaugaaggcaagauguucuucuguauauuucuguuuaauuucuuucagcaguguuuuguaguuuucgauguacaaacuugcuccuccuugguuaauuuuuuuacuaaauauuuuauucuugauguuacuguacauggaauuguuuucucaauuuucuuuucagauuguuguuuccuacuacuuagaaauauauauccuacuauauagaaacugauucuuguguguugauuuuguauccugcagcuuugcugaauuuauuagcucuaacaguuguguguguguguguguguguguguguguguguguguuggguggguauucauuaggauuuucuacauauaagauuauaucaucuaccaagagagauaauauuacuucuucuuuucuaacuuggcugccuuucauuucuuuaucuugccuaguugcugugacuagaacucuuaguacuacgcuaaauaguagugguaaaagugggcauccuugucuuguucccaauuuagaggaaaaaaaucuucagucucucauuauuauguuaguuaugggcuuuucuuauaugguccuaauaacguugaagagguucguuucuauuccuacuuuacuaaguguuuuaucuugauguuggauauugucaaaugcuuuuucggcaucauuugagaugaugauuaugaugaugaugaugauuauuauuauuauuugagacacagucuuggucugucacccaggcuggagugcaguggugugaucucagcuuacugcaaccuccgccucccgggcucaagugacucuccugccucagccucccaaguaacugggauuacaggugucugccaccgcacccggcuaauuuuuguauuuuuaguagagaugggguuucaccauaauggccaggcuugucuugaacuccugaccucaggugauucaccugccucggccucccaaagugcugggauuacaggcgugagccaccgugccaggcccauuugagauuauuaugugguuuuccccccuucauuccuuuuuuuuuuuuuuuagacugaguuucccucuuguugcccgggcuggagugcaguggcacgaucuugguucacugcaaccucugccucccggguucaagcaauucuccugccucagccuccugaguagcugggauugcaggugcccaucaccacauccagcuaauuuuuuguauuuuuaguagagacagaauuucaccauguuggccaggcuggucucgaacuccugaccucaggugauccacccgccucagccucccaaagugcugggauuacaggugugagccaccacacccggacuacaucgauuuauuuuuauauggugaaucaccauugugucucuggaauaaauuccacuuguucaugguauauaaucuuacaaauacgcugccaaauucguuaguauuuuguugagaauuuuuguguuuauguucauaaggagcaguggucugcaguuuucuuuucucucagugucuuugucuugcuggccucauagaauguguucuuuccucuucaaucuuuagaagaguuugagaaggauuuguguuacuucuuuaaauguuuaguagaauucaucuugaaacaaucuguuccugcgcuuuuuuguuggaaacuuuuugauuacugauucaauauccuuacuuguuauagauccaaucagauuuucuauuucuucuugaguuaguuuugguaguuuguguuuuucuaaaaauuuguacauuucaucuaagguuuucugauuuuuuggaguacaauuguuuauaguauuauccaauuuauuucugcaaaacaguacugucucacuuucauuucugauuuuaguaauuugacucuuuucucuuuuuuucuuagucaauuuuguugaucuuuaaaaacaucaacuuuucacugggugugguggcucacuccuguaauccuagcacuuuuggaggcugagguggguggauugccugagcccaggaguucaagaucagcuugggcaacacggugaaacccuaucucuacuaaaauacaaaaaaauuagccaggcaugauggcguguaccuguaaucccagcuacucaggaggccgaggcaggagcauugcuagaacccgggaggcggagguugcagugagccgagacugugcuacugcacuccagccugggcaacagagugagacucgaucucuuuaaaaaaaaaaaaucaacuuuuauuuucauugauuuccucuaucauuuuucuguuuucuguuuuguuuuucuccacucuaaucuuuguuauuccuucuuucuuuuucuuuucuucccuuuuuuuuuuuuugagaugaagucuugcucugucacccaggcuggagugcaguggugccaucucggcucagugcaaccucugccucccagguuccagugauucuccugccucagccucccaaguagcugggauuacaggugccugccaccacgcccggcuaauuuuuguauuauuagaagagacgggguuucaccauguuggccaggcuggucuugaacuucugaccuuaggugauccaccugccuuggccucacaaauugcuaggauuacaggcaucagccaccaugccuggccuuauuccaucuuucugcuagcuuugguuuuaguuuacucuucuuuuucuaguuaccuaagccacauaguuagguuauugauauguuaguuugcuagggccaugauaacacuuuaucacgaagugaguagcuuaaacaauagaaauuuauuuucucacaauucuggaggcuggaaguccaagaucaaggugucagcaggguugauauuuucucaggccucaccccuuggcuugcagaugcugccuucucacuacaaucccacgugguuuuucuuauguguacacacaugcuacuguucagaucucuucuucucuguuaugacaugaggucuugcucuguagcccaggcuguagugcaguggugagcucauagcucacugcagcuucgaccucuugggcucaagcaauccuccugccuuagccucccaagucgcugugacuacaggcaugugccaccaaaccuggcuuauuuuuuuuuaauuuuauuuauuuauuuauuuauuuuuagagaccaggucucacuauguugcucaggauagucuugaauccugggcucaagugauccaccugcuuuggcuucccagggauugguagcauaagugcugggauuacaggcauaagccaacaugcccauauuauuuucuuacuuuccauccuuucgaaucuuuugauccaaaguaagucucuugcagacagcauauaaauuaauaauuuuuagaaauccauucuaucaaucucugcccuuuaauuagacaguuuaguccauuuacauuuaaaguaauuaccaauaaaggauuuaauucugccauuuauuuaauagcuauuugcuuuucuguacauuuuuuaaauuuuguuccucaauuccuccacuacuacauuuuuuugguauuuaauagauuuuaguguaucauuuugauuccuuuuuucuuucccugucuguauauuuuuuaguuauuuucuuagcgguugccuuggggaucacaauuagcaucuuaaauuuauaacacccuaauuugaauaauacuaacuuaguuuuaagaguauacaaauacuuugcuccuauacaucucuuucccucccucuuuauauuauuauugucccagaucauaucuuuauacauucugugcccauuaacauagauuuauaauuauuguuucaugcauuugcccuuuaaaugauaggugaaaaacaaaguauuaugaacaaaaccuacaauaauacuggcuuuuauauuuacugauguauguaguuacuauuuuuaucaguguucuuuuuuuuucucaucauggcuuugaauuacuaucaaguuuccuuucauuucagccugauggauucauuuuagcagcucuuguagagcagggcuacuagcaaugagcuuucucugcguuuauuuaucugaaaaugucuuaauuucuccuuuauuccugaaggauaguuugucugguaggaaauucuugguugacagucuuuuuuuuuuuuuuccccaggacuuuaacuguguuauuccacugccucugggccucugguuccuuuucuuuucuuuucuuuucuuuucucuuuucuuuuuuuuugagauggagucucacacugucauccaggcuggagugaaauggugccgucuuggcucacugcaaccucugccuuccagguucaagcaauucuccugccucagucucccaaguagcugggacuacaggcacccgccaccacgccuggcuaguuuuuuguauuuuuaguagagacaggguuucacuauguugaccaggcuggucuagaaugccugaccucaugauccaccugccuuggccucccaaagugcugggauuauaggcgugagccacugugcccggcacuuaaaaaaaauuuuuuuuugagauggaguuuugcuuuuuuagaguuuugcucuugugcccaggcuggagugcaguggugcaaucuuggcucacugaaaccuccacuucccagguucaagcaauucuccagccucagccucccaaguagauaggauuacaggugcccaccaccgcaucuggcuaauuuuuguauuuuuaguagaaugggguuucgccauauuggucaggcuggucucgaacuccugaccucaggcgaucugcccaccucggccucccaaagugcuggaauuacaggccugagccacugcacccagccccucuaugguuucugaugaaagcuuagcuauuaauguuacugaggacuccuuguaccuuacaaguuguuccucucuugcugcuuucaagauucucuuuuuguuucugauuuuugacaaucuggcugugaguuucaguaugaaucucugaguuucucgcgcuuguaauuuguuaagcuucuuggacguguauguucauauccuucaucaaauuugggaaguuuucagccauuauuucuucaaauuucuuuuucugucccuuccuguuccucuucuccuucaggaacuucuacuaugcauauguugauauaugcuugauggcaucacauggaucuaucaggcucuguucauuuuuccuuuucuuuuuuuugagauagagucucacucuauugcccaggcuggagugcaguggcaugaucuuggcucacugcaaccuccuccuucuugauucaagugauucucuggccucagccuccccagcagcuaggguuacaggugcgcgucacaaugccuggcuaauuuuuguauuuuaguagagaugggguuucaccauguuggccaggcugaucucaaacuccugaauucaagugauccacccuccucggccucccaaagugcugggauuacaggcaugagccaccauggccagccuauuuuucguuauuuauuuuucucucuuuacaacuggacaauuucaauugccuuaucuucaaguucacugguucuuucuucuuccugauucuucagaucagcuuuuugaucucucuagugaauuucuaaguucaagcuauuguacuuuucggcuccaggauuucuauuuuguuccuuuuuauaagauuaaacuaucucuucauuggccuucccuauuuguucauauauuauuuugguuuccuuuagcucauuggguguaagacaguugauuuaaugucuuugacuaauguuuccaauguaaaggcuuccuuggggauggcuucuauugaauucuuuuuuucccccugugaauaggcuauacuuuccuuuuucuuuguaugcuuuguaauauuuuguugagcacuuggcauuuuggguauuauuguaguaacucugaaaaucagauucuccuccucuucagggauugcugauuuuugcuuguugaggguugcagccaucuguuuguuuagagacuuuuccaaacuauguuugcaaaguguguaguccuuauugcaugugguuacugauguuuuuguuucauaaucuuuacaggcaaccagugaccuggaaaugauaucuguaaauuucuggcuacaaaaagguguucuuuacuuucaaaucuccugauggaugcugccauaggaagcacaagagggcugaaaccaauacaggagucugugcuaaucccucaggacucaaaaaugccccaauuuuuggaggacaagggucaucuugcccaccuugcaaccagccagccauuccaggaaagcuauuccugcagccucaugguagggugagggcugagaaauggggcauggcagcuguuuugcauccacccuguugcuguucucuuaccaacaaccagcagccucuuuuuucaucaagaacuccccuggcuguuuauucaugucucaugagguuugccugucuaauuuuuuguaucuuuaguagagaugggguuucaccauauuggccaggcuggucucgaaauccugaccucaggagauccaucugcuuugggcucccaaaguuuugggauuacagaugugaauuauugugcccagccaaggcuggguaauuuguaaagaaaggagguuuauuuggcucgcaguucugugggccauacaagcauguggcaccaacaccugcucgguuucuggugaggccucaggaagcuuccaaucaugguggaaggcaaauggggagcugcacgucacauggcaaguggaaguaagagcuagggagcaagagaggaaggaggaggugccaggcucuuuuaaacaaccagcuuucaugugaacucauuacugcagaagagcagcaaaccauucaugagggauccgcccccaagacccaaacaccucccacuaggccccacuuccaacauuagggaucacguuucaacaugagauuuugagggaacaauauccaaaccauguuaguggcccucuauugacuccaacaucuaugaacagggcuggugcuugccuuggucaacucuugucucccauucccaguggggggccuggcacaugaagaagggauuaaccaauaauaaguaauaaaguaauaagguaauaaaauaauauuuacuuuuuuuuuuugagacagagucucacucugucacccaggcuggagugcaguggcaccaucucggcucacugcaagcucugccucccggguucaugccauucuccugccucagccuccugaguagcugggacuacaggugacugccaccacaccuggcuaauuuuuuguguuuuuaguagagaugggguuucaccauguuagccaggaugaucucgaucuccugaccucaggaucugcccaccucagccucccaaagugcugggauuacagacaugagccacugugccuggccuaccauuuuuuuuuuuuucugagaggaguuucacucuuguugcccaggcuggggugcaauggcaugaucucggcucacugcaaccuccacuuccaggguucaagugauucuccugccucagccuccccaguagcugggauuacaggcaugcaccaccacaccuggcuaauuuuguauuuuuaguagaggugggguuuauccauguuggucaggcuggucuugaacucccgaccugaggugauuugccugccuuggccucccaaagugcugggauuacaggcgugagccacugcgccuugccaauuuuuuuuuuuuuuuagacgaagugucauucuguugcccaggcaggagugcaguggcaugaucucugcucacugcaaccucugccucccagguucaagcgauucuccuaccucagccucccgaguagcugggauuacaggugugugccaccacggcggcuaauuuuuguauuuuuaguagagaugggguuucaucauguuggccaggcuggucucaaacuccugaccucaaaugauccgccugccuccaccucccaaagugcugggauuacaggcaugagccacugcgcccggccaaagcugaucauuugaaagugugauaagugcuacaaagaaaauuuaaaaagugaggugagggcagaugccuagaggagaggggaggggcuuuuguggacaggagaucaagaaagcccuguuauuauuugaacugaggccugaguaauggcaaggaggcaaccauggaaagauaugggagaaauauugcaggcagagagaucagcaggugcaaaggcccugaggcaggaacuagucuggaguaucugaagaagagagaaauuguugugguuggcuugagugguagggggcuugguuggagguggggaagguggguccgacaaugcugaauucuaguaggaugucuggauuugauucugguugcugugggaagccauggagggcccuagaagggagacugacaugaccugauccccuuugaaaagcucacccagacugcugaguggauaauaguuuagaggugugcgaauuggaugucuuuggcugcucaugauagaaaauuguccuggucauuuagaaaauuuacuggccuuuuaaacgggaaguucagaagugaugcagacuccagagcugguugauucagcccuggaucaaguucugugaugcugucaaggauuggguucuguucucagcucugcugaccacagaucgcacuucauucugaguacuggagugucuagguggucuggggggcugucugauacacauggggcuaccugcuuugcacuuccuggccaaggggauagacugauuccuuaugggagcacuuuugaagaaugaggaagaaccuucucaggagaggcgugguggcucuugccuguaaucccagcacuuuaggaggccaaggcggguggaucacuugaggccaggaguuugagaccagccuggccaacauggugaaacccuguuucuacuaaaaauacaaaaauuagccaggugugguggcacgcgccuguagucccagcuacucaggaggcugaggcaggagaaucgcuugaacccaagaggcagagggugcagugagccaagauggcaccauugcacuccagccugggcaacagaggaaaaaaaaaagaaccuucccagaagccuccaggaagucucuguuuggacgacaucgcacacccauucuugaaccaacuauuuagaagggagaugcaucacccccuuugccuggagcuagggggugggucagcuuccuacaggcacaggacuauguggucgcggguuaagccccuaaacgaggggaaguggggugggcagcagccgaucuccauuacaagggacaagaguaggggcagcaaggccagaucaaugguugcugagguggcuggggauggagagaggaugguggugguagaagagaugguaacaauggucagguccuggcuguuccagaggugaugaugguuggauaugcagugaggaaaagacaggaaugaacauuuaucuuuucccaaguuguccuugcuuucuuccuuugaagccauaaaaaggaaaaaaaggguggaucuggacuugggagcugggcaggagugagggaagagaagcagagcaagcaggcacaccaggcugugacucugcaggcaucucucugccuagacuugucuguaugauguggaacgaacacgacccaucuuuacugcuagcgacugcagcagauaaggcaaggccacuuucacgcaguuagguuaauaggaggcuguacaaagggcuguaggaggaagugggcacaggaguucuaaaauaauuggaacggccaggugugguagcucacaccuguaauccuagcacuucagggaauccaagacaggagguuagcuaagacaggaggcucgcuuaaugucaagaccagccugggcaacauagggagaccccgccucuacaaaaaauagaaaaauuaacaggauguguuggugcgggccaguggucccagcuacuccugaggcugaggugggaagaucgcuugagucuaggaguuugaggcugcagugagaaaugauggcacuacugcacuccagcccgggcgacagaccaagacucagucucuuaaaaaaaaaaaaaaaaaaaagaaaagugggggcaaaguuauccuuggaaaauuucuuaguccauucauagcagcauauuaaaauuaguacaguagcuuaauuuauauaagagaaaauacaauguguacaguaauuaaugaacaugcaaaauauaauuguauauuucaacucacuaaaaaggcacagaaagaguugaauuugcuaaaauuaaaugugcuuaugaaacagcucuaguacaugaauuaagcuccuagauacagaugcagcgccaaacgacggggagggagauggggcacucaaggcgacacgcggcucuuguugccgagcguuuccugggcguggagcuucuauagaauguaagcuuuuuuuuuuuaagguuccaaagccuauauuuagugcuuucauauacguaaucucaaaaaaaaaaaaagaaagaaauaucggcauaaaauguaagcuuccagagggauacaaacgcagcccagcgcggacaccgccagccccagccacgcgguucgcaucaagcgcacuccccugggggcggggccugcgcgagcugggcgugucgggggcggggccugcgcgcuugcuuccggcgugccgcgagaggcggggcguguggggaggcgcggccgccacgcgacgccuggcugggcccgcaccggagaggcgucucgguaccuggcaggcggccugcuacucggagcccgcugcggggcggcggcggcggggacaugcacgugugagaugcggcagcgggcggcgcggacgcgaacagcagcggcggcggcgggcgcggccuccugggcgcggggcgcgcggugccugagggcgggcgcgcgggcgcugggcaacugccggccgcgccgccugcgcaggcgcugguucaggacucacacgccgcgcugaggcccgcgggcccgucauggaggcgcccaccguggagacgccccccgaccccucgcccccuucggccccggccccugcccugguuccguugcgcgccccggauguggcgcggcugcgcgaggagcaggaaaagguaacuagcagccccgcgccgcuuccgccuccgcccgccgggcugccccugccugugcucugggccgccgccccgcguggccuaggcccagcugcccgggcccccggagggaacggggauaaacuuuugucacgugcuucuguugucuuugucugcagcccuuugacuucgcagcggagugaggggugugcagcccguucgccugcccaggaaagggggcuucugagcugaaggcgugcggcagcgcgugggaauuugggggcgggggcagcacgcugucaacggaagcguucgccuuaauauuuguagcuuguaaugaccuaaacauugcuuaaaauguguacuguuuguugcucuuugauugcacggaaaaguuuuaccgcguuugucaugauaaugcuuccugugcaauauuugguuauuuaauauuugucacaauauaaugccauuuaaacauuaaaaaaaaaagagagucucacuauguugcccaggcuaaucucgaacuucuggccucaagcgauccucccccuccuacccuuccccaccucgccucccaaaguguugggauuauaggccugagucaccgcacccggcucauuuuuacaaauuuuaauuucaucguauaauaaaugaguuuuaaacuacuggugaaaaggguacaaaguuuuguguuuccuagugggacuuuauauaaagaaguauucccaauuuaagaaauaguuuuauuguuaaaucugauuuuucuguggauucuguggucuuucagauugauucuguccccucaagugucuugaaauuguuacuuugaaaagcaguauuuaauuugcuuaaaauauuuuaugucauguuuggaagagcauggauuauaaaggguuaggaaguugcuucaacacuauaagcaguuuaaaaguucuuaacuuuuuaauugaacauuccuguauaagaacgacuguuuacauagauacaaaaauauacucaguucuacuagauggggguuuugauagaacuuaaaaaacccucguuugcuuggaaaccaccuguugggaugaacugcgggaaucuuucuuuguucugguugguuuaaauuauuuuguggguuggauuuucauuucucagccauuuuucucuaauaacgcaacuguuagguuuggaagccauguuuucaagaugaagguuuaaaaauccaguggcuaggguggugacucaaaccuguaaucccagcugcuugggaugucaaggucguggaauugcuugaagccaaggaguucgagaucagccugggcaacacagggagaccuccgucuauacaaaaaaauacaaaaaauuagccgggccaugguggugcacgcuuguagucccacguacuugggaggcugaggugagaggaucacuugagcucaggcguuugaggcugcagugggccauggucaugcaacugcacuucacccugggcgacagagugagacccugucauucauauauauauauauauauauauauauauauauauauauauauauauauauauaaaacuuaacuaguuuggcgucuuuaaauuagaagacauuaauguauuuuuuuaaaagagaaagauagaaaaagaagaaagaaaaaacagccccucaugaaaucuuacuccuuuugccaaaacuuggcauuuuuuauucuuucagagaaugugacacagacccucagaggaugguguuucuauugccuuuccucugcugcaguggguuaauuucaccuccuucaguguauaauacgugcauaaugcugacuugauauguuuucugccauuuggcauauuaaaaagauauccuuaguuuuauucugauguuagugugacugaaaugcaaaggauacuuuuuggggugcucugaacagcuuucugguaucguguugaguuacauuggaagagagaguaacugcuuuuucaguuacagucuuguggcaaacugaaugacuguuuucuguagacauugacugugcuaccaaauuauuuuucuguguuguguuaauguuaauucggcacacaaaauaaccacguauaucugucauggguguguaaaauuauccccaguucaggaaaaagcgcgucaguauuuaaucuaucuuuauuuaauagaagcauuugcuucaguggacaggagacccacaaggccacaaaauaaacugauuagauagcugcacuguaauuauaguguaguacaggaaaacuacccaguaaaucggcagugaaaauuuuuugugaagcaauuuauuuaggcuuuaaagcuggcccaguugugggaguacagugaguucuaguaaaguagaagcguagugacauccugaguguagaaggggaaaaugucauaguagcuucauauguggcacuuaguauuccuuuaugaaagaugaaucaaacaugcuuuuaagcucuuggccuuucccuacauggguuuugugagacagaguuaaacucugcagaaaaugauuugaaugacuguucucaguuuucccugagaggguaccuaccuaguuggcuguagaugcagagagagaaaugaguuccuuacacacagugggugccuuaggcuuagggcauaaucuucucugggagccuugauugagaggggcugguagguaauguggcuuaaauguugcucauuaguuuugcucuuucuuuuuuuccaaauucagcuaaggaguauaacaaguuuuacgcucucucucucuuuuuuucuuguauguucucuggaacauggaauaaaaaggacaaaaaauuggcaaccugaggaagaggacagacaaggggcaugaacaagccacaaccucuaagugacaauaucuguagucagcgguuaggaucaaauauuuuaacauugcuuucacuuacagucaauggugaaacauuuccaaaacaauuuauuuuaguuagaacuucgguuuguuucuauuuugaucuagcaauaaaacauguaagaaacauucccugcagcuuuguuuauaaagagaaaaacuaaaagucugacauugggggauugguuaaauaaaucaggagcuguuacguaggcauugaaaacuaggacaguauguauagggugguuccaguuacguuuauauaaauauuuacacauuuuacauaggaaaacaccauuguuuuaaaaguacacaauuuuauuauuuuaccuaaaaguuuguaaaauuggaugggauuuuuuuuuuuccaaaaaaagcuauugauaaaacuuauuuuaauuuuaacgaaaauuggaauguuacuuuaauugcaaaacacuuucugagccugaaaaauggcucuuggcugguuugaaugccgguuaggcagguuuauuucuugguuacuucagagcugauauauauaauuuauucaaacaaccaucuuccaguugauuuccuucccccccccaaagguuuuauuuaaucuucauuuguuauaagauacagggagaggagagaaauucagaucauccuuuuuuugucuuuaacuaaaucuguuuuuacuaacagcaguaaaauauuuguuggaaaaauggaagcuuaaccugucuagacugugaccuauaccauaaaauguguggucuaggacuguuguggagugucuugggcuguucagggagguuuccuuguacuaagaucuuguuaaaucugauucuaagaauugcauuauguugaaauuuuuguuucuuggcuaaggugauguuucugagauaccuguauuuuaucucuagauacuauuagcuuuuauuagcagaacuacugagauuuuauuguaauauuuuaaaaagugguggauccaguaucguuuuuauaggcuuauuugcaggauaauaguaagauuagaaaauucauuaggauaauauauuuauaauugagugccucauguaguucucacuuggaauuuuggaauagcuuauacuuccugauauagauccuuggggaauuaaaugcauuaagaguaaauauuuuaaauuuuuuauaaagcagaacagcuaauuuaacuuaauggaggguuuucauauuucuugugauaaacuaaacugcacauaguuuaaagaacugucagccacguaggccauauaacagcuauucuuuccaagccuagaauccaugccauagaauuuauguaacaaauauuuaaugaguaucuacuacaugccaggcauguucugcugagugugcaguaaugaacaaaauacagcaaguucuuucuuucaugguuacacucuaggggugaaggcaugcaguuacauagccuuaccuuggguguuugguagguaaggcuaaguagaaaaacaggaagguaagaggcguguagagaaugagggaugugaguggagggauggugucuucuguaagccaucagagagggcuucucuguuagguuccauuugagcagaaacuugaaauaaguggggagugagcuguguggauauauggaggauauuuuagagaagagcuuucuagccaguaugagagcaguaccagaucauuguaagaguuuugguuuucauauuugugagaugggaaacgauuggaauguguuuugaggcugaucuuaaauuauauccauuugucaugcauaugugaagaaauggacggauggaauuacauuauagggagcaacucugugugccacgcauugugauagauguuuacagauccgaucuuagaauuuucauuaauacuguuuauuuuucagaugaacaguuuguuucuaguuuuugccuggaacuuucucauggcguguuugugucuucaguuccacuuagaaugcuuuuucuaaggugguuauaccaguuuaccgcuugcuagcaguggacagaaguucucccugcuucagucuuuaccaccaugugucuuuucauauuugcuagccaaucuagugaugaguaaugagguugaugaccuuuucagauguuuauuggcuacuuggauuuuuguguuuuguuuuugugaaauaccugcucaucuguuaacuacuuucuauugggauguuaguuauauucuaauugauucauaguaaugacugccuuuccaauuauauauuguaaguuucuucccuggucuguggcuugacuuggagcacuuacaguggugucuguccuuugaucaacagacauuuuuaauuuuaacaauuguuuccuucaugguuaguguuuuuugucuuauuuuuaagaggucuuucuuacuacuuuucugaagauauccucuuauauugucuaauagaagcuuuacugcuuugcuuuucacauugagaaucuacauucuaccuggaauuggcuuuguauaugggggagauugaggucagguuucauuuuuacuguauggauaccuaguugucccaucagcauuuauuggaaagagugucaugucuccaccgcauugucaucuuugucauaaaucaggugacuguguaaguagaucaguuucuugacuguucuguuggcuugucuguucuugcagcaaaccuacacugucuaaaucauuaugacuuuguguuaucuugguaccugguacauggugguguaguuuuaguugugguuccucaagauugccuuuauuuucuccuuuccaguccguaugcuguuucuuucuuuuucuugcuuuugauacuggccaguucaagugcugguagugggcaucaggggucaacuuuuaaacauuuaccauuaagugugguauuuacugugaguaauuuuuguauuugcuuuuaucagauuaaggaaauuuccuuauauuccaaguuugcuaugaguuuuuaugaguggguguugaauuuuagaaaugcuuuuucuaaauugauuuaauuaugguaauuuauugaaaagaguauauuuguucuguaaguucuguaacuucaauaaguaauguugaaguuacuuuuuuuugccuucaagcaucuguuuaacaaagcacaucuugcaccacccuuaauccauuuaacccugaguggacacagcacauguuucagagagcacggggcuggggguaagguuauagauuaacagcaucccaaggcagaagaauuuuucuuaguacagaacaaaauguagucuccuaugucuacuucuuuccacacagacagcaacaauccgauuccuuuaucuuuuccccacauuucccccuuuucuauucgacaaaaccgccaucgucaucauggccuguucucagugagcuguuggguacaccugccacacgggguggcggccaggcagagggaguccucacuucccagaaggggcggccgggcagaggcaccccccaccucccagacgggaccgcggccgggcggaggcgccccccaccucccggacggggcggcuggccaggcgggggcugccccccgccucccucccggacggggcagcuggccgggcgggggcugccccccgccucccggacggggcuucugccgggcggagacgcuccucacuucccagacggggcagcugccgggcggaggggcuccucaccucccagauggggcggcuguggggcagagggggcuccugacuucccagauggggcggcugccgggcggaggggcuccucacuuuucagacggggcggccgggcagagacgcuccucaucucccagacggggucguggccgggcagaggcgcuccccacaucccagacggggcggcggggcggaggugcuccccacaucucagacgaugggcggcugggcagagacgcuccucacuuccuagacgggauggcggccgggaagaggcgcuccccacuucccagacugggcagccgggcagaggggcuccucacaucccagacgaugggcggccaggcagagacacuccucacuucccagacggggugguggcugggcagaggcugcaaucucggcacuuugggaggucaaggcaggcggcugggagguggagguuguagccagccgagaucacgccacugcacuccagccugggcaacauugagcacugagugaacgagacuccgucugcaaucccggcacgucggggggccaaggcuggcagaucacucgcgguuaggagcuggagaccagcccggccaacacagcgaaacccugucuccaccaaaaaaauacgaaaaccacucaggcguggcggcgcgcgccugcaaucccaggcacucugcaggcugaggcaggagaaucaggcagggagguugcagugagccgagauggcggcaguacaguccagcuucggcuuggcaucagagggagaccauggagacagagggagagggagacuguggggagacgggagggggagggggagggagagguuacuuauuuuuuaagaaaggcacaguuguaagaauauguuugcuuguauagccgaaggcacauuccguuuuguagguaggugaguuuucagaacucauuacuuguaaguuuuauuuuagauaaacuucuuguuguuggcacuuaguauugugccaguaaugugccauaagaagagacaacuuugguuuuaguucuuuggaaguugucaauaaacauaaaacaguauuucaaggaggaaaaaacccauuucauuguuuuaggcuucucuagauuggaagaaaagaugguaauggucccaaaacacuggggggaaagggggaagaaggugcguggaaucugugauuuggccauaacugcuuuauuuuguuuuaccuguuguuaucauuuuuaguuuaagaaccuuuuagcuuguaucacuugcccuuaucuccagagugaugucucaaucuuuuuagucugucauaugcaauuuuccccccuuaaacuacaacuguuuauuugaaaaauuauaaaaguacaggaaaggugaaagaacaauaugaugaccacuguuuagaguaaucaguuagcauuuuguccuauuugcuuuucucuuuauauauuccuuuuuuuucccuuuucccccugcagaaccauucaaaagugaauugcagacaucaucacaucaauaauacugaagcacuuaucauuuuacaucaaggucauucuucuacauaaccauaucuuuuuuuacacucaagaaauuaacauugacauguaccauauucacauuuucucaguuuuucuaaaaauguccuuuauaacucucuuucaaugcaagagccaaucagagauuacuauggcauuugacucucuuagcuccuuaaucuucuuucaucuaaaauuauuccccgccaccuucugucuuuaugaaauuggcauuuuugaagcguuagaucaguuuucuuguagaacgucccacaauuuggagaugucuaaugaacauaaucaugaagaaacaaacauuuuuggcaagaauacuacguagauagcugguugguggcacaagccuauagucccaguuacuccaaaagcuccgaaggcugaggcaggagguggaguccagccugggcaacaaagugguaagguccugucucuaaaaacacacacacacauacacgcgugauuacauagaugaugaugacuuuccauugcaucacaucaggagacacauaaugucauuuuugucccauuauuaguguugcuaaccacuuguuuaagaugucaagucucuccaucauaaaguuaccuuuaaaugguauaguacuugaagacaguguaaauauccuauuccucaaaagccuuuugccauggaugauccuugccuaaaucaguuauauugguguuugcuaauuagugauuuucuaacaauguauuuauuaguuuauguuuuucgagcaacaagaacucuagcaccccccccuuuaguuucacaauaaacucauuuuuuuguuguuucaaguugagagugaugugauuucuucauuccuuuugauguucaaauuguucuaaauuuggccaaugggagccccuucaagcuggcucaagcaugcauucuuuuuuuuuuuuuuugagacagaguuucuuguugccuaggcuggagugcgguggcacgaucuuggcucacugcaaccuccgccuccuggguucgagugacucuccugccucagccucccaaguagcugggauuacaggccucugccaccacgcccagcuacuuuuuuguauuuuuaguagagacgagguuucaccauguuggccaggcuggucucgaucuccugaccucaggugauccaccugccuuggccucccaaagugcugggauuacaggcgugagccaccgugccuggcuugugcauucuuuuuucauuauuugaucguuaccuugcuuucuggcacaggauguuccaggcuugcccuguaguuugccuuaguccugaaauugacuguuucuuccaagagccuuauaaaauaagaaaugcuuagaaaccaagauauggacacaaguagugcugauugcugcugggguguuaauugcaucaagcagacaguacuaaggaaauauauuaaccuucaauauaccagaaaaagcagucaucaccauuuaccaucuagguccaguggauccuguuuacuguuuauauuuuuaaguaauuuuugcaaauaauuuacaggucuaagaauaaggguuagugaaaaacaauuuuauuggaaaguuuaaucagaauuuaaacacagcaguucucuuuauauuaagcaaaucuugaugcacaaagauuauaagagauuuaagaauacugccacauguccucuuagaacaaugagauuauccagguucuugcaucaugaagucuuuccuguugaaugacugacuggaugggaauauccuauuuccuuuuuguucuuacaaguauaguguucacucacggauucuuaauuuuuccuuauucuaaucagucaacucuuuuuuaacauucacuaaguucagaugcauguaguuuucuuccuccauuggcaugguuucuucuaggacuuaaaacaauacaaagauaaaccauuacagaaugccugcuuuaagaaccuauuucuggugucuucaggguuuuuuucuccuagccucugaccucaagaauuuaaaaaacuuacaggaguagaagaggaaauagaguuuagagaucuuuuauucuagcaaucuuguuuuauuaugguaaacuaaauauauuuaauaaaaucugccauuuaacauuucuuguguguauacuuuucagugacauugauuacauucacuguuagguaaccaucacuauucuuucuaaaacuuuuucgucaccccaaacagaaacucucuacccauuaagcaauaacgcugucauucuccccucccccaaaccccaagucauuuaugacuauacauuuuguugcuuguguuuuuuggugucauaucuaagaauccauugccagauccaaggucuugaagauuuauaccuauguuuccuucuagggauuucaugauuuuagcgcuuauauuuaggucauugauccguuuugaguuaauuucuguauauucauugauuguugauuuugagaaaauucaucuaggauauuuucaucugaaggcucauaaucugagauuuaauuuaugcucucauuucaccaucacgagugucuuucugcgcuaaccaaugugguagccauuaaccacauguggcuauuauacuuaaauucaaaauucaaauuaauuaaaauuaaguaaaauaaaaauucaguuuuuugguuacaauggccacaucucaagugcucauuagucacauuuggcuauugacuguuguauuggucugugcugaugaagauucccuucaucaaaaaaaaaauuuauuggacuucauuggucaagagugcuacuagcucuuuauauucauaaucugauucauuuaauaauugugaaguaucuuuccaucacuuuuuuccucuuuccauuauaggcagaaaguaaaaacaaucugaauucucaacuguguuuauugaaagcgaaaagcagaguacaaagauggugucuguuaucauuuauacugucuugaaagaugaugcaauauccuaggcaaugcaguagacaauggaaggaugauauuuugcuguugauugcauuauccuucugagugauuccauaauucuuccauuuucucauuuucuuauuaguuuuuuuuuuuuagagcguaguuaggaauaguugaucauaaaauaauuacuaaggugaugaugaaauggcaagaugcaggaaaaacauaaucacuaggauccuguaguguaucuuagacuuacaaagccacuguauucauaugguaauugcagaauaaaaugaguuuuuuuuuucuuaauaggaaaauuuucuuuugauuccuuggaaggccucuaagagaagauaaaaggcaugaaauauuaauccuugcaaauaguuagaacuacucaagaaagaaacuaaaaaaauaaaacuggguucaauggacccugacuguauacccugauacuuugaauucaaauccauuaccacaagguucuucuuaaauuuuccccagucuauauuugaaacuccccuucuuucauagugaaaaccuugguucucaacaucugcauuuauucauuugcucuauccuacaauauauacaaaauagcuucagaauuacugcauuaauaccacugccaauggcaaaccugaaguaaaguucaaaaugucuuugcaguuucauuggcuuuuguguaauuaaugcuuuugggguguacaguuaggguacugaucccaaaagucacuugaauuacuuuuuuucugugcaguuauaccuuggauuuuuauuuauauugaaucuuaguauuuguuuuuuaucuuuuucacuuaauugcauuuuaugaauacaugaaaacauuugcaugguucaaaaucacaacuaaaucaaaaguuaucccuacugagguaauucugauucauucccauuccugcucuuacuuaccccuacagauaaacuuuuuuuuuuuuuuuuuuuugagacagaguuucacucuuguugcccaggcuggagugcaguggcgcaaucucggcucacugcaaccuccacaucccagguucaagcaauucuccugccucagccucccaaguaacuggaauuacaggcgcccaccaccaugcccggcuaauuuaaaaaauauuuuuaguagaaauggaguuugaccauguucgccagggugguuucaaacuccugaccucaggugaucugcccgccucagccucccaaagugcuaggauuacaggugugaaccaccacagccggccuagauaaccauuuacauucacuuuugaccuguccuuccucuguuucuucuucaaaaauacauguguucacuuuaucuccccuccauacugcuuucuuauacaaaaggcagcuuauuuugccuuuuguucaucucauuaaaugauaaaccugggaauuacucugguucauagagauauuccucaucauuuuuuuuuuauuuuuuuggagauggagucucgcucuguugcucaggcuggagugcagcggugcauucucggcuccgccucccggguucaugcuauucuccugccucagccaagcuaauuuuuuuuuuuuuuuuaauuuuuuaguagagacgggguuucacuguguuagccaggauggucucgaucuccugaccucgugauccgccugccucggccucccaaagugcugagauuacaggcgugagccaccgugcccggccuccuuaucauauuuugugguugcauagugcuuuaugucugugucaucagauauucagcugauaucuuauugaugggcauuugguguuuuuuagucucuugauaguauagauaaugccucaguaaaucacuuuaugcauauguuguuucucauuugugaaguaacuuuggguaaaguccuagaguuggauuacugagucaaaggguaaauuuguuuagcuuuauccauauuuauaaccacccucucaaugaacuauuauguuuaauuuaauuuauaaugugaaauaaaaauacauaagagaaauagaagaauauuauaucugaaaacuaggaauuccuugaauuggcuguuuccugugaucuucauugccauuuucccaguuaccauuuuuuucuuuucuuuuuuuuuuucuuucuuccuggguucaagugauucuccugccucagccucccaaguagcugggauuaacaggcacccaccaccgugcccagcuaauuuuuauauuuuuaguugagacaggauuucaccauguugaccaggcaggucucaaacuccugaccucaggugaugugcccuccuuggccccccaaagugcugggauuacaggcgugagccaccgugccuggcccaguuaucauuucuuacaaaagaggcaguaauuccuggcuggccuugguaguuccacuuuguuccucuucugucuauuucccagaguagucuuuuuuuuuuuuuauuuuuugagauggaguuucgcucuuguugcccaggcuggagugcaauggaguggucuuggcucauugcaaccuccacauccuggguucaagcgauucuccugccucagccucccauguugcugggauuacaggugcccgccaccacacccagcuaauuuuuguauuuuuaguagagaugagcgccauguuggucagucuggucucaaacuccugaccucaggugauccaccugucuucggccucccaaaauuuuacaggcaugagccacggcgccuggcccagaguagucuuuuuuuuuuuuuuuuuuuuaagaagguccaaaucaauaggucuuuuauugcaucauugaaauaucacaaguaugucuuaggagucaucuggcaucuucuuucuguagcuggauaacucuuagaucugauucaucaaccugcugaacaguuccuuuuucagagacauagauaccauccaaaaauuuccugauauccuuguuuuuaacuguuguggguugcugaaucaaagcugcugaauuugaaacaagcucagugucauuuccuucaaggauuaauucaucuuucugggcuugagguacugaacaggcaacaccuggucucaucugaacccugcggauguauuuuucacccaagaaauuucggauuucaacaagagacccauucuggauaacgacguugaugggggaagugagcauacacagaccucaucuuguaauggaagcccaguguaacacccuugaucauguucuguacaugacuacaaauaguccgaacgguagccaguuccuuucuguuacccgaccauuugucaacccggagccucuuuuuuuucuuuccaaggagucugaguucuacguugaugugauugaaguccuuccgcaggguuccucuggggcccuuuaugauaacugugcgucccuucagaguaacguugacauuuucuggaaugucaacagucugauugcugagaauggucuucauucucacaguaaacgcagcaaaaaaaaguggcccagaguagucuuuuuaagaaugcaaauuggaugaugucauuuugucauuuuccugcuuauaauucuuuuggauuuaucagcaggaaaaccguaaaagaaauacaauuuauguuuugaaauuuuaaaauggauuccaaguuucuguugacaucugcaacuuuucuucuguuuucaugaauguauuaaucauaaagucuauuauauuuuauaaaugcaauaugucaaucaaaugaaggucugcuuuuauuccuuccccuugguuucuuuauagccgcuuuuguuuuuauagauugccuuguaccuuguaauuuugaacuggaugccagauauuguaacaaaaaauucuagggauucuggaggggguuaagcuuucuuuuagcagccagaguaauccuuauggaguauguugucuguuucauaaauuaugugauuauuuguguguagcucuguuucucuauucuguuccauuggauuauuugccuguaauugcaccaguaucacacucuuacuauuuuagcuuuauaauaggucuugauaucuaguaguaaaauuccucuagcacuuuguucuucaagauugucuuuacuauucugacccuuugcuuuuuuguauauauuuuaggaucaccuuuccaauacucaaaaaauaacauuacugggguuuugcuuggagugcacuggaucuaaagaucgguuugaggagaauuaagauguuuacaauauuaaguuuuaaaaucuaugaacaugguauaucaauuuauuuacuucuauaacuuuuuaguauuagcuuuuaaaaguauauaaaucuucauguguuagauuuauuucuagauacuauuuuuuguugccuuuuguaauuuacuugcuauucauuuuuuuuuuuuuuuuugcugguaacauacuugauuuuuacauauugacuuuguucuaaaauuuuuuguuguuguuaaaaaauagagaugaguuugcuguguuggccagacuagucuccaacuccaggccucaagugauccacccgccucugcuucccaaagugcugggaccacaacaagugugagccaccaugccuggccuaaauuuauuugaauucuaauuacuugccuguacauucugauaguaucuguguaguuacauacaggcauguuguuuguaaauacugacaguuuuauucauuccaguucuuaaguuuuuuuuuaugguuguuuguuuuguuuuguuuuuugcccuauuguaugggcuagaaccuuuaauauaauguaaaauaaaaguuaggacauugggcuuuacauaccaggagggcaguuuuaaguauuucaccauacagauguucguaguuggcuuuuuguagcuacucguuaugaaaauaaggacauuuucuccuguugcuaauuuuaucauuaauggaugcugaauuuuaucaaauguauuuucuauguuucuugagauaacaauaugguaaauuacuuugauucuuuaaaaauauucaaaugccauugcauuccugcagcaaacccauuuguagaggauguguuuaccuuguuguauauugcuagauuaaauuugauaauauuuuauuaagguauuuuguucuguuacaugaggcaaaauucuguaauucuuucuuuucuuuucuuuuuucuuuuuuuuugauuaacucuaccagggugcugcggcucacaccuguaaucccagcacuuugggaagcugaggugggcggaucacgugaggucagggguuugagaucagccuggccaacauggugaaaccccaucucuacaaaaaauacaaaaauaagcugggugugguggcgggggccuguaaucccagcuacucggaagguugaggcaugagaauugcuugaacccgggagguggagguugcagugaguugagaucacgccacugcacuccagccugggcaagugagacuccgucucaaaaaaaaaacaacaaaaaacauuaacacuaccuuaaaccuaugauuuucuuuucuuguaaugucgacguaaggauuuggcuucagaauuaggcuggucucaugaaacaacucccauuuuuguauauccuauaaaaguuuauacacuguuguuauugguuuuuguguguguguuuuguuuuuguuuuuuugaaacagaaucucgcucucauccaggcuggagugcaguggccaauccuggcucauugcauccuggaacucccaggcucaggugauccucucgccucagucuccccgaguagcuggggcuauaggaaugcgccaccaugccuggcuaauuuuucuguauuuuuuguagagacagagucucacuauguugcccaggcuggucuugaacuucugggaucaagcuauccaucugccuuggcuucccaaaaugauggacuacaggcuagucagccacugugccuggcucguacuguuucuaacuuaaauguuuggaagaguucaucaacaaagccgucugggcccaauauuuuucuuggacauuuuguauggagauuuuaagauacgaccucaauuucuuugaaaguucaaagacuauccagauuuucuguuucuaguuauaucauuuuagaaaaugugauuuucaaggaauuguccuuucuaaguuuucaagcuuguugucccuccgaguuaucauaauauccuguuaucuuuuuauuaucaguagauuugguggugauguccucuuuuuaauuacuguaauuuuuaauuuguggguuuuuuccucccuugauuucucuucuuaaggguuuaucaauuuuauauuuuauauuuuugccuuugauuuuuuuccucuuuucuaagucugcuuucuacuuuacugauuucuucucucuuuuuuccuguuuaagauuuuccuuugccuguaauuuuucuagcccuuagagaugaugguugagguuacuaauauuaaccuuuccuuauuauaagauaugcauuuugagcuuuaaauuuuucucuuaaucauugccuuagguacugcacacauuuuguaugucauuuuccuuaucagucauuuaaaaauaguuucuaauuucuauugugauuugcucauugacccauaaauuggaaauacauuccuuuucaaacauuauuuucuacuuauuuuucuguuucucuaguguggucagaguacacauucugcauaauugaaauuuaagucuugccuuuugaccuaauguuuucuuuuucuugguaaauuuuucauaauuuacuuggaaaaaaauguuaauccugcaguuuuuggguucaguaugugucuguuaguucaggcugcuugaauauguuguuccaguauuuuauguccuuguuaauuuuuuugucugcuaauucuaucauuuauugagauauguauuaaaauagucacuaggauuauagauuuauuuuucucucuuuuuuuaaccuuugcuuuauauauuuuacagcuauguuauucauuguauacaaauuuaaaauuguaaaaacuuccuggucaguugaccuuuucaccauucugagauauuuuuaucucuaguaaugcuacuugccuucaagucuccuuuguuggauauuaguauuaguauggucacaccagcuaaauuuguuuguuuugucuaucuuuaaaaaaaaucuucuuaacuucagucuuuuggguucgaagugugucuuauaaacagcauauuguugugguuuuaauauucagucuagauaucuuuuccuuuuauuuagaguauuuuaagccauuauauguaguaggauuccugauauauuuaauuuuaucaccuuucuauuagacguacauuguauuuauuuuuuauucaaaaaauuguaguaaauauaacaaaauuuaccauuuuaauaauuuuauuuuaagagacugugucuugcuuugucacccaggcuggagugcagugguauggucauagcucacugcaaccuugaacuccugagcucaagugauccugccugagucuccugaguagcugggacuacaggugcaugccauugggccuagcuaauuaaaaaaaaaaauuuuuuuuuuuguauagacagggacucacuauguugcccaggguggucucgaacuccuggccucaagcggucguccugccuuggccucucaaagugcugggaaauaggcaugagcuaccaugaccagcccauuuuaaucauuuuuaaguauacaguucaguggcauuggguauauucacguuguugaucaaccguaauuaccauccaucuccaggccuuuuuuuuuuuuuuuuuuuaaaucuugcaaaacugaaacucuguucauuaaacaauaacucucuauucuuccccuuccugaucuggcugccagcauucuauuauacuuuuugucucuaugaauuugauuacucuaaguaccuuuaaguggaaucauagaguauuuguccuuuugugauuggguuauuucacuuaccauaaugucucaagguucguccacguuguggcacauaucagaauuucuuccuuuuuaaggcugaauaauauuccauuguauuauagaauguauuaugcaguguauuauacguuuuuguuuauuuuagcauccauggauacuuggguugccucuaccuuauggugauuuugaguaaugcugcugugaacauggguguuugguuuaaguaucugcuuuugauucuuuuuuuuuuguuuuuuuuuuuuuuuguuguuuguuuugagauggaguuucacucuuguugcccaggcuggagugcaauggcacaaucucggcucacugcaaccucuaucuccuggguucaagugauucuccugccucagccucccaaguagcugagauuacaggcaugcaccaccaccccuggcuaauuuuuuguguuuaguagaguugggguuucaccauguuggucaggcuggucucgaacuccugaccucgggugauccacccaccucggccucccaaagugcugggauuacaggcgugugccacugcgcccggcugcuuucgauucuucuggguaugcucagagguggaauuucuggaucauaugguaauucuguguuuaauuuuuaaggaacugccacacugcuuucuccggugacuguaccauuuuacauucccggacaaauucacaaggguuccaguccacauacugggcaacuuuuggcauuugcauuggcuguuuuuguuuucuguaaggaccauccucauuacuggagugucaaaugguuccccauuauaguucuaauugauguacuuuuauguucuuuuuucucugcuuuuuuuuuuuccuuccuuuggaucaaacauuuuguauuguuauuuccuccuauuaacuuguuugugauacauuauuuuuuacuacuuuuauacuguacuuaugguuuaguacuaaauauaauauguauuuauaguaucuuuuuuuuuuuuuuuuuuuacaauuccuuuucacuaaguaagucucuggugucucuagagaucauagcauucauucauuuauccagcccaccucuugcaugauugcucccaugcauuuuaauucuacguauuuuaaacaccacaacacuguauuuaauuguucuguguggucaauauugauuuaucuuuacccaucuuuuuuuuuuuuuauccuguaccuuuacucuucaauucuuucugcauuuauauuacucugaagaguccuuuuuguuguuguugcugucuuuuuuuuaaccgaucacacuuauuuaauaacaauaucuaguuuaauaauuuuuuugauaagacauuuuauuaacaacaugucuaguuuaauaaaccguauuucuuuuaaugaaagucugcuggugcagaauucuguuucuguugaaaauguuauuuuuuccuucauguuggaggaucuauuugcuguguaugucacuauagauuuucaguuauuuuuuccagcauuucaagauacucuguuaucuuucacuuucugucauugauguugaaguuagcucuagcucuaagucuugucacuccuuugaaggcugugaaucuccccugugccuccuccgccuacccccagcugcacauaaaguuuucccuuuuucuuugguuuucaucacuguuaacuauguugugccuugaaauuuucuuugugcuucucuugcuugggauucuuggaguuucuucagucuaucggcugauacuuugauaucaguuuuagaaaauccagaauucaagaucuuuucaauauugcuucugcugcauucucucuucccuuucuggaucuugcacuuacacuguguuucacaugucucuuauuggucuuuucuguauuuuccauguuuuauuuuugaaucucugggcuuuaauuugguguuuucuuuugaccugucaaguucaaaaauccugauuucugcuguuuaaucuucuuuuaaugccauuuauuuuaauuuuugguucuucaguuguacaauuuucauugguuucuuccuguagauuucaguucucuagugaaaauugcuauuuuuaaaauauauuccuuuuaucuuuuccucuauuuccuugaacauauuaaucauuauguuuguuaacaccaguaucuagauugcauguguguuugguucuguuuuauauauuuuuucuuuugacuuuuggucauaugauccuguuucuuggcauccuaguuauuuuugacuaaauccugggauugugucuuuaaagauuguagauauuccugaaggugauaacuuccucuggaaaaggcgcguccuuucuucuacugaagcagaugcagugggagcuggucaccuuacuccgggcaggugcuggguggagugaaggccagguuguuguuuuaguaagccaucugcugcuucugguuucuucaggcuuucaucuggaagcuugauuuugcucacuacaccauauuuccuuggaggcuucugaacuaauuuuuguuugauccugagcucugcuuuucagaguuuuaguuuaucuuuuuggccuucgcagcucagaauuugacagauaccaugggagggaaagcaguuguaugcuuaagaccucucuugugcucucauuuuacuaccauauagccuugucagacugcgcaaguucugcuuguuucuuucugcuagccauggcugucuccucagggcccaacauaauucucagccucuugccugugccuccuguugucugagaaaaaaguggcuucagaugaucagcucacuucuccacaguucuccccucucugaauccuuggucccucuuguccucacugcuuuggcagcucuugggugccuuuaaagagauaauuuuuguauuuaucugucugucucuucuacuuucugagaguuacaagcuuuuuuuguccuacuuggagguauuacgcaagucuagacugaguuuugaauuuacauagcuacuugcagugauuuagugugauuugagauuuuuacuacagucucacugacaguggugguuucuuuuguuuuuguuuuuuguuuuguuuuuuuuuuuuuuuuugagacggaguuuugcucucguugcccaggcuggagugcaauggcgugaccuuggcucacugcaaccucugcuuuccggguuugauuuuccugccucagccuccugaguagcugggauuacaggcgccugccacaacgccuggccaauuuuuuguauuuuucguagagauagggcuucaccaucuuggccaggcugaucucaaacuccugaucuuaggugauccaccugucucggccucccaaagugcugggauuacaggugugagccaccacacccggccagugguguuuaaaauaaaaauguacuucuuuaauuaaugcuaaauaagauugcuuuaauuugacuuuuuuguuaccugggaguauauuuuccuguuuuuuuuuuuuuuucuucuacuuguauuuacucuucaguggacuguuuguuuccuuugagccuuucacaggcacauucuccuccuaaccuguguggcaaguuugcuacucuaaaguuuucuuaguugcaaaucauacagaugcuuaggaaauuaugaaauaauuuacuguaagaagucaggagggagucaaggguaggaguuuuuugggucucuguguuuuguuuucuuguacauuuauguuguuuccuguaccagcugcuuuagaugguugguuagcuugugcagauccuauaguggucuuucuuuuaggaccagaaucuguaaucaccucaggcucugauguccaaaguaaaugagguugguccaguuagcagcagguaucuauccucucccuuuauuguggcuacagacggagaaaugggauucuuuacccauucuuuaugggagaagggcaggguuucuacgaggaaggcaugugaauggagaagaaaugauugauaaucucugauaaaacagugggcaugcaagguggaauucaggcaguauuucagauucagaaauguaggucacaauuucuuaucugcaguucggaagccugaaaagcacugaaaacacaguuauucuuaaguuuauggcauauucauuguugacaaaacuggaacuuauaugggugaggcauuuauuacauuuugaauauucauauguuucauugcaaauguuauguuuacuacauggcccuaccucauggagcuuucagccagaacaguuagaguuccuggaucucuaguucaagucacccccaaaacccuccaaacauguaaacgucuucauucuuagaaguauuacugaauguaugugucaccacucuuaaaauauuuccaauaggagaaaacuguaauagaauacuuaagauagugaguaaugauuacugaaagaaaaaaagagcccaguuuguagguaaagccaacaagggagggagauguauagugccagagcacguuagacauaguccgauauuuguguaaaacgagacuagauuggcauacaggaaaaaaugcuuagaagccuguguaggaggaaucuggcuaaaacauaaagguaaagauuaaggagacuuuugauuccaucuuagcuaacauuuuaaauaagaacauguaaguguuuucagaaguggcuccauauaauuggacuuagcuuucauuagcaguuuugcuuugcagcauauuuggaacauaauuuguuuaaaauugaaaugguuuucuuuacuuuuauggugguugauuuauuuauuuauuuauuuauuuuuggggacagggucucugucugucucccaggcuggagugcaguggugugaucucggcucacugcaaccuccaccuccuugguucaagcaauucaagcuaccugaguagcuggaauuacaggcaugcaccaccacaccuggcuaauuuuuguauuuuugguagagacgggguuucaccauguuggcuaggcuggucugaacuccuggcaucaugugaucuacuggccugggccucaaagugcuaagauuacaggcgugagccacucugcucaggcuauggugguuuuuauacagcaacacucaguuuauuacaguuuaucccagugcuuauugcauuuuuuucuguuaggaaccuguagucaauuccucccuuauuugcaaagggguuuacuuaaaagauuuguaauuuuuguaaauuuuguugaaaguacacuauuuguauacuuugguaaugauauuuauacaucuacuugacaaaucuaucuuuuaagaaauuauuuucagcuuuuaaguaacugucacauaacauguauguccaguauccauuggcuucagcucccacugauacuauuuucuuuuugacucagcagcuuuaaaaccaaaauaguaagaucugucuugaagccacagucuagcaggagaagcaaacuauauaaauuuagacagcucugauuagcacaguucccaaacuguuauauuaugcauuaacccauacaggaagaauuuaaaauugcaguauggugagacaaguuuuagaagugaagcauuuuugagaaaaguaucaaagaugaagaaguacucuugaccuuuuaggcuuucuguuccagucuaguuuuaguguggcauuguauuuaacuugccuuagaaacucauagguuuaugcccucuuguggucugucaccaauauaaauagcacaaaugaaaauuuuaaguacuggagaucuuacugcauguuacugcucuccuuuauaaaauaauuuuuaaaaagcagcuucugaggaacaacagcuaagaaauuauuauuccugucuuccauauaauguguggagcuuaaaaguuaccaaauguuauuuuaacccuugguaacaaaauguauguguauguuagguggacacuaaugaacagaaaaauauuuuuggaugggcuguccaucauuguccuucuaggugucuaacccuauuaauuuauaagugucuuaaaaauaugaugaggugugauaguaauuguagggcuagcacauuacccuucuaccuucaccuaaacauacacagauauacuaguaaaugaugcuugggaaauguguuuauacuuguuucaucugaaagggucaggagcuguaggaggcauuggaagaaauaaggauuauaauguuagugaauuggugaacuuaagcuuacagaauuugcuuuuacugacaugauuggcaaggucuuauuugugagugugggacugaggaacuaacuaguggaggagaaacagcaauagcagucaguguuuuaagacugcagcuguaaccaguguuuuucugcuguuauccaguaagccgcaugaugguuggaagcaggccaguauagggacugugcacuuuaggauuagauagaaucccugauagaaagacuugguuuuaaaacuggucucaucucuuaccaguuccuggacaguuguguaauauuaaguaaguuacuucaucucugaauacagguuuccucuccaaauaaagauuuaaaccgccuccauugaacucuuugcaguucguuuugucacaugcaguguuggcauauacuccuguuguuauugcucauagguuaaagacaguuuuguguugcaaagaauggauaccauaugacuuuguagccacuggguuguugguaaagacuccuaaauagugguaaaucagcucauaguucuuuuucuuuacuguggacuuacugcuguacuucuauguagguacauacuuuauuauaaauucuugaguguaaacgaggucauuauguuaaagaauuuacuaguucagguauuuuaaaguugaagccuaguaacuauuuuuaagaaaaaugaaaauaauacaauaaguuuuuuuucuuuaggggcacuauuugcauguuuuggcagguuuaaaaaauaaacaaaaacuaguuuuguucuuccauuguggucuuacuuuuguggaggacaacaaaguaaugaaauguuuuuguuucuuuugcuguguuuuucaaguguugcuuguagaacaaggcucgcugccuuaugguuacuuuuaaaauuuaauacuuaaaguaauuaaucugaguccccuuucaggagaaauaagauuauuuagaauaauuuaacuuaagggaaaaauauuuguuuuuauaacaccuucuaaaauuucuaaguuguagaaauuuacuaauuuuuucuuuuuuuuuuuuuuuuuuuuuuuugagauggagucuccuucuguuguccaggcuggagugcaguggcgcgaucucggcucacugcaagcucugccucccagguucaugccauucuccuaccucagccucccgaguagccaggacuacaggcaccugccaccaugcccggccauuuuuuuguauuuuuaguagagaugggguuucacuguguuagccaggauggucucgaucuccugaccucgugauccacccaccucagccucccaaagugcugggauuacaggcgugagccaccgcgucugaccaaaauuuacuaauuuuuucuuuugaauaacuugcugugaaauagaagacaacuaaaaaaaaaacccucuaaauauaauagaacugcuugggcuuaaaucuuuucugcaaguagguggaccauaaaucauauaaacaaagauaaccuagacaugccaucagaaggcuagucuauauauuuuuauaucuaccucuuucaucuuuccccuuauuucugauuucccaaaugucacuucuuuaguuuacauuuggauagugcuuauuugaagucucugauauucuacacacuauauguaacuaauaaagacuuuaaaauguaaggcagcauuuugguagugaaaauuucucuuguacauugugaaauggauuuuguuguucgucuaucuuccuagggagacuguuuaagggaaguaaaaggaacagggcaagaauggccggaacgaaguggaggguagacuauggggagugauggcaagaacacaugccauucuaccagugacuuguuucuuaaacauaaaaagcauaugugccaaauuugcauauuuacuaauuaaaaaggcuuccuggaaacauuagguagacuaucuucuauaaccuuuaacaccgucacuaauggauauagcuuagaagauuuccucgaagguccuuuaaauaauguaaaugauuaugaauguguaacuaguuaauaugcagcuacgaaaggauuaucauguagagguuaaugaacauucugcucuuaugguuugcagggcuuugcuuucugugcuuuuggcucucuucaugcuuggaaacacaugcauugggauuggaaaacauccugacuguucuugggucucaucuuuuaaugggguuguuaaauaggaacuuuaugaaaaggauuucaugagcauuuuuuuccuuuuucaauuuacauuuaauucuauuugucuauuuuguaauuacugccaaaucagaaacagugaaauggauugauguaguuuuagcuuggcucuuccagauguaaagucaguacucuauuauauauugccacuguuauuaaguguugcuaugugauugauacuuacugagagaucuucauucuaaaauggacuuuuuaugcugaguuaauguguaguaugguuggguuucugauuauagcauguauuuugguacagaauuucugucuuaguauuuaaaaugucccaaaagaggacauuuauuucaggaauuaaauguuacaauagaggaauuuagugacaggucuaaaaaaaaucguguguauuuuuuuuuuuuuuuuuuuuuuuuuuuugcugggacgggauggugaaacauugagcauauacaagagacaauauugguauuuagagcagugaacuagagcagcguuuugcaaaccagauaaugcugcucucuuuuucucauggccuagucuuaagcauuuuggcuuucauccccuaguuucucugucucuaaaaugguauaugguauucuagacugcuguuuaaaauuuuuauuaauagguaauuuaaaaguagauaauuagcaauccuugaaaacaguguuaauucuuaaauugucauucaaaaauaguguuauuuuuuuaaauugcauuuuucuuuauugucuagucuucuuauuuucugagcauuuugagaaucuacugacauaucuccaaggaaaacaaauaacuuuuguacuuaaauucauuguuuuaguauuauaaacauaguuuaaacuggcugugaagugcuuacagucuugaucauaauucacuggggaacaaaugagcuguucagagcaucuccuuaucccaaguauuucuucuugaaaauguaguagaaaaauaucacugaauucauuuuuuaaugcgucagaauaaaaauuacaggugaaaauguuuggagauauacugacaaaauaaaauauugucacuacagucauuuuuuuuaacugacgaaacguggauguuacauugguuucuuguuauuuauaacauuuauguauucuacaaaauauguaauauugaaaacaggucuguagauuguacaaaauacuaguuaucuuauaucauaugucaccuaauaguuaugaagcggguuuuguaccaaaguaugaaucagaaagcuguaauuuguucugcaguuaucagccugcauuagaggguuaugauaaagugugcugcuuaaaaacuaacguucacaucucugugcauuugacaaauaaaaauguauacugagaugcuauuaaaucuguaaagccaauguucuaguuuucagauacacugauuuuuguagcucugugcauagcucuguuuuuucaugaguaguuaucuguuuucaugacagguggucacuaacugccaagagagaauccagcauuggugagugaaagaugguuuuauuacacuucugaaauacugaugggguaaccuacuuguguucaaauaauguguuuacuguuugcguguguguguauguaugacuaguaauugaauucuucuaguagucuccauuuugaaugccuuuaauacuaauuuauauugucuuugacccuuuucugaauuacacauuucugauuuccugacguuguguuaccacuuguauuuauucuaagugccuuuucuuuucuaagaauaauauuaauaucauuaugaauuggagacugagacauuuuugaaugugacuuagcucuauuuuggggauauuucuuacauuuuaguagaaaaauaaugggaaucaguuacuuuaaaauaaugauggaaauagggcacagaaauguuuucccaaaguuugaaaaaaaaaucuaauuuucuacuuuucagagcuuguuuuauugacuguacuuuuuuuuuuuuuaagagagagcauaucuauuuuaaugugcuaaucuauaguuaauaggaccauguuugguaaauaacacacuuuccuuuggcuucugaggaaaaugcucgauuuaauggugaauaaaaucuuauauuaugaguugucaugaaguauagcuguugaucuuacagauaucaaauuacaauauauccaugcugugcuuacgaagguuuuacugagagaacaacaggagcugucuugauuauugucugcaggguuauugcaaaaaucaugguaacugccccuuuaguggugagauuaaaccuucgguuauacaccaucaagcauauaauauuuuaaauuuauuuuaagaggcuuuuucuucaugccugagagaucuccaaggaaauaauuuauaguuaguguauaucaaauguuuuuugguuuaaaugcacauaggcugcaggcaguggauaagagugaaaauuggugcaaucuguacacaucaucuuauuaaauuuugacuauuggcuugcagaaaauaaucuaaaacuaauaauauccacuuuauaaguaaaaauucaggacuucauuaauuuucaauaaaugcaucguuguaguugcuuccacuggugguguaaguguguuagcauuuccauaauggaccauucgccuuucauuauacauucaguucagguuaaaacuugaaauacaagucguuggccaaagaauuuuuuccccugcacauuuagucagaguggcccauuuuacaaauaauuuccagaggaaguuuauuaacguggacuucugucuauugguuuugguaagaaguucaggaaauuagaaagguauucacuggaaauagaugcuaguuuacauaaaugggugaaugguaacuugcuucugguuuguuuuauaagauucuuauuagaguucuuuaaggauaagggcacguuuucauccuuuuauucacagccccuacugcuauguuuggcacaaaauaggcacuugauaaauguuugaguaaaugaccaaauaugugguuauuuucuauauaacauuuuaguuuacaaauacucuaguagugcacaagucuagugagcagugacagaaaugugacauuuacuucauggcagguucaugugacccucaauuucacuuuucaguuuuguaaaacccucuaaacuguagaagcuuagcauauuugccuacacauaucuugaaguaauauaguacuuuauacauuuaaaaaauuauuuuuuuccaguuaaaauuugcauuuuccucugaaucauuucugguuugguucaggaaacagacuuuucucuuugcuuuuaaugaagaucuauacaugguauauugcucaaaucugaauggccaguaaauuaaucaauucauuauaucaaaaaauugaaaccaaagugucaccauuucccugaaagcaaggaaauugcuguuugggagagucguggaauucuugugauauuuuugcauucucuuaauuccucaaacaauaguugaguuucuaccauaugccaguauugugcugcuguuuggaauugaaagacccugccauagaagaauucauagccagacauauaacagggaaaucacgauaauuuugugcuauuugcggagauaugaagcaacuacaggaguucagaggcuggagccguucuuagggugucucacacacuacuuuuaaaagcauguugcuuuaauuccuacuuaacccuugguauuagccuagucuaaaauauaauuucuguuaagccccuauucuuuaugaguacgcaccaguauaguaaagaagaacaaaauauaugguuugaaaaaugcauucuuaugcuggugauguuuaugcuuguuuguauaauuuuuaagggauucuuuaaggaacaaguauauguauucuaggcucagaaauaaucuaaauugguuuuuguuuaaaaaaaaauguaggacagggaguaaaaauauuuauagaaaaauaggagugaaaauggucugggaccacaggaucuacccaaaaaaaucuuugagaaaauuaauuuaaauccuagaacuuuggugaacgaagaaauuuauaauauuuguuuaguuaauaacagauaaaaaggaaagauucaagccuauuggaugagaauuuguacauuauuuuagagcuaauaauaaugguuuucaguuuagugaggauuuaaaaaauguuuuugaaucaaacuuuuuuucuuuauaauccuuuuuaacuaacucaggaaauaagguauuaugaaauccacacacuguuaccuccuuaaaguaugaggauacuucccacuguuugguccacuaguggcugauuauuuuguuuguggauuauuuguaauuuucuuuuuaauucuuccuuaaagagcauggcauuuggagucacagaccuauauuugaauccugucauuuacuagcguuuugaccuugaacaauuaugcucagagucucaguuuuuucuuguaaagugaugaugauacuacuuaacucacaggguuguagugaagaucaaaugagaucaugucuguagaacacccugcccggcacucaauaaguauuaauaggaacccauauaccucuuuugaaaauuuuaauugucagacaaauaaaaaaaaaagccagugcuuuguaaauauucgugaauauuuaguguucauucuguuuuuuugucaugauggagagagaguuggguuucugugaauuacuguuacagcuuuacauuaauauuuuuaaaucacuuuuugguaugaagaauuucaaaugaaaggugauagaguaguauagugaauccucauguacucaucagucggcuuugauaaucaucaacucaugauuuucucuaaacuguucauuucaacaucuuaucuugccaucuacuccuaccuccaauuuuuuuuuaacuuuuauuuuagauuugggagguacauguagagguuuguugcaaaggugcauugcaugaugcugagauuugagguacaauugaacccaucacccagauagcauaguacccaguaggcaguuauucagcccuugccccugcccuuucucaccgcucuuguauuccccaguguuuauuuguucccaucuuuauguccauguguccccagugguuagcucccacuuauaagugagaauauacaguauuugguuuucuguuucugcauuaguucgcuuaggauaguggccuccugcugcauccauguuacugcaaauauuucuucuuuuuuauggguguguaguaguccauaguauauauguaucacauuuuuguuauccaguucacuguugaugggcacuuggauugauuccauggcuuugcuauugugaucauugugguagugaacauacaggugcauguaucuuuuuggcagaaugcuuuuuuuuuuuggguggucuguauucaguaauggauugcuggguugaaugguuguucaguuuaguucuuucagaaaucuccaaacugcuguccacaguggcuggacauucccacuaacaguguaaaagcauuccuuuucuuugcaguccugccaacaucuguucuuuuuugacuuuuuaauaaaaacuauuuugccuaucccaucuccaguuuugaaaugaaucuaagccguaucauuccaucuggaaauauuucaguauauaucuuuaagagacaagaaagacuauauauuaacuuuuuaagauuuaaauaaaaaauauuuaaugagacaauacauuuacauguuucaaaauuuaggagguaugaaaggauguaaaugauguauagguuccuccuaacuuuguccccuaauucucaguucuguuuacuuuuuuuuuuuuuuuuuuuuugagauggagucucacucugucauccaggcuagagugcaauggcaugguuucggcucacugcaacuucugccucgcggguucaagcuauucuccugacucagccuccgaaguagcugagauuacaggcgcgugccgccaugcccagcuaauuuuuuuaguauuuuaguaaagacgggguuucaccguguugcccaggcuggucucgaacuccugagcucaggcaaugcacccuccuccgccuccuaaagugcuaggauuacaggugugagccaccgcacccggccccucaguucuguuuucuggaaacagcaguuuuuuaccaauuucucauaaaucuuuucagaaaugguuugcauaauguaaguguuuguguauguauguguguguguuguguguguguauucaucuacauguuuauauacggcucccauccuuuuggacaaaaaugaaaucagauuguaccuguucauuuaauacuauaccuacccuguaucauuaacuaacaguuccucuuuaccucauuccauacauuuugcuguaugucagacauuuaacuuuuaggauuacuaaaugagaccuggaacuauuuuuuuuuaaauaaauaauugcuacaugacugagaguauagcucugaacucaaaauauauccuugcuaagaugauauaucuguuauuuuacugcuccuuaguaaaauuacugcaaaacuuaguggcuugaaacaaccaccauuuacuugcacaugauucagugggugugcauauuaagcugggcucaccugugugguucuucugcuagucuugugugggcucacugcuuugguugcagccaguugguggcugggucagcuuuguuguccagaaugaccucacccucaagucuggugguuagugcuguugguugagccucugccuccaugugcucuuuuguccagcuuacuuucuaugggcaucucagcagcaagaauggaagcugcaaggccacguuauguuggucaaaggaagggccagcgcagauucacaaggugggaagauaacacccaccuguugagaggaggcgugaaaaagaauuaauggucauuuuuaaugcacugcaaugacuuuauugaauagguccuacacacacaaaaaggaagucuccguccuuuauguugacuggugagaaugaaaugaaauaguacaugugaugccuggcaguucaucuuuauguuaggcauuacuuacaaucguaaaucguaugcaugugaguuguaaaaaauuuauugccuugcuuccuuuauuuuaaaaggauuuuugguaaagguaucuuugaaauuacaugaaacagacuuaaauauagaagaagauacuuuguucagguguuuaauuuuggaaagaauacuuuaaauuuagacauaaaaguucuaaaacacuuuggcaugugaguuuugagagagucuaaagcaaauacucaacauuuuuuuauuuuucaaaggaaacuggacaaaaauaauuguucagaggaaaagaguaacuagcuuccauuagaauuuauaguuaaaguauauaguaggaaauaaccaagaaagcauaccuguauagcuaaaaaucucaggugaagauuugauuuucucucucucuuuuuuuuuuuuccuguuggagcuacucuuuccuaucagucgggauggagauaccugcuuuaugcacacauuguauaucugucuauaugucucauguuuuugaggcauuccuugugcacagaagcacugaacuauaucauuguaacaaugccaugguuuacaguauauuucauaugaauaccugaaacuguuuucuugaguugccuucacaugcuauauaaaauuuauuuuauuauguauaauaugugaaauauugaucugcauaccuuuaaaacuuguaaaagccaaugacuuuuuucuacaguguuagguagauuuguaaacuguguuuuucagagucuguauuuuacugacuacaaaguuuucagucacuguuuuguagagggccuucuguuugggcuuuuucuuuauguuauuuuuucuuuuuuuuuuuuuuuuucccuccucuugagcagagagcaacugccaaacuuucuggaaauuuugcauguuuuuguuguuggaguuucuguaguuguuuaugaaagucuuagggauaagggggaagaaucauauaugucaaaucuugucauuaaguuucugcacaguuuuaaaaaauggugugaguuaguacaugcgcuagugauuaagugaguuuggaacucguguguaauguuucaaagcaaauuaagaggcaaaaaaaaagauucaaguugaauguuuaaagaauuuuuuuuaaaucugaguuagguuuuuaaauguuuauucugaauauaaaaugaaugcaugcuuaguuauggaaaaguugaaauaagaaaggaauaaagauaaauuuacucauaauuguaaagagaagcuaauucucucccuguuuuuaaaacauucccuuuuauucccucuagcuucuuaauucuguauguguauuuaugugacuaaggucaaacuguaaaugcauuuuucuuuuccuucucuuuuuaaagaguuaaaugauuuuuaacuuguaauuagaauuuauuacuuguaggaguccucaagcuuuuauaucauguuuuuggaagcaaccagcuaguuuaacgcacuucugaaaaugaaaggaaaacuuacauguuauaggagaguuuuuuuccccugaagaguuuuaaacuauuauuaaaaaaaaucccuaaucacauuucaucaccuagaauaguccuugaugacgacguguuuccagugucaauaugguuugguucaguuucccaugaccagcucaaguccaguaucugacugaggcaaagggcuuagggcuuacugcuuugggcacaccucaugauuuuuuaucuuugucucaacuguauuagguuugaaaacuguacuucuuuguacuuuuuuuucauuuuccauuuuuuuuuaugaagaguaacauccaauaaaacucuuaagcacagaguccuguuugaggaugaagaugugaauauugcaacaaccacagugcuugucugagaagugcaucacuuggugauaauccugagugcuuguucuuauuuugagaaauauaaguccagauuccacuauaccaaagacagauugggguggguaucaguguaagaccugagagaaauguaggcugugaaaaauggaggcaugccuauaauuuacuuuuuacuaauucauauugaacucaugaucaaauuggugaggguuuucacauuuuucuuuuauuuuuaagucaguugauaauuuugagguuuuuaaauauuugguagguucaaaaccaggauugccauuuuucacuguuguaaaaccucuugagaaacuuuaacccggagguaucuaugauugggccucugcugaaacuauauguaaaauaugaguucuuuucucagggaagagccuagaguuuuucuaguuucucauagggaucagugaccuaaaaggguuuuuuaauugcuacuguaauuaagaaaacccacaaaauuacuuuuuucuaaaauaugcuuuagaaagaaaauauagaaaguguaaaguagcaaaaccuaugaauuacgguaagauuuaaguagaaauuugcacaaacuuucaaagcuuaagucagcuauaaacucaucacaccuuuucuaaaagguccuuuccuuugauuuguaauaggaauuuauauuaguuauagaaaauuuggaaaauaaaaagaacaaaaauuacauauaaacucaucaguaaaaauuaacuaggcacuuuaggauauuucuuucaaacguagaugaauguguuuuuacauaauuuuaaagguuuuuugcuuugaauucacaucucauuuucuuagagcaaaagauuaguaaugagugaagaaacaggcaccugugauaacugacaagucuucaaacacauguguaugguuguuguagagagaacaguagaacagauuuuucuguccaggcuuacuauauauauauauccauugcacuguuuucucauuguugaaaaguuaaauugaagaaaucuaguagaauguuagcugcaucucucuuuagauaauuuuguuucauugacuugaaaaauuauguuuuuauaugcggguuaaucuugguaucuaugucuaauaguaaaguuuucugauggacucauaaaauauaaagaacauagauuauuucaucagcaucuucugaugacauaaauuccuugguauaauagaguuauaaaaaaggaauauaccaccauucugccugaauuuugugguacauuucaguuacuuauaucaauugaaauuacugaauauuuugccaugaccauuuagaaaaaaaguguaaugcuauugauuuaauucaaguacauuuaaauuuuccaugaggaguguuccuuuucccaccaaauugcauaaagcauaacaguauagaucccuuuuucaagaauuuuuaaauaaaauguaacuuuuaucaauuuguuuagauuguuuaaaaggauacuuugaaaaaaaucauuauuucuugcuuuaguaacuggaggacaucucuuuaucuauauagaauccaugcccaaacuuaauauuccucuauuuucuugauuuuagaggugaaaagccaggcauccuucaagcuaguggaucuuugacaaagaugcauugcaaaacaaucaacaaacaaucagaaaggcaugcuaugugugagugaugaucccugcagcauaugccauaggcuuguuguagaggagcugcucaguaaaugguggauucaauugaaacaagucuuuuuuggaugcuuaaugggaaguuguaggguggguaugauggacuaaaaauuauuucuaaagaagguuauauauuguauauauuccagaaucuuccguuuuuaucguuucuuaaauuaaaaaauaaaaauuuaacucugucccagguuaacucagauguuaacacuuauauagaaauuuuuuuccucuuuccccguuaggcaucucacaguauuuucugcuugucuguuuaggauguuagguagaggaaaagagagugauagaagauuuuuuuucuuaaaaaaaaaaaaaaaaaaaaaaaaaaacugggccaggcaugguggcucacaccuguaaucccagcacucugggaggccgaagcggguagaucacaaggucaggguucgagaccagccugaccaacauggugaaaccccgucucuacuaaaaauacaaaaauuagccgggugcgguggcgcgugccuauaaucucagcuacucaggaggcugaggcaggagaaucgcuugaaccugggagguggagguugcagugagccgagaucacgccacggcacuccaggcugggugaaagagugagacuccaucuccaaaaaaaaaaaaaaaaaaaaaaguucaauguuaguauuugcugucuauuuuaacuucuuacuuuaaaguaaaauuagcaaagucuuauuguuucaaccugauuuaaauuuuaucucccuuuuuuauuauuuaaagguuggagucuuuaucacuggccucaaaggauguagacuuuuuuuuuuuaauagagauuuuuauuuuugucagucacuuuuaagaggauuaaaaauguugaucccuuucauauuuccucgucccuuuaaaaauauucuauuaugacaaauuucaaacauauggaagagugaaucuugaucaccuaucugucuguacccuaauccguuaauccauuuuuuucugaugaauuucaaauuaaguuguggacaucuguguauuucaccccuaaauacuugagcauaucccucauuuaacuugauuucucucuuacuuucuacaauuuuaugcaaaugagcuguuucccauagguucugucuugaucuuaauccuuuaaggguaagggcuaacuugugguuguguuaauggucuucaucgcugcugccuauuuuuuuuuuuuaauuuccuuaaaacaaaagguacucucaaaaggcauauugcacaugauuagcaagauucagaaggaagugguuaaaguuucuuacaugccuuauaccuaugcuuuuaguucuuguuuuguauaaggaauguugcaugaggauauuggaaaaaaauuuaaaauuaagaguugaaggcggaaccugaucuauaaggauccauuauguugaagccaaagaagcaggucuagcuauucuaaguaaguaggcuggagagguguuucuuaacucuaucuggguuuuguuuuccauuugaagaaaaauuauuuuaagcaauuaccauuuuugauuacuguaaugacuccuguguccaaaaauuaauuacguuucuaauuauuaaaauagaaaaaaaaaucuguucaaauuuuguuauaaauaaagaccccagacuuaaccucaguaaugcauuaguucuuagcauaacuuuugcauuuucuguugcauaggcuuugugaucuuuaacaggauuauuuaagccugaaauaauagagauacuauuuggagaucacuguuugacuaagcccugaacauuuccacgaauguagccuuuagagagagaggguuccucaagcuguaguuucuuccagagacauugcuugacuccuccuggccucccuucauaaaggauuucuacaugggcugcauuuuaagugaucuucuacuuuuguauuuuuagaaaauaauucaaaauuuauaaauagcaacucuaaucuuaaacugcucuccaguauguccgcauuuuuauuccagagagaauuauuaauaaguugaaaacugauuauauuugacuugaaauauugacauugaucucugguauugccuguuuuugaacguacuguucuuuuaauguacaaaauagauguuuuuugugaggaaguuguuuuuuuuucuccuaagcauuguuaccaaaauaagacuuauugaauggugacuuuaauacuagcuucuuaauauucauagaaauauuuagauaucuaggcugguguauuuaguccuugagcauuugcagaauuacuuaucugaaacauaaauaagcuguuaguguuauguuauuaauagugaguguugacugucuaggcacuguaccagucaguccuauggagacauucucccauugauugcucacaccaguccuguuuccaaagccccugaaugguuacauucagcuguacugucuuucagcaaguuauacuauuuguaucaaauugguuagugaaaucuuguagguaauagucuuucuugaaaguuuuggaauugauguuuuuugaugcuucaugaaaaaaaugaguuuugaguuuuggaaccaaaauaguaguugcuccaugcugggcaguguguuagaccuuuuauauuuaauucuguugaaccugugagauaaguauuaguccaauuuugccauugaaguuacuaagacuaaggugaauuuguguaaauugcauguagagcuugggauucacucucuggucugacuucaaagccauguucuuucugguacauagccuugugcaugaaguuuuuuugccauuuuauccauauaaaaauuuuccaggaggaggauuuuugccuuaaacaaaagaauaaaacauguuucguauuuauuuauagaaaaggauuuuuuuuggggaaaguuauaaagcaguugcacacuagaaaaugagaaagcuuucaugaaggaaugcaggucagaagaccuagcuagguuaaacucauugcuuaccucaucuugauagaggagaucuggcuucuugcuaugugguuuuuccaucuuccuucuacuuugucuucuguaagagaaaaauacugauaagugacauuuauuauagguuauguaaaauaauauauaugugaaauuccuuaagaucuuaagacugagcuaauuuuuuuuuauuaauuaugcuacuguugcuucagggaacuaagcaguaagcugaaaccaauucugugauguuugucauuuauauuaucuggagaguuguuaccuacauugcaguuuauccugauuucaauuugacaaugucuacauguucuuuuaaauuacuugcugaguuggugaauuuuuguuucuguuauuuuuaaaaacugacaacauccuucugcuuaaaaaaaauucagugcuguaguuuugcuugcagccuguaucuuagcagggaacccuuuggaaacccagucuccagagaaaguuugacgggcaucuuggcauaggcugcugccugguauuacucaaaaagaagggcuguucauuuccagcagguguuaagagcugaguaaggcccauagcauggaaauacgaucaucucugccccuacagaguuacauauaccuuuugguuguuugaaauuacuuauuugguagcucuguuugauguaacaagaaacagacuccuaggccaaauugaaacgccuuuuguauuaucucuacuuaauuucuucuacccccaguugauucucucuuaccuuaaucacauuauuaugaauaauugaagagcugaugaugcauuuuucagccuaagguuuucugaugaggacuaaagcaucugaucaaauuucauguucaugauuucaacuucacagccaguaucuauucacucaaaagcuuuauuaaaucucuucuuucggccgggugugguggcucaugccuguaaucccagcacuuugggaggcugcgguggggggaucgcuugaagccaggaguucgagaccagccuggccaacguggcgaagaaaccuaaucucuauggaagauacaaaaauuagcugggcguggugucaugcgucuguagucucagcuacucaggaggcuaaggcaggggaaucacuugaacccaggagguggagguugcagugagcugagauugugccacugcacuccagccugggcaacagagagagacucugucuuaaaauaaauaaaucucuucuuuuuucaucuugagucccuucuucucuccaaauaucaggcccucuuuuacugucucccuuaauuuucacauuuuauuugguccagauagucuuguaucuuaaaaaacaguaauucucaaaauuugaguauucugcuucuaaaugccagagucccugaagagucuuaauucuucaauaaauguaugguagaauaaugccauugcuaaacuguauaaaaacaggauuuuaaaacuaaaaauaaaaccacauuaaucuugaauuugcuaaaauuauguuuuugauuagcuuguuuuaugauaccuggccuacugggccucccaaauugcugggauuacaggcgugagccaccacacacgacugaaagaagagauuuaauaaagcuuuugagugaggccaggugcaguggcucacgccuguaacucuagcacuucaggaggcugaagugggaggaucaugaggucaggaguucaagaccagccugaccaacauggugaaaccuccucucuacugaaaauacaaaaacuagccuugcaugguggcgcacacuuguaaucccagcuacucaggaggcugaggcaggagaauugcuugaacccgggagguggagggugcagugagccgagaucacgccacugcacuuuagccugggcgacggagcgacacucugucucaaaaaaaaaaaaaaaaaaaaaaaaaaaaaaaaaaaaaaaaaaaaaaaaaaaaaaaaaagaaaaaucguuaauaauguguguauuugguguuuucugucaacaggaagaagguagauaaugacuauaaugcccuucgagaaagacucagcaccuugccugauaaauugucuuauaauauaaugguauguuugguguguuucuuuuaaaguaauaguuguuucuuguaaacauauuaacuaugugucgguucacagaaugucaggcugauggacuguguccaagguaacuauguagcaaggaagauuuguuuuguuuuacuuuauaagaacacaguaauuguaguaauuguugguauuuaccuuuuuuuuucagaauauauauggugacacaaaugacauaaauauuagcacaaaauuggacauauuucaaauggaaacuuacuauauaaaaaauguaauuaugacagaaauaugguacuaagucguuucuuguuagccagagcaggaauaggccauaauguuuuguaauucacagaauuaaaccuuaggacauugauuuuuauauaaaaacgugcugcuaauuuuuguuuuaaugaucuucacaucgacauagugaucuguucaugagcccuggauuagagccuuucauugcaugaauguucuuucuuaugaagacuuuguucuuuuauacuaguccaaguauuuuguauauauagcuagauagauccauuaaagcuauuuguuuacuaauuccugcuuugcaaaagugucuacuuuauugaaaauaauuuuuaguuuucuuuaucaaaaguauuuugcauugacaauguuucacuacuaguugcuuucacuuagauuugcaagugaaugaaaaguauaaacaugccgagacaguacuacuuucuuuaagagcuauauguaaauaugguguggauuuauuuuccuguuuuaacauugauuuaugaacauaaagcaauuuucuuuagauuuuccuaguaaaauuuuaauauaguguugaauuucugugaagcuggcauuuuauuuuucccaauguauaaauaaaaaaauucaguuauguaaggcuuuuaaugcgaaguguuuuauaaaauguacuuuucaguguuuuauguuuuuucccuuuuuucuuuuuuuuuaaacaauagguaccauuuggcccuuuugccuucaugccaggaaaacuuguccauacuaaugaagucacuguuuuacugggggacaacugguuugcaaagugcucagcaaagcaggcuguagguuuaguugagcaccggaaagaacguagguacccauuuuaaaugauguuucuuuguuguauauguauccauucacagauugccaagcugaagggcuguuucuuaccaaaaguaccuuccgugaucuaugaauccaggcuguuugugauucuguugaauuguagguaguuugaguagaaccaacauuugagaaugagcuggagaauggagcauccggguuggaaaugucaccuacauuggcauguuuucagaaguuacaaaguuucaaagucauuaugugauuuuguaguuagaaguugggaagacauaaaaauuggagucauuuuauaccuuauaauuuuuuuuuaguugcuauuauagacuuauuuuugcacuuaauacuuuaguacacagaaauaauguguuuucuccuuagugaacuaagagaaauaccuguuuacauaaguagacaauucuuaaaaaugcuuuuugguuuggaaaaaaaaccauauuuucauuugauagaggagaccaggugugaaaaggugcuaccuaaaacagcacccuuauccuuuuucaguuguuugaguucucugcaucccuuuauuagggcagcucuugaguuuuguuuauccgugcuauuaucuguagguguauagaagccuacauacacacacacaacacacacuacacauuuugcaguuggaugagcuagcuuggguucuagcuuaguuauauuuuaaaauuagguucaguuuauaaucuguuguuauuucuguaauacguauuuagauugagaguauaauauccgcccuaccugcuuuuuaaccuuuuaguuaaauguguauuugaaaauaaaugaugggaagauccuuuuuuauaaauaaggucauacuaaacagaaaacagcugaguuuucuaaagcugaacuugauuucacuuauacaugaaugaguacuagagaacucauuuacucagugaaauucugggaacuauauuuggagacucuaauugcaaaucaacuccuauaaguuuauaauugauauauauuuugaucuuuugugacacuaaucagaaucuuauuguuaggccuguauguaauuucuggcaaugauaaaucuuuuggcuuugcugcauuauuuuugucauguauauuagcgaaagagaaugggcauacuuuuuucuuaaagaccuuacugaagacgaagccucucuuuauauacugaaguagcucugauguuaugaaaugaauccauagccuguugaaguuuguucacauugauuuucauauuucagugaaaaaaaucuuuauaauuaguuauaacuuaaaauauuaaugggaauacuuauacuacaauagaauagagcucuagaguagagaaacauguuuuuguaaaucacuuucuaguaguuaaauaugguuuuggaaagugaccaaacauagaugacuuuugggaucaauauuuaucuaaaauaauuuucaaaguacauauuuccuguuacaauaaauucugggccgggcgcaggggcucaugccuguaaucccagcacuuugggaggacaaggcagguggaucaccugaggucaggaguccgagaccagcccgaccaacgugguaaaaccucgucucuacuaaaaauacaaaaauuagccgggcgugguggugugugccuguagucccagcuacuugggaggcugagacaggagaaucacuugaacccaggagguggagguugcagugagcugagauugugccacugcacuccagccugggcaacaaagcgaaauuuugucucaaaaaaaaaaaaaaaauuacguaaagcucuuuuauucacaugguuuuauaauuuauaccugaagaaaauacuuagguauauuguuguacuucacauuuauuaagaaaagguacuuuauuuuucuuaaggcagaggaaauauaaccaguuaaacacauagucaucuaugucaugguugauugggguaauuggggaaggucugaguuacaacacgggucaugauuuguuuagccagcaccacagucaggacacggaauaggauacaagauacugcucucaggacucagcuccuaucaaaaccucccucacacugccccuugguggucacacccuacggcugccuacugcugaaggauugacgacuucacgucugugucuuuugagauuagcuucuucacuugcuguaacgccucauccaggugguucuguguauucaaaguucauuucuuuuauugcugaggaguguuccguuacaugcauaucuauuaaaugcacguacagcaguuuuuccauucaccuuuugagggacauuugggugcuuccauuuuuuggcgguuaggaacagagcugcuguaagccuuuguguacagguuuuugugcgaacauacauuuuuauugcuguugguaaauaccuacaagugagauuguuagaucauaugauaaauguauguucaauuuuuaagagacuaccaagcuguuuuccaaaguggcuguaugauuuacaucucuuucagcagugugugauagugguaucuuugcgucucuaccagcccucaauauugucaguuuaagaaguguagccauuugaauagguguauagugauuuuaguuugcaucauugccuaaugauguugagcauugauucaugcacuuauuuuaucuuuguguccucuuuuaccuguugaacucuuuugcccauuuuaaaauauuggguuauauaugcuuuuuuuuuuuuauuuuuugagauggagucucacucugucgccuaggcuggagugcaguggggcgaucuuggcucacugcaaccuuagccuccgagguucgagcaauucuccugccucagccuccugaguagcugggauuacagacaugcgccaccaugcccggcuaauuuuuuuguacuuuuaguagagaugggguuucaccauguuggucaggcuggucuugaacuccugaccucaggugauccacccgccucagccucugaaagugcugcgauuacaggcgugugccauugcaccuggccuggguuauauauuuucuuucuuuuuuuuugagauggagucucacucugucgcccaggcuggagugcaguggcgcgaugucaguucaucgcaaccuccgccucccggguucaagugauucuccugcucagccuccugaguagcugagauuacaggugcguaccaccacgcccggcuaauuuuuguauuuuuaguagagacaggguuucaccauguuggucaggcuggucuugaacuccugaccucaugaucuguccgccuugugguccacccaccuuggccucccaaagugcugagauuacagguaugagccaccgcaccccgcugcauuguauauuuucuuacugucguuuugagaguuuuuuuuuuuuuaauauauucuggauuuauguuaaauaggugaugugcaaauauuuucucccacuuugcaucuugucuuuucauucucuuaacagugucuuuccagagcaaguuuuuaauuaugaaguucagcuuuuagcuuuuuuuaauggaucauauguguggugucauaucuaagaacgcuuuaccuaaccuuaguuguugaagauuuucuucuguguuuucuucugaaaguuuuauacuuugauauuuuacaauuagaucugugauugauuuuaaguuaauuuuuguuugaggugugggguuuaggucacgguucauuuuucuugcauauggauguccaguugcuccaauacuauguugaaaauacuguucugucuccauugaaaugacuuugcaccuuugucaaaaugaauuggcaacaagaccaucuuagauaccacacuaggaugguuauaauaaaaaagacaguaacacuuguuggugaggaugugaaaaaauuggaacccucauucauugcuggugggacuguaaacuggggaagccacuuuggagaacaguuuggaauuuuucagcaaguuaaacauuguguuuuacugugaucuagcaguuccacaccuagauaguauucuacccaagggaaauaaaaauguauguccacaaauacuuguacaugaauauuaagagcagcacugcuuauaguagccgaaacauggaaacaaccuaaaugucuaucaacuaauaacaggugaauaagugucguacauccaugcaguggaauguuguuuggcaauaaaaagauguguaccuugaaaacauuagaauaaauuaaagaaaccagucacaaaagaccauauauuguaugauuccauuuacaugaaauauucagaaaagguaaauuuauaaaagaaaggagaguaguggcugcuuagggccaggaaggugugagagagaauggagagugacugcuaaagaguauggagauuuuuaggggcaaugaaaauacaaaaauacagauuuugguaaugguugcacaacccuuugaauauacgaaaaccaucaaauuguacauuuuaaaugggugaauuguauguuaugugaauuauaacuuaaauuguuaaaaaacaaaugaaugagccauuuuguguaauuguguuuuuggaccaucuguucuguuucuuuaucuaugugucugucucuuugcugaugccacucuguuuugauuacuguagcauuauaguguuccuuacaguguuccuuaaaguugguaguacgggugcucuaaguuuauucuuuccaaauuguuuuggcuguucuaccuccuuugccuuuccauauacauuuuagaaaccacucgcuuauguuuacaaaaacuccuagugggauuuugauuggaaucgcacuaaaucaacacauuaauuuggggagaauugaccucuuaacuauuaaaucuuccaguguguaaauacuuacagccuguaaauacaguguaucucuguauuuaggacuucuuuaaucaguuuuguaguuuuugagcauacaggucauaugcguuuuguuagguuuauaucuaaguguuucaccuuuuguggagcuguuguaaaugauggcauuuuaaaaucuuguuuuucaaguguucuaguauauagaaauaacucuuuuuaaaaaagaauuaacauuguauccuccauucaugcugaccacauuuguucucugaacuuuuuugggguagauuccaugggauuuucuauguagacaaucaugccuuuuguaaauagcuccuauuuuuuuuuauuccuuuccaagguguauacacuucauuucuuuuucuugccuuacuuccuuggcuaggacuugcaguauaauauugaauaggagugguaagaguagguaggugucuuugucuugaaacugaucuucuggggaaaaauuuggcauuuuauuguuaaguguguguuagcuguagguuuuuuaaaaaaauuaauacucccuauaaguuuagggaacuuucuaccugguucuaauuugcggauuuuuuaaaugaaaauauguugaauuuuguccaguguauuuucugcaucuauugauaugaucuuguaguuuuucuucuguaucuguuaaugugguggauuauauugauugauuuuucuucccuggaugaaccgcauuugaucaugguguauucuuucauguauuacuggauuugauacauugagcuuuuuuuguuuaauauuugcauggcguauauuuuuccauuucuuuuacuuuuaugcuaacuauaucauauuuaaaguggguuucuuuuuuuuguucuuuugagacagagucuugcucuauugcccaggcuggagugcaguggccugaucuugacucacugcaaccuccaccucccaaguucaagugguucucccgccucagccucccgaguaguggggauuacaggcgagugccaccaugcccagcuaaucuuuguauuuuuuauagagaugggguuucaccauguuggcuaggcugaucucgaacccuugaccucaagugaucugccuaccuuggccucccaaagugcuagguuuacaggcgugagccacugugccuggccuaaagugaguuucuuauaggcagcauggaucuuuccuuuuuaauugauucugauaauuucagucuuuuaauugauguacuuagaccauuuacauuuaauguaauauguuuggauucagguuuggcauucccccguuuuuguuccucuuguuacccuuucuuguccucuuuuagauuauuuaauauuuuuaguaucuuauuacucuguuguugcugaaauaggaacuucuuaaaguauuuuuaauguuacaaauuagggauuaauguauuucacgugaacuuaaaaguuuuacucuaaauacuugcuuugagauuugcugaauucuuuuuuacguuagagagcaauuuuuggcuuagaaaggaguacaucuucaaugagacuaagugaaaagaccaggauuuaaucagagguuucuacaguauagacaaguuuuugguaauuuuguuucugcaugucucuguaaucuacuuuugaacaccgguauauagaaugacuugaaauucuaguaucuaggcaccaugucuuagaauuuuuggcugugacaacaggcauuuggccacauuucuagucauuaguccagugauuaauguuaaacaguuuuacuuauaggaugaucuuaauagauuuuccuuucaaagauaauauggggagaauuauuuuaccgugugucuuuuguucagaauuguaucugacacauuuauuuuaucuuauuuuuacuuuugucuuaaaaaugcauacuuagucuucauuuuuacaauaaaguuauuuuuauuaaauggaagaguggacaugaagggauaagagcaugaacuagggguaauggcuauaggcuuagagaagagaucagaagcaggaagaauuucugagccugauaggacuuggcaacugauugaaugugaagguugaggggaagcauuggaugaguggugaccuagaggcaauguuguugacauaaucaaguaaguuuguagaucacugcacacuacuuucccucuaccagagaguaaaaugcacauaggcacguuacuuagaagcccuguaaugaaaaauaucccuuuagucuuguuuaauguugugguucccaaacuuacuugauuuugagaaacuuuuaaaauguaaugucuguuaucuuacagagcauucuaaagaaaaucuugauuuaggaauacauuuuuaggcagauuucagaagaaagugggugauaagacguuagcaccgaauacagcuuuuuuuuuuaagugauaggagaagaaagauuguaugaggugcaucaggucauucacaagaugggcuuuuuuaaaaauuauuuuuuuaguagguuauauauggacaugauacaaaaucuaaaggauauuuauuaaaaaacaacuaugcuuccuuuucuuguucuuuaacauccaguuuaccucccuggaggcaucgcuguuaucaguaucuuacucauuauuccagggauauucugugcauuuacagccauagacuuaugcauuccuaccccacccuauacaccuccacucaaauuguaggcacacuuuuauuuuuuuguuuuggcagcuugcugucuuauucuuuucauggcuauauaguauuauauuguacucuauuuagccaguccuuuacugauaggccuuuagaucgucuuccuuuuuuuuugcuguuaaaaucaaugcugcagugaauaaccucuguguguauguguguguguguguguguguaucauuuguacuuguguguaucuguaguauaaaugacuuaagauacaauugcuggcaugaagugaaguagauuuuuaacuuugacagugcuggcuuuaacagacugacuacaccuuugccaacccaauguguuugcaaacuuguuuugaaacugauaccuuauuguaggcccccuggcacugcuaacuagcuaacuuacugucuuuuccuccuuuuccuccccuccccucccuucccuuccccucauucacaugguuggucagcuauaaccaccauccaucuccagauauuuuucaucuucucaaauuaaaacuguaccaguuaggugauaacuccccauuuuuuccuuccuccccccauccccugguaaccacuauucuacuuuccauaugaauuuggcuauucuagauaccuuacauaaguggaauccuacagcauuuguccuuuugugucuggauuauuucacauagcauaauguuuucuagguucaucuguguuguagcacgugucagaauuuccuuuuuuuuaaggaugaacaauauuuuauuuugugaauaaugugaauuauucuguucgcuauugugaauagugcugcuaugaauauagguauacaaauauuuauuuaguucccugcuuuaaauuauuugggguguauaucugaaaguggaauugcuggaucauauggaaauucuguggauuuuuuuuuuuuuuuuugaggcagggucucacucuguugcccaggcugggagugcaguggugcaaucuuggcucacugcagccuccgccucccagguucaagagccuuccugccucagccuccugaguagcugggacuacaggugugcaccaccaugcccgacuaauuuuuuguauuuuuaguagagacaggguuucaccauguuggccaggcugaucuugaacuccugaccucaggugaugcaucugccucagucucccaaagugcugggauuacaggugugagccaccacgcccggcccuauguuguauuuuuuaaggaaccuccauucugucuuucacagcagcuguaccauuuuauauucucaacaccaaaauacaaggaauccaguuuucccacauucuugucaacacuuguuacuauauuuuuuauauauaaaauaaauauauuuugaaguggcauaucaucaaggaauauaguuugaaguggauuugaagugaaguaucagcaggguuuugauuuguauuucuucagugauuaauuauguugagcaucuuuucauguguuuauuggccacauguauaucaucuuuggagaaaugucuauucaagucuuuugcccauuuuuuauuuggguuguuuguuuuucuuguucaguuguaguucuuuauauauucuggauauuagucccuuaucagaaguguaauuugcaaauauuuucuccuggucuguugguugcccuuuuacuuucuucuuuuauuuugucuuacuuaaaaaaaaaaauagcugccagguagagugcccuuuuacuuucuugauaauguuguuugaugcacaaaaauuuuuaauuuucacuguccaguuaguguuuuuuuguuuuugccuaugcuuuucaugucauaucuaagaaauuguugccaaaugucaugaagcagcuucccuguguuuuuuuuuuugaguuuccuagauuuagcuuucauuuagguugcuguauccauuuuauauaugcuuguaagguaaggguccaacuuuauucuuuugcaugugguuccaguuuucucaacacgauuugcugaaaacacuguccuuaccuuuuugaaugguuuuuacacucuugucaaaaaucauuuggucauacauuuaugaggucuuaugucugagcuuuguauucuauuuuuugguccguaagucuguauuuauguugguaccacauuauuuugaugaggguagcuuuauaguaaguuuugaaaacagaaagaugagacuuacaacuuaguuuuucuuuuuaaauauuguuuugguuauuggggaacccuugagacuccaugugaauuuuagaaugggcuuuucuguuuuugcaaaaaaaaaauuacuggauuuuacugggaguugcacugagucuguugguugccauggguaguauugacauccuaauuauuaaauauauucacuccgugaacauaggauaucuauuuauuugugucuuauuuguuuuagcaacacuuuauaguuuuuagugugcaagucuugcaccuucuuaagaguuuaguccuuuugguucuaguuuaaaugaauugcuuacaaauuuccuuuuuagauugcucauuguuagugcauagaaaugcaguugauuuuuguguguugauuuugcauccugcaacuuugcugaauuuuuuuuauuagcuuuacaaggguguuuuguguguguguguguguguguauucuuuaggguuuucugcauauuacauauaagauuguaucauauguugguaguagagagaacuugacuucuuuccaauuuggaggcuuuuuauuuguuuuucuugcuuaauugcucuagcuagaacuucuaguauguuguugaauagacauguucauagugagcauccuugucuuauucccaaucuuaggggagagacucgcagucuuucaucauagagugugaugucagugugggguuuucauauauggccuuuauuauguuauggaaguucccuucuguuucuaauuuauugaguuuuuuuuuuuaaucaugaaagguuguuggauuuugucaaaggcuuuuuuggauucaaucgagauuaccauguuuuuuccucuucauucugcuaauguaguauauuacauugauuuuuauauguugaacccauccuugcauuccaggguguggcagagaucauucuuggucaugauguaucauucuuuuaaugugcuaccguauuuaguuugccagcauuuuguugaggauuuuuauauguauauucauaagagaaauuagccuguaguuuucauauuuuuaucuggcuggcucacagaauguguucccucccuuuucauuguuuagaagaguuugagaggauugguguuaauucuuugaauguuugguagaauucaucugugaaagcaucucuucuugguccuuucuuuguugggagguuuuugauuacugauucaauaugcuacuuguuacaagucuauucagauuucaguuuugguaguuuguguuuuucuaggaauuugucuauuuuaucuaaauuaucaaacuuguuggcagucaguuguuuguacuauuucuguauaaucccauuaauuucuguaauaguuuuuauuguuccacuuuuguuugugauuuuagugauuugaaucuucucuuuuuuucuuagacagucuaauaaagauuugucaauuuuguugaucuuguaaaaaaccaacuuuugguugcauuaauuuuucagcauuuuauaaaaauucuguuuuguuuaucauucucuaaucuuuguuauuccuuucuucuguuagcuuuggguucaguuuacucuuucuuuuuuuuccaguuucuuaaaguguacagugaaguuacugauuugaaguauuucuuuuuuuuugauguagguauuuacagcuauaaauaucuuucuuagcauugcuuugcugcaucccauaaauuuucguugaguuuucauuuuuguuggucucaggguauuuucucuuuucuuuugagacagagucucacucacucuguugcccuggcuggagugcaguggugcaauaucggcucacuguaacuuccaucucccgcguugaagggauucuucugccucagccucccuaguaguugggacuacaggugagggcuaccaugccuggcuaauuuuuguauuuuuaguagagucgggguuucaccauguuguccaggcuagucuugaauuccuggccucaagcaaucugccugccucggccuccuaaagugcugggagccacugugcccagccauauuuuuuaauuaugccuaugauuucuucuuugacccauugacagauuauuuuguaaaauuuucauauauuuaugacuuuuuccaauuuuccuucuauuaaugauuuuuaauguuauugagcauuccaguuagaaaagauacuuuauaugauuucaaucuuguuaaauuuuucgagacuuauuuuguggccucucauaugaccuauccuggugacuguuccauguuucccuuagaagguguguauuuuuccuguuguuggguggagguuucuauauaugucuauuaggucuaauuggucuuuagugguguucauguucuuuauuuccuucuggcuguucuguccuuuauugaaaaggggauauucaugucuccuccagcuauuauggugaaauaauuucucccuucuguucuguacauuuuugcuuuguacauuugagcucuguuagguauguauguauuuauaauuguuguaucuugauagauugaaccuuuuaucagugugaaauauccuuugucucuugugacuuuuuuaauuuaaagucuauuuugucugauacuacuauagcuacuucauuucuuuuuugguuacuauugguauggaauaucuuuuucauuccuucacuuucaaccuauuugugcccuuagaucuacaagugagucucuuauagacaguauauaguuggauccuuuuuuuaaaacaauugauucugccaauuuaugcuuuuugauugggaaguuuaaucuguuuacauguauaguaauuacugaugggggaaagacuuucgcuguuuuguuauuuucugcauguuuuauagcuuuuuuuugacucauuucuauauuacugccuuccuuuguguuugauuuuuuuuuauggugaaugguuuugaucuccuuuucacuucuuuuuaaaauauagguauuuucuuugugguuaccauggcgauuacauagaacauccuaagguuauaaaauguauuuugaauuuauaccaacuuaacuucaaucacauacagaggcuuuauuccuguucagcuccuucaccucuuuauauuauuugugucacaaauuauaucuuuauauauugugucuccauuaauauagauguccagugauguguauucauuuuucuuuaucacauagaaaagaaaaaaguggaguuacaaaccaaaaugacaguaauacuuauuuuugccuauguguuuaccuuuaucagagaucuguguuuucauauagcuuugaguuacugucuuuucauuucuacccgaagaacuuccuuuagcauuucuuggauugcaggucuaguggugaggaaugcccucaacucuuguuuaucugggaauaucuuaaauuuccccucauuuuuaaaagacuguuguuuugcuaaacauagaauucuuggaugaaguauuuuguuucucucucagcacuuuuuaaauauaugucaucccauaaccuucugugcuucaggguuucugcugagaaaucugauaaucuuguugaagauuucuuguuugugaugagugguuuuucucuugaugcuuucaagauucucucuuuguuguuguucaacaguuugauuauagugugucuuggugugggucuggguuuauccuacuuggauuucguugagcuucuuggauuuguagauucguaccuuaucaagcaauguguaugcucuugaguaucuccaauaaggcauuucaaaauacaaauuuaugauuuuaguuuaugauagauguauauagcuuuaaauaaccacaaaccaucuuaagacguuauuuaaaaaaaagagcagcauucacuuaucccuuuuggcucacaguucccauuccucagauguaauuacuuucuguuuuuggcuauuuuuacucugcucuuuuuauucauauuuuccagugguuggcauauccuguuuuuguuuacuucuuuuuuuuuuaauuuuauguauuauuaacuaccugucuauaauuuaagaggaccauguagcauuuuuacauguccucccugucucugcuucucuaaucuuuuugcuauuguuguaucacaauuuuuguugaaucaguauucaugcuuagauauuauguaauuccauuuuguucuuguacaggcuuuuaguugaauuuaacugcuuuuuuuguugcauaguuuucuaugugucugucauuaauucagucagauacuuuuuuuguuguuaaaaauuuuacugcuggagucuuucauugucuugcuucaauuuggacuggcuucucuccugaucaaaggagagccgucuuccuggugucuucuuacccuguuuuugccuuuuauuuauuuccuguuuucuguuucccaaagcacccuuuuuucagguucuauuuaguuuguuggaauauugcuuuaaguaacuuuugggaaccugcucggagguacuucuuugaauuuuuauguaucugaauaacucuuauauuccuuauacuccugcuucuuauuguuaaguagacuguuuagaauucuaggucuuaaguaacuguugcccucagaauuuuggauacauuauucuguuaccuccugucuuuaaguguugcuauugaaaaucuugaugcuauuuucguuuucuuuguauauaacuuguuuuuuuguuuuuaaagcuuugagauuccuuuuugguccuuauuccccaugaucuggaauacaacagugguacaccuugaagccgugcuauggauccuuuaaaauuuguuugcuagugcuuaguaggccuuuuuugaguggaggcuuaaguccuccagccgugggaaauuuauauuaguaauuugaaaauuuccuuuucuuguugccuauuuguuuguccuuguuguaauuuuugaagugauuucuucugcauacucuuuuaaaucauguauugacuuuaaaauuuuccuguacauaguuucauuucuggaagcacuuuuuuuuuguucuuuggcuguuucuuuguuacagcauccuguucuuguuucauggauggagggucuuuuuuuaaggaguauuuguuuuuucuuuuaaaguuuucaucuuuaaacauuuccuccauguuucuuuuuucuucucccucuuuucucucuugcucucuuuuuuuggucucuagcauuaauguucaagaauuucuucaaaugucuggugauccuuggcuaaccauuuauacuugcguugaguacugucaggaagcucugugugcauaggcaagguuuguugacugauagguauuuuuuguagggauuuaagguagcaagcugauuuauuuauuuuuuuuaaauugagcaaucuuuaaguaucagcagauucuacaaaagagucuucugaucuucuucaucuaguguucugagaaccaggcugggcguuucaagguucaguauguucacuuggaauuaauccuccugguuucacuaagacauuuucuauucucuuuccacuucccuauucccuaccaucucuacaaaccacucuaagcugugaaucuuuuguuuaagcaagaaaggagaaaccuuucuugugagauuaggguuuggggaccuguucuuuucaaacuuuuaucuagaucuuugguuaaaguucacucuucuuuuggaaauacucucaagugaauugccuuuuccagguccgauaucccagaucgacuuguaguagcuuuucccagccacaguuagguuccauuuuuuucuguugugcaaaguccauuaucaguugugcaguuuccaaaauuugguugacauuucuugucuauuuucucuucaaauguauuugucuuuauggguuuaugccuuuaaaaauuucuuaguuguuacuuuaccuaagguauaggggaaaggcaaauacuaaguacauguauucaaugugcuauuuuaaagcagaaguccaaaccuuuguacugguuuaagaaggaguacauccuguccagagguuugugaguauuuccaccagggggcacguccuguugaagcugucgaaagaauauuuaaaaauuccagcacacaaaagaaacgagguugagaauagaguggucacaaaggauucaguagagaauugcauauuuacaggcuucauacuauucaguacauaugaauauauggcuaaguaaaaaagacuccuuucacgaaugauguucauaacuuuuauuaguguuuugcaaauaauuuuuauuacaucugcauuucuguuccuuucaaauauauacaauucuacaaacuguuaacuaaauguuucuaaauauuuggucuuacuuagugaguaggcauaucguuuaucuuuaggugaaaaugacugcuuaaguucuuaugagguuuuaaauuuucuuuuuugguuuaaacaugucuuuggaauuugcacuguuaauuugcuuuaagucuccuuuuucauagcuaacucaaaggauuucagccaguucuggacaaagauucugaauuagugaagacuuuaaaauauuagcuuaugcuugcugcacauuuaaccugcagccugguuuugucagcuaaauaaauaaaaacuauaccucauucuauacuucugaaauccuagaaaauuuaacuucugauuuuuaguuaaaauaaccuguguuugaaaacaaucuucuguccuucaaauuacuaauuuuuuucuucaauuuuaguuuuuauuuuuugggguggggggaaguaucuguggagaacugucuuuuguacauuuucacagcuauuucuuugaucccauugaauuuguuuucuuuuuucuauaauaauugguaacuaaaauguuugagauuaaaaugaauacagauauugucuauaucacaaaguauauuucuuuuucucucaguaguguuauuugcuauaauuucagugugguuugaaauuuugcuuaauuagauuucaacuuagccauguuuggagcguuaaaauugauugagucuguuuaaaugauccauuuuuagugacauguauauuucaccucuuaaaauaaauuuuuggagaauagaguacaaaagcuuuagugaaaaauguaauagcaugguuucuaauguuaaaucucagaguuauagaaagaaauggaauuaaauucucauucugcuuuuuuaacuguuguucuuuugaaacaaccuguagauacgaauuuagacuuguuauuuacuuuguacaaaaucgaaauaggugcuuaccauucugcuguauuuuauguuauugugagcaccagguucguuugccuugcgguugcccagcuuucuuuugucuugucuuaaauuuucuguauagcuaucuaauuuuuuguugcucuaggacauaggacuuaugauaauuuaauagagauauauaucugcauauauaauguguaugugacgguguuggugcuuaucaguuugugguauuucugagauucugauauaaaguauaugcuuuugagaucugauuucuuaaccuugugauagugguuuauauuaauguaugauucagaaagcuuucuugaauuuaaaaauggaacugugcaaucguauuucaguuuuucauaauuacccuauuuccaaaacacuuuguuucuuaaauggaauauucacacaacuuuuucuuacaugcgugaguuaugaugaauuuuuuuuaaagucaacaauaguugauugaaaguaacuccuauaacaucagugaacaaucaauucuuuacacauugacaacccaaggcuuucacugauaccuuuagcuuaguugcacaguauuuauauguggauagacuuuuaaaaauguacuuagcuuaccuaccugccauuuuuaauauuuuccagucuucuugaaaaaaguuauugauuugaccuccuaccuaaaauaauguucuuuagaucuaaagcugguuagacacauuaucugacugaguuuacugaagcaaaaacauuccauaaccuuaaccuuuucccugacccccugcuuuuaacaacugccgacauaguuuuaugcuguuaugugaccaugcucggaugaaaucugucaaacagcuccuugaguuauuaggcugucugagucugaccuuucugcaaucaaagauauaugacuuaagggcucagauuugccauggcaaccgguccaauuugcugccgugagaaaaggucuaauuguugcagaaauuuaaugaucuagagcgacaucagggcugugagauuuuaugaacuguuuacaccguaauuuucauuuuguuaaugcagucuuuuuuuuguaacccauucauggcuagagcauaagugauuguguuuuauuuaaaauagcauugcauagcaugagagccguaucggagaacaugugccacucucgagaagcccuucauauguggugauauuucacuuuuaacucccuuccuuauuuucauucuuuuaaaagauauuuuaacugcuuagaccuuugccagaccugcauucaucauugguagagaaagaacuauguacuuuucuccuccauccucuucugaucugcuuacugauugagugccuguuguaaaacaguaggaaaucacagagcaucugggggaggagguaucauaucacugucuauuauucuuuaucagcgcuuggccauaaaaauucuguauuuggagaaaaguaggauauuguucagcauauaauuauaguuagaaaccccauguauuuuuuagauggugccauuuacugcuuagcagagauuucuacucugauuacagaaacaugaauuacuuguugcauuuguccaguauuggguagagaaauguuugugucuauucucaaauuaaaauuuuuccucaaauagguuaauagagggugguauuuaggagauguugaaaggcuguguguuguguuguuaugcaguuuaacuuggaaaugguugauuauauaccguaaaaaauguguuguauuuucagucaucuaauuuaggaauauuuucuguucaggaacagaauaacuugucuuaaucuauguuaucuaugcauuauccagcuggacaaaaauuaccugugcaacaaaacuguuaugaaauacugcauuuuaugugaugauccaacuagauauuuauccuauagaaaccugguagcaccaggcagcaucuacaaucuaguucuguacucuguaauagagagaaaauauguuagacauuuuauuacgaacaaaguaaugugcuauauauauagcacaaaaauacacaguauaacuuauuaaaaguccauuuaaaaggaaaauaguguaagauuuuugaaaagcauuacuguuaaaucauacuuguagugugauaggacuacaguuaaaauauuccuacaggucguauauaugccaugcuuuacauaaugguuguguucauuguuucagauguaagaaaaacaauagaugacuuaaaaaaagugaugaaaaauuuugaauccagaguugaauucacagaagauuugcagaaaaugagcgaugugaguauuuguuuuuagucuucuauauuuuuagaaaauauuuucaaagaaauaugaagcuaucuuacagccaaggaacaaauuaauugaaguuuaaaaugcuuucagacaucuuagguugaauaguugcucuuuggauaauuuuaguaugcuggagauuuguguuguuaauacgcuuuuuuuuuguuuaaaaaccaggcugcaggugauauuguugacauacgagaagaaauuaaaugugacuucgaauuuaaagguaagcaguaagauuguuuuauguguagcuguuuagauauuuugauuuuuguugauuuucagugggcuuucugugagauauuugggauuuagaauacacuuuuaaauucauaggaugccaacauuuuucuacucauugauuuuuuuuuaugugaaacauuaauggauaaauaacuuuugguuaaaaaugugauuccugacuggucuguuuuaguggugggauuacauggcuuuuuucucccaaaguucuccagugcuccaaaccucuaaaacucagaagauguauauucuagacauggaucugcuccuaauuuguucucugaccauggugaaguccuaagauaucuuuugcuaguuuuucuucuuuuaaaacugcagcuuuguaagcuguuuuuggaagaaugaaugaauguggguguauuucagccauuccucuuauggugccugcaguggcuuucccugcgcagguuguucccaucuccacccaguagauuucuuuugccaaggcuggcuuauguguuuggguuuacuucuguaaagccaaugguuccuucgucaguuguaaaguguuaacgguagugaaauuguaaaaaguauuacagauggcuuauuauuugcuacuguagaagacuguacagugucuuaaacaaauguacugagcauucguuuugacuuucagcacucauauuuuggugaugaacucuuaagauaacuuacugguugaaagaagccacaucacaaguaacaggaaguggcuuuagaaggugaaauaaaggauauguauauuaaaguugaacagaaagacaagauuuuuguuuguggugaccagugacaaauuaugagcgcuacaggucugaaauaaaaauuguuaacuacugucuuaucaauaauaguuacagagaauaaggcugugaaacauaauuugauauuuucagauguaugcaacaaugcagcaaauuugaauauaugauggacucgaggucaucugguagugccauaucucauaacaggacgcaucuuagacuucuucccauuacuuucccauuacuuugcuuuaauaaagcaaauaaagccuuaauuugcuuuauuaaaaaauaaucuauuuuuuaaaaugaaaagcagauaccucugaguucagauuugacccaucuuuuuuccucacaugaagauuacaaaugaagcaguuuaaaaaguagagauguucauauguaaaaugauaauagaacuuuacagagaugagccgccguuguuuccuuguaggguacucauuccuuggcagugcccuggaguuuaaaguauccugucacaaggcuuuugcacguuacuguaguaacuagauuuccuugaguaaggaugguaaauggaaauuuaucauuuauguguugcauuucgccuuauaaccagggugcauuguggccauuucuuaugcauuuuugaagcucuucucacaaccuugaauguguaugcagguucucuggggcucuuguugaaauacagauucugauucagugggucuaggguguccuuagagcuuacacuucugaaguguuccccaaggacgccagugcuguugauccauggaccacacuuugaguagcaaggcuguaagagacauucauccuuggaguucuguuuggcuuaaaaauugugaccccucuguuucaauauuucccuugccccaaaagaaagucucauuaagucuggguuugugccuuuuuuauguuggcuauuaacagccacgucuuuuccuuuuucuaaauagcaaaacaccgaauugcucauaaaccgcauuccaaaccaaaaacuucagauauuuuugaagcagauauugcaaaugaugugaaauccaaggauuugcuagcugauaaagaacugugggcucgacuugaagaacuagagagacaggaagaauugcugggugaacuugauagguacuugaugacaaauuaucuuuccaagauaauuuguuucuauacacauuuccucauuaaucuuuuucuucauuaauaaaauaauauguguucauugaagaaaaugcagggaagcauaauauauuaucaauaauccuuucaccucaagaugaacauuaauucucuggaauauuuucuuauaggauuguguguuugugcauauucccaugcauguacauguacuuaaauacuuaagaucaacaucuucauuuuuuauuauggccuauuuuauauaauuaauuauaccagauaguugacuuuuaauaaucauggauuuaauauauauaauguuaaauuuuaaaugaaguauuuuuaugccacacccaggauagugcucuaucuuugaauguguugugaaaaacaaaaauacacuuugaauuuaaauuugauacaguaaaauguuuauucuugcuuuccuuuuauaaacuuuggagcagguaauuuguaaucuggucagauagcuauauguaugagaaacuuuacgaaauugcuguuugaaauacacauuagcacacacuuagaauuguuaaaaugcuaaaugaaaucugcuacucgagaaguucuauauuauuuugcuuaaaugauguaccauaugcaauaauuaguuucugugaaaaauagggcaggaagcauaaaaguuucuuuuuccuaguguuucaccuauaaauucuuaggucuuuuugauuaacuaauacuauucauuuuuuaaaaccaguuuuggaucuugugauuuuucuuggucaugauucucuuucuauuuuuuguaugauguuauuucaguucuguugcauuuucaauuuuguuauuuuuguaagguccucacaucuuuuauagaaucaaguaugauaaauguucacucaugcauauagauauauucgugugcauauguauaaauccuuuauuuuuaaaaauuacaauaauacaugcucauuguaaaauauucugaguauaggaguagaaaauaaguguguauuaugugguuucaauuucuggucuuuagagauaaauguucucugaauuucuuacaacuuuauuauuauugauacuauauuuauauugcauauggccaauaucuuucuugcaaagauaaaaaaauuaucuucuauauucuacuuaugucugaauaaccucaauauauagaagcagcauaggaacuguuuuuuguuaauuuauuucaaaacauuuuuuuguuuuugaacuuagaauucuaguuuuaaaaauacuuuauucaagaucuuaguauuuacccauggaaacuaacuggaaauuuaaauaauguaaaauucuaguauguuuguuugaucuuguuaauuuucuuccuugcuaguaagccugauacugugauugcaaauggagaagauacgacaucuucugaagaggaaaaggaagaucguaacacaaaugugaaugcgaugcaucaaguaacagacucucauacuccuugucauaaggauguugcaaguucagaaccauucaguggucaagugaauagucaguugaacuguucagugaaugguuccaguucuuaccacagugaugaugaugaugaugaugaugaugacgacgacgacgacaacauugacgacgaugauggugauaacgaccaugaggcuuuagggguuggagauaauucuauaccaacaauauauuuuucacauacuguugagccuaagaggguuuguauacuuuuaacuuuacuaauuuugcauauaauuugaacauuaagcauuaugauauuuuuuagaagagcaauauuaacaaucauuaucauuguggauagugccagacaggaaaaucaucuuuugccucuuguucugaccaauuuaagaagaaaaagggaaaaaaaauuuaguuagcugguauugguccauuguucucugaaacaaugcauuguuuggggucuggaaggggaucagauuugaguggcaacuacuguaacuucaccuguccuucauucagagaguuuucuuaagaauccuggaguuaauuauauuguggacauuuuggugugcuuaggauguugaaagugacugcauuaguuaaauuuuuaauuaugccagguuguuuucuauggacauaaaaugaauacuucauaggcacaaagggaaaauguaggaggaaguaaaaauuaguuucuuuucugacaaaguaaauauaaacaucuguggauaaucaugacuuagaauuuuggcauuuuagagcugggggugacuggagauuuucuaauacagaguuuuaaagcuuuucucuaguaugaaaagccuuuuguucccuccauacuuacuguagaaucccaguauuuaaaauagaucaaagcagcuuggcucugauugaaggaaggauaggcugccuuaaguccaucuuugcccucucucugcuccauguacugcucuaaggggacacugggaauucgucuaauucgucuuucucagggaaauuuaaggccuagaagacauagaucugguugguaacaaaacaggaacucuuucgccucugagugcccuuucuacacaauaucccgauugccuguaucaguuaagggucugugguaucauucuuaagugugugugauuauuauuuagugaaauauguuuaaaacauauuugauauuucuuagcuuccuaaaguuauuccugcuccuauaugaagugaaauaauuguuuguguuuuuauauucuaauaugucagacugaaggggucuuccccugauucuucgggaaaaguugacugagaugauuagccagaaaaaaaggucgcuuuuuaaucuuuugccaggcuuuuacuuuuuuccuguuuucauuuagauaaaacagaaagaacaaauauuauuugcaggaacguuacagguaauaguggucauuauuguggaaaguaugcucuaagugcugacuagggauagaaaaauaacauguuaaccccaugugaacccugaacaggcuugguuuuuauuuuuuuacuccuucaauuucuaaaaauuagagauguuuuaaaaauucuaaauaggcauuauuuaauaguacuuuuaugacuuaaagguuguauucuuacugaauuuuuguuuauacucuuucuuuugaaauacauaauucaagccaaacacuuauaucaaaggaauggggugaugggaaguuuauaagaaaucuagcauuuaguucaaauguauuuugcuuucucuacaauaauaaagacacugaagacuaggauuuguuaauaaagaagauuuucuuuagaugucauagaucuaugagauaaggacuuuuuaaaaaauuccaucugauaaugcacaucauuucagcaucagaaaauuucagcugccucucuuacuauuauuuuuuuaguuauagaguuuauuuguuuugguuucacuuugauuuaauuugucaaaagauucuuaauuucuugcucugaaauuuuagguccgaauaaauacuggaaagaauaccacuuuaaaauucagugaaaagaaagaagaagccaaacguaaacgaaagaacagcacuggcaguggccacucugcccaggagcugccgaccaucaggacgccugcagacauuuacaggugggaggcgcucacagcugcagggcagucugcugggcuugccucucuuucugccacugaaccuuuacuggagaaaguugacuguaacacagaagacccucacugaaaagugaaguguucugaggaguuaacuuaggaucugauaggcugaccggcuguagcuucccaguccagagcagugggaauggaggauuuuuuuuuuuuuucacuuucuccucuucaccagugcuuuugaaacauuuccaaauggucuagucagaaaaucuuguaucuucagaaagcauuuuuguuuccagugggcuaggucccuacguuucuaccacagccguaacaugcuuggcaugcaguuuaccuuuucagaguagaaauuauacuguugcagguuuuuuuuuuuuuuccuuuuuuuuggaauuguuuguugagaaaacuaucacuugaaaauaccuacuguuuuuaugacccuuauuuauaaaucagugaaaauugcuaaauguauacgugggucuaaaacuuuauguagaauuuuggcaaaccaugcuauugccaccuaggacaugcuuaaaaauaacaugcuguguuuuuguucucacucauaggugggaauugaacaaugagaacacuuggacacaggguggggaacaccacacaccggggucugucaugggguggggggaggggggaaggauagcauuaggagauacaccuaauguaaaugaugaguuaaugggugcagcacaccaacauggcacauguauacauauguaacaaaccugcacguugugcacauguacccuagaacuuaaaguauaauaaaauaaauaaauaacaugcuguguuuuauuauuaggccagagaaauagcuuucaaaauaguaugaagauaccauuugaggcuauaaaauuauugugauugugacuauuuuagauauaagauuguaauaaaaauuuucagauuaauuucuagaauagauucaaggaaauuuucaaaaaguuguucucaguuuuaugaguuacguauagugaaugcauauguguuuugaauaucacagagccuuuguugauguugugaauggagaauaugucccucgcaaauccauccugaagucucgaaguagagagaauaguguguguagcgacacuagugaaagcagugcugcugaauuugaugauaggcggggaguuuugaggaguaucagcugcgaagaagccacuugcagugacaccagugagagcauuuuggaagaggaaccacaagaaaaucaaaagaaacuuuugcccuuaucaguaacaccugagguguguguguguaucuuuuaauucuuuauuucauauaguaucuuugaccaguuuuagcuauuuaaucugaaaagucauaagauuaaauuaauucuagguuuuauacuuucuugguacuaauuaauaaaaaauuaauagucacaaacaguacaaauauugugauaaucaaauaguuuauuuuuugauaaacacauuacuugucuuaacguucuauuucagcaaaaugggaaauuuaaaaugucuuacuuggcauuauguauuacauuuguagcuaggaaauuauuucgcaguuuauuuuaaauaaauuaccaguaggucauuuucugauaguguaaggagcagauuacauuauucucuuuuaaauaccuuggcuaaguuaaagaaaaauaaugcaugcauagcagauaauuaccuaaagucuaauauuuuaccuuguaccagugaaacuuaacucuugggggauuauggaauuguuuuauaaucugaugaaagcuguagacccuguccauagaaaaaauagugcacacucaauacacuuucacccaccacacuucuuacaguuuuuggugguggugcaggggagguuaggaaauccccaaauaaggaugucugugaaauauaaggcuauugauuucuucauucuuguguuuuggugcguauuugaaguuuucaauuuaaaaaguauuuaggaagauuggggaacccaugccuggaucaaaccaguguacacauuuguauauacaauaagauacaugcauauauauaaccuuaucuaaaaauuccauugcuuuuacuaaaugguauuauacucaguguauuaaaugguaauuggggauggagauugguagcauuuagggacaguacauaugacuagaauguuuucuuccccucuucuuaguauaaugaucuuaggugaccuggaaaguaucuuaccuuauuugauagucuuccauacuguuagaaaacagguaauggauguuaucagguaauugcugauaaauguuugaaaauuaguuuuuuguaaggacuuaguguaucaugguacagcuagaguguggaaccuauuuuuuauuucacccuuaguagcuuugcauuuuguauggaaauguuuaauaguaguugcuauacauuuuuuaacaucaaagaaauaguucaugauuaugguaaguacuuuggaagauauccuuuucaguaucuuuuuaaaugcuaaaauaccucuuuuucaaaggcauuuuaaauagaagaaggagaagaaggcucuaugcucaucgugauaaaguggaguuuuuaggaaaguaagcuuuaagcugcuuuuaccaguugaacuccaaaaauaauguaggagagagauggcuuucuuuguuuuuguuucagugguggggcaagguagaagaagguggcuuuuuaaauuauuuagguguuacguuguuuuaacuaauuuugagcacuugguagacagaggagaacaaaauguacauuaaaguucaccugucaaauuuucauuuguagagggaaggauggagguucuaaauaccagcaaucuuaaaaaaaaaaaaaaaauuaacuccuugugucuuaccuauuuuuguauaaaacgacauguacagauauuuccagcaauuuaugcacauucuuuaauucuguuccaguugaacauauaguugaccagauuaaaugcagcaaacauccaggugaaauugagucauuucuuuuuuuguggaacuucugauuucugucauugaguuaauuauauuaaaauuuugaaaccuguacuuauuccuacuaguaucagcacuuuuauuuuucaacuuccacugaucuuuuaaaauugaggcaauaugcaguaaaauauuuaaauaauugcauaaacaccaccaaagagauaucaguuagaaaugucaguacuggugaaacuaagcuauuggcuagcaggcagcaaggccaucauaggauagcucauucaucaacugauguacaaaagucagaguuugacacccuaauagcauuuuuauuuuaauacauuauuuuucacagcaugggcuggacaugaauggaauguaugaaaguuugaagaccuuuuauuuauccauuucuuuuuuuucccagauaaaauuuacauuuuacauuuuguuuucuugcauguauacuguaaaaauuacuucuguuugguggugaaauuaaaacuuaaugguguugguuucucugaacaauuaguauuuugguguaguaguguugucuagccaaaaaucucgugaauuuacuuuuaaugaaaagaauugccaaaugagugaaugggaagauuuugugggugucuuauuugcauuuuauuaccauaaccugacuuuuguuuucuaggcuuuuucuggaacuguuauagaaaaagaauuuguaucaccuuccuuaacaccacccccagccauugcucaucccgcacuacccacuauuccagaacgaaaggaaguucuguuggaagcaucugaagaaacuggaaagaggguuucaaaguuuaaagcugccagauugcaacagaaagacuaggcccugucuaggaaaugggaauuuacauccuaaaaccuaguuguucauuuguuuagaguaucuauagcaaaauagguuacauguaguuugaaauaagguauccugaguuacuuuggcaacaaguucuuuuacccuuacccgugguauuugaaaaaaaucaagguaacugucugaauacuuuaauaucagcuuguuuugugaauucucugaauacugucaacacucuuaucuaaguuugccuuuaugaugcaguggcagcauuuugaauuacuuuucaaagaauacuguucauaugcauuguuuuuguguuucaaacuaaauacaggcaguuuugugccagcugugauauugugcauaccauauggaccauuuuaaagaaaauuuuaaaauuucaaauagauucaacaauuacauuacuugcuuucacauuuuaaaggcacuuuaaaaaaaucuacuucucuuguagguuuugcggcuaguuggcuauucaagaaaccucgccccucugaaugucauacuguaaucuuuaaggaagaaagcuacaugaauuaauuguacucuaugggaaaauuucuuuggaaagauauuuuguaaaacuuuuuuuuccaaguaaaaacuuuaugaaacuuggucucaaaaauguugugaacuuuaugauucaaaauugaguacagauauguccuugauucauauguaugcuacauguaucacacaacagaucuggaauucuuucaguuccucagauacuucucccuuaguuuuugcaguuucacugggauuauguuuugggaaacaaggaaaggucuagaugcuuaaacauuuuaaauaaaaauuccuuacaguuucaucuucccaacauuuucauucuuuaaggcuacuuuccuacuaacugaaauaacacauuuacuuuuaccacaauuccucaaaauaaauuuauucuaacauugaaaauaacauuacaaguuaaucauuagcuugaugcaugcuaaaauguagcuuuuaaaaagcauucugcauuaguacuaaaauaagccaucaaugccaguccacccucucuauucauggcuaaauauuuaaagguuauuuauagcuucuuuaaugaauucuucuuaaacaaagugaaauuauguccuagaaaaguagaagcuauucguaacuagagcagugcaacuuuaaaguuuuaugaauauguauuuuaaugacaagggggcgagcuugcauccccacuaguuaauggauaauucaaaccgaggacugauuuugaaagaucaccuaaaaauguagauuuguucuuuaguaaauuuagaucaacuaugcauauauuuuguagguaaaucuuucaguccaugccccaacccucaccaaaaccaaagcagaaauuacacacacaaagaugcucccguuaggaauugcuauucacaugaggcuuucugugcuagauuuuuuucucagaaacaaacuuuacuguaggacuauugugguguucuuaacagauuuguaauuucaagaugcgugucauuaaauaauuuuucauguucacagacuugauu

SEQ ID NO: 15130 - RNA, 16818 nt, Homo sapiens
ggccggguucugagcgucgucgggcgugguggagcucggcggggcccagcgcgggccuugccgcggggacacagggcagggucgcgcucugcccucugccgccacuccaggucagcauccucagggcucgcgugggugacggcccgucucguagcgggggugagcugggcugguccgaggggucuccgcggccuccccagccacaguccccgcccgcuccgcgcccuccccgcggggucgauggcugggggacccggcuccggcccaagccaaucaguccuuccugagcagcgugagguggcugcccgagggcgggcggggugcugcucuggcgggcuccuggaggccuggguggcgcagcccgggggagcggagggaggaggcggcccugagaccgagccgcgcggcgggugggcuccccugaccccgcuccgacccggccccgcgcccucccggccgcucgaucgcaaagcgucugcugccaucugguggcggcgcccgggcaucugcggagcggggaagccuggccaggcuggugcucagacccccacccagcgcccccgcgcccccgcgcccgcgccgcucucccgggaaguccccaacagccucuggcuuugcucggcuucucccagcagaaaccgagccccacgucuccugggagccagcgcgcgguggccggugccgugcccagggggugacgugcgucccucucuaacucgguuuucucaucucuaaaaugggguucauggaagugcgugccuuguggaggcuucgcaaggcucccagguucccuuagcucagaaaucaggccuuaccccugaggcgcgaggcugcgggcacgaggcugcgauuuggcggcagccguauuugcacacugucacagaauuaaccucagagcuggcuggcugcggguccuggagggggugcagaaaaggggagggcgggccaggcucccaccaggagcaccugcagaucgcccugaucgucaagagcaaggcaugaccccugcagaacgggcuguaggcucggggcgaggggggagggggaggggacugucaccggggggggggccagaauccucugagccuggggacaggggacugagcgaggcagguagagccccaggcccaggcaagagcucgaagaguauuagcuuuugcuguuguaaaccccaugggguggucugcaaacugcuucccauacucgcuccgucaugcccuggcucggcucugacaucacugguguuggccauaucgcggauuuucuguuucccccucuguaaacuggggaugccaaugccagcccccacucccggaugagguaccugguguacagauggcucggccacucugcugaccgugcccccgacaucauuguuccccgggguuuucccucuaagcuccaagagguuaguuaauucucugccagugugcagagacucccacagcugcccccaaaccuugaggucuccccccauauccuccugccuuauaggcaaggccuguuuccugagccaagggaaggcgggugucuuuccugggaacccccuccgcacgaucacagacuagagaguccaaaccacagaucauguuuucuuuccaaaaauaggagccccacugaggcagaaacuucauucuuuuaauaagaugaugguauguuuaaggaaaauaaauauuucuuuuaaaaaagaaaaggcgauuuggauccacucacaugccaagcacugucccggagacccaggcuuggugcauggcugcggaggauuccagcaggcaugcaacuuuaauuacuucucaguguaccacagagguggccugcagcaccgggugugacagcaagguaugccaccaguaagggggaugucucagcagcugccagcacucugccugugaaaacgccagcuccaauucaaagguaucaaauauuugccuagcuguucaacauuucuucaaauaauauacucacgacuaauucauaucuggacucgacgucuucaucucuccaggccucccuccuggauuagcgugucuugucuauuccgggagaaaguuguccuacauucuaaaaauagagcugggagucuggacaugggcaugcacagucaggggaggcuuuauuuauuuaucuuaaggguuguccucugaagacagcugcagcugagccugggacucacucaucaaauagccauucgcggcugggcgcaguggcucaugccuaaaaucccaacacuuugggagaccgagguggguggauuaccugaggucaggaguuccagaccagccugggcaacauggugaaaccccaucucuacuaaaaauacaauaauuagccgggcgugguggugggcgccuguaaucccagauacucaggagacugaggcaggggaauugcuugaacccagggggcagagguugcagugagccgagauugcaccacuaaacuccagccugggugaaacagugagacuaucucaaaaacaacaacaacaaaacaaaaacaaacaaauaaaaaaacaacaacagaaaacaaacagccauucauagguacucagcagagggcagggccuucuaagaagucugugcuggcugcugccuuccaaaagaggccgugcuccacuccaggggaugcuccgugaccucugaagugaggacacccucucaaaucagaggcacgggccucucuccuccauagagggguucuuccguuccuggggauuaaaagccccaaaugccccuguaucauccaggacccauuggguggauugcucaaucuggccauccaggcggaguuuuauaaauaacuguuugcaugggggaccucaggaggaggagugguacccugggucuaguagcagugggcuguucccaucccuggggccgcagggcuacgugaggaggcguucucugacgcagggcaagguggcuguguaggcagcacucccugauagcaguggugaccgaagaaggaggaggagcucagggaacccccacucuaggugcucuccucugccccccaguuuccugcuagggccucccagguccaccugcccagaaggcagagcgaggcauccacagauagagucuguggagggguacacagagccaguggaggagggugaagggggugugcagggcagaggggagacuaccagcuccucucucuuuuuugaacccgcuccaccucuccagccuccuucugugucuccugugcuaaguaccauuucucuuucuuucucauguuucaucaccuccgucucucauugacucuccucucuguuuuccucuugauauauccuccccacuucucugcugcagaagaggcgaggugaguaccauucaccucucccaagugguccaguggcaguggggcccccacgcacucuacaccguuguuguguugcuagaggaaggagagcagcugagcccuggggaccuggggacgggcuucauuugauucucugcucuuccuccucugaacuacucuaagugaagccaaucaggauuacuuucauuucaucacuucaaggacuuccuccucggagucuuuucauccuucuccugccuuggccuagaauuagggagggggaguuaguccccuccucucuucagccccucuggccagcaucaagcccuuauugagagcuccaacugugcacccagcgucagaaaugauuuggggugccuguguccggagcauacaguccugacauggguggggacccaugauccauucauucagucaucggacagaaugcauccagggccacccugcuugggcuccgggcuagacuuuuuuuuuuuuuuuuuuuuugagauggagucuugcucugucacccaggcuggaguacaguggugugauuucacugcaaccucuaccucccagauucaagcaaccgauccuacuaccucaggcucuggaguaguagggacuacaggcaugggccacgagcaccaucccuggcuaauuuuuuuuuuuuuuuuuuuuuaguagagaugugguuucaccacauuggccaggguagucucaaacuccugaccucaagugaugcagccaccuuggucucccaaagugcugggauuacaggugugagccacugggcccagcuuuuuuuuuuuuuuuuugagacagccuugcucugucacccagguuggaguacaguggcacuaucauggcucacugcagccucuaacuucuggacucaaaagauccuccuaccucagccuccuaaauagcuaggauuauaggcaugcaccaccacacccacuaauuguuuuuuuuuuccuuuuaauuuuuguuguuguuuuguuuuuuguuuuuaggcagagucuugcucugccacccaggcugaagugcaguggcaugaucucaggucacugcaaccucugccucccggguucaagugauucuugugccucagccucucaaguagcugggauuagauuucgcaccaccaugccuggcucauuuuuguacuuuuaguggagaugggguuuucccaugcuggccaugcuagucucaaacuucuggcuucaaacgauccguuggccucagccucccaaagugcugggauuacaggugugagccaccgugcccagccaaucucuggcccugauagagcagauagggaagguguguagcacaguggaucaguagauaagcccauccaagccucagucuccucuucucuuaaauggggaugagaaucccuacucacagguuugugugaagguaauaugaccucacagaggguugcuuucuuauuaaguggcagggacuucugcucugccccugaagcccccaaauacacauaaaagguguaaccucagaugcaaguaaggaggcaccaccaagaggguagaggauacagaccugaaacacaaggaggagauuggcaccucagcuggaacagaugggcuugagcccccgaauucugcucggguuuuaaauugaauaaaauaauccccagaaugaauauccccucugugaagcacguccacugugaggaaaccccuaguaacagaucucaccauggcacaaagaaaauccugcucucauagucuuggaugauauauacagccagcuaaugcaaaaaaaauuucauguuauuuuugcuuauuuuuaaguccacugggugcaucguggcugaucgcuguucugacauuuuucuucccucauuaagaaagaugccccuggugagauaccugugcugggcucagagcagaaaauaaauaucgcuggcauccacuuuccuauacucucuggguguaauuaagaaaaaggcaccugcaggagagagaaagugcaggguagaaaauggcccagugguuacugcucaugagaacuccccagucuucauaaccauccaaaugucacuccuuccaugacauucuucuucuucuucuucuuuuuuuuuuuccugagagagggucucgcugugucgcccaggcugcagugcaguggugugaucauagugagcuaugaucagccucgagugagcccgagggagcagccucgaccuccugggcucuaaugauccucccgccucagccucccgaguagcagggaccacaggcguaugccaccacgccagucuacauauauauauuuauuuuuuguagagauaccgucucacuguugcccaggcuggucuggaacuccugggcucaagcaauccuuccgccucagcuucccagaguccuggaauuacaggcuggagcugcuaugccggacccauuacaaccuccuggaucugccggggucccccuccaucucugagcccuaacacuucccuuuggggacuuuuccuuuccauugcgguuuugcuuuucccccuucacacgucucuuaucccagcuguaguuggcugucuuguuuguuuuguccaagucacccugcuuuucuuuggaggacccauccaugacucacaguccaugugauuuagguagagcuccagcagggaguggcacuacccaggaauggccaaccaaugagggcacagaagugcagcugcaggccacugugauugguucaggggugggcagugagcuaagcugaaccaaucagaacgaaucccaagauauggcggggaagugcugaacaagccccucuccuugagcugaggcugggacugaaguuguagucgccuuuggcgccacuggggagagccugccugugaaagaauuccacuccgaggacagcugagccucucaugacaaucuggguccugaugccgcuguuugagccccugggugcagggcugcuggaaacuuccggaaggagauugcucuucucucugggagacguccccggggaagcuucagacccugccaucucguccauccccaccaugcccaccaccgcucuggcugaggcagcucccugcggaguccugcuccgggcucagucucccagagaggcagagucgggcaccgugggcaugggagaccugcagccugccugguucucagcucucaggggcuggccagggucacaguuacuguagcccagggggauucugugagagacagaugggcuaauuuggcucguucgucauuuuuaaugcccuaauuuccuguuuuacacgcagaaauggcccauaaauggcacagcaggcuucagggagcugaacuuguacuucccgcugggacugacuuacuccuacuuuuuggaaucaggugcaccugcagccguucaggagcuggcuggccgacugucccaguaccuccuuggucaccuucauacggagcuuugguccuucaacuuuggaaaggguuuugauuaccgaaugccaggcucucuuucagucggauuuuccuuugccccacuuuauuucauuuugcuuuuuuuuuuuuaaauuauuuucugggcuaggagccggggcucaugccuguaaugcuagcacuuugggacaccaaagcggguggaucaugagguucggaguucaagacuagcccggccagcacggugaaaccucaucucuacuaaaaauacaaaaauauuagcuggguuuggugguacaccccuguagucccagcuacucaggaggcugaggcaugagaaucacuugaaccugggggguggagguuacagcgagccgagaucacgacacugcacugggugacagaugagacucugucucaaaaaaaaaauuauuuuccguagagaugggggucuuucuauguuguccaggcuggucuugaaaugcugggcucaagcaauccucccaccuuggcuucccaaagcacugagaugacaggcaugagcuacugugcccagcccauuugccccacuuugcacacuuucuccucucuugucaccuuuccuuccauuaccuucaaaugugcucaucaaaccgugagccccuaugaggcacugggcgugcacacccugagcagaggccucccugaugcuccacgcccauguagcuuuaguuucugcuguuccucucuccuagggugucuuguuccuucccugcauaacccuuaucauggucugccauugcugagcauuuuguuaugguuguuuauuggguucacugcuguuacacugucaguucucagaagacagaaacugauuucuuuuucuccuuaagaacguuugcauccagcucagagacuggcccacggagggcccuagagaaacacccagggcgugaccgagugggugggugugagugugccgcacccuggcccuggugcuggaggggaaccaagcagaaccugccccaacacugcucccaggaggcucagcuucuagagggguagcggugggagagggguuggugggguguggugagcuguccuaagugcaagugcagaucagagucugagcugcagcugggagagggagacaggaagccugcccagcagcggggagccugggguggacucuuuuuuuuuuuuuuuuuuuuugucagagacagggucucacacugucaccgaggguggagugcugugguguaaucucagcucacugcagccucgaccucccgaacucaagagauccuuccaucucagccucccaaguaccugggaauacaagugcaugccaccacacucggcuaauuuuuuguuguuguuauuuuuuguagagacagggucucacuauauugcacaggcucgucuugaacuccugggcucaucaaggaauccuccugccuugacugcccauaacgcugagauuacaggcaugagccaccuugccccgccuuggguggacucuugacugaaacacagaacuuuaagagaaaugcagaaauaagagaaugggggcugccauccaaugcuugaucauauucgucuccugcuuugcuuucugauccugacuucccauggaggaauucagccuuaggagcagaaaugggcugugguuucuaaucugccccacaucauucagcacagggcugggcugcguggccugugacuaaucagcgcucacccauaagaaauggugugcaucugcaaaugucguggugucccuugcaaugcccuauuucaggucugcagugggugagggaugggcagggaagcacagugaauuaugugacaccagccuggaauggcuucauccaacaaagggcugacauuuucucuugguuuauuuugagauggagucucaaaaaucugauuacagaucacgccuguaaucucaacacuuugggaagucaaggcaggaggauuccuugaugagcccaggaguucgagaccagccucugcaacauagugagacccugucuccacaguugcccaggcuggagggcaguggcgcgaucucggcucacugaaaccuccgccucuuggguucaagcgauucuccugccucagccucccgaguagcugggauuacaggcaugcaccaccaugccuggcuaauuuuuguauuuuuaguagagacaggguuucaccauaucuggucucgaacuucugaccucaagugauccccccagcugggccucucaaaaugcugggauuacagacaugagccaccggcccggccaggagugacauguucauuccaagagcccaucucuguuccuguauuauuuacaacggacgcuggccuuucggacccccaaacauguaagugguucuagcucgaggagaggugugaggcaugugcuauggguucaagucccagcucuaccacugaguagugaaaggccuggggaagcuccuuaaccucucacaggcuuacuuccugccccugagaagugggagcaguggguagccccaggcgaggguggggguuggggcaaugccuggcccauaaugaagcacccucugccgagccucugcguggcugccccgaagccugggugcaaggccccucugucaccucuggaguacuugccuccaucaaagaagggagcagcugccuccugccgguguuagccaggcauaggcucucugcccucccugccugggcuuuguguauucuugguguucaaaagguaucucuugaaugaugugugaacaacugguagaaacucaucagcacuuauggaaauagcacaccaaguugucaacugcccguaaacccuuugccaucccuccgguggcagcauguuccccgcugguggggagaaagggccuugcuuggucucauggaccagccaggcaggcaaggaggccgcaaacacaggacuaauagcacccucguggccugcccccagcccucauuucagaacguggcccuuccugaagccgcuuuagcuggcugggggaggggugggguuggagggguggagacgguagcgguucuccaccuucccucugccccgcugugccgcccagcagauggggaguuagcacgucacaggugcagcuccacuuuggucaccuggaggcucugcuugcaaauguggggcuggugcuuggaauucaagaugcccaauaaaggauccauccacagcggcugcccacgggagccaucucucuguggcucccaggagccaggagggccuggagcuggggacagggggaaguucugauuuuaaauuggggaauucugacaucagcccagucucguuccccagaaagaaacuggucccgucugccgucuuuccagauaguuccuucuggagcagaaguaguccaaauuccaaaccucugauuacugacauuugcgguuaguuuuuugguauuauuuuuauacaggaaaacuuguucugaauaaugcaacuuuacacagacacucucaccacugggccucaccaaguccugauuuucaaaacacucagagcccuuccugagcucaccugagagaugcugucuuuggaguuuguuccugaugaguuuuagagagcuuuucuuuuucuuuguuucuuuguuucuuucucuguuucuuucuuuuuuuauuuuugguuuuguuuuuugagauagggucuuucucugucacccaggcugcagugcagugguaugaucuccguucacugcaaccucggucuccuggcuucuagugauucuccugccugaaccucccaaguaacaggaauuacaggugugcacuaccaugcccagcaaauuuuuuuuuuuuuuuuuuuugagacagagucuugcucugucacccaggcuggaguacaguggcacgaucuuggcucacugcaagcuccgccucccagguucacgccauucuccugccucagccuccugaguagcugggacuacgggcgcccgccaccgugcucggcuaauuuuuuguauuucuuuaauagaggcaggguuucaccguguuagccacgacggucucgaucuccugaccucgugauccacccgccuuggccucccaaagugcugggauuacaggcgugagccaccgcacccagccuccagcuaauuuuuauaucuacuaaaaguagagauggguuuucaccauguuggccagguuggucucgaacuccugaccucaagugauccaccugccuuggccucccaaagugcugggauuacagguguaagccacugcacccuucuuuucuuucuuuucuuucuuuccuucucucccucccuccccuuccuccuucucucccucucaccuuuccuuccuucuuccuucuuccuuuccuuuccuuuccucuccuucuccuuccccuuccccuucccauucucauucccuuccuucucucucuuucuuucuuuucuucuuuccuaaagcagggguuacacaaauuaaggugaaccgaauacaucuauauuuagcaagugaaugcuuuaacuucaacacacauagauacuuccuagaaacccuccccaacacagcgacaacaggcugcauugggggcucaucaggaaugaguggccugggcagaauggcccuccaaccccucgcacugcccugcccauaaccggcccugcccuugagggcuuuugggaaaagguaggaggggcagaaauaaccuugacuuucagccaaggcagaagagccagaggauggcugcugcuccuggccugcgcacugcggcuccuggaagccaagacgggcaggcuuguguggccgcggugagcaaggagggcagccaucccaugcagaugugugggaggggcggggaggcagccaggaguagcugugucaggcaggccaggccaagguccuggacuggccuccuugaaaagcagccccucaucccugauagcccaggguugcggggagccauugggggauggucugagaugaugucuccggaccccgugcaggaguuuuguuacgacaaaucuagucccuucucagcuccuauggugacaagaagcuccagcuauuuuauuuuguuuuguuuacuuuagagaugggauuuugcuguguugcccaggcuggagugcaguggccccaucucagcucacugcagccucaaauuccugggcucaagcgauccucccaccucagccuccugaguaccugggacuacaggcaugugccacaacgccuugcuaauauuuugauuuuuaaaaaauuuauuuuuauguauuuauuuuuuguguggagaucuggaauucuugggcucacacgauccuccuuccucggccucccaaagcacugggauuucaggcaugagccccacaguccagccagcuccagcuuuuauuuacuuuuuauuuuuuugagacaaagagucucgcucugucacccaggcuggagugcaguggugugaucucagcucacgcaaccuccaccuccuggguucaagcgcuucucaugccucagccuccagaauaucugggacuacagguguguaccacuacaccuggcuaauuuuuguauuuuuuguagagacaggguuucgccagguuggcugggcuggucucaaacuccuggccccaagugaucccccacuuuggccucccaaaguguugggauuacaggcgugagccaccgcaccuggcccagcucuaacuuuuaaaccugcucacuggcuggcucucuucucgacuucuugggaccugaguuguccuucaucucugugaccuaccugacagguguuucugggguccagccugaagcaccuggcuggugagaucagaguccaauucucacccucuucccaggacccccucccagcuccugagccugucaacccuggcuaugcacagcccucgccugagaagcgucuucaaaauucuagugccuucuccucccuucaauuccaggauaauggcacacacagcaccagucaggcccuggccuguguugcaggcacaccuccgauacauuuugaccugcaugccaacugcagaaccuaaacccaggcaggggucacuccccagcagggugcugagguucaaagagcucgaaggaaauaccugccugggaagacaggugacaggugacugaguuccucuccagaacuuuccagacaauaaucaggcugugugucaaauucaccaagauuuagcuccagacccagcugaucugcagccaggaugcuauugggagcaucacugcuuccgucuuugacccaucuuuccacguggccccccagacagagagcacuuccaaccuaugcauaaaaauacaggggaaaggccaggugcaguggcucaugccuguaaucccaguacuuugggagaccgaggccauuggaucacuugaggucaggaguucgagaccagccuggccaacguggcgaaaccccgccucuacuaaaaauauaaaaguuagcugggcaugguggugggcaccuguaaucccaacuacucaggaagccaaggcaggagaaucacuugaacccaggagguggaggcugcagugagccaagaucaugccaguuauacaacagccugggucugucucaaaaaaaaaaaaaaaaaaaaaaagggagcagagcgggggaagaaaaaaaaaaaaacccagagagcacuguuauuuacccugaugccucauuuucaagcaugcauugugaauagagcugaccacaguagcacaggucucaccguaggccuccaggaacacccugcaaccucagucugccccuccacauucauuuccaggaaacuggaguugaucguuaauucucagacauccuuuggugcagacuggaggauaucaaugaacaugaacacaugcgagaguuccuguacggagcuguggaccauaaaccacgcaugcugucccgguggcaagucagggggcuuucuggguaguucugcuuucucucccuguauggagaguuccacagugacucuggggcaggcaggguugagggccccuuaucagucaccuggucccuccucuccuucccaaugucacccccauucugcugaccucaaucccugcucuccagcuacagauacauuuccuugaucuucaccuugaagccugggcccuugcucuucucuauuccuggcacauccuccucacagaucuuuacauagcagguugauucucacccuuuaagucuugcucaaggucaccuccucugagaaacccucccugaccacccaggcuaaaggaauccccgccaccccuccccucccacccgccccccgccgcacaaaaugcuucccacaccugccacaucugggucagucuccugucuguagagugcaaguucacagcucuaguuacagcagcuacaacugugucuggagcugggguacuaccccauuuaaccaucuguugauuaaugcacuugauuaacaucagaggacguaagguccucguaaagcuaagaaagaauuuaggagaaugacuagggcuggccacauuagcaauggacccacaguaggaggcuucagggacacccugccugugucccuccaguguucacugcucccuugcaugagacccagaaaggggcuggcacucugcuuggggaaaggcucugccuccaggagacugcucuguugugugcagaacaagggggaagugccagaaauuaauggcccagggaacagccuucagcaaugaugaagagaaguuggauaaguagcccagcucucaugucuacgggaugggucaaggcugagucugcacugccucccagaggccccaguagaggggcugccugcagcaguaucugcucagucauacaccccuacacguguacacuaggaaggaagugcuggcuuccuucccuucccugcugcacacaacacucccugaaacaugccugcaagaaccaccccuuggcucagcagcuuugcagugaugaauccaaccucugcagaaaaggcacccugguguucuaauuccugggcauggacaaacugccccgaggaggaugagaggugucuccuucaccucugauguugggucucagguuccuggguaaagggacuccuuugguuuccuggcuccugccccacagacaaauuaaacuggacaaggugacaaaaggagucauuuggaaaagucuugggacagggcuuaguggcucaugacuguaaucccagcacuuugggaaguugaagccaggaguuugagaacacccugggcaacacagugagacuccaucuccacaaaauuuuuucagacuuagcagagugaggugacaugugucuguagcuucuugagaggccaagucaggaggaucacuugagccugaguucaaggcugcaguaagcuaugaucgcaccacugcacuuuagccugggcaacagagcaagacccugucucuaaaaaaaaaaaaaagaaaaagaaaaagaaaagucaggccgggugcgguggcucacaccuguaaucccaguacuuugggaggccaaggcagguggaucaccugaggucaggaguuugagaucagccuggccaacauggcaagaccccaucucuacuaaaaaauacaaaaauuagcuggucuuggugguaggcaccuguaaucccagcuacucaagaggcugaggcaggagaauugcuugaacucuggaggcggagguugcagugagccaagaucacaccauugcacuccagccugggcgacaagaguuaaacucuguuucaccaaaaaaaaaaaaaagaaggaaagucaaagucuuguggcuaaagacggcagguggaaugaggagugggagagaagggcggggaaaggaggugagaugccuggagaaguugagguccagggaaccaacuccacccagagcaagcucucugcaggcaggacucaagcaacagccgcagaugggagcaaaaaaaguuuugcuacuccucccucccagagauauuucuaagagcuccauuuucuuuccaguuggcuaagaagcaaaaaaggaacaauagauucaagcugaaauaauuugcauuuaugaugaacacaaggaauaucuaccuugcauuuuccuaaaaaagaaaaauuaaaccccauuuuuaauuaacugauaaacuauuaaucaaauuuuugcaauguuaggugacacauuauucauuuagauagaaugacugugaacuuaaacuaaucaaaucugauuugcccacauaggcuugauugaaauacauuuuaacuagcauauacaaagagaaaaucuuggauuucuuaccuaaucuucagaguauacugcugaguuaauaagggcaguuuuuuuuuuaaaugagaccaccauuucuucaucugcauaucaaaaucaagaggaacuuaauugcaaaacacauauuccugaaaucuaaucauuacacugcuuuaggguauuuuauugaagcauguuaaauuauggacagaauauuaaugaugaaacuaaucaaacccaauuagucacuucuaacaauagucacauaaauauacaagucagguacuaaaguacuguagauaugauguaaaaaugguuaaaaucuuaaauguauggaauauuuaugaaauauucauguugaauuuaaagccaaaaauuauugggguaagucacuuuaaagaaaauaaauuaggcaguguccuauacuguuugaccggaauucacaaguucacauuuucuucagguaucuuugaaucuaggagauuagugagucuauaaucaaucaaucagcaaaauuuuaauaagaugacuuaccauauucaugaccuaguauuucauucuugcauccagagacuuuuuuuuggauuuuuguuuucugacuuuuucaaggccuuuuggaaaggggucuccaggccuuggaaaagcagauggagugguggaugauuucugggguuggggauuugccauccacacugucuccuucccugccuccagccccaggugcagaacuugcucuaggggcaaaagcagugaggacagaacagaggagucacugcccagggggccuccuccuccuccucucauaccugaggcugcagaggaagcugaagggcccaggggagcuccuggccuuggccugugaggauucuugguggaagauuccaggcugggg

SEQ ID NO: 15131 - RNA, 8376 nt, Homo sapiens
uacuuaucuauuaaucaauucuauuacauuucuuuauuauguuuuaaaaauauaucagaauaaauaaauuaguaucuaucuauauauguggaaaaccagcgguauccaaaguaaaaccaacaaucucagcucuuagauuguguagccauaguauucagcaauuuccauaucucuuucccuuucaaugaaaaacugcacuuuccccaaagagguguauuuggcagcauucucacgcucuuguugagccuuucucuucauggccucacgcucuggccucugcucuucugugaugggcguugacauuacuggcucaggaacaguggguuuccuccauggacgggguuggaggcugaagucuuggauuagaaauugauuuugaggcuugggcagugaccggagacuggucacagcaguggaaacaggcucccgcugcagagaagaacaagaugauguuuuguaggcugauggccuagaagcagcagauugagggacaguaggcuggguaggguuggcugaacuggguuggguugcuuuggcugaaauuggcugagcugguguggcaggaccugucaaagauguguugguaggagcuggucgggauggauugacugcauucgauugagcugaguuaguagaaucaggucgagcaggguaagccacagcaggccuacgugaggcuagaggguuuggccgccgagaaacaugucgagcuugagguugguccagggucagaaagggcaaagguaucaacuugaccuucccaggugguggcaacucagagugggauggagauguacacucuuuuucagcacuaccaucuaguuucugggccuugacuugaauuuucuccgggccuuuacccucauguuggauauccagccaugguuugagagcugggaauggcuggcgguuuuggguguugcuugagcuucccaggguccuggaggaagagaauccaguuuucauaucgaucuuuuucccgagugcauggaaaacuugcacggacucuagcaugugcaugccuagggagcuucggggcuuuuuaagggucuuuuggcuaagcucagguugauuuuucuuccguuucauauugggaaugguuugcuucucuucuaccuugacuuuuuucccugacugcuuacucucuucagauuucuuggagcuguucuuucuguucccuuuggucuuuuccugcccauggcucuuaguuuugcugauccugcuggaugcagccuugugagguuuguugcuagaaugcuuggccuuguucacagaagcgcuguuacugacuguagcacugccaacaaccacuucucucucuaauaggcacucuggguucuuuggcuggauuuuggccuugggagcacccuggauaggcucggaagcuuuaugcuuguucuuccugacuugaucagagugacccuuuaugacacaugacuuuuccugcaccugauuuaccuugauggcacugguaucuuuggcuuucuuugcugagggacuuucagguuggucaagaucuuguaaggaacugaagaucggggggagguaaguauccuccacccauguagugaugucugccaaaucacugcuagacucaaucccauuuucaaauaucccuugguccucaagacucaggcucuuauuucuuagauuggcauuuucagaaccaggcugcuccucuuggccaagaggaucaaugcaggccagaagcgggugaauaucggggauuucuacaggaaguaguggaggaucuugauuuccuauuaggaucugguggacaucuagaggcuuugaaagguugguuuuaaucucauccaaauucucauucucauuuuuuuccuggcuuggagcuggagacagugucaagagauuaguaggacucuggacuggaguuauugaaauguccccaagcucaggugauggguuacucucaagugucuggguauuucugcuacugaaggacuuggagaauucuggaguuuguggcagacaaaaugucuggcuuggagauugcaaucccagggaaguauccauccccagggaaguuuccaucacuacaaaggaaucaaggaagaagucagucccugguaagugagaugcucccccuacacaccagugcagcaaucggauaccuuuccaacaugggcaaggcauuucuacuagcucuucuuaaggaccaugggcaagacccuguauuaggagauuggcagugacuguucucuuacugguuaucauuugaugugauuguuucuugguuuucuuuguauuucauaggguuguuguagaucaaaaagugaaagugauuuuuaaaauaggagauguuuuauacagccucacauucuuacaggguccuuucaauucucuccacucuccugagagaauaagaacaguuuacaccauggacuaggguaagguagagaguggagcccuuccucaugaaauauauaagcaagcacagauucugagccuguuuguuuuggagaggaucucugaacacaaggucuuaaauccuauuguaaguuaaggaaaaucaaaaugucaccgccaaaauaagaguucugaagugccuuccaaagagacuaaaguaauagauuaaggaaggacauuacagcgugguagugugggggaagugaucagucagggcacuaaaaaguguaucccucaguaugcucuugcgauucucuuacauguagcauagauggccauuacaguguuccacuuucccacuuauaagguguucuuauauagagucugaaaauggagagcacugccaaagaauagugguugaagucucaggacuuaaauucuaccuauccacggacucaccacucgcuacagauuugacccuccuuuucaacgcugacauuauuccucuccuuucuugauguuuguacucaccuugaacacugguuucugugauggguugagaagacacagaguaauacaucccagaaguagagacuggugguaggacauuugugggcugaaccuccuucagcaccaucaccauuucugguugaugggcagaagcccuauauccuguguaugacacagagccauaagauugcaggcaggauaguugaggccccagugugccuugauuauaguaauagaccuggcuuccuaucuggcagggaagugacagguuauggcccugcugauuuggaauuugaguuaguguccccugaacaaggcuggcagauagugauggauacagagggaccauaguauugguaucugaaguuuuauaauacugggcugucauagacauggaagagacagcuguguucugaucaaugacagucacagugaagucccugagugaggaugacuucuuuacugugcuugcuguacuaucccacucaaaaacgccuggauaagaggcagcugaaguacagauauggcucuggccaguaaccccagacaacauaguugugcuagaauguugguaaagguaggcacugcccaugaguggcuggaaggaggugccagaggcugauggcuguagccaugcugagcugauggcuggagcagaggcucuggagaaguuggagaugcuuccuguuaagaaagcugcauugcucaccacaggaagagagaacugccgagaauuugcaguuccagguaaagacguauuuuggaaauauucuguaggaaacaagagagagaugaaaaaaccgaugagagugaaaaauucucaccuuauuggaagacuagcauuaucuuaagguuguugcaaucaggaagccucuaauaccaauacucacugagauaccaaaagccaaacaguuuaugauggccuugagugcugaagcaguuugguccucuucugaugaacugucuuuguguccaacuuggacacagauaugaagacccaaauggucugguuucguacauuauuuccuaggcuagaagcaaccuucucccuucccuaucuuucccuugaaucugggcuaguauagacucauaacuauuuccuagaauuggagcauuuuagaacuaggagguccuuagagaaguucuaacauuucauuuuaugagucugagaggucagauugaccuguuuuaaguuuuaccauuauguuaauaucauuaccagguuacagaaccugacuuccuugccaggagucuuuucucugagcauagaccagaaaccaggaaauuagaacuuuuaauauggcauuuuuuuggucuacuagaauauaguacagcuauuaccuuuauaauccuuagugucacauuuugcuucugcaggucauaugauauguccuagaguuuauauuuaacccaggccauugguaaaucuaaaaggucauucuuugcccucuucaagccuggcuuuuuaucauuagucaaaauaacuaccugauagaaauguuuucuuuuuucuuuuuacugagacagagucuuacucugucacccaggcuggagugcaguggcuugacacccaggcagccacucugccuggcuaauuuuuugcauuuuuaauagagacgggguuuugccauguuuaccaggcuggucucaaacuccugacaucagauuaucugccugccucggugucccaaagugcugggauuacaggugugagccacaaugccuggccaagaaaugcuuuuugaaagaaaaaagcuaguuaaacucugugagcuucaggcugccugucuauaaagaaguuguaaaauaauaacagugauaauucauacaugaauaaaagugauagauuacauaugacuuauaaugaggaagauauaguaaguucugaaaaaacagacaaaauaauuaaaaacauaaaaucauggaacuaaaacaauauauagauauuaaugaaaauugggguauguagcuagcaucaaaacauaguaaaguacuaacuaaagcuguuaccauacaugcaacauuaggaaacugaauaguaucuacucuuucuuagugaauacuauuaaccaagaaacagcccauaauagaaugaaugaauuucuaacaagcauauauagacagagaaauuguaucagcaaaaaguguguaagaagcagaaaauguauagacaaacuguaucagcaaaaaguguguaagaagcaaaaaguauguaagaaacagaaaaaugcaguaaaugugaauguaaaauagccauaauauauguggauagauauuucaauaaaaacugguacaagguagaaugcaaaaaauaaguguaaaggaauuauuaugcucauucauauuucuaugaauauuacccagcaaaugacagguauuaauccuaguguaauauuuaaauuauuguagccacauaacaagcagaaaagaacucuuaaaaaguaucaugagaacuuuaauaucuauccucaaaaccuagauuauaaucaucuccaacguccaggaaaaugacauucccauagcuuaaaaaaaaacaacugcuagaauccaauuaaaaaauguuuugaauguaggaaaguucaaaggacuccagaaaauuuggcuuagauugauauggaauuagagauauguggcugauauguggcuugacuuuuuauucuuaggucuaaaagcaguccauuaugaaucaguagguacucuguuuuuggaagaaaguauuaagauaaaaaagcagcuuuuacuuggaaucuacuuuucaugcaaagguauuguucuucugaugcaaauaacgauacauucuuuuuucagaaaacuuaauuuuauuguuaauaggagaaacauccauauaauuuaaaaauuagaaacagcacacugcaaauuacauguccuccagcucucuagguaaccacuuauuaguuucuuguuuguaggaagcaacauuucuuuucuuuucuuuugagaugggguccugcucuauccuacagacuggagugcaguggcaagaucucggcucacugcaaccucugccucccagguuccagagauucuccugccuaagccucccaaguagcuggguuuacaggcgccugucaccacacccagcuaauuuuuguauuuuuaguagagaugggauuucaccauguuggccaggcugaucucgaacuccugaccucaggugauccacccgccucagccucccaaagugcugggauuauaggugugagccaccgagcucggccuggaggcaucauuucuaaaacauauauauauauauauaugaaauauacauguauauuauauauaacauacauuuauauuauauaauauacauauauuauauauaauauacauguaauauacacuaaauuuaaaauuuauauguauauuauauauaauauacauguaauauauauaacauacauguauauuaauuauacauguauauuauauauauaaaauauacauguauauuuuauauauauauuauauauacauaaaauauacauguauauuuuauguauguauauuuuauauguauauuauauauauauaaaauauauauguauauuuuauuauauuauauauauuauagauauauacauaaaauauacauauauauauuauguauauauauaaaauauauauauuuuauguauauauauaauauacauaaaauauacauauauauuuuauguauauauauauauauauuuucuuuuugagacagaguuucgcucuuguugcccaugcuggagugcaauggcaugaucuaggcucacugcaaccuacaccuccuggguucaaacgauucuccugccucagccucccaaguagcugggauuacaggcaugugccaccaugcccggcuaauuuuguauuuuuaguagagacaggguuucuccauguuggucaggcuggucuugaacugaccucaggucaucagcccaccucggccucccaaagugcugggauuacaggugugagccauccugcccggccucuaaagcauauuucuaaaauguuuauauuaaaaacugucaagugucaucuauguucaaaaaggcaacagaaaaaaaacaacugaauaugacuucugauaaggugcuuuuucuagggauacucuauucuagccuguuuccuuccuaguccuuugaucuaagcauuugcuaaaaccaacuucauuuugcucuauuuugaauagauuucacucuguuguccuuuugcuuuuuuuuucaaauuuaaaauauauuuuuuuauuuuaaaaucauuucgucauucuccagggcauaucccaaggggaaaaguaggggacccugucuuucugcuuuaauuaaaauaccaaauuccuuacucuagaauaccugccuccuuauaacccaguacucuccauuuucucuuuccaccuaguuuagauaggaauguccaaaacaugaauauuacuuuuguuuguuuauuuguuucuuugugacagggucucacuuugucacucaggcugaaguccaguggugugaaccugacucacugcagccucaaccuccugggcucaagcagcgucugauccucccaccucagcuuccugaguagcuggcacacccccaacccuggcugaguuuuaaaaaguuuuuguagagauggggucuugccauguugcccagacuggccgggaacuccuaggcccaaagcgauccucccaccucaggcucccaaagcauugacauugcaggcaugagcuaccacgcccaacugaauauuaaaaacaucacuacacaucaguaaacaucacuaaauuuaaaauaggaaaguugaaauauuagugagggagauggccucccaaagugcugagauuacaggugugagccaccgugccuggcugaauauuauuuaaaacaucacuaaacaucacuaaauuuaaaauacgaaaguugaaauauuaguggagggagacuauuacacaugaaacaucucagaauauauugcuaguuuucuagaccacuuugguuuuuucucuguuucuguugaaaugaacacucucagaaagucucugauuucauuuucuauacguauacccuuuaagacucaguauuagaaaagaaaaaggccagggggaauaaccagucuauuauccuaguguaauagaugaggaaacagauuuugugagagaauaaaaguuaucuaaagucacacagcuaguuaaugucaaagccaaaacugaaaugaggucucuggauuucuacuucaauacuuucccuguuauuccaagcuguuugggaauauagggggaaagaaaucuaaauuuaguggcaaagaaaucucaugaaaaccuuuuuaaaaaguuucucucuuuaccugacauggucagagaagaagaaacaucaacugcagauagaagggaagaagagacgauacuagcggaugucuggguggcugaagccaaccagugcauguguccaguaugaaggccacuggucacugguuacuggucacuggccccuugugaug

SEQ ID NO: 15132 - RNA, 6602 nt, Homo sapiens
gaucuuaccaauauauuugaguccuuccugccucaguuauuggccuauccuaaccccauagauccucucaauggugacgcugcagccauguaccuccaccgaccagaagaauacaagcagaaaauuaaagguaagaggauggguaguuuaaccuggagacaaaagaacuuaaaucuguugggcuucagucauuaaaaguccuucuuaaauuacuuaguuccuaauacuuuuucuuaggccuaaaaagagacagcugugggcugaaguagugcucaccaaccucggguggcaguagcaccaguuugcucauccuuugcgauuuagaauccuauuuucccauccuuaaaacaguuuacgugcugaugggauaugaguuucauuuaaaugaagauaaguuugcgacuggccgugguggcucacgccuguaaucccagcacuuugguagcccgaggcaggcggaucacaaggucaggagaucgagaccagccuggccaacauggugaaaccccaucucuacuaaaaauacaaaaauuagccuggugugguggcacgcgccuguagucccagcuacucgggaggcugaggcaagagaaucgccugaaccaggaagcagagguugcagugagccuagacugugccauuguacuccagccugggugacagagcaagauucugucuuuaaaaaagaaaaaaaaucuaaagcuccaccuggguucauuggauuuuccauuuuaccucuguguauguuucagaacuuucauagugaaaagucuagauacaugaagcuccaccaagaagcaaaggaauucaaaguuugugaaauauaccugcugcuuuuaaccaauggcaggcauuaguaucuagccaguuuuucacaugaugggccuaucugcauagcaguccagaauguuugcuuccucaaaauguguggccucucugagguacauuugcaagagguggcaguagaaguaauuuaccagagcuugaaugugcaggucuucacucugaaaugugcagguaugaggcaaacagggacuauucaugaaacaauagcuuuucuucuauuuguuuucuaauucuucuuccaaggucucuauaggguauuguuuggagcuguuguugagauaaagcagaaauaaauuuacuauaauuaauuagaucucaagugcuuugcaaauuaauaucuaauuuauguagcaaaauauauagcuaagcaaacauguauuugaagaaaaaggcagucaguuucagccagauaaagugcuguuaugagacuauauuaaaauuuugacauaggaaucacuuagcaaugucugcaaaccacagauaucuuggagcagaguauauuucucuaguucacauaugcauucugucucaacaauuuagcaguagcccuguuucaguacaugucugcuauagucccauuuacaaaaagaaccgagccuacauuuaucuuagaauggcucacuccagcguacggaccccuagccuucggaaauguucauguuggcuaucauuuugucuuccuuaguaaucucagaaaaucauggccaucagaccugagcucacccccacuuccuacugugccuugauaucuucucccuucccuccugcaucuuuucuuuguuccuaacuauaggaaauaaauaagagacacccuuccucauuucucaaacucacucccaccaccaaucugugaucuuguucccccaaccccccgcccccucccaaugcagucuuccuccuccaccccaucagaggucucccuguuucaggagcagugaucugcuccugugggcucucuuaggagucaugcuguuuauuccuuuucauuuucaaacuucuugcguccucaccuuaaacuccucuaguuuuuuuccccuccucugcuuaaucugugcccucauuucuucccaauccuuuggacucuucucaagucccauuuugcuggaccuuucugcaaguguuacauuuuacccucaucuuucuggaaacuucucauuccauuuccuaaauguggucauucacuuaggacucggucccugggcucccucucuuccuuugucaucccugaggagcuguuucaccucucacagcuucagucaguccccuccagggagaugauuucugaaugugugucuaggccuggccucucucccaagcugcugcuggacauuuccauuuguguggcagucaccaccaacccaacacagcuaacacagucaguguucauauuuaguuggcgcuguauuauaguacauguuugaaaaaguguuuaaauauuggauagcccguagcacugggcaccauuggagcugucuaaagcugucacuucccugcucaaaacccuuugcugggugacaucuuugccugccauucagggcucucugauacugaguggaaucuacaucuuugcccuuacuccuuuuuuuuuuuuuuuuuuuuuuuuuuuuuuuugagacggagucuugcccugucgccuaggcuggagugcaguggugcgaucucggcccacugcagccucugccucccggguucaagugauucuccuuccucagccucccgaguagcugggauuacaggcaugugccaccacauccagcuaguuuuuuguauuuuuguagagaugggguuucaccauguuggccaggcuggucucgaaguccuaaccucaggugauauacccgccuuggccucccaaagugcuggguuuacaggcaugagccgcugcaccuggccauaguucucucuuaagguuguguuuaaacaucccagccacuuacuuucaacaaaacaaagccuuucccuggaguggccucuccuaugccauagcuggcaggacuugggggucaguguggcugggacugccucggccguuuuucguccguaacugcuucccucuggugacacucagcagcuccuuuuaucuuccucuguuuccuccuccucauuggugaccuugcucuuccuuucucucucucaaaggccuuguccuaguaaguacuuaauauacauuuguuuccuugaauacauuaaagagggcugauaguaucaaauucuagugucaaaaaaaggucaauauuuaucuucuacaaaggaagacgcaaaauagucaacccauuagagguuaaaaauaaaauuguuaaaguuugaauaaauauuucucaauuaagguaaauuccuaccuaaucaugggcuacuuuaaucucaucaaaaucauuagcauaaaauuuuguuauaaugaauuugaagggcucuaagucucaagucugcaaaccuuuucuguaaaggaccacauuggccagauguggccuuuaucacacauucuguuuauuauuuuuuaagacaguuuuuaaaauauaaaaacauucuuagcuaggcccugugcuaguuauucaaaucugguaggcccauuuggccauucagcuuaucuuccuauugcagugaguccccgcaacucuauaggaggaaaaacaaagccacaaggguguguuuuuguguggcuugcauuuugaauagguuucugucaugucuuuuccuauuguguggaggcuguucacuugaaaacaguaugcacuuagaguuuuuaggaacaaguuuguuuauucagcaguucuuaaaagccguuucagcagucuuauucagccuaggguuccaccaaggcuguagcagcggaaaucuaccuucagguaaauuauacauggaaaaaccacucagagccgaguggugucuccguauagcagcuuaguccugagcagauugagcgaugguuuuugccagcugcuucaaaaaccugacaggcaggaucuguuuagacuaaaaucgauuccuaaaauaauagaccuggacugaccguaauuauguaacugcagaucuaaaaaugaugaaggauuuccuuauaaauuacuauggaaucaugacugguccuauacuaucugggagaugaaaguaaaaagaaagcguggggcucccauuucccuggucccugaagaguucuuggggugcugcagcacacacauuccccugcaagcugagccugcuguguugcucuucccaauaccccuuuccucagggggcaaaaugcagaaacccugucccaaagaagucucccuaugggauucuccuuagcuguagugaucaugauuacugucaucuuuguccccccugguguucaagguaaguuugaaccuccgcagccuugccagcuuuuuggggucgccaaagcacaugccugcccacucacugcccuuguugucuuucucccaccccgugcagaguacauccagaaauacgccacggaggaggcgcugaaagaacaggaagaggguaccggggacagcucaucggagagcucuaugucugacuuuuccgaagaugaggcccaggauauggaguuguaguagaaaaagcaccugcuuuucagaaagacuauuauuuccuaaccaugagaagcagacuauaauauucauauuuaaacaaagcaauuuuuuuuauuacuaaacaagguuuuuaugaauaauagcauugauauauauauauuauauaucacccuuuagaucuugauuucuuggucauuucucaaccugaggugcauagcauauucccacauuccauuugguagcaauaugcggucugaaugcaugcauucaugaguccauguggccaagucagccugugugcuacugaacugucgaaggaaauagccgcucugauagguagaugugaguaaaaagaacaggaaaaaauugcuucuuuuauugguuuccaaagaaacaaaccaaaccaaccagcucuuggaugugaagauaaaauagugcuuuuuugaaauggagaggaaaaacuuggggaggaagaggccugcugugggggcaucggagccagccauguaagaaucagagcugcuccuuccugugaauccuagguggcccuaugucuucuguggaguuacaguauaaagcagggagcuaauuaagaguauuaaaacuuaaaaccauuuuuugacucugauuuuaaguacauuuuuauaugucaguugcugcccuucacacuaccaggcccugcagccacaguguucuguuggagaaacuuggggaaguguuuucugaaccaguucuuuuucuugggguagagcgugaaauccagaccuguuuuugaaaggacagcacaggaggagaaaagugacugggacgaugcuuccucucauccaaaacacaugcagagucacauccucauccuaguguuuggcaguuugagaccgcuacccugaacuuaagagcuuuaaauaugaggguuguguuucuggggggguuauuuuuuugguguguguguguguguauugugcuuagaaagguugcagauuucaucuucaccuaccaagaggcggccgccuccuuggacaagccgcucauggaccauuagacuugagaagacgacccacguggugacugcaaagcccuggguacuugccuucauguucugguuugguuuucccuuuuucugcugcucuuggcagcagccuggucaucaucugcuugugggagugggaaauggguauuuuagacccaacacagguucuaaauuuaaaacaaauaauaauuggaacaaauaaagguucuuguacccagagugauucuacaugggaaaaacaaaccagcuuuuuucagagagugaccgaauaggaagaagggauucagaaauaugauguaguagaacaugcccugcaggaagaaaauguuuucucuccugcguauguuaagaggaaaucaguuuaaaaugccugcuaaucaaaugucgacucagcuaaccauauguccagguugcugcagaguuucuuucaaaucugaguguugccugcugaacucggaggggaguuuggagaaauuuuagacagcagcucuguguucuuuuuuugccgcagccaauaagauaauagcagaauuagccaauccuaaaaccuucuaaagacgauuuuugagcaucccacugggauuauuuaauuuuucuuuuugacguguguuuuuaguuuagaagugcuguauuccacaagguuuaagucagugagguuggaagauacccuaucuuuuuuauucaaaaagcacaaucaaucuuuuguuugaaaaucuauauaaaguacaacuugcuuuuagcaugauuauuuuccuaaauaaaaagacaaagaauuuacuuacuuuauguuaauuacgggcaugaagcaaaagguuuucuuuaaaaaaaaaaaaaagugcagugauguagggcugugguuaguuaaccguacugaguuauccaucuagcaucuguggcuugcuggaaggguaguauuaacuauuuaacauguaaugguguacuucacucuuaccuagcacgcugucuucucauugcuuugggggagggagggucucucugcuggcacugucuaacuugcuuaccugcugacuuugcaguuugcuugugcuaugacauuuauuguaggugcuauuuaggguaggcuuaaagugcuggguggugauuugaguucaaacaauaaaaaauuguauuuuuucaauauuguauaaacaauaguguucuaauuaccuuaaaaaaaaauaaugaccaguuaagaa

SEQ ID NO: 15133 - RNA, 446 nt, Homo sapiens
agaguucaacaacaagcuuccaagaugccgcccaaaggaaaaagugguucuggaaaagcggggaaagggggugcagccucugggagugacagugcugacaagaaggcucaaggucccaaaggugguggcaaugcaguaaaggucagacacauucuaugggaaaaacauggcaaaaucauggaagccauggaaaaguuaaagucugggaugagauucaaugaaguggccacacaauauagugaagauaaagccaggcaagggggcgucuuggguuggaugaccagaggguccauggugggaccauuucaagaagcagcauuugccuugccuauaagugugauggauaagccuguguuuacagacccagcaguuaagacaaaauuuggauaucauauuauuaugguugaaggaagaaaauaaaaucauaugaaagacugaaagaaaaa

SEQ ID NO: 15134 - RNA, 3521 nt, Homo sapiens
acagaauauuuccaaaauacgucuuuaccuggaacugcaaauucucggcaguucucucuuccuguggugagcaaugcagcuuucuuaacaggaagcaucuccaacuucuccagagccucugcuccagccaucagcucagcauggcuacagccaucagccucuggcaccuccuuccagccacucaugggcagugccuaccuuuaccaacauucuagcacaacuauguugucugggguuacuggccagagccauaucuguacuucagcugccucuuauccaggcguuuuugagugggauaguacagcaagcacaguaaagaagucauccucacucagggacuucacugugacugucauugaucagaacacagcugucucuuccaugucuaugacagcccaguauuauaaaacuucagauaccaauacuauggucccucuguauccaucacuaucugccagccuuguucaggggacacuaacucaaauuccaaaucagcagggccauaaccugucacuucccugccagauaggaagccaggucuauuacuauaaucaaggcacacuggggccucaacuauccugccugcaaucuuauggcucugugucauacacaggauauagggcuucugcccaucaaccagaaauggugauggugcugaaggagguucagcccacaaauguccuaccaccagucucuacuucugggauguauuacucugugucuucucaacccaucacagaaaccaguguucaaggugaguacaaacaucaagaaaggagaggaauaaugucagcguugaaaaggagggucaaaucuguagcgaguggugaguccguggauagguagaauuuaaguccugagacuucaaccacuauucuuuggcagugcucuccauuuucagacucuauauaagaacaccuuauaagugggaaaguggaacacuguaauggccaucuaugcuacauguaagagaaucgcaagagcauacugagggauacacuuuuuagugcccugacugaucacuucccccacacuaccacgcuguaauguccuuccuuaaucuauuacuuuagucucuuuggaaggcacuucagaacucuuauuuuggcggugacauuuugauuuuccuuaacuuacaauaggauuuaagaccuuguguucagagauccucuccaaaacaaacaggcucagaaucugugcuugcuuauauauuucaugaggaagggcuccacucucuaccuuacccuaguccaugguguaaacuguucuuauucucucaggagaguggagagaauugaaaggacccuguaagaaugugaggcuguauaaaacaucuccuauuuuaaaaaucacuuucacuuuuugaucuacaacaacccuaugaaauacaaagaaaaccaagaaacaaucacaucaaaugauaaccaguaagagaacagucacugccaaucuccuaauacagggucuugcccaugguccuuaagaagagcuaguagaaaugccuugcccauguuggaaagguauccgauugcugcacugguguguagggggagcaucucacuuaccagggacugacuucuuccuugauuccuuuguagugauggaaacuucccuggggauggauacuucccugggauugcaaucuccaagccagacauuuugucugccacaaacuccagaauucuccaaguccuucaguagcagaaauacccagacacuugagaguaacccaucaccugagcuuggggacauuucaauaacuccaguccagaguccuacuaaucucuugacacugucuccagcuccaagccaggaaaaaaaugagaaugagaauuuggaugagauuaaaaccaaccuuucaaagccucuagauguccaccagauccuaauaggaaaucaagauccuccacuacuuccuguagaaauccccgauauucacccgcuucuggccugcauugauccucuuggccaagaggagcagccugguucugaaaaugccaaucuaagaaauaagagccugagucuugaggaccaagggauauuugaaaaugggauugagucuagcagugauuuggcagacaucacuacauggguggaggauacuuaccuccccccgaucuucaguuccuuacaagaucuugaccaaccugaaagucccucagcaaagaaagccaaagauaccagugccaucaagguaaaucaggugcaggaaaagucaugugucauaaagggucacucugaucaagucaggaagaacaagcauaaagcuuccgagccuauccagggugcucccaaggccaaaauccagccaaagaacccagagugccuauuagagagagaagugguuguuggcagugcuacagucaguaacagcgcuucugugaacaaggccaagcauucuagcaacaaaccucacaaggcugcauccagcaggaucagcaaaacuaagagccaugggcaggaaaagaccaaagggaacagaaagaacagcuccaagaaaucugaagagaguaagcagucagggaaaaaagucaagguagaagagaagcaaaccauucccaauaugaaacggaagaaaaaucaaccugagcuuagccaaaagacccuuaaaaagccccgaagcucccuaggcaugcacaugcuagaguccgugcaaguuuuccaugcacucgggaaaaagaucgauaugaaaacuggauucucuuccuccaggacccugggaagcucaagcaacacccaaaaccgccagccauucccagcucucaaaccauggcuggauauccaacaugaggguaaaggcccggagaaaauucaagucaaggcccagaaacuagaugguagugcugaaaaagaguguacaucuccaucccacucugaguugccaccaccugggaaggucaaguugauaccuuugcccuuucugacccuggaccaaccucaagcucgacauguuucucggcggccaaacccucuagccucacguaggccugcuguggcuuacccugcucgaccugauucuacuaacucagcucaaucgaaugcagucaauccaucccgaccagcuccuaccaacacaucuuugacagguccugccacaccagcucagccaauuucagccaaagcaacccaacccaguucagccaacccuacccagccuacugucccucaaucugcugcuucuaggccaucagccuacaaaacaucaucuuguucuucucugcagcgggagccuguuuccacugcugugaccagucuccggucacugcccaagccucaaaaucaauuucuaauccaagacuucagccuccaaccccguccauggaggaaacccacuguuccugagccaguaaugucaacgcccaucacagaagagcagaggccagagcgugaggccaugaagagaaaggcucaacaagagcgugagaaugcugccaaauacaccucuuuggggaaagugcaguuuuucauugaaagggaaagagauauggaaauugcugaauacuauggcuacacaaucuaag

SEQ ID NO: 15135 - RNA, 823 nt, Homo sapiens
aauggagggccaugauccaaaggaaccagagaaguugagaaaacuguuuauugguggucugagcuuugaaacuacagaugauaguuuaagagaacauuuugagaaauggggcacacucacagauugugugguaaugagagacccccaaacaaaacguuccaggggcuuugguuuugugacuuauucuuguguugaagagguggaugcagcaaugugugcuugaccacacaagguugaugggcguguaguggaaccaaagacagcuguuucuagagaggauucuguaaagccuggugcccaucuaacagugaagaaaauuuuuguuggugguauuaaagaagauacagaagaauauaauuugagagacuucuuugaaaaguauggcaaaauugaaaccauagaaguuacggaagacaggcagagugggaaaaagaggauuugcuuuuguaacuuuugaugagcaugauacaguugauaaaauuguuguucagaaauaccacacuauuaaugggcauaauugugaagugaaaaaggcccuuucuaaacaagagaugcagucugcuggaucacagagaggucguggagguggaucuggcaauuuuaugggucgcggaggaaacuuuggaggugguggaggagcuauggugguggaggugguggcagcagagguaguuauggaggaggugaugguggauauaauggauuuggaggugaugguggcaacuauggugugguccugguuauaguaguagagggggcuaugguggugguggaccaggauauggaaaccaaggugguggauaugguggaggugguggaggau

SEQ ID NO: 15136 - RNA, 1300 nt, Homo sapiens
uuuuucucucucuuuuuuuuuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagc

SEQ ID NO: 15137 - RNA, 1300 nt, Homo sapiens
gcuccuccuguucuacagucagccgcaucuucuuuugcaucgucagccaaaccacaucccugagacaccauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccucacugcuggggagucccugccacacucagucccccaccacacugaaucuccccuccucacaguuuccauguagaccccuugaagaggggaggggccuagggagccccaccuugucauauaccaucaauaaaguacccugugcucagccaaaaaaaaaaaaaagagagagaaaaa

SEQ ID NO: 15138 - RNA, 934 nt, Homo sapiens
uuugaaauaaaacucuggaauucuuacugcuuccagaaccuauuuuaaucuucagaccuuggaagguauucauaucucauaagaguaacguaauauaugggggcaaagaugcagccaaguagcucagcacugaaagcuaagaugaagaagaaccccauggcuuccaggaccuuccccuugaugcuguggucggcaaggagggaggugacugcagaacaccagcaugcugaacaucaagaacuugacuuauugaaggugucaggcaaacccauggccaggaaagccaagguaaagcuccccagggucaaggagcccagguauccuaggacaugguagaagacagugcugaaaccucacugcgugugagaacuacagauccaagcuuagagagugugucugugucaaugaagggaggaaaguuucucagcccgagcugacagaucaggagacagauuccacuuggauuagggagaauauaaaaagggcaaaauuaggagauccugauaccaaucaccaucuuauucucccuggcauucuggccuucagagccagaacuacagugaugguuuuggucagaaugauagaaauagccauaguaaacacaacuccaaaugcuauuuguuggagucaccacguagcuguguggggguggccaaugcauagggcagagcagaggaagcacagugugacggaggccagacuuucagcagggugcagcugaaagcccauguacuggcuuuaaccgaggggauuuccugcugcuucacaaauaccccaaggaccacugcaguaaggacagagaggcagggcugugcaggccagagacauccccaaagggccuucaaaagccaagaaguucacauccuuuggaagacaguaaauucucugacuauucugauauugaucaucuggacacuucuuauacugaauagua

SEQ ID NO: 15139 - RNA, 851 nt, Homo sapiens
auucauacuggaaagaaacccuacaaaugugaagaauguggcaaagcuuuuagccaguccucaacucuuagaaaacaugagauaauucauacuggagagaaacccuacaaaugugaagaaugugguaaagcuuuuaagugguccucaaaacuuacuguacauaagguaauucauacugcagagaaacccugcaaaugugaagaauguggcaaagcuuuuaagcauuucucagcccuuagaaaacauaagauaauucauacuggaaagaaacccuauaaaugugaagaauguggcaaagcuuuuaacaauuccucaacccuuagaaaacaugagauaauucauacuggagagaaauccuacaaaugugaagaaugugguaaagcuuuucagugguccucaaaacuuacuuuacauaagguaauucauauggagagaaacccugcaaaugugaagaauguggcaaagcuuuuaaacauuucucagcccuuagaaaacaugagauaauucauacuggaaagaaacccuacaaaugugaagaauguggcaaagcuuuuaacaauuccucaacccuuaggaaacauaagauaauuuauacugggaagaaaccauacaaaugugaagaauguggcaaagcuuuuaagcaguccucacaccuuacuagacauaaagcaguucauacuggggagaagcccuacaaauguggagaauguggaaaagcuuuuaacaauuccucaacccuuaagaaacauaagcuaauucauacuagggagaaaucguacaaaugugaagaauguggcaaagcuuuuagcaauuucucagcccuuaggaaacauaagauaauucauacuggg

SEQ ID NO: 15140 - RNA, 820 nt, Homo sapiens
cauuuuacccacugcuuugauugguugccaaucucuugucucucucuucagcaauggugaggcagauaccuuuuccuuggggaagagaaauccaugguauguugcccuugcaaacaacaaaaauguuggaaagucaaguggcaaagcuguugccauuggcaucuuucaugugaaccacgucaagagauccagggugccucucucuguuggugaucacaccaauucuucccagguuggcaccuccagucaccauacacagguuaccagugucgaaccugaugaagucaguaaucuugccagucuccaaaucaaucugaauggugucauucaccuugaugaggggaucaggguagcagaugguacgagcaucaugagucaccagaugagggauuccuuuugugcgcacaaauauuuuuucucacuuuucacaacuuguacuuggccuccucagguguaauacgauguacagcaaagugacccuuggugucacagaucagacagaaauucucucccaucuugucaaugcugaugacauccaugaauccagcaggguagguuauaucagugcggaccuugccaucgaucuuaaugaaccgcugcaugcaaaucuucuuuacuuccucuccugucagggcauacuuaagucuguuccuuaugaaaaugaugagggggagacacucucucaacuuguggggacugguggauggaugaggagcaaacacaccagucaauuuauccagcauccaaugcuuuggagcugcuaccugcuuuagaugcuucuugggaccacgagccauggcuacguuaggcacagaaaaag

SEQ ID NO: 15141 - RNA, 1979 nt, Homo sapiens
cgcagcgcuaaaaaaagccguuccuuuauucugccccaggcaggcugcagucacagacacacggggaauccacugauggcgucggugcucugcaugaucaugucugccagcagaaagcagaagccuggggggacgggggugcggagcagggagaggaaggugggcccuggggcggauggccgggagggccccggggacugggguuuggggcuccaagggggucucugccgggucugcgggagucguuaguguguuggggaguccccgagagguccccgggguuuccugggagggcagcuggggagccucuggggugagggucuucugggcagucuccuccacccucuucccgcuguccaguuuacccgcgagaauugagaaggguaaggccagccacccagaaaaauaggaccaagagaagaagacguuguucuuccacgcauucuucacgguguagccuaucaaggcggucagcagcagcaguccugggccccgcccagccgcaagaugagcuagcugggccuggugggggcugcacccaggccacgccccuucagacccgcccccuucuaucagaccacgccuaucgccucucagcccgccccuggcccaggccccuuccugcuccucccgcucugaacucugucucgagccccgcccaccucucucggcuucuuccagcccugccccucggauccuggccgaguaccucaagccccuccccuggcgaccaggccccuccaucacccagggcccgccccugccugcccgccuggggcggucugcagucucaccgccgaggaagaggaaggcgcucguggucuggccccgcagcgacucgcccucgucgcaccgaauccgcagucccaucaccaugcccaccacgccgacacccaccgccagcaccaugcacgccacagucaccgccagcguggcuggggagagcgggcgcaucagcccccgcgggcgccgccccagucacuacggguucggccgcaaccggaagcucucccgucuccugcccccaacccgguguguggccaggagccgagcuccaccgaccgggagucaggcguuuggauugagacuuggaggucacaucaggaccugcgguuacugccgcuaccaggacggggagggggucggggacaagcccacaagucgaggggcgggguucguggcggccucggccgacaagggacagcugcaacugagcccgggguggaaggggugggcgucucgccaugggcccagcugugugucccgagcccugggggucugaaaugcccucugacaucugggcgggcggagccucacucuggcaggggaugcuggagcagaugccgugguugcauuccugccacaggccacuguggcccucuuguuggcggguccaguaguugguggccguggagagcaccaugaggacguuggccacgaggcugagcagaaugcccccacucuggaggcuccgcuucacccccaugccacugaggcugcagccgggggccacaagggcaggaugggcccaggccuuuccuaccccgaggcccccagcugaggagcccgcuuccuccacacuccuccccugguacuccugccugaggucccugcuucuggggaccuggagaccccccucccucaacaacccugccugaggauccacaaccuccucccuccagaccucguuccccuuacuggagaccuugagacuuccccugagaggccucugagaccuucaccacaggcuuugcugugaggaaccugucuucccagagaccucccccgacagccgaacgcccuuucagcccagccuguucaauguccuccccagacaccccuccacacaggcccaccuaagugacucacacccagugcccuagggcuccuuagacacagagcccagagagacggggggagggaggcugggucucugugaggccagggguuccagaacccccucccccaguggcuguuua

SEQ ID NO: 15142 - RNA, 5486 nt, Homo sapiens
ggacguggucagaucacgacaacagguaaccuuuagucagaacucaccacccacuguguuaagccuuacaugacaaucaccaugaagauuuacauacacauguuauaucauagucuccucacaacaugucuaagagguaggcacgucauuguucccauuuugcagaugaggaaacugagguucagagagggcacuuggcuugcccaaagucacacagcagggaguggcagaggaagucagguugggugaccccaguaacugcucucagaggcugggugaugaccggcuuccuggcuucucuggaauaaaccuuugccaccacuuccugcauuucagcuucaguacaggcagagaauggggauaggugggggaaugaggugagaggggagauguuuagagguguggagggcggcagagguuugaacagugcagacaaggggagaguucagccgacuggggaggaagaggauggacgauggagccucugggcaucuggaucagcaggagcauaacaucuggaucagcuggagcguagcaucuggaucaguuggagcguaugacuuuauugauccaggacauguauuugcagaucuggguguagacagcuggaugcugggcagagccacagggguaaacaccccacgagaggaugccuuggagggucucgucacagaccagggggccuccagagucacucuggggguggcaggaaggagagaucaaauaaaugugccaacgugagagcugucacuuugggaucuggggcagugguggggaaggaaggaguuggguugggauaaagacgaggaugggaugggguuggaauuagguaugagcuggaagguaggaauggagguggacuucagguuaugggagguugggcugggggaugagaaugaaggcacagugagacugggguugggauuguaguucauggaaggugaggggaugaaaaugggcuuggagaugggaauggggugggguugggauggaaaugggauugaggauagggaugaggaggggguuaggucuggguaagaguuggggucaaggauggguuugggaauggaguuggggaucgggcacagggucugcucuuuucccauaaccucccuguccucccucccaggagucagagacucucccuguucagacccuaccuggcaaggguccuggccccgguccaguccagcacauaucauguuguuggugaccacgccaggguagaagaccucacacucuuuagggcucaggauagugaugcuggagcaggucaggcccuuguuguacuucacugaagggagaauaugccaguaaucccuggguccagcccccaauccuuggggagccaggaguccagauacaagaccguuucuauccuaagccccagccccuccuccuucagacucaagaauccuggccccagccccuccccacuuagacccaggaguccaggcccccagccccuccuccccucagacucacagacccaggcaucuaggaccccagcccguccucccucagauccaggaauccaguccccagcccauccuuccucagacccagggguucaggcccucagcccccuccuccugagguuccggccucagagccccagcucuugccucuccgggcggccguggugccccagccagcaaccuggcacuggucuccgggcugagcacagcgguagggaagcugcagggcccggacgcggggccccagcacuacgggccuggccagcuucagcaacaugagaucgugcucauccguucgccuuggcaggauggggccugagcccuggugguacuugggauggacaacagagcgagugguccggcggagcugcucucccugaagaagcagcagguggucauccccuacucgagcccacaguggccugggggaaggaagaggcaugugaaggcaaacccuucauagggacugggaaagcaggugggcagugacgcagggccuggagauaggaagagucugagggaagagggccuugugggagaaggggaccucaguggacauggggaggaggaaucaguuguuugagcucugaggaucuguaggaauugaggagggcugggggccuggacaccuagguaagccuuccacauuuucuuuucucuuuuucuuuucuuuguugaaacagaguuucgcucuugucacccaggcuagaaugcaauggcgcaaucucggcucacugcaaccuccaccucccagguucaagcaguucuccugccucagccuccuuccugaguagcugggauuacaggcacccaccaccacacccagccuuuuuuuuuuuuuaauuuuuuuaaaauuuuuuauuuuuuauuuuauuuuauuuuuaguugagaagugguuucaccauguuggccaggcuggucuugaacuccugaccucaggugauccacccgccuuggccucccaaagugcugggauuacaggcgugagccaccgagcccagcccaacuccacauuuucucugugguaauacccaacccuuccuccuucaacggggacucacgaagugaaccuuuuccuuuaguucuaaauuccugaccacaccggacccuggcuucuauccguugcaggcaaccaccuccuccuagagcucaaggagaaucagcgggagaggagugacgggcccagaaaugcggaaaaggaccacaccgcccccuggcggccacagcgcaagcccggucucuccuccugcuggaaggacaccggggaccgcaccuccagcugugggaguuccgagagaccccgcccugcccgcuccucccuggaggccgccuccacagccccccguggcguccucggggauggaucuccuccuacuuguuuccgcagugcgcggccgucagcacccaacucugguccaccaggacacccgcgcaguggaacgagaggccguugaagagcgagaccugccagggcugcgagccgcgcgcgcacggggagccauaggcuucgggguccaagcgcgugucguuuugggggagcagcgccgccucugcggcuggagaaagaaaggggacggaaucaaagcacggagggcagggucuggguuugggguuggagcugggcuguggcacuggacugcguucggggacgggggacgcagccagaacgcgagggugguagggaaauauuggggguuucgcgugcaccgaagggaaugggaggagaagaagcgcgugaaaguggaaggaagcugggauaggguagcguggaguaaugagacagaauagggugggucuggagggcagggacugaacgcagcgcgccuggagagcuggcuagaacgucgcuggucgauagaggggcggggauugaacgcggcggggagguaagggugcggggauagaacucggggaucggggagaggaaggggugugaauaacaaaacgggauugaaaaccaggagagggguggggcgcagugguuuacgccuguaaucccagcacuuugggaagccgaggcgguuggaccgcuugagcucgggaauucaagaccagcccgggcaacacagcaagacccagucucuacaaaaacaaacaaacaacaacaacaacaacaaaaaaguagucgcggaggcaugcgccuguagucacagcuaccugggaggcugaggugggaggaucgcuugagcccaggagguggagguugcaaugagccgagauugggccacugcacuccagucugggcgacagagugagacccugucucaaaaaaaaaaaaaaaaaaaaaaaaagccggaugugguggugcaugccugugguaccagcuacucuggaggcugaguaucgcuugagcccaggaggucgaggcugcagugagcucugauugggccacuguacuccagccacggagacagagcacugcccugucucaaaaaaaaaaaaaaaaaaaaaagaaggaaagaaaaagagagagaaagaaaaaaacaagaaagaaagaagaaaaaauaagagagaaaguaaaacaagaaagaagaaacaaacgaaaggaaggaaggaaaggaaggaaggaaaagaagaacgaaagaaagaaaagaaagaaagaaaaagaaaaaagagagagaaagggaaagaggaagaaaaaaagugaggggagagggcaaaaagcgguaaggcaagacucaggauaaaacacggugguguggccgggagcgguggcucacgcuuguaaucccagcacuuugggaggccgaggcaggcggaucacgaggccaggagaucgagaccacggugaaaucccaucucuacuaaaaauacaaaaaacuagccgggcuugguggcgggcgccuguagucccagcuacucgggaggcugaggcaggagaauggugugaacccgggaggcggagcuugcagugagccgagaucgcgucacugcacuccagccugggcgacagagcgagacuccgucucaaacaaacaaacaaacaaaacaaaacacgguaguguaaaauggagcggggccgggauggggcggcguaagaggaggagaaagaacgcggcgaagaguccacggaagagcgaggauccggguggcagaaaucggacagggccugaguggggcgggucacccaggggccgagccagaagaagggcccagcugacuugggggcgggccgugcuccggagcgcugggugggugcuggggucucgggggaggagaggugcgcggggcuuggugacgggaacacauucuccucccgcccgugccucccaccggcgccucuccccgcccccugcccccgaccuuaccccagaguugcgccaucagcagcggcagcagcuucgccagagcccgggcgccagaggcggcggagagguggaggugcggagcucucauggccaggaucugcuggggugugugcaggggcggguuaaaacagaugcuccguuagagacccccaccucgccgcgcucauccgcccagccugggccaccccagcccgcaagcacccuuuugaccugcagccgauaaccccaggggcuggcagacgggagauucgggcuggaacagcgguaaugggcacaauuacccuaaugacgccccucgcggcaucuucccguccucccugugcccgaguggagcgcucuccgcgccccagcuacccuggcugcagccacgccgcgcccgagguuucccccuccuucacgcgcgggguggggauccgaggcucggagccagugggagccucuuucucaaccucacagcggggggacuuccgcgucccgcagguggagaaaccgaggcucuaagccggcuccugccuguggcccggggguccccacccauccucucgcaauccaccccaacccggguggggugcagguagcuucaccugggagucgccgauaggaaggagggaggggacccagacgugccucugcccugccuguggucugccgcugguauccucugcccagggaccccuggcgggaccuucccuuuuaaccc

SEQ ID NO: 15143 - RNA, 7142 nt, Homo sapiens
gauuaaucacaggggcggccccauggaggaggaaggagauggcauggcuuaccauaaagaagcacuggacgccgggugcacguuccaggauccaggugcccaggggucaugaagcugggacuccucugugcucugcucucucugcuggcaggugaggcucccaggcuggcugccccuucacggcuguacuaaggucaccuugcucuucccucccaucccaggcuucugccuccugcccucuaggcuucucagcauccucucccugcccucccagccugcucuucgcugaccccuuugucccucauccccaccccagggcauggcugggcagacacccgugccaucggggccgaggaaugucgccccaacucccagccuuggcaggccggccucuuccaccuuacucggcucuucuguggggcgacccucaucagugaccgcuggcugcucacagcugcccacugccgcaagccgugagugacccaggcuggccaugcuggggagggacagaggcugggggucaggagagggugaggggugcuuuaggccagaagugcggagccuccacuucugauaccacaaguucaacucuuagaaguaggaaggguagccucccaaauccuaaaauucuagagaccagcaauaucucauuugagaagucuaagauucgaaacuuaggcucuucgaauccgagacugacccagagaaauccagaaucguagaauccuaaaaucuugaauuuaugaaauucugcaauagccucagcaaauuuuagaaucauagauucgcagacuauuagaaucuuagcagucugggucagcacugcccagaggaauuaugaugccagccacauguguaaguuuaaauuucugguggacacauuuaaaaaauaaggaaugaguaaaauuaauucuaauagauuuaacuugacauacccaaaaacuuauuuugacauguaaucaauuuuuaaauacguaugaacgauacaguuuacuuuuguuuugguacuaagccuuugaaaucuguucuguauuuuacacacauagccuguuacaaaauggacuagccacauuucaaguguucaauagccauaauggcuagugugauccuagaaucuuaaauucagagcuuucuagauucauugaauauugaaacucacaguacuagaaucuuugauucacaguauccuagaauauugagauucagauaauucuguagucuuaaacuauuugaaucccagacucuuaaauuucuaagguuauagauuuauagaaugaugacauucuagucuuucuuuuuuuuuuuuuuuuuuuuuuuugagacagagucucccucuaucucccaggcuggagugcaguggcacaaucucagcucacugcaaccucugccucucggguucaagcaauucuccugccucagccuccugaguagcugggauuacagguaugcaccaccaugccaggcuauuuuuuuuuuuuuuuuuuuuuuaguagagacggggguuucaccauauuggccaggcuggucuugaacuccugaccuugugaucugcccgccucggccucccaaagugcugggauuacaggcgugagccaccgcgcccagccaaaauucuagucuuuuuguccuagaacauuaaaauucuauguucaaaucuuagauuuaauucagauaauguuagaauccuggaguuuuuuugauccaggggaaucuggaauguuagaaucuuggauucauaaaacucuaaaccuugagccucuagauucuagaaucauggauaauagugugucggaaucugagaauucuagaaucuuagguucugggcauucuaauaguauccuggaauccaccugaugcaggaauccucucuccauugccucugaaaagugaccauccauacuguuccaauuuucuucccuccaugaguaaagcacugauugugguaagagaugcugugugggaauuucccaucaugcauugcuccaugauggaaccuccuuuaacuuaagccuauacaucagacugggagaacgauguucagauuucagccgaaagugaagcaggagaaaugcagagauaugaagguggaagagagugagaggcaggggaaggguagggggaugaagggauguaggggugaggacuacuuuuccagauccagagccaagacagcaagaaugacagagagagacagacacagauguuucugguuccccaacccugaauucgcagucauuagccugcugccuaaugucagaggucagaggcuggggaauggacuugucauccccgaaaggaucccagcugucuagggcauggaccagaaaugaaacaagugcgcugagacuguggugagggcuuaagguuagacaccaggaagacaugcauugaagggugaaggauaugauagacaggaaaagcugaggccagagaugacccccaauuuggggauuuuccauaucccauccccuuucauacacacgcacacguauacacacacaccacuuagacauacagagccgcucccacagaagccaccagaccugugggggcagggguggggcgguuguuaugugguagguggggucccccgugcccacaccguuccuagggacccaagucaccaccaaggcuccaggugaguagggaggaagguggcucacucagccugggacuaggagcgggggcuuuguggggagagcuacaaagauggagacacacaaaacaucagaguggggaccagggacccagaggaggugugugccucgcuuaaaaucacaguacccugggccagacauagaugaugagggugcagagaggguguguggcuugcagagggucacacagcacccugauggacaggaaaagagggcuggggcugaaaggacuuuuaccuuucccccagcuugaccucugaggccugucccagcagguaucuguggguccgccuuggagagcaccaccucuggaaaugggaggguccggagcagcuguuccggguuacggacuucuucccccacccuggcuucaacaaggaccucagcgccaaugaccacaaugaugacaucaugcugauccgccugcccaggcaggcacgucugaguccugcugugcagccccucaaccucagccagaccugugucuccccaggcaugcagugucucaucucaggcuggggggccguguccagccccaaggguaugaccuggcccagaacucucucugaaacuugcucccucaccccucugucucugccuuuucaucucugucuucuccuuuucucucuccucucucucucugucagucuaucuaucugccaaucgauauauuuaaccaaauauaagaugcuagcauuuuuaagaugugccauuauuucaugaacugcgaagaaguggaagaaggaggaggaggagaagaaaaaaaggaggaggaggaaagaucccauuagaucccauugauuauauaacaccauuuucuggaagacacauucuaauuucagaguguuuguuuguuuguuuguuuguuuguuuuugagacagggucucgcuuuguugcucaggcuggagugcagcggugugaucacggcucauugcagcuuugaacuccugggcucaagugauccucucgccucaaccucccaaguagcugggauuacagauaugcaccaccacaucccacaccggggucauuuuuuuauuauuuauuauuauuauuauuauuaucuuuuuuuuuguauuuuuaguagagacagagguuucaccauauuggccaggcuggucucaaauuccugaccuggugaucugcccgccuuggacucccaaagugcugggaaaacaggcaugagccacugcacccagccaaaauucuagucuuuuuuaaaucuagucauaucuuagauuuaauucagauaauguuagaauccuggaguuuuuugauccaggggaaucuggaauguuagaaucuuggauucauaaaacucuaaacguugagccucuagauucuagaaucauggauacuagugugucagaaucugagaauucuagaaucuuagauucugggcauucuaauaguauccuggaauccaccugaugcaggaauccucucuccauugccucugaaaagugaccauccauacuguuccaauuuucuucccuccaugaauaaagcacugauucugguaaaagaugcugggugggaauuucccaucaugcauugcuccaugaugggaccuccuuuaacuuaagccuuaugcuaaaaauuuuuauuauuuuuagcaaagaugaggucuugcuauguuguccaggcuagucucaaacuccuggccucccaaagugcugagauuacaagugugagccacuguaccuggcccagagauguuuaaaugugaaaugcguucaucuuagaaugggaauaagaccaugucucucagagucacggaucacugacccauuagccaaauugggucaguggauuggaaaaacagucugaauuuguugcugccaauaucuaaaacuuggaaaguuuuauacaaaagccagguuucuggauucaccugaaaaaguuugaagaacucacauucccaaaauagcaagcauugggcugagucaauggaggcugcccccuucagccaagauaaguucucugauucacuccaauggacccaaauggcuccugucucccugcacagcccccguccccgacuucuguuuaccaauucuguuuaucauaucccuugaugcaucggagccugcacccaugucuuauauagaugcacauguguauuauauauccauauccacaucuauacugacuacacuguaucugguaucucugucuaugucucugucuccaucagugaccaucuuccugcaaaucucuuuccuuuuaucucacugccuucauuccaccccuugaggucugggucuuuuucuauuucuuuuuuuuuuuuuuuuaagagacugagucuugcucuuguugcccaggcuggagugcaguggugugaucucggcucacugcaaccuccaccuccuggguuuuaagugauccuccugccucagccucccgaguagcugggacuacaggugugcaacagcaugcccagcugauuuuuuguauuuucaguagagacggaguuucaccauguuggccaggauggucucaaucucuugaccuugugauccgcccgccucagccucccaaagugcuagggaguuauauaugcaucuccucuuaucucuuggcucucugcaugcaucuuucuguuucucuuccuuccuuucuuuuuuuuuuuuuuuuuuuuuuuuuuuuuuuuuuuuuugagacggagucuugcucugucucccaggcuggagugcagugaccagucucggcucacugcaaccuccaccucccagguucaagugauucucgugccucagccucccgaguagcugggauuacaggcgccugccaccaugccuggcuaauuuuuguauauuuagcagagaugggguuucaccauguuggcugggcuggucucaaacuccugaccucaagcgauccgccggccucggccuccaaaacacugggauuacaggcaugagccacggugcccggccagccucucucucuacuuggcccucuuccuccuugucuccauuuguuucucuugugugcuaugacugucugucugucacugucucuugucucuaucuuugagaguccuaaauguggcuccauugguccuuuggaaaagcugcagggaggacucagggcaguggggugcugaguguguuggagacaguugcagauccuugacaguucucuucccugacagcgcuguuuccagucacacugcagugugccaacaucagcauccuggagaacaaacucugucacugggcauacccuggacacaucucggacagcaugcucugugcgggccugugggaggggggccgagguuccugccaggugagaccuuacucuggggaaaaugaggcuguccugccaaguuuucuaggauuuaggggagcagaggggucggcccccagccuuccugggucaaaaugagaaggagacugggauaccugguuccugggagaggacgggaccagggccuggacuccuuaguguaaaagagaaaaggucuggagguccagacuucuggaucuacaggaggagugggcugggcguccagagucugaguccucggggaggaggagguuagguccugcggggaggugggcccucugagcuuuuacuccugggucugaggaagaagaggcuggagauggaggacucucggauguuggaggaggaaggggcuggggccuuucugggagggaggaaguggcccguguaauugucaugaacagaguggccuaacaguuccucugcccuucucucgcguacagggugacucugggggcccccugguuugcaauggaaccuuggcaggcguggugucugggggugcugagcccugcuccagaccccggcgccccgcagucuacaccagcguaugccacuaccuugacuggauccaagaaaucauggagaacugagcccgcgcgccacgggggcaccuuggaagaccaagagaggccgaagggcacgggguaggggguucucguagggucccagccucaaugguucccgcccuggaccuccagcugcccugacuccccucuggacacuaagacuccgccccugaggcuccgcccccucacgaggucaagcaagacacagucgcgcccccucggaacggagcagggacacgcccuucagagcccgucucuaugacgucaccgacagccaucaccuccuucuuggaacagcacagccuguggcuccgccccaaggaaccacuuacacaaaauagcuccgccccucggaacuuugcccagugggacuuccccucgggacuccaccccuuguggccccgccuccuucaccagagaucucgccccucgugaugucaggggcgcaguagcuccgcccacguggagcucgggcgguguagagcucagccccuuguggccccguccugggcgugugcuggguuugaauccuggcggagaccuggggggaaauugagggagggucuggauaccuuuagagccaaugcaacggaugauuuuucaguaaacgcgggaaaccuc

SEQ ID NO: 15144 - RNA, 5604 nt, Homo sapiens
aaggaaccagagaguugugaguuuauuaagggagaucuagugcuuauccuagaaucagcccuugcugccuaugaucuucuugauccaguccagguagcggcagauguugguauagacgccagguuugucggaccucccacaggggucugagccccaggaugugaugcccuggagugcaccaucacacaccagggggccuccagaaucgcccuagacagggagaaugagaacagccuugcaucugagauguccacaacgucccuuuuccugcugucccagcguuuuaccaguucuuuggcaugauugguccccuguagccaauggggguaaaagcauuguccccugagaccagucaggacagggcuuggggcuuccauguacagacagacauggugucuaaggguaguggucaaaacacugacagaagaggggaaagaaugaaaucccagacaggcuugguggcucacaccugcaaucccggcacuuugggaggccgaggcgguagaucacuugaagucaggcguuccagaccagccuggccaacauggugaaucccugucucuacuaaaaauacaaaaacuagcugggugugguggugcacaccuguaaucacagcuacucgggaggcugaggugggagaauugcuugaacugggaggcagaggcugcagugagccaagauugugccacugcauuccagcuugggggacagagcgagacccugucucaaaaaaaaaaaaaaaagaguucucgaggguccaauccagggagaagacaguagggauuacuuggagaggacugagcugaaguuuccucuguuccuggccaauagugaaggcaucauugauugcaguugccaaacauaggagaaaggaucaagauucuuauggacacacacacacacacacacacacacacacacacacacacacacaccauauccccaagagaccauggcugaaauauuuguggaagagaccacuaucucuacagaacaauccagagacuggcuuucauggcaguaucgcugauggaaacgacuccauuuuuggccaauggggaagaaagcauuguauuuagggaccagucauuggcaaaggugguggggcuuccaggaaguggacaaagccaggggaaagugcuaggaacaacgaaguugcaguuagaagagagaguuauaucuaugacaaaucccaagagaaagggauuggagcucauugaggaagcacugaagucaauggcaccauuuacuccagccaacugggaagacaccauugucucccaaggaaccaaucacaggagaagggaaccagccuugggauucuagcccggucucaaagaaaaguggcugaccaccgggccggugguaaagucggcacaaauuccacgauguaaugcugggaaccagagagcaggcaacucgucuaaacucuagccucagacucucuccuugcuggacaucuaccccacccucuauagcccccaacucugcaucccauccuguaguuaagcguucgaaagaaaacagcagcagcaauucaaugcuccuaaucccuaugcagugugacuuucagagagagaguuuggcuucucugaaccuggcucccaauccguagagauaggggugaacacuccgggugccaagucuuuggggucacucccuuaccacccccacccccauccaagccuugaaccucgagagggcaaugagggaugugugaggagaaggauuucagaaauugcucaccuggcacgugucagccccuuugcugcugccugcacagaccaugccaucugugaucugccccggguaagcauccucacacuucuucuggggaaagauuuuuacuucugcacaguugagagugucaggaaaauucucugagggggaagagguuguaagguucccugagagagcagcccuuugccuccaucccugucuggaucuaacccccuuucuuuccaggauguaaugggggaguuuuccagcugcaugggggaauuuucugacacugugcacaggggacaucacuucucaccacauuaaacgaagcuguacuuguugcuauugggcuuucuccaucuagagaggggcccuuggaucucacguguuuuuucuuacccugagccauuuucaaaucaaggggcuggggguuacuuggaggugccccuuuaugauaccucugacccucucuuuccagucuuccugcccucagacaaccggguccucaaucugugcuaaauccugcuccuuccaagugucaccuccuccuggaagccuucccugaccacucgaauuaaaaaauaccaucccuccauuacucccuauccuuuuacgcuccacaauauuuccuuacagcacuuugccuaauguuuuauuuuauguguauuuguuuauugucuauuucucccaccuagcuugcaacuccauaacgacaaggacuuuguacaguuugcucauggcuguauauccagcgccugcaacagcaccucaggcauacuaggugcucaguaaauaagaguugaauuaaugauugaagguggaauugaucuuuuuuauuaaccucuuuugaggaauagacuucuccaaagccucuuugagggggaaaaacuuccaucuggcaucucuacgugccaaaagcaauaugcucauaaucucauuuaauccucacaacagcgcuuugaaggagagaugcauucauucauuucauuauuuauucaucaggucauccauucaacaaauauuuauugagcaucuaccauguagcaggcaccauucugagcacuaggagaacacaaugaagaaaacugauguaaccugaacccucacguagcuaaaaaaucuauugguuaaugauucccauuuugcagauaaggaaagugaggcucagagauggaaaggaauuugcccagggagaaagggcagagccauaguuugaacugaucuacuugauuugcgagcacguguguuuccacagccgcaaacugucucauccaaagcauucagagcaggagugaggcaggcagggaccugaaugcugacuuugccacuuccuggagaagcuccuugacucucuuaggugagucccaauguuuucacugugaaggaaggcgaggggcucucuggauucuggagucccaaagggacagcuucauuggagguccagauuuugggguccagagucaagagggagcuaggacugcuggguccugggagaagaagggccuagacucccgggucugagggaagaggugaccagggcccagguuuccuggguucaagaaggagaaaaaggccaggggcgguggcucaugcuuguaaucccagcacuuugguaggccgaggcgggcagaucacuugaggucaggaguucgagaccagccuggucaacauggcgaaacccugucucuacaacaaauacaaaaauuagcucgcgugguggcgggugccuguaaucccagcuacucgggaggcugagguucgagaaucgcuuaaacccaggaggcagagauuguagugagcugagauugugccacugcacuccagccugggcgauugagugaaacugugucccccugcaaaaaaaaaaaaaaaaaaaaaaaaaaaaaaaaaaaaaaaaaggagggaggugggggagaaggugcuuaggagccuguuuuccugggccucugagaaguccaaauaucccaaguguguuaagauuauauaaaauccuauacaaccaaaggucccauaggguagugcucuccgccauacaggaugggcuuuucuggcccugcuuaacaaucugcuaguugguucuuucucucaccacucuuguuaguagucagaucuucgaggcuucucauaugacuccugcuugugaaucucaacaucaugaucacuuucccuucuuugucucccucugggggaccaagcuuugccaauagcuuggguuccacugggccaaccagcuccuccucucccucccauuaguggacaagcccacuaccucggggacuggugacagugccccagccugagacggugcacuucuggccaggcugggugcaaugaucugccaggcugaugggcuucacuuuggaccccagggaugccuggucacgcaguugaagaagcaucagaucaugguugugguccuccacaucgcugcuguuguagcaggggugugggauggacugaaccacagguauuucuugcucugggccaucuuuauucuguaggcuguggucucccaggcguacuguguauuuccuguaaugguggggauaguuugggacccaggcagggguauugcccccagcccccuccuccuucagacccaggaguccaguccucagcucucuccuuccugagucgaaaccccagcccccucuuuccuuaagccccagcugaccucugcccccaucauccacucacgguuuuuuacagugggcagcuguaaggacccaguugccaccuacaaggacaccgccacagaguaguugcuggcccuggaacaaggccgccugccaaggcugcgaaugggguuggcacucaugaccccccagcaccuuguccuccugugcccuggaguguccugcagcaggagggagaggguuggaucgccacccucuggggcagugcgagggcugggaaggccacuguggguucaaauggacacacggcaaguucuccgcauacaacuuagugaggagguccaggcuuccacacgcugccacacggggacacucauuucaguccaugugucaucauacaagagucacacacccaagaaugcccccacaugcuuccacaugagucuacaggccccgaguacucccaggugaaucuaugcccccaagcaagcagcccccaaaggcuguagcuauucagacaauuuacagcaucacggaaccuacuccuaccugcugcuaccuguuucuugccucuguccacccugaggaaagcccacagaggcuccugcaccguaucgcacucuucacauccgugcacacgcacccacauaacccccgcggcauucccacagacuccccagcgccacugcugccuucagaucccuccccuccggaggccuccgcaacccuccucaccugcccaggcuccccccagcaagagcaggaacauccacgucuuggccgcacgaggucgggggcgucccauggugaggucugggaaauggagagggcggggccgguaaacaggaaggaggagccugagcucccaguucuggauuugggcacuggggaggcagccgagaguaucuggggcuguucugggcuucucuggaggaaggaggaggcugggggacuggauuccuacauuccaagggaggggggaguccucgaugucugggucugaggggacagggagcugggagcugggacuccuaaauuagggagaggaggaagccgggguccagacugcuggaucucgacagagaagggcaucugaggcugggguccuggaaucuggagaaggaggguccggggccugaugucuguaucugaguaccucugcaccucaccuuccagaauccaggggcggggucaccuacugauucggacccaguggaggaggccccaguacuucaguucucugccu

SEQ ID NO: 15145 - RNA, 7646 nt, Homo sapiens
uauuucuuucuagucucccuuccugaaaggucaccucucuccaaucuuagaucuucagacuuuuuuccccaccuuuauuuuucauguuauaaaagugcacauucaaggaaaaguacacagaaggaaggagacaccucaugacgaccccaguaugcagucugggacauguguuuucagaucugauucugugaauauuucauuuuuuauggguagggucacauacauauauauuuuuguccuuccuuuugucauuuaacauccuauagccuaaauguucuugaauaauacugacaauucugucuaaguaucauuuuuaauagguuuguaauaucauugugggcuggccgugguggcucaugccuguaaucccagcacuuugggaggccaagguggguggaucaucugaggucaggcguucaagaccaugcuggccaacauggugaaacccugucucuaguaaaaauacacaaaaaauuagccuggugugguggugcacaccuguagucccagguacuugggaggcugaagcacgagaaucacuugaacccaggaggcggagguugcagugagccaagauugcaucacugcauugcagcccaagcaacagagacucugucucaaagaaaaaaaacaucguugugccaagccagacuauuauuuaagccaucugguacuuuuggaacauguuugaugguuucacuucauuucugugauaaauaauaucaugguaaauucaagucuuguucuacauuuuggauuuuuuuuguuucaguagguucuuccuaagauuagaguuacugggucaaagguggugaauaagggucucgguguacguugaccaagugucuuccguaaagacuguacgaacguccaguuccaguguuugagagugcuggucucacugacucuucuccagcacugaggguuuuguguuucuuuauuuguuuugguuuuaggucuuuaccaauuugauugguuuaucaacagggcaugagguugguuuaaauauaucuuugaggaaagguaaagucaaauuugacuucauaggucaucggcguccucacuccugugcauuuucuguuggaagcacacaguuaauuaacucaguguggcguuagcgaugcuuuuucauggugucauuuauccacuuggugaacuugcacacuugaguguagacuccugggucauuggguuggccgcaagggaaaguuccccaggacaccagaccuugcaggguaccucugcacaccaacggucccccugagucacccuagagggaauagagccggagauuaacuuuggcuucagaucaaagcccaacucauucucauacauuccucaguuaucggucuuugucuugcagauuauggacuuccaccauagccaaugagaagagacucauugucucuggggacuaaugggagagcuagugcuagggacacacuagguccuuugaagacacugguuugacccuuggccaaugagaccaauugcagagaagggguggggcuuccaggaucagagcacucuuuauuuuccaauguuaaggacccugcuccaagcuagugggagaaggaacaucaucuccaagggguggaugcgugcccuguggcgcaggaaagggggacacgauggucucggagaccagggugaagaccaguuacauaauuuacaggacuuggugcaaaacgaaaaugcagggcccuuuguucaaaaauuauugagaauuucaagacaacagcaggaaugcauuagacuaaguuugagacccuucugaguguggggcucuguguccgugcagagcuugcacauucaugaaacuggcccucaccaggggagaaggggaacacccuauucucuaggacagucaucucucucccaucuccucuaucccuaacacucaccaucccacauccccugacagcugaaggugcagaugugagcaaggaggauggguguggagagacagagagaguuggagguggagaagaaagagggaaaggagagagagacaaagagagaugaggaagagggaaaggguauggggagagagagagacagagagauggggguggaaaagaaggagggagaagagagacagacaaagagaugagggagauggggagggugugggaagagaagagagagagagauggggguggagaagaaagagggagaagagagagacaaagagaaagggggggaagguguggggagagagaugggguggggguggggagaggagagagagacuggaagagaggaggagaauaaagagagagaaagaaagacagagaugggggagcggcagggagaggagagagauagaagaaagagaaagagagagacaguaaaaaggagggggcaaggagagaugagggagagagaugaagagagacagagaagugggggagagagagaaagaggagagggccagagaggagacagagagagaggaaaaaagagagagcaggggggcagggagaggagagagggaggggaggagagagagagaagcaagagaaagagggagaagacagagagcagagaggagggcauggagagagaacaagggagggagagcaagcuagcucaacacagagaaaaaacaaagaggaaaagaaugaaaugaaauuaugucacaaagagagaugugggaagacuguucagaaacagaggggaugacaaaaggccagaaagagggaacagagaggagguggagagaaagaguguuuuccccgggaccagggccagggucaggugagugagucaucagcuucaggcacaaaaucucaguaacugcaauacacaauacuucaaugcaguacuuaacgaaaucaaauguaauacauaaaacugcaugaugggcaugguauccacauuuuaaaugaagacagugccaguacagcgcugugcugagccacgcuaguacuuacggcaagggaaaauucaguaagauccaccugcucuuuauuuaaaaugugacauuuuguccaucauggacuucugcaugaguuuuuauuuuuauuuuuaaauauugcauuaugauuuaucucaaucacugagguuuuuggugcccccuuaagguuugggccugaggccagcaccucagucuccuucccuggucccacccccacuuucucaccccuauuaaacucucugucucauccccagggccacauuggccccuaaguaaacucccaccccugaccuaggcagagaaugagguggaaaaagcugaggaggccaggccuggggggagggcaaggccgggcuugguacccagucacucgggucaagcucugucccuggggcaugcagacaggguacccaggacuggggaggaauugggggggagggucucacauugcaggcguuuuucuuggagucggggaugccagcgcacagcauggaauuuuccaguaaguccuuguaaaccuucgugcaguccuggggggagaugagcuugacauccacgcacaugaggucagagggaaaggucacugcagggaggagcagggagagcugucagucagagaggaugggggcgaggaccagaagggcuguuguucaggcuccugguuccgagggaggagggucuggggcccaggacugcugggucugagggaggaggggcuggggucuggacucccgggucugagggaggaggggcugggggccuggacuccugggucugagggaggaggggcugaggccuggacuccugggucugagggaggaggggcugggggccuggacuccugggucugagggaggagggcuggggccugcacuccugggucacugaggccaccuaccaucugggcucgugguagugccccagccggagacaguacaggugguuccaggggguucgcagcgggagggcagccugacuuucuucaccauggaugacagccuggccuggcuauugagcuucacgagcaugaggucauuaacaugggucuguguggaguagccgggguggcggaaugacuucgaggccuugauccucugagcucuccugucgcccagcguaucacugcccaggugcacgguguacucacugcgaggagugacauucacagauucagaagagacacugugacagagagggugugcaaagaccugggggacgggguggggacagagacccagagagaggaggggggacagagacacagagagaggaggggagacagagacccagagagaggggaacagagauccagagagagagggggacagagccccagagagagggagacagagacccagagagggggggacagagacccagagagaggaggggggagagagacacagagauaggaggggggacagagacacagagagaggaggggggagagagacacagagagaggagaggggacagagacccagagagaggggaacagagacccagagagagagggggacagagauccagagagagagggacagagacccagagagagagggacagagacccagagagaggggaacagagaccagagagagagggggacagagccccagagagaggaagacagagagccagggagagagggggacagagccccagggagagggggacagagauccagagagagaggagggggaacagagaccagagagagaggggaacagagacccagagagagagggacagagacccacagagagaggagggggaacagagaccagagagagagggugacagagacccagagagagagggugacagagacccagagagagagggacagagaccagagagagaggagggggaacagagaccagagagagagggggacagagacccagagagagagggacagagacccagaaagagaggagggggaacagagacccggagagagaaggggacagagacacagaggggaacagagauccagagagaaaggcagacagagacccagagagagggggacagagccccagggagaggggguacagaggcccagggagagggggacagagauccagagagagagggggacagagaccagagagagagggacagagacccagagagagaggagggggaacagagaccuagagagaaugggggacagagacacagagagaggggaacagagauccagagagagggggacagagacccagagagagggagacagagagccagggagagagggggacagagccccagggagaggggguacagaggcccagagagaggaggacagagacccagagagaggagaauagagccguaggcacagaaagacugcccuuccacccccauagcgagcuggagacgcuggugcaccuccagcagagacuugggcggcaccuacuucaucuugcagugggcggcagugagcacccagcgcucauugaccaggacgccuccgcaguggagcugauugccacugagcagggccaccugccaugggugggagccucuugcacauggggcgccaucaauaaucuugucacccugggcuggauggagacauggaggagcacguggguagcuagcauuaggggaaggcugaggcugcaccucagggauucccagagucagagauggacagagacagaugaaaauguguggagaaauacagagaaagcaagagauagggauagagacagacagaaggagcccacucagaaacccaggaggcgcaucucaucuggggaaccacagagagacccugagcacaggaggcagggccuggaggggacagagacccccugagucagcagaagcaggaagagcgggggcuucagccgacagucugguccucccaggauggaagcuguuugaggagggaaggguucugacucagggacuccuuggagagggucagugggggcccugaggugaggucagacuucccaguccagcuuucaccuucuucuccugcaguuuccaaggcuaaggauagcaguaagaucugcaggggcaggagaagggaucuugccauggugcccugcugagccgcucaggggcugccaggcgaggaagggccucuccugcuggagcugagaaggagaaagcauucaggcccagccccuccccacucagacccagggguccaggccccagccccuccccccacagacccaggaguccaggccccagccccuccucccucagacccagggguccaggccccagccccuccucccucagaccuagggguccagaaccccagccccuccucccucagacccagaaauuccuuucucuggccucuccuuccuuacacucagaaguccagaccccuaaccuccuccucccucauacccaagaguccagacccuagcaccuuccucccucagacccaggaguccaggcccccagccccuccucccucagaccuaggaguccaggcccccagcuccuccucccucagaccuaggaguccagguccaagucccuccucccucaggcucaggaguccaggccccaaccccuccucccucagacccaggaguccaggcccccagccccgccucccucagaccuaggaguccaggcccccagcuccuccucccucagaccuaggaguccagguccaagucccuccucccucaggcucaggaguccaggccccaaccccuccucccucagacccaggaguccaggccccagccccuccucccucagacccaggaguccaggcccccagcuccuccucccucagacccaggaguccaggucccagucccuccucccucagaccuaggaguccaggucucagucccuccucccucaggcccaggaguccaggccccagccccuccucccucagacccaggaguccaggccccagccccuccucccucagacccaggaguccaggccccagccccuccucccucagacccaggaguccaggccccagccccuccucccucagacccaggaguccaggccccagccccuccucccucagacccaggaguccaggccccagcuccuccucccucagaccuaggaguccaggucccagccccuccucccucagacccaggaguccaggcccccagccccuccucccucagacccaggagucgagacccccagccccuccucccucagacccaggaguccaggcccccaggcccuccucccucagacccaggaguccagaaccccagccccuccucccucagacccaaaauuccuguucuucagaucccuagagacccaggaaucuaggcuccgaucuugcccuucccuguggaacccaaacuucugacucuguaguucguuuuucccuaaaaggccccaaauugcagacuuccaggcccucacugcucaggaccgggagucuaggcugcagccccuaccucucgagagcagagucaggcuuggagccagcaucacccucuccccuacaggugcacccuugaugaagccucuucucaccucgagaggaucugaugugauccaaguuccgacuugggcuggcacacagcugggcuccaaaaucuucaucccucugcugggccguccucuuauaucaccccccgccccaugcccggccccagcgcccuggggugcaggcggagccgacucugggacacccccgccugcauuugcgguucugguuaucuggaacccugacgcagcgagagcaauuggc

SEQ ID NO: 15146 - RNA, 10847 nt, Homo sapiens
caguguggugacacacgcuguagcugucuccccggcuggcuggcucgcucucuccuggggacacagaggucggcaggcagcacacagagggaccuacgggcaggugugugagucaccccaaccgcacugaaccugggcaggcugcuucccagugccggagggcucuagagcccggagugagggccugcaggucccuggguggcacagagagugcugggggugcagggaggccuggggcaccaucugcuugccccagaggccggaauuugucuucagacacuuucuuucuccaaaacccggaggucuaaggacugagccgacuagaacuuccucugccucagauucaggccccagccccuccucccucagacccaggaguuuagguccuagccccuccucccucagacccaggaguccaaguucccaccuccucccucagacucaggaguccaggcccccagccccuccucccucagacccaggaguccaaguucucaccuccucccucagacccaggaguccaggccccaagccccuccucccucagacgcaaggguccaggcccccagccccuccucccucagacucaggaguccaggcccccaagccccuccucccucagacccaggaguccaggcccucacugcacucagggaccagugcucccuucccuggaggccuggucaggggucaccaagagcagagcgugggggcgggaggaaugugugugggaggccuggguaaggaggaaaaggguguagccagucuccuggcucagggaccugagagacagggguuaaaaggacguuccagaagcaucuggggacagaaccagccucuuccagggaggccugggagcugggggugugugucuggcagucccugcagcccugggcucugcggccccugcguccuccgcuuggcucugccacugcaucugagugucuucucuccucacggcuccccgcauuucuaacucuuucugccuccucgucucaaagcuguuccuucccccgacucaagaauccccggagcccggaggccugcagcaggugagaucacagacaucacagaaccugccgggugggcgggguggguggccauugcgcacagagccaggcuccgaggaaaacucccauacagaggaagaacgcuagggcccccuaggguaacccucuccugucgacaggaaggcaaaucagugcccaagaaaguagaaagaucuaaucagaaucucaccauggguuacuggaccaguggacguaguucugaauucucuuuggcacuguuuucgugggauccucugauggaagaugugggcugaggaagaauaaaucaggaggcuagaugggaaggacagaggucaaggcaggagaccauagcaggccaggaaggaaggagaggaugcagagggagcagacagagggauggggggagggucgaggcagugacuaauggaccauguggcuuccccucucaggagcggccaugaagaagcugaugguggugcugagucugauugcugcagguggggaaagggcauuuggaugggggaggcuugcagacaggguugggcuuguugauggagaagaggcugguauuggggauggggauaugcacaggguuggggugggggagcuuugaaaugaggaagacguuggggauuaggcuaaggguggggaauacagauagggaggguggugggagguggguuugaagauaugaggguuuggggugggguuggcuuuagggauggggaucuaaacauagaagagguaggagguagguuggaaaguuggagagagcccgggaauaggggauacaguuggguuuguaaugggaaugggguaaguuugggaguggaaauacagagaagcuuuuuuuuuuugagacagggucucacucugucacccaggcuggaguguaguggcaugauccauaguucacugcagacuugaacucuugggucucaagugacccucccaccucagccucccaaguagcugggacuacaggcguaugccaccauacccugcuaauuuguguguguguguguguguguguguguguguguguguguggagaugaggucucacuguguuaccgaggcuggucucaaacuccugggcucaagcgauccuccugccucagcugggauuacaggcauaagccacugcaccugaccaaucuugacuggaguucauguugagggggaugcgcuugguuucuccagaacuccucucugacucagaucuucucucccucagccugggcagaggagcagaauaaguuggugcauggcggacccugcgacaagacaucucaccccuaccaagcugcccucuacaccucgggccacuugcucuguggugggguccuuauccauccacuguggguccucacagcugcccacugcaaaaaaccgugagucuacacuguaaaugaacagcagaugcgacugaacccugagggugucuuauagaugucaggcaggaggugacauaggcaucccccccaucccagcacgaggccaucugauagccaggugcauucggcuguugcuuaauugaguacuuaaugugugccaggcccugcgggcauagcaguggaaaagaaaauaaaaaaaagaaaacaaaaaaaaacaagcaaaauugcuguuuuccugaacuuacuuucuaaugggggaauuggaucauuuggggaccugcagggcgugaugggcauuuggauuuaauucugagcacaguaggaagccacugggcaguuuuguuuuuguuguuuguuuguuuuuugagacacagucucgcucugucacccaggcuggaguguaguggcaugaucucagcucacugcaaccucugccucccagguuccagcgauucuccugccucagcaccccaaguagcugagauuacaggugugcaccaccuugccuggcuaauuuuuguauguuugguagagacgggguuucaccauguuggccaggcuggucucgaacuccugaccucaggugauccgcccgccucgcccucccaaagagcugggauuacaggcaugagccaccaccacacccagccugauuuacauuuuuacaagcacccuggcuaccacguggaacguggucugggcaagagagagggagggaggcccacgugggggcuguugcuuucauccggcgacauaggaggguggcuugaacccaggcggucgcaguggggauggagggauguugaauaucuugggauguggaauucugagacugagccagcagaaucuggcaacgaggaacaggagggagaggaagaagcacggcuggcuuccguguauuuguccugaacaacuggguguuuugccacgucuuucucugaguugugggagagggaaagagaaacaggccggguguaggcaggggagcaucugacauuuugcuuuagccacgaugaguuggagaugccggggagaugucccagcagggaggccagggaggacucuggagcucagaggagaggucagggcuggagguuaaaaugaaggcaucgucagcaaacagguguauuuaaagccaugggacuagaugagaucauccaaaaagcuggcauaguuggaggagcuggagggcccaggacaaaaacccugggcgcugauccucacuagucagauucacgacagcugccacuuguuugaugcuaacuaccaaucaggugcugagugaaaccauguacacaccuuuccuggaaugcccaccacaagggacucuuggcaccauuuugcaaaugaggaaacugaggugcagggaaauagcaagugacaaucccuggggugguuccccugaccccaaggagaccuuggaugacucucaccaccaucauucauuccuuugauguacauugacuaagagcaccugcuaagugccacauucgaguugggcaguggagauucagcaauggaugggacacacacgucaucccugcccucgggagcacaaggacagaaaggugcagacaagcaaagugagggcugggcaugguggcucacgccuguaaucccagcacuuugggaggccgagguggguggauuaccugaguucgagaccagcuuggccaacauggcucaacccugucucuacugaaaauacaaaaaauuagccaggcgugguggugggcuucuguaauuccagcaacuugggaggcuaaggcaggagaauugcuugaacgugggaggcggagguugcagugagccgagaucgcgccacugcacuccagccugaaccacagagcgagacucugucuaaaaaaaaaaaaaggaaagaaagaagcagcaaauugggcuggccgugguggcucaugccuguaaucccagcacuuugggaggccgaggcggguggaucacucgagcccaggaguacaaagcugcagugagcugugaucuacagaacaccacugcagauccagccugggugacagagcgagacccugucucaaaaaaacaaacaaacaaaagaagcaaacccuucaaaaccccauauaauuacaaauuaugaaggaaaagaauacggguaccuacuuuagauggaggagggucaggaaggacuuucuaaugagauaaaauccaagcggaggcaugaagaugggaaaaggaauguucagggcagaggaaaggcugugauaacaccccugaggugagaaccgucuugaguauucucagaaaauaaaauuucccguucacuggggggcagaaggugcugggagauaagguuggaaagugacuacagccagaucacacaggggcuccagugccaaguggaggagcccaggcuuuauucuuaggacaauggggagccaugggugaugucugagcaagggagugacucucuguuucaggaauauguaucaaacaccuauccugugccaggugcugaucaacgcacuggagauacuauaucugaauagaacaaaaauccccaucuugacauccuagagcugcacugucuaauaugguagccaucagccacauauagcaaauuacauugaaauuaaugaaauggaaaauccacaagccacauuucaaguacucagcagccaccuguagcuugugguucccccagccaccucuggacagugcagaucgagaucauggcaucguagcauuuaguggacagcauugcucugcaaggaggagaaauaacacaaugaguaaauauuuaacaauaaauauauagcaggucggaugauugugauagguucucugguggaacagaaagcaggggagggagauaggaauugccuacuaacagguauuuguauuuuaauugggcaacuaaggaaggcuucccugagaggcgacauuuaaaggaagugagggagugagcuaugcagauacuuggaggacagacuugcuggcagagggaacagcagugcaaaggcccugaggugggaagaucacuauuguguucaaggcaagacagggaagccagcguuuggcuggagcagagggagagaaggggagagugggaggagaagaugucugugagaugauggggcagugcuugcaaggccuggugugccacguugagaacuuuggcuuugauucugagugagaugggagucauaggaggggcugagcagaggaggcacaggaccaacuuacauuguuaaaauaucucugguugcuuuguggaggauggacugugggggaccagagacagagcagggagcccagugaggaggcuacugcucuaguucagguaggaagugaaaaggcagcucaaaccaagaugguagccgugggaaaggugagauguggccagauucuggauaugcuucagagaggcaaaaggaauucuggacagcuuggauguagggcaugaaauaaagagagugaagaauagcccccaagauuauucugaaaggauggaauugccauuuacccagcuggggaagacugugggaggagcaggccagcgauucaugacuucccagcccucucugaagccucaacugcagcccaagggcuccaggugagacccagcccucuuccuucccaggaaucuucaggucuuccuggggaagcauaaccuucggcaaagggagaguucccaggagcagaguucuguuguccgggcugugauccacccugacuaugaugccgccagccaugaccaggacaucaugcuguugcgccuggcacgcccagccaaacucucugaacucauccagccccuuccccuggagagggacugcucagccaacaccaccagcugccacauccugggcuggggcaagacagcagauggucaguagugggaggcugguggggagcaggcuacuggcuacuuggggaagugugccaaaggauggggagugggaaaauuggugaggggccaugggaagaugggcuaauggugaggaccaaugggacaggguuucaaugggagaaaggucaagggggagggagagugaauuugggagcugggccagugagugaacagccaauggaaaauguagaccaaugggugaauagcaugggagagauggaacauaagaugaagguucaauaaagagggaaggucaguggggagaugcuaaucaggaaggaugucaaaggucaaaggggacugaucaggauucauugaacagcaggaaggaauaauggagaaggaacugauggaagaagagaaaccaauaaagcacaaaagccaacugaaggaugugaauugagacagugaauggggguauagcugauggaagagggacuaaggggaaaggaucaaugguccagaggagucacuagaggaaaaaacagguccaauagaucagcaggauccaugaaggugggccugugugugaagggccaauaagaaaggugaaccauuggaugaagggccagugggaaggcagagacaaugggggaggaugcggcaaguuagaaaaggaccaaugagggagguggaccauuggaugaagggcuaauaggaagggagagccagugggggauggugaggccaguuagaaaaggaccaaggagggaagcagaccaauaggaagagagagccaaugagggagggcagggccaguuaggaaaggaccaaugaggaagguagaccauuggaggaagggccaauagaaagggaggauccaugagggaggguggggacaguuagaaaaggaccaaugauggagguggaccauuggaugaagaaccaauagaaaggaagaaccaaugggagagggcauggccaguuaggaaaagaccaauggucacagagugaccaaucaagaugaaucaaugggcaggaaguguccaaugaagaauggacuacugaucaggagggguacaguagaggagggcguaacagaggaagaguccuccaggucaacugaaacuacugaagaaggugggaccaguggaagagagaaaaguggaggagggaccuaagagaaaaggaaaaccaauaggaaaugaggacuccuggagaagagacuauuaaugaggaagacagccaaugggggggaagaaugauagaaagagggaccaauuaggaggcagggacgaugguaaugagauguaagaaugagagacaaacaggaagaggggugccaauagaaaagagggaccaauagaggauggaggacuuauagggguuggggggugacuggggaggaugaggggagugcaaggccugggcugagucuggcccaucucuccccuaacaggugauuucccugacaccauccagugugcauacauccaccuggugucccgugaggagugugagcaugccuacccuggccagaucacccagaacauguugugugcuggggaugagaaguacgggaaggauuccugccaggugaggugacccggaucugccacuuacacagccagggacaggacgaagucacaaaaacauggccagacacaggaagagagagacacaggccaaaagagagcuuuacagagacagauagagacaggcugagggagaacccaagccuugaaaagaagagacuuaguucaacacacagagacacagucagggauaugcagagauauaaagacacagccagcagagacaggaagugcagagacaaggauggaggccgcgggaucaagaaccagagaggccaggagcagcggcucaugccuguaaucccggcacuuugggaggccgaagcaggaggaucaccuagggucaggaguucgagaccagccugaucaacauggugaaacccuaucucuacuaaaaauacaaaaauuaggaugggcacaguggcucaugccuguaaucccagcaccuugggaggccgaagcaggaggaucaccuggggucaggaguucgagaccagccugaucaacauggugaaacccuaucucuacuaaaaauacaaaaauuaggaugggcacaguggcucaugccuguaaucccagcaccuugggaggccgaagcaggaggaucaccuggggucaggaguucgagaccagccugaucaacauggugaaacccuaucucuacuaaaaauacaaaaauuaggaugggcacaguggcucaugccuguaaucccagcaccuugggaggccgaggugggugaauaaccaggucaagagauugagaccagccuggccgauauggggaaaccucaucucuacuaaaaauacaaaaauuagcugggcgugguggcaggcgccuguagucccagcuacucaggaggcuguggcaggagaaucacuugaaccuggaggcggagguuguugcagugagucgagaucaugcuacugcacuccagccuggcaacagagcaagauuccgucucaaaaaaaaaccaaaaaacaaaaauuacgcaagcauggugggacacaccuguagucccagcuacucgggaggcugaggcuggagaauugcuuaaacccaggaggcagaggcugcagugagcugagaucacgccacugcacuccagccuggggacagagccagacucugucuaaaaacaaaaagaaccaaagagaaguaguaaggaagcagauggugugaggggacuguccuuccucaaacagagcccccacgaguccugcucagaaacgaccaggcucuggaggagggagacacuagcuggggaaaggggacucccucccgaauacuuuaacuuggguuuccuccauugucauccauccaggcucuccucuuuaugccagaaugacuaaugcacugagggaugugcagagaccaaccaagggggagacacaggcagaaacggagacacaggcagaaacagggacagagacagggaaagcgauacauagcaaguuggacgcaaagaaagggcaggugggcgagacuguccucaagacacgagguggagaggugucccuggacagaauagugccaggcauaucucucccugggcccucccuaccucucccaccugggucuuaucgucuccuccucccccuccucccccuccccauccuccucccccucuccauccuccucccccuccccauccuccucccccuccuccucccccuccuccuccccccuccucucccuccuccuccucgucuucccccuccuccuccuccuucuccucuuccuucuccucuuccuccuccucguucuccucuuccuccuccuccucuuccuccucccccuuuuccuccuccuccuuuuccuccucuucuccuccucuuccuucuccuccuccucuuccuccuccuccucuuccuccuccuccucuuccuccuccucuucuuccuccuucuucuccucuuccuccuccucuuccuccuccuccuucuccucuuccuccuccucuuccuccuccuccuccuucuccucuuccuccuccucuuccuccuccuccucuuccuccuccucuuccuccucuccuucuccucuuccuccuccuucuccucuuccuccuccucucucuccaucggucucuacaccucugccucucuccacaccucucagucuccauucuuaaauuguuucucuuucuugcucucuauguuccucugcaucuuggcauuccuaucucugugucuuugagucuccuuuauucucucucuaccauucucucucugugccuuugugugucuuacugucucucucucugucucucugucccugagucuuucucuccaucuuucaguaaguaccucugucccuuucuaccucucucucugucacacacacacacacacacacacacacacacacacacacacacacagucucuggguuucuaucuguaucugacuuucucccucuuuccugcagggugauucuggggguccgcugguauguggagaccaccuccgaggccuugugucaugggguaacauccccuguggaucaaaggagaagccaggagucuacaccaacgucugcagauacacgaacuggauccaaaaaaccauucaggccaagugacccugacaugugacaucuaccucccgaccuaccaccccacuggcugguuccagaacgucucucaccuagaccuugccuccccuccucuccugcccagcucugacccugaugcuuaauaaacgcagcgacgugaggguccugauucucccugguuuuaccccagcuccauccuugcaucacuggggaggacgugaugagugaggacuuggguccucggucuuacccccaccacuaagagaauacaggaaaaucccuucuaggcaucuccucuccccaacccuuccacacguuugauuucuuccugcagaggcccagccacgugucuggaaucccagcuccgcugcuuacugucgguguccccuugggauguaccuuucuucacugcagauuucucaccuguaagaugaagauaaggaug

SEQ ID NO: 15147 - RNA, 5299 nt, Homo sapiens
cuggucauuuccaagguuccaaguuuacuacaauaggggguugauaggggugcucagggguuggccacgaugguguccuugauccacuuccgguaaugcaccaccuugguguacagggaaggccuuucgggcagggcacaugguucacugccccaugacgugauaccuugaagcacaccauuacagacaagugggcccccagaaucacccuaaggguaaaagcagggagagagugagauaggucagucccaguuucugccugggcaauccuaucuuucagaccuggacaggcagauaacagauagcaguucccagcuuuggaagaagagagaaaugucuccagagccgacuuccagaagaaggugggcagggauuccaacagagggguaggggcuccaguccuggccgguggggaagggacuucaggguccagcuccugugcagaggggaggguccacgaggacaguccuuguagacaggucggugggacaagggccaggaccaucugcaggaugcuguccccguggcuccucacagaggccaccuuccaggacuacucucugacuagacaccuccucuccagggcacuagggagccauggaggaccaucggcagggcuggcauggucaguucggugaucagaaugacccacuguggguagguggagaauggaguggaggggagagacugagggccaggagccugugagggaggcuggguaagggcccagguggggacaaugccuggagccacccccaggucagccccaucaucacucccuccacaucccugcugcccucccucccugcagucugaucccauagggaggccagcggcagccucuggacaccugagccaggcccuguccugcuucuguccagcaccauccacaguuccugacuccucagaggaaaagcaguguccuccuguggcccaggugaggcccugcaggagggguccuuucuucccucucgcacccugccccgauccuucacuccagccaggcaaccuccucucugcuccugacgcccucuaggccccuccucccaggccuggccagaugcuguucccucugcucccccaggugccgcagggcccuccccuccccugcggcagguguuugcucacucccgccuucugcaggaugucuccucccagucacacuccccaccccuucucccuccccgagagccugaucaccuccugacacccuccagcuuuucuguguuguggucccuguuccugccugugccccucacuggcuugggggcuacagaagggaggggcugcucucugucuguucacugcuaugucccaggcucuagggcagugcugggugcauagcaggugccuaguaaccgugugcugaacgcaggaacagaugaguugugcuguaagaauaaccuauugccuugagggagucaaagaagagggaaggagggaaugagaugagacacggggagguggcauggcuacagcuggggagcaggggaggcagacgccuuguuggcuucuagaccccagcccagaauuaagguccccacucaccuuuccccucaagaucuugggaguagggaugacucaccgagcaggugcuuuugcccccuguccagcguccagcacacagcaugaacuuggucaccuucugagggugaacuugcgcacacacgucauuggaaauaacauggagguccacacacugaaguuucuuuggggucaagacuacgggccaggcaaaaacacuguugugggcuggaccccaccugguuccuuggcccuccucccucagaccuaggaguccuguccccuccucccucagacccaggcaucugggcucccggcugcaccaucuggcccaggcguacacuccucugguucaaugcugccccagccugaggcguagcaggugguccccagugcuggcuccugggugggcagguccaugaccuucacagcauccgugagcucggcaggcucugacaggcggagcagcaugaggucguggcuggagucaucaccuggccugaggaaucgauucuucaggaggcucauaucguagagcgggugugggaagcuguggcugaccugaaauaccuggccugugucuucaggaugaaacaggcugugccgacccagcaagaucacgcuuuugcuggggaggaagcagacgcaggaaugaggagcgaggaugauaaggaaagagagaagggacagaggagcaaggaggaggcuccaaaagagaaaaagaaacagugagaaaaacacaggguuggggaagacacaguucaggccaaaaauacagacaacgaguugggaaacagcagugugagagggugaagggcagauacagaaacugagagaaaccaagggaaaaaggaagaggguaaaaggacagagagaaugaaagggcagaggggagaacagugacaaacaaggugagccgaaaauacacaggaugagaaagaaaagacagaaacauagagaaacagacaugggccagagaaagagagagagaagaacaaaaccaggcagaaagugagaaacagaugaaugagaaagggaagcaggaagucaaaggaagaaugagaaccaaguagagaggaauccgggggaugauagagugugggagagaaaagggagagagacuuuggagcugaguggggaccgcuggggaggggaggccucagaguggcucagcuguagaugcggcuuuggcguggguuuccaaguggguagguagccuggccugcaggcccaagguuguauccuccacuucgcuccccaggguccuuucccccauacccuguuuuccuucccccuucuccuuccuccucccucaauugccccucccagcuccagcuggaaccagcccuucucugugucucccaagaguggagggauguccuggagaaggaauggagugagaggggcccucucauacccucauacccacacacaucagggauaaaacacuuccuuuucuuuucuuuucuuuucuuuuuuuuuuuuuuuuuuuuugaggcggagucucacucugucacccaggcuggagugcaguggcacggucucggcucacugcaaccuccaccucccagguucaagcaauucuccucccucagccuccugaguagcugggacuacaggcaugcgccaccacgccuggcuaauuuuuuguauuuuuaguagagaugggguuucaccaguuggccaggcuggucucgaacuccugaccucaggugaucuaccugccuuggccucccaaagugcugggauuacaggugugagccaccgcgcccagccaaagcccuuccuuuucucaggguccccccaggcccaucccaugcgugugcucaguagggagaaggcacaggugagacagagaccgagagacagagccuggcagagagauacagggugagacacacuggcuagagagggaccagagaaggacagagagagggggagauauggagacugaagacagagaagagagggagagagagaacaaaauagucacacggagagacacaaccgaagccaguuaccaagagacauaaugaaagcgacacaaagagacauagaggaacacagauggagacccaggcagccauggggagggugguccagccccaacccugccuccccaugugaccugaaccagaacuuucccucucucccccagucccaaggcuggccuuagagguuauccuggggaaaaugcccagcuguuauuccucugggacacagacaccugcuccccagaccccaggccccuacucacuuccugaugcagugggcagcugugaggacccacugggggugcaccagaacaccgccgcagacugcccugccacgagaggccacaagcaccugccaggguugggaaugcuucucgcacucccagccucccacaauccgagacaggaugaggggugcagcaccugcagagggggugcuagaucaggggaaucaggguugacaggaggaacugggggacucggauaggagauggauuuaggauguggguuugaaaagacacgggggcagagaaccaaggcugggaguccugggacaugggcagggggagcugggaaaggcugggaauucugucaaucuucccuagguuugcagguugguggcuggugcugguggagaggcuucaugcucugggagcagaguugaacccagggaucaggguaggagacacaagacagcgcccagaccauaucuugagucuggggauuggguccuuuguggugauuuggggucuuggacugggagaagggaaacuugguacaaguuguggauucugaggggauaagcggugcuaggaaccagggauaagugccuuauggcgagguucaguugcuggaagaggaagguuuuggaaaguuuaggaagucccagguugagaaaacaguucuggucugaguugguuuuguuuuauuuguuuuucuuuuuguuuuuagguuuugaaaaggaugcagauuuggggaaucagagagcuggcaguuguggcuggggaugcucauguuuuuccuaaggaaaaugugggccacugaaugaagagucuggggcuaagagucagggaaugaggaguucucagagucccauugccagacugagggacccauuuguugucucaggccagauagccuggcuaggaagaaggaggugucugguuggcaucuggguauccuagggcaagauugggaggccaagcaucaaggucucugggauaggguugggcacucacagcugaaugggaaaagucaguagacugugauaggauugaggggcucaggagguggaccagugauacgguccaaggaaccaauggcauugagagagguccuuggagguuuugagccccacaaagagaaacacggagaugcccaggaacuuccccuuuaguaaagcagcugggagcagggagcuggcugggcaauggggagaaaguucugggguaagugggagggagcggggaccuggugugggagugaggacuguugcaauauggaggggcuggggguaugggcuuggaguggggcugggagagacagaaaagagcccagcucccugucugggcuggggugcuggguugggggggaaagagccucagcuugacagucagggcuggcucccucuccugcauccccccaaccauggccccucucaccaauccacgucacggacagggugaggaagacaaccgggacccacauggugacacagcucuccgggugcaggugguaagcuuggggcuggggagccucccccaggagcccuauaaaaccuu

SEQ ID NO: 15148 - RNA, 4867 nt, Homo sapiens
ccacacagcccucgcuccccaugcacacaggcgcacaguaagucacagaagccagagcagcuacugagcauacauguugggguccagugucagcuggggguagggaagcccugguuucuggcucacacggggccccccaaggcccgcaggcacccuggucuccaggccagcaggcccagccccaagcugagugccaccagcacagcuacagcuccggccagcaggggcaccacuggagcugcagggagaacacgcggggggugagugccaggacuuggcaacccuccacucccaccccaacacagaggacugucaccuggggggauggcagccucauaggggccauggcaggagaccccaugggcgggaggccgggccggggcagucagcugguagaagcggccuaguggacagggggccgggcacccggggaggcugagaggcaggggcaggugggcggagucauugcgguagaagagggagacggugacauuccuggagagagaggacaugguggcaccuccucccuccugucauugaucuuaaagccuggagaaaagggcuucugacucccaccugucauccucccagcaucaucccaugcagcuccccaccuggccaugcccucugccugacacaucaccccuugcuuugagaguucugucccacccaugucccugggcaccaaaccauucucacccuccaucuuuggcgggauuccccaggugcuuccggaacucaaagccgaggcaggcagcauauggcgggguguguccaucauagaggcccagggcccccuggagggccagcagggugcugucaugcugcagguggacccgagggcugagacggcacuucucucuggaggccuuucuccugagcacuacacuugcgcauccagaugucccccaggcuucuuagaaccaaccccccaaagcuacuccuuccucccauccugaaggcaguaccaacauuugcaggcggccacuuaauaaagauugcucaaguaggugcaaaauaugauuggacuaagcagccuuucuccuccggaaggacagacugcuuaguccaaucauaguuucuuaaagaaaacaaggaauuauauuuauucauaaauucuuccucccauaacaccgucaccucccucuuuccagacuaaugguagagccugagaguaggguuuggagauacggguuaccccaggcagugggcugagauccacugggaccacaggcucuuccucaccuaaaucgcugucacccucaucccugugccucagugccauguggcacugcuucccaaggacucacagcugaguacaugaccaucuugaggggcagccccaggcgcuggacccgggagaaguuugcaaggauagcauucagcaggaucccugaggaugggaaaaaagagcuuagacucucccagaggaaggcaccccagccucccagacccacaccucacccccugucagcugggccuucucugcugcccggggugggcccacgugggcuccaauauccaaagccgagaucugggcaagaguccgcaggacaucuggggaggcccaggcugguaguggaagaccgugggcuugcuguggggagacaggacagauggaccauccugagcccucgaguuugccucuggccccgcaggccugugcugcccccugcucuucugaguccccccaugggccggaucuggaucuggcugggaaaucaugauguggauaacaguguuuuuuuguuguuguuuuuuguuuugaaacggagccuugcuccaucaccuaggcuggagugcaguagcgcaaucuuggcugucugcaacccuugccucucggguucaggugauucuccugccucagccucccaaguagcugugauuacaagugugugccaccauuccuggcuaauuuuuuuuuuuuauuuuuaguagagacgggguuuuaccguguuggucagacuggucugaaacuccugaccucaggugaucugcccaccucagccucucaaaguggugggauuacaggugugagccaccacacccagccaacagcgauuauuaguuaauaauagacaucgucauuacacagcccagaaggcuuuaucugaaaccccuggggccagagguauuucacagcucagacauucuggacuuuagaaaggucugauggugcugacaccacacagcauggaacacacacagcaagggccggggcagcccccuuagucacacacaucacugcucccacccugcgauucagaacauucccgugagcuggagugagcaaagacuagcaagaguacuagcuggguaugguggcucacgccuguaaucccagcucuuggggaggcgaaaggauuguuugagcccaggaguuccugggcaacauagaccccaucucugcaaaaaauuaauuuuuuuuuaauuagccaggcaugauggugugccccugccugccucagcuacuugggaggcugaggcaggagaauuccuauagccagggagauggaggcugcagugagcuaugauaaugccauugcacuccagccugggugacagagugagauccugucuccaaaaaaaaaaaaaaaaaaaaaagcauugcaucauuucaggucagcucccgcugcccagguuuuggguuuucugauuauaggacuguggggaggaguugccaaauguguagccucaaacccuggcaaggcccucacuguacaccaggcacuauuguaagcacagugcguggauuaacccauuugaauccucacagcguccuggggagguguugauaccgguguugccauccccacugugcagaugggaaaacugaggcacagaggauuaacuacaugccugagggaacacagcuagugaguagcaagcugggauuggaaacagguguccuuaaacccuuggcugggaaggggcagggcucaccuggcacaugaggguguccagaaccuuccaugcccugcgcaguggcucuccaaccagcgacagucccgugaaguucuccaggcgacucaggaagcccuggaugcgcggggcugggugagcccaggcccauccccugcaucccgccccccaccgccgcccugcucaccguccagcccuccagggccuccugguacucggcggccucgguggccucccgcagcagcucgugguaucggggacagcugcgcauggggaaccucagcagcuggggaaaacugagucucagagaggacagccgugugccuugccuugggucucacagcgggucgggggaacccgggcucucggccccugcgucuuugucgcaguuucucccagauccaggagagcagcgugggccggggcucacccuggucuggacagaccagcucgaggacagucuugcuucucggagccagcucaggcggccagacccagagcugccucucucuccacccgcucccucccucgccacacguggguccagcccccugaccuuauccucagccacgggcaccgugugcaccgggaucggccuccagcgggccucggggcucccuggagcagccucgggaaacagcccggcaagguuggccugggcacucuccagcgugcggucaaaguccgugcugcggauguacaccuggagcgggguggagagagggcacgcggggggucgugguuggggacagaggucagcugucguggcaaaucagaagccucagauucacuuuggaguaggggucagacacugagaaucauguggccuucgaaguuggaaguugggaucaaggguccagaggcuaaugucaggagcaguugggcuggacguccuaagcuggacagccauguuggauuuagggggucaauugagucaaugagggucaaaaaggaagaucagaaucaguagaggcuggagguuagaggucaaguuuaggagggcagcuuggaggacuuggagucagaguucaauacauguucuucagagguuaggaggacugucuguagcugggggaugucagaagacauaggaggagacagaaaagguaggucagaauugauaaagcguagagguuaaagguuagaggucaagagggcaaguuacgucaacaagggucaaagaucgaaaucaaguuuggggucaaaugucagaggccagaggucugacuggagucaaugggacuuagaaaacagagauggaggccagaaaauaaagucagaguugauggaggucagaggucgagaugugacagguugagauggggucagaagucaguguggguuagucaguguaucgggggucagagauuagagguagagggcaagucagguugauggaggucaaaggccagagguggaggcccaaagagagcguuguagucaguggaggucacaggugggaggucagggggccaggugggggucacuauggcccuaccuccucccgccgguacuccggacucaggaaggccucguagcggcuccucaggaagcggcccagcuccagcugcuggcggacccccuccuggggacagaacagccucagccuaccacuccccaccccucccacccuugcccucaccgccuacccgcuucucaccguggucagcuggcccaggccucguggccacaggguggaggccaccuccuuguguggguccaugggguaggaggccagcggggcccggucgccauggcggaauaccuggggacaggacuggucagggcuagcccugggggagcuaagggcaggccggggugggggcgccucaccagagccacgaacaccagggguccuucuggcagggcccgggguggcagcaccagcagcagcagcagcaggagagguccagcaggguggccccaaaaccccaggccggccauu

SEQ ID NO: 15149 - RNA, 7911 nt, Homo sapiens
caaagagcagcggcugcccaggccuugugcagcgggcagcgagcagcccagggagccaggccccagacaccgcacucagggccauggccgacaggggcccguggagggugggcguggugggcuauggccgccucggugagucccugaccauccuuggccuccuuccccaaaccccuuccuaaagcucccaagacucucugcccuccacaaacacuuuuuucucucucuaucugccccuggcugugucucugggucugcccacugcacccccaccccaggucucuguccucuccgucucugucucccuucucucugggccucuguccaccccacugugucucugcccugcccccaucucugucucccuaccccgcaaucugagucuguccccaccuccucucucucugggucucuguccccaccuccucucucucugggucucugucccccucucucuggaucucuagcccucuccuuucccucuccccaggacagucccucgucucccgccucuuggcucagggaccagaacuuggccuagaacuuguuuuugucuggaaucgugacccaggacgaauggcagggagcgugcccccuucccugcagcuccagaaccuugcugcccuuggggaaaggucagugaccuugccaugggagaguggagcucccugaagcuccuguccuggcucucuuagccacugugugaucucagggguucccugacccucucugggccuugguucaagcaaaugugaaacaggacgaacccauucaucucauuucgccucccaggucagggagaagaagggcagcccucaguagacucggagggaaccuuggggagaagaggccuaauaccucuccaagacccuccgcccucuuuccccucucccaggcgcccugaucugguuguggaaguggcccaucccaaaauaauccaugaaucuggggcacaaauccugcgccaugccaaucuccugguaagccccaccccaaccauuuacgcagagcccugccccuucugucuuggucucaccccacccugaaguggauauccuucccugaccucaacccuccccuccuucauccaccccagguggggucccccucagcucuaagugaccagaccacagagcggcagcucuuggaggccucacagcacugggaccacgccguguuuguggcccgaggggcccuguggggcgcugaggacaucaggagauuggaugcagcugggggccuccgggugaggccugcugggcuccccaggaaccaggggaggccugcaaagaccccacucccccuaacccgggcucuugcuuccagagccuucgugucaccauggccacacaccccgauggcuuccggcuugagggaccccuggcugcagcccacagcccugggccuugcacugugcucuacgaaggcccuguccgugggcucugccccuuugccccgcgaaauuccaacaccauggcggcggcugcccuggcugcccccagccugggcuucgauggggugauuggggugcucguggcugauaccaggugagcagagcuaagcaggguguugggcugaguccaggcucuccagacugacugccccucuugucccagccucacggacaugcacgugguggauguagagcugagcggaccccggggccccacgggccgaagcuuugcugugcacacccgcagagagaacccugccgagccaggcgcggucaccggcuccgccaccgucacggccuucuggcagagccuccugggugcggccaggccccucucccccggcccugggcuccuguguucugcagagcuugggggucccgggcucucacuaguucugcaguucugguucuguauuuguugaccuuucuuucuuucugaccuuuauuuccuuaaccucucuccaugacuuugaauccuggcacuguagaugucuccauuugugcccgccucugaucgagacucucucugucucuguccacccccagggcucugucccgcucucuccgggucuuccuccaccgccccccugcccuguccccuccucccaccacugccucccccaggcgucugucuccucaucucuccucugucucauucgcucauuccccucuccccgcagccugcugccagcuccccuccaggccggggauccaucucugcugagaagccuccucccucccgagacaagaucaucugccuggccucucaccaccaccaucccaccccugcccugccccacuuccccagggucucccuucugacucaguaaagaucaccgcugccuccccccgcaccgccuggcgucucugaucccuuucccuugugugacgucacgcugcgucugcgcaccgcgcaugacgccaucgccgggggcgagcacccaugagagcgcggcgccaggaagcuaucgcgagagccuaccuacuaaguuuccuagaaucucugagcaguagugggcgcggccguaugcgaaagaagggccucugaggcgcacuuccgggaccugccgcggagcccgacggaaguuguagugcggcauuuccuaggcccgacggccgacuucagggccacgcggcccgggcguuccguguggagcaggagucccgcggggccccacgggagucguaguccggcgcgcggggaucaccgggagcuguaguccgucccgccugcccagucagcgcgguguugcccgccccgcacucggagcccagagccgccgcccaggaaggggaugcggaaaccccuggcucgguggagcggagaggcaggcggggugaggggcguugccaggcaaagggcgagcgccguggcuggggugcgggucggcgaagggcuccauuccuugguguccggggagggggccugguugcugggugauaggaagaggaacuccuguugcuuagugacuggggagggggccccguugccaggugacaagagcagagagccucgcugcuacaugaccggggaaggggagucuucuguugcuaggagaccagaggggacccuaucaccuagagacaggggaggaggauucucuauugcuaggugcucggaggacagacuuuguuaccuagugcgguggggagggggcuuuguugcuagguaaccacagagcgcccugguuaccuagggacggggaggcagguuccucuguugcuaggugaccaugauagggacccuuuuacuuagagaccuggugagggugguuuucuguugcuaggggagcagaagagacagcguuuuucguaggaauaggaauaagggauggagggacgugugcugccaggagacugccagggagcggggucaggggcccagugucuuccugggcugcuccgagucccagcucaaucaauggcgaugccccaaaggccugcugggaggcuggaccucuagaucccgggccccugaggaccuucucccccucccaacccccagcaggagccgaggacggcaugucccaggccccgggagcacagccgagcccacccaccguguaccacgaacggcagcgccuggagcugugugcuguccacgcccucaacaacguucugcagcagcagcucuuuagccaggaggcugccgaugagaucugcaagaggugaccgucacccaccccagccccuggagcagcagagcucuggcggagugacccaccugggucucgccgccaggcaggcgcugagccuugggggcuuucuucugcuccgcgcucacuugccuaagcuagacgcugggacucuggggagauguugccuccugugccugucugucccuguggccucagccccagccagaccucaauccagugguucuuucuuuuuuuuuuuuuuuugagacugagucucacucuguugcccaggcuggagugcaguugcgcgaucucgcucacugcgagcucggccucccggguucaugccauucuccugccucagccucccgaguagcugggacuacaggcacccgccaccacgcccggcuaauuuuuuguauuuuuaguagagacgggguuucaccauguuagccgggauggucucaaucuccugaccucgugauccacccgccucggccucccaaagugcuaggauuacaggcgugagccacugcacccggcccagugguucuuucuuuagagacaaggucuggcuggucuugaacuccugagcuuaagugauccucccaccucagccuccccaguagcugggauuacaggcucacccagcuucaggcaucucuuaucugggcccugucacagcucuccaguccauccuaaacacgcccccgcccuacucagggcccuccucauagcggaggccgagccugccuccgcaucuucagcccucacggccccccucaaaccagacucuccacucccgugagcccuucugugcggccucugggcuuccagguacuucuuucugcccggcauggcuuccuucucugccagcauggaauguuccucuucacuauucacaauguccaacaucacucuuuggccgggcgcaguggcucacaccuguaaucccaacacuuugggaggcugaggcggguggaucacuugaggucaggaauuccagaccagccuggccaacagggcgaaaccccgucucuacuaaaaaauaaaaauaaauaaaaaauaaaauuagcugggcgugguggcacaugucuguagucccagcuacucuggaggcuaaggugggagaauugcuugaagcugggagacagagguuucagugagccgggcaacagagcaagacugucucaaaaaaaaaaaaaaaaaaaaucacuccuuuaccaucucucacucccuccucucuguccccaugucccuggccccagcucaggccugacccucuccugcccagccugcccauggccuccagucugucccugccuucaguccccacuugauccuagagagucuuucuacaccuggagauggcccugccuccccugccucuugcuccaagccuccuccggcucucggacaucuuaagagucccagccccucagacugauuauuaugguauuuagucaucuccucuaucauucgcaacaaggacccaucagcucuuucauacaaaagccaugcuggagacccugagaugacucagacacaagugccagccuaaggguggugagggaaacacacacacacacacacacacacacacacacacacacacacgagcguuuuccucccauguccugccugcccaggguccagauagggaacagaggugcagcuguucagaggcagggcccagagacaaguggugacaggcggaagagccuuccuaggcaggggaagagcuggaggaaagguuggcggggguggggcgggaggcggugggcaccggggauguggcuggggacaggggaccaggaaggagggugcugaggcucugaggugaggccaccagagccagaccacgcagggccuugugggacucuguccugggggaaaugaggcagcagagugggcugugagcaggggaggggugagggcaaccccgugggagaagcaagcaguguuaaaucagggugaugcgggcagcugucaucguugagguggcucaguucacugggggagcccagacagggccccgauccagccuggaggucaggaggcuccucucagaggacgugacaucugaggugggccuugaaggacagaggaagggacuggcggagggacagggacuuuguccaaggcauuggggagccaugggagagcugagagcaggagagggccagggccgugugggaauggacuggagggaggcuggaggcugcgggagaagacagagcccaucuggggccuuggggacagggcagagucagggcaggagagacaggacuuggggacagggcagagucagggcaggagagacaggacuuggggacagggcagaguuggggcaggagaggcaggacuuggggacagggcagagucggggcaggagaggcaggacuuggggacagggcagagucagggcaggagagacaggacuuggggacagggcagaauuggggcaggagaggcaggacuuggggguggaugaguuguggggucugaagcggggagagucaaaggcugaggcaacuuguggccccugggacccccauuuuguggggaggccuuuccagggguccccaccucagcucuggccacccccacuaccagguuggccccagacucccggcugaacccucaucgcagccuccugggcaccggcaacuaugaugucaaugugaucauggccgcucugcaggggcugggccuggccgccguguggugggacaggaggagguaggccccagagcagcacagcaugugcugggccgggcacagagggcacccuauagugugagccuguuggggggcagggaggggaauguggcugggggagguuggcaugaaugugggaagccuggcacugauggguugaaagggggagaucagguggucgaugggcugagaugcuggguggaugaugguuacugggugaaugcugaguaggccguuggauguguugggucagggggagugaagugauggguguuccugggcaaugggcagcagacaggaggcuggggaguuggguggaugaaugggaaguuuugauggccggcuggccaguggcugggcauguggcugguggaugagggguagaccaauggcaggggggucaagagugagugaggauugggggcauggcgaguccacuguugggugaauggcuggcugggugguggccggcugugugggugggugggugggugguggguggugaacaguagauggcuaguuggauggugauggugguugggugguugacggggagguggggcggguguauaugagggauggaagugaaugcauagaugggaggugagugugugaaucgucauugggaaguuggcugguggcugggaggcucaguggggugggcggaucaugcauggauccuggguggcugugugaggaguugguaaguugguggguggguggcuggacagacagggugauggugguuggugaagggccgaugugaguuggguggacgguggguggguggguggacggugggugggugggugggaggucugguuggguggccgcaugggugggagguuugagugggcaggugaacggaugagugucgggaaccaggguggcugauuaaggaacaccucugggugggcucaggaggcccucaccaccaccagccugggccccacauguucagcaacauuucaccggcgggcggagcaggcccugauggcaguguccccucccugcccacacaggccccugucccagcuggcccugccccagguacuggggcugauccugaaccugcccucgcccgugucgcuggggcugcugucacugccgcugcgccggcggcacuggguggcccugcgccagguggacggugucuacuacaaccuggacuccaagcugcgggcgcccgaggcccugggggaugaggacggagucaggugagccccacagaggcgauuccaagaccaggggccugaaaccccacuccccagacggaaugcccaggcuggccgagccucagucuccccauuucucccacccagggccuuccuggcggcugcgcuggcccagggccugugcgaggugcugcugguagugaccaaggagguggaggagaagggcagcuggcugcggacagacugaccauggcugaccaucggcgcccacagcgcagucccugcgcaucccccuccggcugcgcacacugcaugccugggaaaggccagcacuucauggacccuggggaggccccgcccccuccccacaccccugcuccccacugccgcugcugccucaauaaaucugcugauuugcugccug

SEQ ID NO: 15150 - RNA, 7911 nt, Homo sapiens
caggcagcaaaucagcagauuuauugaggcagcagcggcaguggggagcagggguguggggagggggcggggccuccccaggguccaugaagugcuggccuuucccaggcaugcagugugcgcagccggagggggaugcgcagggacugcgcugugggcgccgauggucagccauggucagucuguccgcagccagcugcccuucuccuccaccuccuuggucacuaccagcagcaccucgcacaggcccugggccagcgcagccgccaggaaggcccugggugggagaaauggggagacugaggcucggccagccugggcauuccgucuggggagugggguuucaggccccuggucuuggaaucgccucuguggggcucaccugacuccguccucaucccccagggccucgggcgcccgcagcuuggaguccagguuguaguagacaccguccaccuggcgcagggccacccagugccgccggcgcagcggcagugacagcagccccagcgacacgggcgagggcagguucaggaucagccccaguaccuggggcagggccagcugggacaggggccugugugggcagggaggggacacugccaucagggccugcuccgcccgccggugaaauguugcugaacauguggggcccaggcuggugguggugagggccuccugagcccacccagagguguuccuuaaucagccacccugguucccgacacucauccguucaccugcccacucaaaccucccacccaugcggccacccaaccagaccucccacccacccacccaccguccacccacccacccaccguccacccaacucacaucggcccuucaccaaccaccaucacccugucuguccagccacccacccaccaacuuaccaacuccucacacagccacccaggauccaugcaugauccgcccaccccacugagccucccagccaccagccaacuucccaaugacgauucacacacucaccucccaucuaugcauucacuuccaucccucauauacacccgccccaccuccccgucaaccacccaaccaccaucaccauccaacuagccaucuacuguucaccacccaccacccacccacccacccacacagccggccaccacccagccagccauucacccaacaguggacucgccaugcccccaauccucacucacucuugaccccccugccauuggucuaccccucauccaccagccacaugcccagccacuggccagccggccaucaaaacuucccauucauccacccaacuccccagccuccugucugcugcccauugcccaggaacacccaucacuucacucccccugacccaacacauccaacggccuacucagcauucacccaguaaccaucauccacccagcaucucagcccaucgaccaccugaucucccccuuucaacccaucagugccaggcuucccacauucaugccaaccucccccagccacauuccccucccugccccccaacaggcucacacuauagggugcccucugugcccggcccagcacaugcugugcugcucuggggccuaccuccuccugucccaccacacggcggccaggcccagccccugcagagcggccaugaucacauugacaucauaguugccggugcccaggaggcugcgaugaggguucagccgggagucuggggccaaccugguaguggggguggccagagcugagguggggaccccuggaaaggccuccccacaaaaugggggucccaggggccacaaguugccucagccuuugacucuccccgcuucagaccccacaacucauccacccccaaguccugccucuccugccccaauucugcccuguccccaaguccugucucuccugcccugacucugcccuguccccaaguccugccucuccugccccgacucugcccuguccccaaguccugccucuccugccccaacucugcccuguccccaaguccugucucuccugcccugacucugcccuguccccaaguccugucucuccugcccugacucugcccuguccccaaggccccagaugggcucugucuucucccgcagccuccagccucccuccaguccauucccacacggcccuggcccucuccugcucucagcucucccauggcuccccaaugccuuggacaaagucccugucccuccgccagucccuuccucuguccuucaaggcccaccucagaugucacguccucugagaggagccuccugaccuccaggcuggaucggggcccugucugggcucccccagugaacugagccaccucaacgaugacagcugcccgcaucacccugauuuaacacugcuugcuucucccacgggguugcccucaccccuccccugcucacagcccacucugcugccucauuucccccaggacagagucccacaaggcccugcguggucuggcucugguggccucaccucagagccucagcacccuccuuccugguccccuguccccagccacauccccggugcccaccgccucccgccccacccccgccaaccuuuccuccagcucuuccccugccuaggaaggcucuuccgccugucaccacuugucucugggcccugccucugaacagcugcaccucuguucccuaucuggacccugggcaggcaggacaugggaggaaaacgcucguguguguguguguguguguguguguguguguguguguguguuucccucaccacccuuaggcuggcacuugugucugagucaucucagggucuccagcauggcuuuuguaugaaagagcugauggguccuuguugcgaaugauagaggagaugacuaaauaccauaauaaucagucugaggggcugggacucuuaagauguccgagagccggaggaggcuuggagcaagaggcaggggaggcagggccaucuccagguguagaaagacucucuaggaucaaguggggacugaaggcagggacagacuggaggccaugggcaggcugggcaggagagggucaggccugagcuggggccagggacauggggacagagaggagggagugagagaugguaaaggagugauuuuuuuuuuuuuuuuuuuugagacagucuugcucuguugcccggcucacugaaaccucugucucccagcuucaagcaauucucccaccuuagccuccagaguagcugggacuacagacaugugccaccacgcccagcuaauuuuauuuuuuauuuauuuuuauuuuuuaguagagacgggguuucgcccuguuggccaggcuggucuggaauuccugaccucaagugauccacccgccucagccucccaaaguguugggauuacaggugugagccacugcgcccggccaaagagugauguuggacauugugaauagugaagaggaacauuccaugcuggcagagaaggaagccaugccgggcagaaagaaguaccuggaagcccagaggccgcacagaagggcucacgggaguggagagucugguuugaggggggccgugagggcugaagaugcggaggcaggcucggccuccgcuaugaggagggcccugaguagggcgggggcguguuuaggauggacuggagagcugugacagggcccagauaagagaugccugaagcugggugagccuguaaucccagcuacuggggaggcugaggugggaggaucacuuaagcucaggaguucaagaccagccagaccuugucucuaaagaaagaaccacugggccgggugcaguggcucacgccuguaauccuagcacuuugggaggccgaggcggguggaucacgaggucaggagauugagaccaucccggcuaacauggugaaaccccgucucuacuaaaaauacaaaaaauuagccgggcgugguggcgggugccuguagucccagcuacucgggaggcugaggcaggagaauggcaugaacccgggaggccgagcucgcagugagcgagaucgcgcaacugcacuccagccugggcaacagagugagacucagucucaaaaaaaaaaaaaaaagaaagaaccacuggauugaggucuggcuggggcugaggccacagggacagacaggcacaggaggcaacaucuccccagagucccagcgucuagcuuaggcaagugagcgcggagcagaagaaagcccccaaggcucagcgccugccuggcggcgagacccaggugggucacuccgccagagcucugcugcuccaggggcuggggugggugacggucaccucuugcagaucucaucggcagccuccuggcuaaagagcugcugcugcagaacguuguugagggcguggacagcacacagcuccaggcgcugccguucgugguacacggugggugggcucggcugugcucccggggccugggacaugccguccucggcuccugcuggggguugggagggggagaagguccucaggggcccgggaucuagagguccagccucccagcaggccuuuggggcaucgccauugauugagcugggacucggagcagcccaggaagacacugggccccugaccccgcucccuggcagucuccuggcagcacacgucccuccaucccuuauuccuauuccuacgaaaaacgcugucucuucugcuccccuagcaacagaaaaccacccucaccaggucucuaaguaaaagggucccuaucauggucaccuagcaacagaggaaccugccuccccgucccuagguaaccagggcgcucugugguuaccuagcaacaaagcccccuccccaccgcacuagguaacaaagucuguccuccgagcaccuagcaauagagaauccuccuccccugucucuaggugauaggguccccucuggucuccuagcaacagaagacuccccuuccccggucauguagcagcgaggcucucugcucuugucaccuggcaacggggcccccuccccagucacuaagcaacaggaguuccucuuccuaucacccagcaaccaggcccccuccccggacaccaaggaauggagcccuucgccgacccgcaccccagccacggcgcucgcccuuugccuggcaacgccccucaccccgccugccucuccgcuccaccgagccagggguuuccgcauccccuuccugggcggcggcucugggcuccgagugcggggcgggcaacaccgcgcugacugggcaggcgggacggacuacagcucccggugauccccgcgcgccggacuacgacucccguggggccccgcgggacuccugcuccacacggaacgcccgggccgcguggcccugaagucggccgucgggccuaggaaaugccgcacuacaacuuccgucgggcuccgcggcaggucccggaagugcgccucagaggcccuucuuucgcauacggccgcgcccacuacugcucagagauucuaggaaacuuaguagguaggcucucgcgauagcuuccuggcgccgcgcucucaugggugcucgcccccggcgauggcgucaugcgcggugcgcagacgcagcgugacgucacacaagggaaagggaucagagacgccaggcggugcggggggaggcagcggugaucuuuacugagucagaagggagacccuggggaaguggggcagggcaggggugggauggugguggugagaggccaggcagaugaucuugucucgggagggaggaggcuucucagcagagauggauccccggccuggaggggagcuggcagcaggcugcggggagaggggaaugagcgaaugagacagaggagagaugaggagacagacgccugggggaggcaguggugggaggaggggacagggcaggggggcgguggaggaagacccggagagagcgggacagagcccuggggguggacagagacagagagagucucgaucagaggcgggcacaaauggagacaucuacagugccaggauucaaagucauggagagagguuaaggaaauaaaggucagaaagaaagaaaggucaacaaauacagaaccagaacugcagaacuagugagagcccgggacccccaagcucugcagaacacaggagcccagggccgggggagaggggccuggccgcacccaggaggcucugccagaaggccgugacgguggcggagccggugaccgcgccuggcucggcaggguucucucugcgggugugcacagcaaagcuucggcccguggggccccgggguccgcucagcucuacauccaccacgugcauguccgugaggcugggacaagaggggcagucagucuggagagccuggacucagcccaacacccugcuuagcucugcucaccugguaucagccacgagcaccccaaucaccccaucgaagcccaggcugggggcagccagggcagccgccgccaugguguuggaauuucgcggggcaaaggggcagagcccacggacagggccuucguagagcacagugcaaggcccagggcugugggcugcagccaggggucccucaagccggaagccaucgggguguguggccauggugacacgaaggcucuggaagcaagagcccggguuagggggaguggggucuuugcaggccuccccugguuccuggggagcccagcaggccucacccggaggcccccagcugcauccaaucuccugauguccucagcgccccacagggccccucgggccacaaacacggcguggucccagugcugugaggccuccaagagcugccgcucuguggucuggucacuuagagcugagggggaccccaccugggguggaugaaggaggggaggguugaggucagggaaggauauccacuucaggguggggugagaccaagacagaaggggcagggcucugcguaaaugguugggguggggcuuaccaggagauuggcauggcgcaggauuugugccccagauucauggauuauuuugggaugggccacuuccacaaccagaucagggcgccugggagaggggaaagagggcggagggucuuggagagguauuaggccucuucuccccaagguucccuccgagucuacugagggcugcccuucuucucccugaccugggaggcgaaaugagaugaauggguucguccuguuucacauuugcuugaaccaaggcccagagagggucagggaaccccugagaucacacaguggcuaagagagccaggacaggagcuucagggagcuccacucucccauggcaaggucacugaccuuuccccaagggcagcaagguucuggagcugcagggaagggggcacgcucccugccauucguccugggucacgauuccagacaaaaacaaguucuaggccaaguucuggucccugagccaagaggcgggagacgagggacuguccuggggagagggaaaggagagggcuagagauccagagagagggggacagagacccagagagagaggagguggggacagagacccagagagagaggagguggggacagacucagauugcgggguagggagacagagaugggggcagggcagagacacagugggguggacagaggcccagagagaagggagacagagacggagaggacagagaccuggggugggggugcagugggcagacccagagacacagccaggggcagauagagagagaaaaaaguguuuguggagggcagagagucuugggagcuuuaggaagggguuuggggaaggaggccaaggauggucagggacucaccgaggcggccauagcccaccacgcccacccuccacgggccccugucggccauggcccugagugcggugucuggggccuggcucccugggcugcucgcugcccgcugcacaaggccugggcagccgcugcucuuug

SEQ ID NO: 15151 - RNA, 983 nt, Homo sapiens
cuuuccuuucccuccucucuggaccugucuccucuccuggcucucucuccuucaagcucucacucccacuggccucccucccgggagccccgucuccuccgucuccagguggccccugcaucccugccuggugggccuuugccucccucuccuguuccugccuugccugcucccagguuuccagguccugaccaggaggcaggaguccauaccgaggcccaaacaggcuagcccugagcagggcccccaagccugaggcccaggaguggacagaccuuugugacacccauucucucuuccuuuuccaucuguccggaacucuggacacugccuggaggaaucaggccugccguaggcccaggaaggcggaaacaaagacgacgcucagagacaggaagcaacuugccuaaagauacacagcacguaaggagcagggacaggacuggguggggccccugggguuggccaggagugggcuccugaaucugccgaucccuggccuccuaucugagcucagugagcagcggaugacgccuuucugcuccauuccgcucccuucccaacucuuccucugacaacaugaagcaccucagcacugaggggaccucaccugaauuccauuucagaaaugagaaaauuggugcccaauguuucugaagaccagcaacugcuaagacagagacuucgagggaacccgaccuugccugaaggaccaacagcgcccccugcaggacacuucccuccauugagagaagccacaggcgccggccugaggcauucugagugcguggaauccucuauuaccaccuccuggcaaagaacggagcugcaacccagcuauaugagacaccgagaaugaucucaacaaaaaggaacagugaccagaaugccugggggaggaacaggggauacuggguggaaggaggggagagggagaaguuguaauauuuuguaaaaaugaacauuuuuacuccuaaucaaua

SEQ ID NO: 15152 - RNA, 983 nt, Homo sapiens
uauugauuaggaguaaaaauguucauuuuuacaaaauauuacaacuucucccucuccccuccuuccacccaguauccccuguuccucccccaggcauucuggucacuguuccuuuuuguugagaucauucucggugucucauauagcuggguugcagcuccguucuuugccaggaggugguaauagaggauuccacgcacucagaaugccucaggccggcgccuguggcuucucucaauggagggaaguguccugcagggggcgcuguugguccuucaggcaaggucggguucccucgaagucucugucuuagcaguugcuggucuucagaaacauugggcaccaauuuucucauuucugaaauggaauucaggugagguccccucagugcugaggugcuucauguugucagaggaagaguugggaagggagcggaauggagcagaaaggcgucauccgcugcucacugagcucagauaggaggccagggaucggcagauucaggagcccacuccuggccaaccccaggggccccacccaguccugucccugcuccuuacgugcuguguaucuuuaggcaaguugcuuccugucucugagcgucgucuuuguuuccgccuuccugggccuacggcaggccugauuccuccaggcaguguccagaguuccggacagauggaaaaggaagagagaaugggugucacaaaggucuguccacuccugggccucaggcuugggggcccugcucagggcuagccuguuugggccucgguauggacuccugccuccuggucaggaccuggaaaccugggagcaggcaaggcaggaacaggagagggaggcaaaggcccaccaggcagggaugcaggggccaccuggagacggaggagacggggcucccgggagggaggccagugggagugagagcuugaaggagagagagccaggagaggagacagguccagagaggagggaaaggaaag

SEQ ID NO: 15153 - RNA, 2803 nt, Homo sapiens
ggagucaagaaggacagacacuccaggguccagacaacacuguuuuguucucagcgaaaacuccagaaagaacacaguccugggagguuggggauuggggucaggacuccaccaccaauugucuuggcagguaggggacaggucucacugcggcacugcaggaaaacgagaaagcgggugagccaggcccgggcacgccuccuccugaagccccaggaggaggagcugcauccacaugaccagcagggggacaggaugacggucaccaucccgccccauccuaggccacuguggcuggacaacccagagucacagugcuccugauuacugguauuuuggaucccagauggggacauucugagcugcuggcuguacgcggucacuggaauccugaggcugggauuuuucugagcugauuuaauaguuaaucagggagacagcagaguaucagaaauugggugggcuuggaagggcagugaucugggguguuuuuguuugguuuuugagacagagucucacucuguugcaccaggcuggagugcaguggugccaucucagcucacugcagccucggccucccugguucaagugauccuccugccccagccccccagguagcugggacaacaggcaugugccaccaggcccggcuaaauuuuuuuguauuuuuaguagagacaggguuucgccauguugcccaggcuggucuugaacuccugggcucaagcaacucgccugccuuggccucccaaugugcugggauuacaggcgagagccaccgugcuuggcuagaaaguguccucucugagccuuuguuaaggguccccagccacccugucugcugggcuguccucagagccagggaagucagaggucagaagucaccauccgggagggacucuggaaguccacauugaugucauccugcucugagggacacgguuaguggccuccucgcugagccuugacuggcagacaucugaugggccggagcccaggguaaaggagcgggggaauuguguuccaggaagagggaagagcaugugccaagucccuguggcaggaaagccuggccaguguaacugccaacagcccgguguggcugggacaucaugugggaagaaccgggguggacacaccaccgugaacaccaggcggaggggcgcuggggcgguggggaguccccagcgggcugggaucagggcuggggcagagcagcucuggauagagagagcucucuggggccagaguccaagggugaaaguggcuggcaggagggagagacuggagacggaggcggcuggaaauggaauaugggaggaagaggauguagcuuucgcuggggcuggagcugugggaccgagaugagggacggggcagggagaggcaggggcaggugggugggagcauggggacaggcuauggagggaggcacucuugggagcucccgccaccccuggucauccguguuauccauauuugcucucacucugucaacccaucugccuacgggggcccagguacacuggaggccuuggggacguuuccuaagcccuucucacucagccuuccucuuccuuguccuucaacuccuuuggaaaaaucugacuccuucccaagcugggucaggggcuccccaaccccaacuccuaggaugcccugugcugccuucaggacagcagcuucccaguccuccucccagagggcuggucucacucgucuccagaucucagcggugcucagcccggggccaccggccaggcuggcacagggcccgagcaagggucagccaguguuggggauggccacgcccucaccucggaccuccagcuugcacucagccagcgccucgcccagcucguugacggcccggcagguguaagucccagcgucgaagggcgaggggcgacggauguucagcgucaggacuccuugguaauugguuaucaggaacuugggaucuucacggauuuccaucuuguucuucauccagaccaccuucggcuguugagagucaagggagaggaggccaacuuagagagagacccugggcaaugaugacaaaauggggcucaggaagccgaucuggguucuaggcucugccacccucuugccagauguucuuggacgagucacuucucccugacccucagucuccucuuauguaaaagcagguugauaaucccacuucacaggguaacgguggggucuucccauugcucucaggacaaagagcucacuguuuguaguggcccacagggucccacacucuuugacccccauuacuucucugcuccagccaaacaggcuaccucacuguccuucaaacagaccagacaggcacccaccucaggacgcuggcacuggcuguucccucuuccauagugcccuucccuuuuuuuuuuuuuuuugagacagaaucucgcuuugucucccaggcuggagugcaguggcgugaucuuggcucacuguaaccuccaccucccggguuuaagcaauuauccugccucagcuucccaagugguugggauuagaggcgccugccaccaugccuggcuaguuuuuguauuuuuaguagagaugggguuucaccauguuggccaggcuggucucaaacuccugaccucaggugaucugcccgccucggccucccaaagugcugggauuacaggugugagccaccgugucuggcccagcccuucauaauuuuauauuauuuaugugacucugggcaaaugucagucucccccaacauacaggaaauuucuuguucgaaucacccaggucauugaaagccucugaa

SEQ ID NO: 15154 - RNA, 12110 nt, Homo sapiens
cagcccgcccggcaccaccaugcucgcccuggaggcugcacaguaagugagggcccccaaaccugcacccgggguccccaccugcacugccccucuguggggccucacccaugggcagugguuucucugcuccucacggccggugggugggaguggaggggagggguccacccugucucuugccccuucugguucuguucccucuucacuucggacucuccauccccccaguuccuaucuuuccugguccccaaagaucucauuuccccagaacacuugcuagcgugcccuccugcgggcguccuccguggcucucacucuguccauccuccugucuccccgaguucccguaucuguucgcucuguaucuggcaucucccagcucucaacauucugccuguugcucucugucucucugccugucucugugucucugucuccaguucucgcucucccugccuuuuggucuccuucugccucacccucacucucagugccuccaucuggggcuccaggaauccuccccgccucugugcgugaaugucccuuugcacaccuuucucugugucccaccucuccuugagccuccucaucugagucuucuccgggcuucccccucucuacccagacaucucuccauccuucuccucugguccaagcuggacucaacugacucgccaccaaggccgcacuugacccaggcccccucuccauccccacaccuccuuuccgggacuuucucucccucacuuucccugccccuccccaccagggugucuaugcaaauucuggggaggagggggacauuugccucccccccaccccccacuuccugucccagcaggggguagugggggaguccggugaaugugguggggcuggucccucacacagggcugcgguggucacagcugcugccgccuccccaucagcccccaaccacuuugagauucagguggcuggaggcagccucagcaugccccugugucucucccccuccaggcucgacgggccacacuucagcugucuggugaguuggggccccugggggccagggagggguggcccacagugaccucccucagagaagucauuugcuuccugccucaguuuccccucccaccucuuccugucacuuuguuucugagcucccccuugguaucuccugcuaccccgcauccguauuuuugaugucucucucccccucucaggcuugaauccacuuccuuguggcuuuguaucucucucugcccaucccauauucagacaauguauuuucauguuccuuuccuucuuuuuguucguauuuuuaaaaauuguguucucuaacaguucagauacggaauacuauacccaacacccuugaacccacaauccagucugaguaaucaaaucuuacugaugugguugaaagaaagccccuguuuaugccccuccacauucacaccccagccauguuuuuuuuguuuguuuuuguuuguuuguuuuuuaauugaaguguaacuaacaagucaguaaagugacaaaucuuguguuuuugcauuaucuauacaccguguagccacaagccagaucaagauaccgaacauuucaaucucugaaauauuccuuccugucccuucucagucaauaccuuucucugauauuuuccgccaccaauuuguaauuuguuuugccugcucuuuuuuuuguuuugcuuuuugagaaggagucucgcucugucacccaggcuggagugcaguggcagcgucuuggcucacugcaagcuccaccucccggguucaagcaauucuccugccucagccucccaaguagcugggauuacaggcaugugccaccaugcccagcuaauuuuuguauuuuuaguagaggcaggguuucaccauguuauccgggcugguuucaaacuccugagcucaagugauccucccaccucagccucccaaauugcugggauuacaggcgugagccaccgcacccagcugccugcuuuugaacuuuauguaaagugagucauacagcaugucccuuuuggggucuggcuucccucacucaacaugaagugugugucaguguuuguccuuuuuccuugcuguauaguacucuaucuaugaucagcccacaccacagucuguuuaucccuucuucuguugaugacaccugggcuguuuccaguuggagacucauaauaaagcugcugggaugauucuggaacaaggcuauuuugugcacauccauuuucaguucucuugauuaaaugccaaggagugagacugccagguccuaggcaugguguggaucuagcuuuaguuuuuccuagacucgaguucuugaagcaacaacacaugauucauggggcgaaucaacauauggagauuuauuuauuuauuuauuuauugagacagaguuuugcucugucgccgggcuggaguacaguggugcgaucucggcucacugcaaccucagccuccuggguucaagcgauucuccugccucagccucccaaguagcugggacuacaggugcgcaccaccaugccuggcuaauuuuuguauuuuuaguagagacgggguuucaccauguuggccaggcugguaucgaucuccugaccucaugaucugccugccuuggccuuccaaagugcugggauuacaggcaugagccaccaugcccggccuauuuauuuuucgagacagagucucacucugucacccaggcuggagugcaguggcgcgaucucagcucacugcaaccuccaccucccagguucaagcgauucuccugccucggccuccagaguagcugggauuacagacaucugccaccaggcccagcuaauuuuuguauuuucaguagagaugggguuuccccauguugugcaggcuggucucgaacuccugaccucaggugauucacuggccucagccucccaaagugcuaggauuacaggcgugcgccaccacgccuagcuaauuuuuguauuuuuaguagagacgggauuucaccauguuggcuagacuggucuugaacuccugaccucaggugaucugcccgccucggccccccaaaguguugggaugacaggcgugagccaccacgccuggccuggagguguauuuaaaaagcauugaccccugccucuguuaagugaaacacuuccauuuccccuugcccuucaccuccggagcccccaggcaggcaaggcugggggaguucuuccaccccuucuccaggcgcccugauucgcugacugugugccagugaggggccaggguucuugggagcccaccgucuuagcaggagcuggcugcugugugccccuauuggguugugucucuacucucuguaucucugucucuuugucccugucucugaugccuagucucuguguuucuuuguugcucuaaucucuccagcauccccucuucucucccaugucuguguuggagucuccccaaggguccaggguggggguugggaguccccaaggccugggaugaccccucuucccuccugcaccccguaucaguacccagauggcgucuucuaugaccuggacagcugcaagcauuccagcuacccugauucagagggggcuccuggugagugaccccagcccugugcccuuccugccuuggggcccauuucacagauaggggagcugaggcccaggggaggucauuuccuagcacaacaggauaaagguggcccgggccuauagcccuccuccccuuuccucuccuacccauccgcuccuccaugcaaauccuggggucagagauuugcacagccuacaauggccucucugugcugggggcuucgacugcgaggaggccuccgugagacaucccagcuucugacucagugcccuucccccagacucccugugggacuggacuguggccccaccugucccagccacccccuaugaagccuucgacccggcagcagccgcuuuuagccacccccaggcugcccagcucugcuacgaaccccccaccuacagcccugcagggaaccucgaacuggcccccagccuggaggccccggggccuggccucccugcauaccccacggagaacuucgcuagccaggugagugguaaggggacaguuaaaaucaagcccaaaccaggugugguggugcacgccuguaaucccagcugcuugagaggcugaggugggaggaggauugcuugagcccagaaggucgaggcaauccacugcacuccagucugggcaacagagcaagacccugucucaaaaaaaaaaaaaaaaaagaaaaagaaaagaaaacucaagcucagucauuugguugagguuugcugggugccgggcacugcauugagacugcacauaguaagcccugcagcggccucccagguuacguuccguuguugccccucugaacaagugagucaagagagguagugacaggaagccagggacagggcagacucgcauuaccuguguugggccggcuuugaggagguaccucagguguccccuggccacagcguggugaucugaacaaaggccaaaaucuaggcugucaacaaagagggagaccagagccaggagggccaccgccuuggccugagaggaggaaguggagggagacaaggggucccuggacaugcaggugacccugaccuuccgcagacccugguucccccggcauaugccccguaccccagcccugugcuaucagaggaggaagacuuaccguuggacagcccugcccuggaggucucggacagcgagucggaugaggcccucguggcuggccccgaggggaagggauccgaggcagguaugcgggaguggcuggggugggggagaugccagcuggagauggugggggggcugagagcaccauggcuuccugggccucuacauauacuccagcacucugggcagcucccagauccgcaccaccugcuggcugugugaccuuggguaagugccucuaccucucugugcccagguuuccugucugugcgauggggauggaggugauagugucuacccuccugaggucguuggggggacuaaaugggauaguaaguguaaaugggacagcagugccaggcacagagugagcacuucaauaagucaaccucuucaccaucauucccgacaccacagcaacagaaaugauaaugcuaucaacccccaacgguucaacccuugcccccugcccgugugcccaacauccuuuaugcucaaccccaagaaagcugagaucguuccuuccuuucugugucugggccucgguuucucgucuguaaagugggcaucacugucauccuccccaucucacgggguuaugauggagauucaaugagcucauaacuguaaagugccuugugaagcaccuggcacuacaugcuccacggugcauuguaaaaaucaacacacaggcugggugugguggcucacgccuguaaucccagcacuuugggaggcugaggcggucagaucaacugaggucaggaguucgagaccagccuggccaacauggcaaaaccccgucucuacuaaaaacacaaaaauuaggcugggcaugguggcucaugccuuuaaucccagcacuuugagaggcugaggaggauggaucacgaggucaagagaucgagaccauccuggccaacauggugaaaccucacauuuacuaaaaauacaaaaauuagcuaggcgugguggugugcaccuguagucccagcuacucgggaggcugaggcagaagaaucgcuugaacccaggaggcagagguugcaguaagccgagaucuugccacugcaguccagccuggcgacagaguaagacucugucuuaaaaaaaaagaaaaaagaaagaaaaaaaaauuaauggggcauggugguacaugccuguaaucccagcuacucaggaggcugaggcaggagaguugcuggaacccaggaggcaaagguugcagugagcugagauugcaccacuggacuccagccugggugacagagcaagacuccgucucaaaaacaaacaaacaaaaccacagccucauuuaaaaaauuuuaauuaauuaauuaauuuauuuuuugagacagagucucgcucuguuacccaggcuggagugcaguggcacgaucucggcccacugcaaccuccaccuucuggguucaagcaauccuccugccucagccuccgcaguagcugggaucacaggcacccacaccauacccagcuauuuuuuguauuuuuaguagagaugggguuucaccaucuggccaggcuggucucaaacuccugaccucaggugauccgcccgucucggccucacaaagugcugggauuacaggcgugagccacugugcccagccacacagccucauuuguggcugagagacuucagcucagagagguuaauuaagucaccuauuuuaacuuaggacauuuaagauggagaggaucucuccaaugacuaggaaagacacaagauggaaauaaagauuuuauuuauuuuuauucauuuauuugagacggucuccaucugucacccaggcugaagcgcaguggcgcaaucucggcucacuacugccucaaacuccugggcucaaucgauccuccugccucagccuccugaguagcuaggaccacaggcguacaccaccacaccugacuaauuuuuaaaauuuuuguagaggugaggucucgcuauguugcccaggcugaacucccaacuccugagccuaugugcuccucccaccucagccucccaaagugcugaaguuacaggcaugagccaccacacccagccagaaauaaauuauuuuauggcuuauagguccuggggcauacauggcacgccuggaggccacacacaccaggucagggagcgcaggcagggagggagagagagagggaccaguggacugacgccuuuauuggguccaaggcgucggccaaacagguuuccugaggggguuuuaauugguggguucaggccaggcacaguggcucaugccuauaaucccagcacuuugggaggcugaggcugguagaucaccuaacgucaggaguucaagaccagccuagccaacauggugaaaccccgucucuacuaaaaauacaaaaauuagcugggccugguggugcacgccuguaaucccagcuacuugggaggcugaggcaggagaaucgcuugaauccaggaggcagaguuugcagugagcugagaucaugccacugcacuccagccugggcaacagagcaagacuccagcucaaaauaaauaaauaaauaaauacuugguggguugaaagcaagcaggaucaaguuccaggaggucacgcugugccugagagggggucacugaggcaucugcacaguccaugcagggccgucaaguaggcuguccauggcucucccacagggagguggucaccaggagucaguugcauaagagagauaucugggucagccacacugaggaacucggggagggagauguagaacugccaaggaggacagcccugcuuccagcaugagaauguccaacuuuuauuuaguuuuauuuuauuuuauuuugagagggaguuucgcucuuguugcccaggcugagugcaaugauaugauuucagcucacugcaaccucugccuccugggcuaaagugauucuccugccucagccucccaaguagcugggauuacaggcaugagccaagcacacccagcuaauuuuuguauuuuuaguagaaaccggguuucaucauguuggccaggcuugucucgaacuccugaccucaagugaucugcccaccuuggccucccaaagugcugggaucacaggcauggcccaccgcgcccagccuccaacuuauacuuucgaugaaugccgaggcagccuaaaauuauaagaauucaauccgggugcaguggcucacaccuguaaucccagcauuuugggaggccgaggugggaggaucaccugaggccaggaguucaagaccagccugggcaacauaguaagacaccaucucuacaaaaaauaaaacaauuagcuaggcaugauggugcauacuuguagucccagcuacuggggaggcuggggcaggaggauugcuuaggcccaggaggucgaggcugcagugagcugugauugcuccucugcacuccauccugggugacagaacgagacccugccuugaaaaaaaagaaauuaagaugucacuacgucaccaccccaaggucacacugcuguaaaauggcagagaugggauucuuguagccagugcccugcuuugaaacucccaguuauuggccgggcgcaguggcucaugccuguaaucccagcacuuugggaggucgaggugggcggaucaccugaggccaggaguucgagaccagccuggccaacauggcgaaaccccgucucuacuaaaaauauaaaaauaagccgggcaugguggcagacgucuguagucccagguacucgggaggcugaggcagcagaauugcucgaacccaggaggcagaggcugcaguaagccgagauugcgccauugcacuccagccugggccgcagagcaagaccccgucucaaaaacaaacuaaacccuaggagcccaggagucaggugcccuggccucucccgggacccugucccgcuuugggcugagaggcugggagaccaggagcuggagagauagccaggccaaugcaacugccuccagaucuguucgccucuccguuauaauccuuuaagcggcgcugucaacccauuucacagauucuuucauccacuagcucaacaaauauggaauauuacgugcuggccgcagggcggaaggcaggacagauguaaaucucgaaaauuaaagcacagaacgcggagggggccuggggcugacagcuucgggcagggggaguggcuugcccccccccccccccguggugaggggcgcagagccagguguauguaacagccacuucccucaccccacuuuucagauccaggagauggaggccgggguggaagucucggaggaggguggauggggaaggcggggccuuagggaccccucaccuaacgcgugcccccgaccccaccgcagggacucgcaagaagcugcgccuguaccaguuccugcuggggcuacugacgcgcggggacaugcgugagugcgugugguggguggagccaggcgccggcgucuuccaguucuccuccaagcacaaggaacuccuggcgcgccgcuggggccagcagaaggggaaccgcaagcgcaugaccuaccagaagcuggcgcgcgcccuccgaaacuacgccaagaccggcgagauccgcaaggucaagcgcaagcucaccuaccaguucgacagcgcgcugcugccugcaguccgccgggccugagcacacccgaggcucccaccugcggagccgcugggggaccucacgucccagccaggaucccccuggaagaaaaagggcguccccacacucuaggugauaggacuuacgcauccccaccuuuugggguaaggggagugcugcccugccauaauccccaagcccagcccgggccugucugggauuccccacuugugccugggguccucugggauuucuuugucauguacagacucccugggauccucauguuuugggugacaggaccuauggaccacuauacucggggaggcaggguagcaguucuuccagaaucccaagagcuucucugggauuuucuugugauaucugauuccccagugaggccugggacguuuuuaagaucgcugugugucuguaaacccugaaucucaucuggggugggggcccugcuggcaacccugagcccuguccaagguucccucuugucagaucugagauuuccuaguuaugucuggggcccucugggagcuguuaucaucucagaucucuucgcccaucuauggcuguguugucacaucuguccccucauuuuugagaucccccaauucucuggaacuauucugcugccccuuuuuaugugucuggaguuccccaaucacaucuagggcuccuccaagauccuuuugucaugucugaaaucacucuugagaggucugggguggaggauggggagucagugaaaugugucaugucugggcccugucagggacacccuuguuauaucugggauccuccaaucacaucugagaccuccuaggcucuccaucugauaugcccuuucagggaccccacaaagacugaguucucauggggauccuacccuuccuagugccacucccuauggccaugcugaagaccacucuggccacgcgacugauuuugggugaucauggcagcuccccacccaugucauuucuaaccagaagucucaaggucgucaccccccugccccccaaccgaggccccggucgcuggugguggucucuuuagugcacuguagcacuuggugguggaggugugagggauccacauuaacagcaggccaucagcugggcaauggcucacaccuguaaucccagcacuuugggaggcgaggcagggggaauggcuugaacccaggcauucaagaccagccugggcaacauaaugagaccucgucucuacaaaacauaacaaaaacaauuagccgagcgugggggugaacaccuguggucccagcugcucaggaggcugaggugggaggaucucuugagcccaggaaguaggaggcuguagugagcuguaaucgugccacugcacuccagccugggcgacagagugagacaccgucuuaaaaacaaaaacaaggccgggcacgguggcucaugccuguugucccagcacuuugggaggccgaggcaggcggaucacgaggucgagagaucgagaccauccuggccaacauggugaaacccugucucuacuaaaaauacagaaauuagcugggcgugguggcacgugccuguagucccagcuacucgggaggcugaggcaagagaaucgcuugaacgugggaggcagagguugcagugagccuagauugugccacugcacuccagccugggggacagagcgagacuccgucugaaaauaaaaacaacaaaaacagcagaccauucaaaauagggagacuuugcauaauccagauuucugccuucacuuaaaacuuuggacggucuggagagagucggccaguuuucggugggggguggggagcuggaacaggacaguagccuuuccuaaugaggcauuuguucuccaaucugccccagucgcugccaucccuggcuaucucacccuagcagcuucucaagccuguuggcuuuagaccacuguauaaacccagcuggaacugaagccuggguggacuauggagcccugguugggacccccagggagucaaaggcugcgggccaagaggccagagguccuugagccugggugggcagguggaucuagggugcaugacuugcugcuucccaaccuuaguuugucccuucugugaaaaagggagagaaggaggaggaagaucucaaaaagacuuuccagcccagugcgguggcucacgccuguaaucccagcacuuugggaggccgaugcagguggaucaccugagguaggaguucaagaccagccugaccaacauagugaagccccuucucuacuaaaaauacaaaauuagcugggcgugguggcaugugccuguacucccagcuacuugggaggcugaggcaggagaaucgcuugaaccugggaggcggagguuguagugagcugagaucacaccacugcacaccagccugggcgacaagagcgaaacuccgucucaaaaaaaaaaaacuguugcagccccguugagccuuugacaccgccugaaauccaccccacucccaggaggaggaggaggaaggaaugccaaugaccuagagacacgagaaguccauguggaggcacacagcagcugauggcagagcccaggcugggaccugcccuuaagagaaugagugggaagggggagggaggaagggcagguaaaacguccuccccagggcccccugcaacggggaagguacuuuuuacaaaagcuaucauugucacccuaaauguggaauaaaauaagaugcaucgacguagacaaa

SEQ ID NO: 15155 - RNA, 6575 nt, Homo sapiens
uccgggcuggauuguauucauauuuuauuuuccuguuucuguuuuuaguuuuuauuaaauaaaagcagaggaagaggaaggcccuggucucccgggcuaggggggagagccauggguccuccccucccucuguucaaggugcacugcgugcugggcuugagguguaagcuggggagggagggcagccgggaagggucaguggucgggaccugcaacccuuucaccccuucuggaagacucgcugggcagggagggagccuccuggaccuggacuggggcuuaucccaagggaugagagccgauaggucuacaggcucggcccagggccccuuccacccuaggaagaggaaggggugccggcgucuaucugcuggaggguggucaggcaaggcuguggggcuggguggccagccccucacucguggacgucccagaucuccgacagcagaggcggcagcuucuuguccuggagccgcaaggcgaagaccugcuccgagugcacagagcucagcgugcgcaggcucaccagcuucaugagcaugcgcgggaagcgcagcugguccugagggaggaggcaggugggcgcuggcugagccccugcccugccaggcuuugggaggcccaccccaacagaaaggagggccccuccccgaccaggcgugggagccagcguggggcccgccucugugcuuggacuagaccuggcucccagucgagcaggguggggccugaggaaagacucugcggaggggagggcaguguggcuggcagaacccagccugaacggaccacgugggccgcgggacguaguuggcucugcgcagaggcucugcggggcccuaccugcggccucuugaugcgcguguaggacagcagcgccuccacguagggcugcugcaacgccuccacgcggcccggcuccugcacguugggccggucggccgagaagauguugauggcgaugagcagggcguacucagcgucguccaggcccagccgccgcauggcccgcgagaacucgaagaugggguugaugaacuccaccugcaggccugcggggcgggaggcagcccgugacucccucagcccgaaaccgugccccacauccuggacccuggcgcugcccacagucucuggggcugggaacacagcaguaauuacagcguucuugucauuucuguccaccugugccccgugcccaugagugcuggcauguaguaggugugccacacaugcugcccagugaaggaaugaaugagggugcauguuucuucaguauuuucuacuauccuaucaccacccucccuucccaccugggcgguggcugcagcuucccgagucccuauucuuguccccuucacaaaggcaaagggaagcuuuuaaaaccuaggucacaucgugcuggucccagcgcuggcuuccacugcucaagguaaagcccaaacucauucccaaaacugacuuguucauucagucaucaaaugucacugaguaccugccacgugccaggcuccagcacuuacauuugagagccuaggggaccggucauagacaaacacauuaggaagaggcccagccugucagagggcugugaguucaauggaaccaggcagugcagagaagugugaagggcccugcugagccaugguucuauuuuacacaaggcgggcagggaaggcugcgcucugggugacgcuggagcagugaccaauccgaaggagaugagggauugugagggugaccaacgucugcuguucccaugacuugggacgggggcuacccaggccaugagacuuucaguguuaaaacugggaagguccugggcaaacuaggaccaguuggucccccuaguucugggcagaggaaacuccaaguacacaggcccuuggcugcagcaugcuggaugggugccaguaagaggccagaguggcuggaacagggggagagggugagagcugagggcagagagugagcgaggccagguccuaaagggcuuugugggccacagagaggacucuagcucuucucccagugagacgggagccgcggaggguucugagcggaggagggaagugggcagccuuaagugcugacaggacccuucugccugugcugugagcagccccaucaggcagggguggaggcaggcggccccucaaggggacccuggcaguguuccagggugguggcagaggagcggcugggaagggguagggugggauucccgaccuccucuccaccccaucuccuugugcuccagcugccugggccucccuguaguuccuccaaaccaccagcucuccccaaccucagggccucugcaaucgccaaucuccucugccagaaacgcuucccugcagcccugcccugcuaagcucauacuaaaaggguuacugggaccgucucggguggugaaagggccggaguaagaggaaggggagagggugggguuuggacagaugucgggaaauacagagaggucccccagagauugugggacaaugagggagcgaggcccuggugcaugcucugcagcacuagcaaugcuccucccacccuuuuccuaggcagugccucucacugcccaggccuucuuccagaagcccacccacgcagguuagcgcucucagagggcaggaagcagugcuccccuagacaguaaagaaggcugcccgcuucacaauggaccgagcuccagcccgccucccuugggugagaccacguuuuggcgggggcggggaaugcuuuuccuaaugcccaccaagaugccugaugugguaacagggcuccucccaucucaacuuccacugcaacccaauguacagagucggcacucaauacaugcuuuuuuuaaaaaauagagacacggucuucucugucaccaggcuggaaugccgucgcacaaucacggcucacuauagccucaagcaaucugcccuccucagccucgaguggcugggacuauuggcgugcaccaccacacguggcacaugcacucuuaccucacucucaccuuggcucaacccucaccccaacuuuggagauaaagaaacagagacuccaacagggaugaguuggccccaggucuuccagccagcaggggcgccaagccuccccgaagccuccccugggcccuaccugcacgguggaagucguccuugcuguaggugaaguccuucaagaaggugauacacucugucucgugguuguagcgccuggcugucucuagcagcaugaucuaagggcggcagcgggagggggagcuugagcccugugacccuucagcugcuagucccuccccuccuggcccaaaugggggucuaaucucaccaggauuaucccuuguccccuuccccccuguucucucagccacaccagcgugcagccaucacgugagacagcccgagcucuuucuccacuucaggcuuccgcacaugcugcauccccaucuccuuaggauacucuuuccccaggugagcacaagguuuggggcacgggguuugaucugcuuuguucuuugccccauaugccaacacuuggaauagagccuggcauacagcacgugcucaauacuuauauguuaucccuacuuugauucaaaugcuaacuccucugaaaagccuuuuuggcaacuuuucucugcaauagcgccucuagccugauccucaauuuucucagccucagacccuuuuuccuuucucuccuuggcucauagaagacucuauucgccguggaaugucauccuacaacggcaagcacuggucuuccuuaacucugcucccagcaucuguccuggagcuaucucugggguuccuugugggcagauggaccauuaccucgauaguggaugccuucaggagggcgaucugguccucccggcccagcugcaggaaaccaggcacuugcuuagcgaaguccacgaucuccuggacugagaugauggccagcuccgugaagugggcaaagcguugcuggcgggcaucucgggacugggggucugcgcccaggggccagggcugggacacaggagaccagggucacucccaggucuuugugagccuaagucuggguggccaccuugaggccaagccugcacccugggggauccucuucccaaagccccugcccucuggagccucauucucccacacccugggugauggcccagcuggcucuaccccauugggaccgucacacucaagguuguggagggggcaguaccgugacuuugggcuggucggagaaggagcguuuguugcacugcaguugggccgccaccaacugcuggaucauuaguucuugagccgcuguuagcuggacacccucgccuuccccggagcccuggcugccugccucagauccaccaggggaagccccaggcccagaggcugagcugcugcugcccugcggccccacaggugacugcgacugugacugugacuccugcugcuguuuccgaaucuucuucuuccggaucuguucuucagaaaggacgccuguagggggaugcaggccucagcagaaccccagggcuaggcggggggccaggccggcaccgcccccucccgcugcacucacacugcucccucaucccugccuccuugcacuugcgcagccggcacugcuggcacuugcgccgcaugaaagcguccaucuggcagguuccgccaccccggcaggcauagcgccuggccccaccacggaccacacugcgccggaagaagcccuugcagccuucgcagcugagcacguuguaguggaagccggaggccuuguccccacagacacggcaaagcucguggcccagcaucuucggggcugggcccuucuuucgcuugcgcucugguuccucuucgggaucugggaugacugggguggguagguagaggccaugagaaagccacaaggagaaacaggaaccagagagaugggcccacaggagauccccaggcaaagagccagaggauggagggagagaggaguugcugcucacauucagggaaauugcaauuuagaaagauguauauguuaaggagaaagcaagaacaaaaagcaaagaucagggccucccauucccauuucuauuucuuucucccuuccuaaaccccuccccaagcccccacaucaacuccagggcccugucucaccccagucugugcugcaggcugagcuggccucaucagugccugggacaucaggguccggacccccgggccacggcuccggacccuccuccuuuacagugggugaagaagaaggggcgccaggcugaggggggccauuuccuggaagaggguggaauccgggagagguacagugagcuucugcucgugugugauaagggcuggguggggaagagagucacucaccaggcagggggguauccagggaacucgugguaggagaggacaugguggggucacggagcagccuguagaauacaggggauugagagccuuguggggcuaagaaggguuagguuaggucaguuacagguccugacagggcuuucccuuuuuuuuccaucucuccaaagacccuacucucagccacaacccugguuccugccagccuacaaacccuccccauccuucuaacaagaccugcccccuucuguuccacgccagccuucagcuuggucuuaagccccgccccugcuguaggccccgcccccucagguccaauccaccugcuuuuucuagguagggcccauucuccuuuaaucaugcucugccuucacggccuccaugccauguaguuuccccccaccuccucuucuuaagacucuaccucacuucugccccaagcaucccuauuucucauucugaccccaccuccuccuacuaugcuccgcccucaaccuuccagguucagccccuaaagcccccaucaugggccucccaacaccuugccccgccccauaugcaucccucccuccaagccucacccccacaaccucgcuccagguccccauccccucccaucaugccccgcccccgccccgccuccucccuuccuacugcacccccacaaccucgcuccaggccccgccacaucuccucccaucaugccccgcccccagccccgccuccucccuucaugccccgcccccgcaccgcgcugcaggucccgccccaucaccucccaucaugccccgccccgccuccuccauucaugcuccgcccucgcaccucucuccaggucccgccccucuccaagcaacagcggggggcggggcucauggcugcgcgcgggggucucguggacggccucucgcggagugaacuacuccuguugcccuggaaacagccgcgggaggcgcgaauuaccgaggggaggaaauggaaggagagaagggggcagagcggaguacgcggggagcgccgagaagccccggguucggggcuccuccugcgucuccccacucucgggugcaccuaccuggguucccuugcucugcuuuucuucguccuccucuuuagccccugacacaccgccgcuacucaaauacccucaaaaguaacuucgccacuucuuccggcaaccccgcccuugcgucacguccggaagagggg

SEQ ID NO: 15156 - RNA, 6575 nt, Homo sapiens
ccccucuuccggacgugacgcaagggcgggguugccggaagaaguggcgaaguuacuuuugaggguauuugaguagcggcggugugucaggggcuaaagaggaggacgaagaaaagcagagcaagggaacccagguaggugcacccgagaguggggagacgcaggaggagccccgaacccggggcuucucggcgcuccccgcguacuccgcucugcccccuucucuccuuccauuuccuccccucgguaauucgcgccucccgcggcuguuuccagggcaacaggaguaguucacuccgcgagaggccguccacgagacccccgcgcgcagccaugagccccgccccccgcuguugcuuggagaggggcgggaccuggagagaggugcgagggcggagcaugaauggaggaggcggggcggggcaugaugggaggugauggggcgggaccugcagcgcggugcgggggcggggcaugaagggaggaggcggggcugggggcggggcaugaugggaggagauguggcggggccuggagcgagguugugggggugcaguaggaagggaggaggcggggcgggggcggggcaugaugggaggggauggggaccuggagcgagguugugggggugaggcuuggagggagggaugcauauggggcggggcaagguguugggaggcccaugaugggggcuuuaggggcugaaccuggaagguugagggcggagcauaguaggaggagguggggucagaaugagaaauagggaugcuuggggcagaagugagguagagucuuaagaagaggagguggggggaaacuacauggcauggaggccgugaaggcagagcaugauuaaaggagaaugggcccuaccuagaaaaagcagguggauuggaccugagggggcggggccuacagcaggggcggggcuuaagaccaagcugaaggcuggcguggaacagaagggggcaggucuuguuagaaggauggggaggguuuguaggcuggcaggaaccaggguuguggcugagaguagggucuuuggagagauggaaaaaaaagggaaagcccugucaggaccuguaacugaccuaaccuaacccuucuuagccccacaaggcucucaauccccuguauucuacaggcugcuccgugaccccaccauguccucuccuaccacgaguucccuggauaccccccugccuggugagugacucucuuccccacccagcccuuaucacacacgagcagaagcucacuguaccucucccggauuccacccucuuccaggaaauggccccccucagccuggcgccccuucuucuucacccacuguaaaggaggaggguccggagccguggcccggggguccggacccugaugucccaggcacugaugaggccagcucagccugcagcacagacuggggugagacagggcccuggaguugaugugggggcuuggggagggguuuaggaagggagaaagaaauagaaaugggaaugggaggcccugaucuuugcuuuuuguucuugcuuucuccuuaacauauacaucuuucuaaauugcaauuucccugaaugugagcagcaacuccucucucccuccauccucuggcucuuugccuggggaucuccugugggcccaucucucugguuccuguuucuccuuguggcuuucucauggccucuaccuacccaccccagucaucccagaucccgaagaggaaccagagcgcaagcgaaagaagggcccagccccgaagaugcugggccacgagcuuugccgugucuguggggacaaggccuccggcuuccacuacaacgugcucagcugcgaaggcugcaagggcuucuuccggcgcagugugguccgugguggggccaggcgcuaugccugccgggguggcggaaccugccagauggacgcuuucaugcggcgcaagugccagcagugccggcugcgcaagugcaaggaggcagggaugagggagcagugugagugcagcgggagggggcggugccggccuggccccccgccuagcccugggguucugcugaggccugcaucccccuacaggcguccuuucugaagaacagauccggaagaagaagauucggaaacagcagcaggagucacagucacagucgcagucaccuguggggccgcagggcagcagcagcucagccucugggccuggggcuuccccugguggaucugaggcaggcagccagggcuccggggaaggcgaggguguccagcuaacagcggcucaagaacuaaugauccagcaguugguggcggcccaacugcagugcaacaaacgcuccuucuccgaccagcccaaagucacgguacugcccccuccacaaccuugagugugacggucccaaugggguagagccagcugggccaucacccagggugugggagaaugaggcuccagagggcaggggcuuugggaagaggaucccccagggugcaggcuuggccucaagguggccacccagacuuaggcucacaaagaccugggagugacccuggucuccugugucccagcccuggccccugggcgcagacccccagucccgagaugcccgccagcaacgcuuugcccacuucacggagcuggccaucaucucaguccaggagaucguggacuucgcuaagcaagugccugguuuccugcagcugggccgggaggaccagaucgcccuccugaaggcauccacuaucgagguaaugguccaucugcccacaaggaaccccagagauagcuccaggacagaugcugggagcagaguuaaggaagaccagugcuugccguuguaggaugacauuccacggcgaauagagucuucuaugagccaaggagagaaaggaaaaagggucugaggcugagaaaauugaggaucaggcuagaggcgcuauugcagagaaaaguugccaaaaaggcuuuucagaggaguuagcauuugaaucaaaguagggauaacauauaaguauugagcacgugcuguaugccaggcucuauuccaaguguuggcauauggggcaaagaacaaagcagaucaaaccccgugccccaaaccuugugcucaccuggggaaagaguauccuaaggagauggggaugcagcaugugcggaagccugaaguggagaaagagcucgggcugucucacgugauggcugcacgcugguguggcugagagaacaggggggaaggggacaagggauaauccuggugagauuagacccccauuugggccaggaggggagggacuagcagcugaagggucacagggcucaagcucccccucccgcugccgcccuuagaucaugcugcuagagacagccaggcgcuacaaccacgagacagaguguaucaccuucuugaaggacuucaccuacagcaaggacgacuuccaccgugcagguagggcccaggggaggcuucggggaggcuuggcgccccugcuggcuggaagaccuggggccaacucaucccuguuggagucucuguuucuuuaucuccaaaguuggggugaggguugagccaaggugagagugagguaagagugcaugugccacgugugguggugcacgccaauagucccagccacucgaggcugaggagggcagauugcuugaggcuauagugagccgugauugugcgacggcauuccagccuggugacagagaagaccgugucucuauuuuuuaaaaaaagcauguauugagugccgacucuguacauuggguugcaguggaaguugagaugggaggagcccuguuaccacaucaggcaucuuggugggcauuaggaaaagcauuccccgcccccgccaaaacguggucucacccaagggaggcgggcuggagcucgguccauugugaagcgggcagccuucuuuacugucuaggggagcacugcuuccugcccucugagagcgcuaaccugcgugggugggcuucuggaagaaggccugggcagugagaggcacugccuaggaaaagggugggaggagcauugcuagugcugcagagcaugcaccagggccucgcucccucauugucccacaaucucugggggaccucucuguauuucccgacaucuguccaaaccccacccucuccccuuccucuuacuccggcccuuucaccacccgagacggucccaguaacccuuuuaguaugagcuuagcagggcagggcugcagggaagcguuucuggcagaggagauuggcgauugcagaggcccugagguuggggagagcuggugguuuggaggaacuacagggaggcccaggcagcuggagcacaaggagaugggguggagaggaggucgggaaucccacccuaccccuucccagccgcuccucugccaccacccuggaacacugccaggguccccuugaggggccgccugccuccaccccugccugauggggcugcucacagcacaggcagaaggguccugucagcacuuaaggcugcccacuucccuccuccgcucagaacccuccgcggcucccgucucacugggagaagagcuagaguccucucuguggcccacaaagcccuuuaggaccuggccucgcucacucucugcccucagcucucacccucucccccuguuccagccacucuggccucuuacuggcacccauccagcaugcugcagccaagggccuguguacuuggaguuuccucugcccagaacuagggggaccaacugguccuaguuugcccaggaccuucccaguuuuaacacugaaagucucauggccuggguagcccccgucccaagucaugggaacagcagacguuggucacccucacaaucccucaucuccuucggauuggucacugcuccagcgucacccagagcgcagccuucccugcccgccuuguguaaaauagaaccauggcucagcagggcccuucacacuucucugcacugccugguuccauugaacucacagcccucugacaggcugggccucuuccuaauguguuugucuaugaccgguccccuaggcucucaaauguaagugcuggagccuggcacguggcagguacucagugacauuugaugacugaaugaacaagucaguuuugggaaugaguuugggcuuuaccuugagcaguggaagccagcgcugggaccagcacgaugugaccuagguuuuaaaagcuucccuuugccuuugugaaggggacaagaauagggacucgggaagcugcagccaccgcccaggugggaagggaggguggugauaggauaguagaaaauacugaagaaacaugcacccucauucauuccuucacugggcagcauguguggcacaccuacuacaugccagcacucaugggcacggggcacagguggacagaaaugacaagaacgcuguaauuacugcuguguucccagccccagagacugugggcagcgccaggguccaggauguggggcacgguuucgggcugagggagucacgggcugccucccgccccgcaggccugcagguggaguucaucaaccccaucuucgaguucucgcgggccaugcggcggcugggccuggacgacgcugaguacgcccugcucaucgccaucaacaucuucucggccgaccggcccaacgugcaggagccgggccgcguggaggcguugcagcagcccuacguggaggcgcugcuguccuacacgcgcaucaagaggccgcagguagggccccgcagagccucugcgcagagccaacuacgucccgcggcccacgugguccguucaggcuggguucugccagccacacugcccuccccuccgcagagucuuuccucaggccccacccugcucgacugggagccaggucuaguccaagcacagaggcgggccccacgcuggcucccacgccuggucggggaggggcccuccuuucuguuggggugggccucccaaagccuggcagggcaggggcucagccagcgcccaccugccuccucccucaggaccagcugcgcuucccgcgcaugcucaugaagcuggugagccugcgcacgcugagcucugugcacucggagcaggucuucgccuugcggcuccaggacaagaagcugccgccucugcugucggagaucugggacguccacgagugaggggcuggccacccagccccacagccuugccugaccacccuccagcagauagacgccggcaccccuuccucuuccuaggguggaaggggcccugggccgagccuguagaccuaucggcucucaucccuugggauaagccccaguccagguccaggaggcucccucccugcccagcgagucuuccagaaggggugaaaggguugcaggucccgaccacugacccuucccggcugcccucccuccccagcuuacaccucaagcccagcacgcagugcaccuugaacagagggaggggaggacccauggcucuccccccuagcccgggagaccagggccuuccucuuccucugcuuuuauuuaauaaaaacuaaaaacagaaacaggaaaauaaaauaugaauacaauccagcccgga

SEQ ID NO: 15157 - RNA, 679 nt, Homo sapiens
ccccaccaauccaccagggcagagacggggccgggcugccuugggaggagcagcugcagugcagacccucagccucccaggagcaggagggucccagcagcugggggggcucugugggagggaggacaggacucagcaggggccccuuccugggacccagguguccccuuuccccacucacagugcacggagaagcugagagagacgcgcugggagcccagcgggugccgagcguggcaggugaacucuccuucgugcuccauuugaacccgaggcagcuccaggaccccagggucugagggcugggaggggcccacggucuguccccaccggguccagcucagccuggcuggggggcugcugugugugacacagaccagacgcaggcuuuggcccuccaggacccggagggaugugccguuccucagguuuuccaggacuagggaaggaagaggcagaaucgacgugcagcucagggcucagggacccgccugcauggggacccuccagacaccugggcccccaauuuggcacugagaggcccuggcuccucugucuccuuuccuaccuguccuguuugcuugggaaaccaucacucucagguucucuggaggaucugaaauggagacaggggaccggcucuagacggaccagggacuucccucugggcaaagggaag

SEQ ID NO: 15158 - RNA, 4791 nt, Homo sapiens
gccagaggaaauguuucguuuuauuuuugcucauaaccucccaaaaaaaucaguaccccgccaucccucacccagacacagccccucuccaacaccuucacgaaacacugauuuuuuuucuuagagcuaaaaugaacacccagucaccaacuacagcccugcccugccccuccucccacuggccugcucaucuucccgcacugcaaaccuggccgccuuuagccucccucccuuagcguagugucccaaggucaccuagccugcuuuuugccuguaggauauggguccccuucucaaagcccgcccugacuuacuuccucauuugcauaguccuucagcucuauccugucgccacuccacccaccccagacaaccaccuguaagaaaccagguuugaaauucaagagaccagguuuccaagcucccagcugcuucccugugggccucggugccucggcuguuaugugacgggcauagacauugacuaaggccaaacauuucaugauuuggacgagaaaggagggaaggagauccagaaauacgcaagagaggugauaagcagagacagaggauaaaaggauaagaguagagaggaguugggugguuugguggggaagaaggguugauuuuuuuuuuuuaauagagacagggucuuacuauguugcccaggcugguauugaccuccuggccucaaacgauccuccugccuuggccucccaaagugcugggauuacaagcauaagccacugcacccggccgagagggguuuggaaugaagguagaggcagggggaugaaggcgccagagcugaagaccagcccccagaagccacaccccugcccuucuagcagcuacggguccucuggcuccgggccuuguaaaccucgaugagcagguccuugacguacuggaucucgcgcuccacggacucugcccguuccuucagcucgcgauuccgugccuccagccccuggcacucgcccuccagggccucacccucugcccgcuuccgcuggcgguaccucagagccgccgacuuguucuggucucucuucuuuugcuugcgguccccucgggugguggcaggauguggguagggggccaggcgagaagguugagguggagaaggaggagggggcugcuguggcgggggcagaggcggcauccccacuuccuccugcccggccucguugcggcaguagauggccagcaaguccagaguauccaagacagggggcugggggaggucaaaggaggggagggacagggggagggagggggcuggugguaguggugguggugguaguggcggcggggaggguggugggaggggcggggcaucuaggaagaagucuuccaucuguuccagcuccuucuugaggagggaggccauagcuuccaggucaggugggguuggggaagguugggggagggugccgggggguaagggaggcuccagagggaggagagcugugaaaucaacucgcucagucauccagucagagaagccaucaccugggauuaaaguggggagggacacaaaauucccugaguugcuggucuucugcguaguugggugcugacucacgucucauucaggugcaucugucccauucauucaguaaaacaacuaaccacugaaucaucaaaccagucaauaaaccaacaaaccagugaagaaaccaauaaaccagucaacgaaccaaccaacaaucaaccaucuaaccacccagucaaccaaccaaccaaccaaccaaccaaugaacuagucgaccaaucaaucagggaaucggucaaccaaccaaauaaaucagucaaccaaccaaucaacccauuaaucaaccaaugaaccaguuaaccaaaacccaacaaauuagccaaugaaagaaucagucuuaacccauaagaggguccaggagaaaaaaaaaauuaaaaaagaaaaaaagaaccagccaaccaaccaaugacucaagcaacagucaaccaagcauuucuucaaccauuccaacaucuccuuuaccgaguacucuguaucuguggugucucuauucucucuuuuuaaaaggcaaacuagaucacauuacacacacagauacacacgcacauaugccuuguuucaucuuuacucauuaauuauugaaaacccacuaugugccaagcauuugggauacaguaaugaaugaaaugauuccugccuccugagggcuucugcauauacaguucccuccaacuaaaaugcucuucccuuggguguuuuccucauuccuucccuacuuuuuuuuuauuuuaagggauaggguuucacucuguugcccaggcugcagugcaguggcaucaucuuggcucacugcagccuagaccucccaggcucaagcgauccucccaccucagccucccaaguagcugugacuacaagcgugagccaccaugccuggcuaauuuuuuuuuuccuauagauaugaggucucgcuauguugcccacguccugaacuccuggacuaaagcaauucuccccgcuuggccucccaaagugcugggauuacaggccaucaugccuggcuuccuucccaucauuuaugccucagucaacauguuaccuacuuggagaagguuuucuggcuacccauucuauauuagguccccuuugucauuuuguagcucagcugcuagguguuuuugacuuauuccaauacacucucauuuaauuuaucucuggucuacuccccacagugugagcugcuggaaggcacagaccauguucuucuuguucccagccguauccucagcaccuaaaacagugccuggcacauuguaggcacucaauauuuauugaauacauggaugaguucuuccucccccaucuuccccugcccuccacuccccagcuccaccuuccaccugcccuuaccugccaggggcucuccccccacuggaagcccgcccuccagggcucccccaaggaccucauagggagccaggggggcaggggccggggggaguuucccauagucuacgagccaucccagcccacuagcugggagcagggcccuguccagcuccagccccagggucgccaggagugacauggcuguagcacaggugcugggcacugauggcaacaggagaggcugcaccagcagcuggcacgaggcucuggaggaugcucaggugggcgaagacaggcaccaaggcgaaaguggaagaccuacacgcgugagacaagaguggguguggucaggacagcgucauccaccggccaaaaucaaggggaagccaagccacacccccaggcacguccaugaggcuccucccucccccuuccaaccaccguuuagaacacuaagccucagccucuccgaauucuaaauuugcccuuucuuuacccaaaucucugagccccacccacucccaagggaauuucuuuagguccuaaaguaggaccgaugccccaccccuucccccaauacagaaaaaaaaaaccuaaaggucucccaggggaauuaccuuaggccccucccauccaccucagaauauuucgccucaaggaaaaacucaaucccagggacauuuucuuccagccacgccccuuccucuaaaauauuuccuuuuggccccacugccuuccuagcuuccaucccaaaccaguucccaggggaacugccccaggccgcagcccuucagcaauguuauccacucaaaucccacuccucgcucugccgcugccccuccaagccccgccccucauuguuuauuuagcuccgccccucccccgauuccccagaggccccgccucuuugucacaucgaaaccccaccccucaacuaacgguugguuuagccccgccccuucucacaaugugcuuccgaaaucccacccaucgugacgacagugguucuauccccacccacuuagaggguugccucugggucccgccuucugcccugucaaucuaagccaguccccgccucagcaggugccugguuuaaaaggaaggaagcugggcugugagccagagcaacguggggcagggaggguggaggaggguagagggggcacgcggagaacggcuacccgaacgccacccguccacacgcggcucugcgccgagggccaaggcgcaugcuacgucgcccgagcgguccaauugccuuuacaccuccgcccucuuggggaucaaugcgcaugugcggccauucaggguccgcagcucuuucacuacggggcacuggugggcuacugcgcaggaacaaccaagcacgaagaaucguuuagaaaaaaaaaaaacacacccuccccuggagugcucaggcccagcugcacgcgggcugacaaacaucgagucuagaacucucccacccggccccgggcccagugcgcaugcgcagccgcgcgccuucggcccaccguacuacuucugcgccugcgcgaccgugauuccccgcucgcgacuccccaccccccagggcucccuaaagagggccacgagcugcgaaagggcgggaaaggcaguuggagaagagguaagcgguuacucacuccauggcugcagcaaggagaggcggcggcggccucggcugaagaaagaaggugggagcggagagcgcaggcguggugagcgcggagacgggccgggggcacaaaggggucgaggcuacagagccauggccggggcuacgcaggcagaggcggcgacacuguagugagaagagacugugauccgaggacagggaaugaggcggccccggggacuggggacagauauauacuggguggcggagcacggcccucccg

SEQ ID NO: 15159 - RNA, 6613 nt, Homo sapiens
uggagcacgcgucgucgccugggaaacgggucgacccgcggaaggcgagcgggugggacuuccggagcaguuaaugguggggaaacuuucuaguggaugugggaggaggcgggacuuccugcagcaaauuggggcugugcgccgcucaagcccguuuaccugcuccccaggccggcacccaggaugggcgagguggaggccccgggccgcuuguggcucgagagccccccugggggagcgccccccaucuuccugcccucggacgggcaagcccugguccugggcaggggaccccugacccagguuacggaccggaagugcuccagaacucaaggugagcggggccugagcuggaggggguguggccugcugcaaaagcgggaacaauccagagggacgcuuggcugcuacgcgggauugcaguggugcagccagccccgaagucggaaggugcucucuagggaguacaggaagauaaaguuugugcuugauuuagaauuagcuagauccuuugggggagaggggaucgagccgauuuagggaggauguucacugcgcggaugaugcucaggccaucgggaaauccagaaacaggcgacgaccuucgucaagagaaaaaugauccuguggagaaaaguaaaugucgcuagguugggauggaugguaacaggccaagccccggaccuauaucuagccacauuuuuugucaaggaggaaaccaauucuguagagaaaaguaccucccugucccuugcaaggaccagugucaggcaauccuagugccacuaucuggcuacugcaugucaaggagccaaucccauguagaaauaaacugccucuuacucccuggaugcuauagccugaagcaggccacacuccccagaaaugagggacccaaucacacaaggaugcaaauccugacuccaccccuccaauccucaguggagcuggucgcagauccugagacccggacaguggcagugaaacagguaucagugccucugcaagggccagcaaggccuggggaugggauuuggggaggaauugcaagccgucagugaagggguacauuaggaaaaucugauuggggccgggcgugguggcucaagccuguaaucccagcacuuugggaggccgaggcgggcggaucgcuugaacccaggaguucgagaccagccugagcgacauggugaaaccugucucucuaaaaaauuagcgggaaugguggcgcguccuuguaguuccuaaucgggaggcugaagcgggaggaucccuugagcccaguaggucaaggguguagugagcagugaucaccacacuguacuucagccugggugacagagcgagaaccugucucaaaaaaagaaaagaaaaaauauggcugggagagaaggggauguguccaguaaagaaagaaguguugccuguuucagugggguggguaccuguccaagaccuuagaaauuggacaaggcggccaggcgcgguggcucacgccuguaaucccagcacuuugggaggcuaggcgggcggaucacccgagaucaggaguuugugaccagccuggccaacauggcgaaaccccaucucuacuaaaaauacaaaaauuagcggggcaugguggcgggugccuguaaucccagcuacucggguagcugaggcaggagaaucguuugaacccaggaggcacagguuucaaugagccaagauugcaccacugcacuccagccugggcgacaaaacaagccuauaucuccaggggaaaaaaaaaaaaaaaaaaaaaaaagauucggacaaggcugaaaaccuguaaccguuccaaagcccguuccaaagugaagagguggggccuaagggucugauagugguggagaagggcugauuuuuccgcuggguauuugauuggaggaagcucccggugggggcggagccagucccagcuccucccucucuuucugcagcugggaguuaaccccucaacuaccgggacccaggaguugaagccgggguuggagggcucucugggggugggggacacacuguauuuggucaauggccuccacccacugacccugcgcugggaagagacccgcacaccagaaucccagccagauacuccgccuggcaccccucuggugucccaagaugagaagagagaugcugagcugccgaagaagcguaugcggaagucaaaccccggcugggagaacuuggagaaguugcuaguguucaccgcagcuggggugaaaccccagggcaaggugagggccacgccgagggcugagggagccgccacagacugggacccaaucccacguuuguugcgugcucucaacuuuuuagccucuacuuacuuuucugagaaaugggccuaaugauaaaugcagggaucguuguaagcaguuaagcaguggggagaaugauauaugucagcuccugcguuacccacagugaccacccaguaaucagcaaugaccaugacugucucaguaggagcuauuacgaugaggauuuuuuauguccagagagacuugaguucaaaugcuguuaccaccacauucugagucccaugugucucaucucuacgaugcugaauccauaaaaaaagcacguggcauaguuccugacaugcaguuagcacccaaagcuuugcuccugcuuuuauuuucacgguuauuagcccaccgagguggugaaggccaggggaagaaggaggcuggguaagacauuaacccccauuuuaaagacuguaauccuggggcuggcgucauaaggaguaacaggagacaguaagguuaagaugucgggccccacucagaggcaucacggaugcuugagauggaggugcucugugacucgguuuccccaucugugagauggcagugauaacacccugccuggcaggguuggugugagucagccugugagugaggagggucagagguaucacagugcugcuguuugucuuuccuuggugacaccagguggcuggcuuugaucuggacgggacgcucaucaccacacgcucugggaaggucuuucccacuggccccagugacuggaggugauaagaggcaaaacaagggagugagugaggccuggaguccaccucuggccccgggucaccccugccgcuucauaccugccguaggaucuuguacccagagauuccccguaagcuccgagagcuggaagccgagggcuacaagguaugugcagccgccugucugcaugggcacgugcacguggcgguccgaccgcagucagaccaaggcccuggugagcagagcgucuggugacacccuuugcuccccagcuggugaucuucaccaaccagaugagcaucgggcgcgggaagcugccagccgaggaguucaaggccaagguggaggcugugguggagaagcuggggguccccuuccagguauggcuggaagggaggcugggagcuaugugggggcacagagauccagagcgagggcuuuagacuccaggguaagcggggcggaggccucaggcagugugaugcugauaggaacccaucaucagcuacaaauucugggcugggguggcauccaguaggugcuugagggggagcuaaagcugguggcccccucccauccacaggugcugguggccacgcacgcaggcuuguaccggaagccggugacgggcaugugggaccaucugcaggagcaggugagucuugcagccugcccggccccccuccuuuuccucacuccagccccucacuccugggcuccccggccuccgguuggggccuccuuacuccucuguccucucucgcucccuccuucuguuuuuugcugugacaucuuagauguugguuuacgagaccagugcuuucagacuuucuacaucagaguaguagggaagcuguucauuccuucguucauucguuugugugugcauuuguucugaaguuuagcgcauucuugagcugaagguaucagugagcgggacggccugcuccagcagggcccucacggcgagggcggugacucuaggcggaugggcagacuggcguguaaaacagcaggagggagggagcuggagaaagcaggcaucacccguggugggcagggauggccucugaggaggugacaucagaggaaaaggccuaaggcagggaaaggagggagccagguggacaccuggggaaagcgguccccccccuugugggagugacagcaagugcaaaggcccugaggcagucccuagccugggcuaguuagggacagcgaggcccaugcggcuggcucuaagcgagggaggggagagggcagggccacagggagggccccgcuuuugcccugagggagggggaaccugggaggcgccggcacgccggaggcuggagcuguagcagggugggugcccuccgguggccgcguggggaacgggaggaggugaagucgggagaccuggagggagggggcuguguggagagaccacggaggggggagggggccaggagcacggugcaaaguggcuggagagugaggacaugaaaggucgggggaugauuccugauguggggcacagaccaggcgaagcagccccagggacccgcuaccgcugcggggggacauuugugggaagggccuccucacuaccgucucccguaggccaacgacggcacgcccauauccaucggggacagcaucuuugugggagguaagggccuggaggcugcugagggugggcugggacgccucccuccgagcuggugggaacggggugucccguguguuccagacgcagccggacgcccggccaacugggccccggggcggaagaagaaagacuucuccugcgccgaucgccuggugaggccccugcccccugccccgcgcccgagcccgacccuggccugugucugauguucguccucaaccccuaguuugcccucaaccuuggccugcccuucgccacgccugaggaguucuuucucaaguggccagcagccggcuucgagcucccagccuuugauccggugaggcccuggggcggggguggggguggggaugggagggcucccggggauggggacggcaucucacgcgugucccccgccccucgcagaggacugucucccgcucagggccucucugccuccccgaguccagggcccuccugagcgccagcccggaggugguugucgcagugggauucccuggggguaaguguccuguuccugugcgcgugcccugagccccgccuggguccuaggccacccaccgacacugccccccacacagccgggaaguccaccuuucucaagaagcaccucgugucggccggauauguccacgugaacaggguaugaccaggcuuuugccgccccaaaucuauuauaaaguucccaucuccaccucucaacugguuuggggcggcuuuccuccaucauugccuccccguccccgcucggggucuucucucccccugggucugccgaucuguuugugaccucucguguccccaggacacgcuaggcuccuggcagcgcugugugaccacgugugagacagcccugaagcaagggaaacgggucgccaucgacaacacaaacccagacgccgcgagccgcgccagguagcgugaccgcggggccguagguggccugcggcggggugggcggggccugcacauccagcuccuucccccacagguacguccagugugcccgagccgcgggcguccccugccgcugcuuccucuucaccgccacucuggagcaggcgcgccacaacaaccgggugagcccgcucagcccggacaccccccgggcugcacccccugaccccccuccuccccugaccccugggccugccgccccucugauguuccccacaguuucgagagaugacggacuccucucauauccccgugucagacauggucauguauggcuacagguacuguuggggauagcagggggcaggggcacuggcugggccacaugauccaggcugucccucacuguucccaccacugccaggaagcaguucgaggccccaacgcuggcugaaggcuucucugccauccuggagaucccguuccggcuauggguggagccgaggcuggggcggcuguacugccaguucuccgagggcugagccccgcccagcuccccuccacaauaaacgcuguuucuccuugagcuuggccggcauuuugcuggaaggagggugguccccacgggggaggggcuccaggccugccaguuucuuacauggaggaggcuuuaaggacauuuucagguaacaaaagguggggcccuaccgaggggaguccagcugggaccuggcaugagcacuuuagacauuagccggggaacacacagggagggcgcuguguggccccccgagagccagcuggugagcccacgagccucaaccgaggggcuggcucaaggccaggugugaccccugaggacaaaauccagcucagguucugugacacugaacuugaacccaaggccugcgggucuggagauucgggggggaagaggguguggacagccgagagccagacccagugaguucccgggcuguccagccugcugggccaccuuagagcuagggggcug

SEQ ID NO: 15160 - RNA, 20424 nt, Homo sapiens
auguuucaugaaaucuuuaaugaaauuggggagaggggcacaaacagaagggaggggcacuggggacaggcuugggggcaagggagguggacacggggcagggcagggcagggggcucuccucuucccugcagcaacccucccccagucaucccacugacgggggagggagguggggagguggagccauaaauacguccagaguuucaaagaggugaggggcgaagagcuggccagggcucucagagagggggcaggggcaggcccgggccacccuugucugggggcccuggcuccuugggcggccgugggggcccugggggguccccuggcuugcgaccgugcuugcggaaguagcgguagcgcuggacguaggcccgcaccagguugcucaccuucacuggguugauuuccccacuuuugcuguggcagaucuggggggccggggacaguuggagucaccaccaggcucccggggccccauccacccaggacuguugggcgcagcuuggaacugcgguaggaggagcuuccccaauaaccaggccaaagucccucugucccccuagacgaugggugccccagggccagcggaacaggcccagguggccuugagaaaauccugucacccuccucaccucccagacugaccuccuccccgucucccauccgcguccaucugucugcacacaucugucccuccagcucguucucuccccggccugugucugccccucucuccgggugcccaccuuguggacggccuuccucaggauguccuuguacuccuccuuggugauguccuucuucugauaguauggcuugauggccagcuucaccuccuccaccgcccgcuccugcgugugcagcuucuucagauacuggugggguggcgacagcgggggaagacacagcaagggccagugaguaccugcggaaccuccaccuccacucgccucugcugccagccuaaccucucuggccguccagcugcucucaggcuggaaguccugcugagggucugucccaugcgcccucugcugcaggugcccgggaccaaaggccaggccugggccucugcaugucacugaacaucuccuccaggccgaacccugggcugcuccaggccuggccgggaccaggacaugugugucgccugcccucacaaaguucagucugaugagaagacaggcauuggccaagaaauugcagcugguuuugaaucagacucuagaggcggggcuguagaaaacugcacagggcuuuucaccgcgggagcggggaggacucaguuuagguuuuuacaguacugcucuggucacccaggggauggaggggguggcuaggggugaggggcacuggggaguggggguggggacugaccuugagcccauuuguaucagaagccuggucugccacucccugucucugaccccugggaugcucagccaaaccuuuuuguggcuccuuuuuuguuucuuuguuuuugagacagggucucucauugucaugcaggcuggagugcaguggcacaaucacugcucacuguaccccuggucuccugggcuaaagcgaucuucccaccucagccuccugaauagcugggacuagaugugccacccccacgccuggcuaauucuuguacuuuuuguggcgacuaggucucacuauguugcccaagcugaucuugaacuccugggcucaagcgauucacccgccucggccuugcgaaguguuggaauuacaggcaugagccaccgugccuggccaccuuuguggcucauuuguaaaacggggacagcaccuaugggcaguacuacagcgacacacauggaggacauggcacaggcuggguacagagcaaagacucaauccaggggagcugugccuguuccaagggggauggccaugggaugaaaaggggaggacgcaacagggacagggcagagagccuccgaggcaaggcucuucccgccuguggccagcaagcuaggagaucccgcagccgcaggcucggggcagcagcugcagcccuggccucaggcagaauccuugcaaaagcagacaggaaaccucuagccagagagccacgugggaccagagaagaacaggccuucugcaggcacaagggacagucccuuggcaccacccuuggagaagcugcccucccaagccaggugacuaucaaaguaggggcagguaaacugaguccugggaagggcagggcacaauggcuagccgacuccaggagcaacaucagugacacugucugacgagcuacugagcuguuagggaacucuguggccagaagagacacaggcugcccuggagggacuucucaggcuugccuggccccacaggaugugggucucuagagagacgcugcuccccaacacccaucucggaugggcaaagcggggcaaagggcagagcacagaccagggcagagcaagggccacuguagaccaggggguccucaccguccgaguccugcagcgcaaggcacaagcuacggacaagugaccgacuaaacugcagccccgccucugcggcucacacaggauguuuaaugggguuuauacagcuuuaucuggcacgguacacagcuguguaaggguggccaacgucaccgucuggcuaugggcuacuagacuguaagaaaacacaucuaggcugggugcaguggcucaugccuauaaucccagcacuuugggaggcugaggugggagaaucacuugagcucaggaauuugagaccagccugggcaacauagugagaccccaacucuacaaaaaauuaagaaaugagcugggcaugguggcgcgugccuguaguccuagcuacacaggaugcugacguaggaggaucccuugagcccgagagaucaaggcugaggcuacagugagcugugacugugccacugcaugccagcuugggugacaaagcgagacccugucucaaaaaccaaccaaccaaggccgggcacgguggcucacaccuguaaucccugcacuuugggaggccgaggcuggcagaucaccugaggucaggagucaagaccagccuggccaacguggugaaaugccgucucuacuaaaaauacaaaaauuagcugggugugguggcgggugccugucaucccagcuacucgggaggcugagguaggagaaucacuugaacccuggaggcggaggcugcagugagccgagauggcaccauugcacuccagaccaggugacagagcaagacuccaucucaaagaaaaacaaaaacaaaaacccacaucuagaccugaccaagagagaaacagcuccagagcccaggaguaggagccggccagagcagcugaguaagaaccuacauuacugucugccuggcacccauucuccccugcuucaucuacaaacagguucuugaguuuucauucggaaaccacccucccccacucacagagacggagacagcgcgagcaacagauaaucaaggggugggcugcagcgcggggcaucucuuccaggguguguauaugugguguguacgcacacagccccacacacgcacagacgcgauuuuccuuuggacacgccuaacgcauuuccugcucacccauuccagcaaaguggaguuccuuaugguuccaugacuuuggucucuacggcccugucucccugccucagucucccuuucuccuugggcccccgcgucucaguuccuguccauauucucuacagaacugucagcaccgccccaccucuccccaggccagcucaccuuaucuguguccccacggcccucagagcugcugcugcccucucucuugucagacguggcagccagcccgguggggguggggggggucgaaccgcagccccccagagggaggcugccaggaagcagguagcuggaggggccagggggcagacccaaagaggugggcacaggagcuggggucauccccagacuugaggguggcuuucuguggcugaggaucugugggacgaggacagaggggugaugaguaaagggagguggaggggaagaggggacgugcaccccacuguucccacgcugacuuccccacagcugaggcaacaggcuccucuucaggccgauaccuugccccagagcugccaggcccgcgguuccucuccuaacccgaggcaauggacaaaagaaggggcggcagggacucucccccaggggagcccaccugguugguggccuggaucagcuccugggccuucgcucggcucgccagguuggcuucuuccaucuugaagagaagugcagucacugcaggaggcagagaggugacaacaugaagaugggagaggugacaggacaggagcuggugaaccucaccuggacaccugcugucaucuccugcccuuggccccagaacagccacaaagccucacgcucagaacugggaaaagggggccuuggccaaugagagaacagcccauaccacgaauguucuugggacuccaggugugugggugcgggguuggccagggucaugcagugaugagacaguggcaggagugagauucugccuccugacccgcuguggccagucccaaccucucuccccaccucugcagucugguagaggcaaccgccauccguaaggaauacgaugcccugcucaagccauucuuucuggucccucucuccuacuccccgucuaggggaaucccagaacccagcccaccacuccagucugugcuggccaccaccugcucucaccggccccucucucccaguacacccaggcaccuagagccuggcuggccuuuacucacccccacccucccagucuaugucccuauaaaccucucccugccagggcaccccacugccucuaagucuguacccuccaguccccauccugucucaccugccccagcaccacccucccccaggggacacucacaggccaggacgccgcugguggugcaguccacaccagcuggcagauuccagggcaugggcgggggcaacgugggcagcugggagacacgggaagcuggcccguccuccgcccccgagucaccggcuguggaccccgcgcugggggcagugcuuggggcggcugcagcagugcugguggccguggugguagcaggcugcugcuccuccuccucuuccucuuccuccuccucuucuucuuccuccuccuccuccuccgccccaccucggaccccagccuccucaguggccuccucgggcaggaaggagaccucaggugucuugcagcugcuguccacggucugcgaguccggagugagggcagggggugguggggcugccuuggggggcggggugcuaggaaccuuggcugcccgcuccuccccggaccaggaagucuccuccgcccccuuggugccugccgccuggcugcagcuauccgccuuggacuucuucagcgacaccuggccaccacugcccccgcugccaccuccacugcggaccuuuuuccuggucuuggauggcuuggucuuucccuugguccccuugguuuucuuggccccugccuuggccuugaccuuggucuuuuugggcuuggugcugcccggagcugcuuuggccaucucagugggggcccgcucgucagguuugaggaagggggagcgacucucgcggucacggcugaauuugacgccaauggagcccaggccggcugacgcggcauccuuggccgggguggugcugcugacacccucgcggaucagcaccgccaccuuggacugcagcuucaccuuccgggaagaacaggaggacgacgaggaugaagagccugagccgcugcugacugguggcuuuggcgggggcccugaggaaggcgccgacuccuuggggggccgggccuucuuggaugaccugucccugucccuaucucugucccugucccgaucccggucacccccguccagcgccuuccgacgagaccccuucucccgggaagaggaggaggaggaggcggcccccgagcggcgccgauccuucuggcugcucuugccgccccgcuccucgccgcucagucccucggagucguacaggaccucccgcuuaggugaggaggccggagcaggagaggguccucgggggucggacuugucaagccggcccaccgugaugguccgcuugauggcgaagaggucgugguccgugagguccuggauggaggguggcacggccccccggcggcggcugucgcggucaccacacgagguggagccagagggcggcggggcgggcgccggggccuucucgcugccauccccagaccgcuucucaccccgggaccgcgaccgcuucuucuucuucuugcugccgccaccgucccgguguuucccgcggugccgcucgcgccucgaggacgacgaugaggaaguggccgggggcggggaggcggagcgccgccgccgucgccgcuucucccgggaccgcgaccugcggcugcccccgcggcggcggucggugcugcgcgagcggcggcggguggagcgggagcgggagcgggagcgggagcggcggcgggcggacgacgaggcgugggagccgggcuugcggucccgcgagcggugcuucuuggagucccagggcgaggccggggcgggcggcgcuggcugggugcccgacgaggacgaggcggccuccuuggccucgccgcugcgcuugcguucccgccuggacuucuugcgcgugggcggaccagcagcggcggccggggcgggcgcgggcgccggggagggcgagcgcuggcgguagcgcucccgccguugggucaggaucuugcggcgcagguccaggccgccccagcgcgagucggcggcgggcggcgcgggagccggcuccccuagguccaccugcagggcgcccucgccguccgacuccgcaugcagggacaagaagucgucccccucgggggcccgcggagcgggaggcugaggaaggggcugggccguggggguggccgaggcggccgguguaggccgggcggcccggccgccggggcggaagagggacagcgccagccugggcuccuccuccggcuggacgaucuccccuuccucgaucuccgagucgccgggcggcagcaggggcggcgggagggcggcuccaccagcggucaccaccuccaccgagaccuugccuucccgacaagccucugccucgguccccaccacgaagacccgccggcgcauggcuccaucagcccggguggaguccaccuggggcggcguuccaggggcgggagucggcugugugggcugcgcguccgggcgggggcucucgucaccugggaaguccuggcucaggcuguugucaucguagaugcccgccagggucuccgagaugcggcugaugcucugggacaggccuuccuccuccuccucgucuuccucuuccucuucuucuuccucuuccuccuccucuuccuccucaggugaggggguccccgcugaugagcugggguuggagccggugggcucaaaagggucguacuuuugcuccggagcaggcgguggagaguaggccucgucggugggguggaaggggucauagauaucgaaucggggggcagguggggcugggggugcagggggcggugggggugggggaggggaaggggaggaagaugagggagaaggggaaggggaggaggaugcagaggagggggcaggggguggggcagggcccccgucucccgugcccaaggugaggugacgggcacaggugggccuagaggaguucgacuguggagaaacugcaaaggaacagggagagagaggcggucagggccuuugccucccuccuggugccugcuugcuggcccagccguggacacucccugggccaccagguccugcccaggaagccccaagugcuucacaggagccagccguaggaugcucccaacaacugcacaccaugguucuuaacccaaaggucacaggaggaaacugaggcagagggcugcaguauccuccccaagggcacacagagagaaggcagcagucaggguguaaacucagucagugcggccccgaaccugcacucccauauccugagacagcacuggccugacccugggcaauguacccuggccuugaaacuaggaacuaucuugaccagugccggcgacccaucccaggaggagguggaggcugcagugagcuaugaccacaacaccacacuccauccuggggggagaagaaacaggaaaacaggcugcagggggagagcugggauucaaaccuaagucccccuccaagacaaaaacaagcucuggccugcugcgccagcugccucucgugggaguuucucccguuugguagagggugagauuccagugcagagccaggaaauggcagagcuggggagcccaggaaggcuggucuucaccccaagcucuucacucugugcugaguccccacccaaggaauuacaucugcucaggacucaaagacaccacugaccagugacaguggcaaugacaaagguuugccucuuccuccaaaccaggcauggugcuucguaugucaccucauucgcccccaaagagcccgcugcacugugcuaaguacuacagucaugaugccacagucacacgauggagauggcugacagaggccacaccacaggcaaggaugccagcagaguggugugaggacagugccagggaaggagaggggucaagagggcagcaccagagccaccccuugauccaggggcuggcccucaccagccacaugaccacaggcaaguggaucaaugugucuuacuucaguuuccucaucuauaaaauggggguauguucauucauccaacacccuuuauggccgggugggguggcucaugccuguaaucccagaacuuugggaggccgagguggauggaucaccugagguugggaguucgagaccagccugaccaacauggagaaagcccaucucuacuaaaaauaccaaauuagccgggugugguggcacaugccuguaaucccaacuacucgggaggcugaggcagaagaaucacucgaaaccaggaggcagagguugcagugagccgagaucguaccacugcacuccaaccugggcaacaagaccaaaacuucaucucaaaaacaaacaaaaaaaauaucaaugaguggaguguacggucccucagcugccaagggcuuaggggaagaugaaacaggggugaugaugacagcauuuacuucccaggauaagcggaggaauagaugagugcgcagaaagagccaggcugcaccugcugcugggugaggacagucugagccucagcuuuuccuagccucauugcuauucccagcaccuuaagcacaaaauacucuccacagacuagagcgcucugcaaacacgcgagauccacagcuuuauauaaauuucuguaugggacaggauuaugggugaacuuucuuuucuuuuuaaagcuaccuggaauaagcaaagaaaacauaaccucagagucccccugaaaacaacuacuauuagcuuccggauacacccuuaucacucuuaaggcccaggggucaaauccagcauaccaccuguuuuccuaaaucaaguuuuagaggaacguugccugacccauuuguuuacuuauccucugcagcuucugauuuuuuuuuuuuuuuuuuuugagagggagucucacucuguuacccaggcuggagugcaguggcacgaucucagcucacugcaaccuccaucuccugguucaagcaauucuccugccucagccucccgaguagcugggacuagaggcgugugccaccaugcccagcuaauuuuuguauuuuuaauggagacaggguuucaccauguuggccaggauggucucaaucucuugaccucaugauccgcucacauuggccucccaaagugcugggauuacaggcgugagccaccgugcccagcccuacagcuucugauuuuaaagaaauugaaacacuuuugugggccccuaagaaugucauaaguccuaggcaccauaucacuguacuuaauggauaaaucauuuccagcuguuaaaaaaaaagggggggggguguggcaggcaugguggcucaugccugugaucucagcaguuugagaggccaaggcaggaggauugcuugagcucuggaguuuaagaccagccugcgcaacauaucaagaccucaucucuauuaaaaauuuuaaaaaaauaaaaaauaaaggcugggcgugguggcucacgcccauaaucccagcaguuugggagguugaggcaggcggaucacuucaggucaggaguuugagaccagccuggccaacacagugaaacccuaccucuacuaaaaauacaaaaauuagcucaaugugguggcaugcgcaccuauaaucccugcuacucaggaggcugaggcaggagagaaucacuugaacccgggagacggagguugcagagagacuagaccccacuacugcacuccggccuaggugacacaguaagacuccaucucaaaaaaagaaaaaagaaaaaaaaaaacuagccaggcaugguggcaugcaccuguagucccagcuacuccagagacugagacaacaggauaacuugaaccggggaauuugaggcugcagugagcugugacugugccacugcacucuagccugggggacgcagugagacccugucucaaaaaaaacaaacaagguagcagggcacaguggcucacgccuguaaucccagcacugugggaggcugaggcgggcggaucacuugaggucaagagaucaaggccauccuggccagcauggugaaaccccaucucuacuaaaacuacgaaaauuagcugggugugguggcaugcaccuuguagucccagcuacucaggaggcugaggcaggagaaucgcuuguacucgggaaguggagguugcagugagcugagauuaugccacugcacuccagccugggcgacacagcgaaacaagguaaacaagguaaacaugaccuggcacagaguggugugccugcucuaccacagaacuggugcucacggcucacagcuggugcccauagcugacugcaccuucuucuccucucccuccaaccccuccuccaaauacagauguucacguagaaggaaggccuaaacccaggguucucaacagaguccagggcucagcagcauguauuguuuaaaaugaaaauucccaggucccaccccagaccugcagaaucagaacucuugggagugggcccagugaugugcauaguaacaaguccuccuugcaacugagaugugcguucgcguuuggucuaaagggcucacaggguuaccguugugugugggguuggaggaagagauuccuccuugggcagcgcacaucucagacaucaaaaacuugggcuucagacucagacacaccagggcucaaggcccaggcaccccacggagcaucuggcugugcgcccuugggcaagugccugcccuuuuucaggcugucugcuucucugaagauagagauucgaagagucccccuccuggggagaugaacgcccagugcagugacacuaauacuuagcgugccgaaaccaguugucacacacgcugaccacucccacauagccccagcacaucaguuuuuacuuuauguacaucuguaugcgccuacagccuuaaucacgucuaauacgaagagaagggaaagguuuugucuaaauaacaugaucaccgcuaccaucacuaccaaaaacagccgauccccacacaacuccacgaccaccugcccagcuccgcccuggccccacauacccguuuugcccguccuccaggcccugagacggggcagcaggcugggcacaggcagagggaugggaucucuguccccgauucggaccucagccaccagcuccagcauguccucacuucugcaaggcggaaggggugggugagccucaggggugcuucuggcucucacgcugaggccucucccacuccagcugcccagcuacucacucgccaggccgcagguccaggcggcugggaacccagguauccgggggauccaggacacucaccagcccugcgaggaagcuguccguggccauguccaacaccuggaagaggccagagaggcucuacgccgucccuggucacaugaagacuggcaaauccugcuuccccacucccuaaccucucaggaacccagacaucuaagauccccaagaaaacugaggaucuaauuccuauagccugacugccaucaacacucaaagcucaggcccacagaucaggcccccagacucuccaacauugccccuggucagcaucgcagagccaggaguccagguccccaaaccccauucccccagacucaggcccccaucccuuccucccugauacccgugagccaggcccccagcccccucuucuuacucacaguagccgugucagugcccccugauuccugggaacggggcucugaccguggacuccggcagcgccgccaucgaaggccaugacaccgagagccaucuggugagagauuugcaugggggauuggacacaggggacuugcugcagagacuugcgggguagaggaaagaggagcuugaucuaguuccugacagcggaaccagccucccgcaugcucuccaggccuccaugcgccaccucccaggaggacuucccagcacccacuucagaggcugcgacgcucagccauucguccuccugucugcccucagacaccucaaccuggcauucaggccuugcugggauccaguccccacagaccucuccugccucccccaaccccacucacacccuccugcaugccagccccaaggaagcccagcgcagccccucgccgcugcacccgugcuguaggccugcugcagcugaucaggcuucccucuaauccuagguccuuagacucuucuagguccuuagagagccguucacugucccugcucggggaaggugcccugacccgucucccaccaugcuagcucaagugggccuccugcccucucccagcacugugccugucucccuuccacugcacacuaggcccuuccaaggcagcuacagggugucugcccauuuuuggcuccccaugccagcacaaggguggcacccaggaggcuucagaaaagcuuguaugaaugacauuaggauaaagaaugcagagagggggcaggggcuaaaaggaaccggaagccgccauaccuuuaucauugggcaggucccccugcagggagcuucccacagccugcuggauggcucgcuggggaaggggggaagaaccaagcgucagaggacccaggcagaugcuuugcaaccucugccccuugggagacagacaucccagacacugacagcuagacucaagugcuucaagggagccaagaguccagcgccccugccucaggcccuggagucaggccccuggaguguggaugcccagcuccuccaucccucagugccaggagcccagcagccucaccaggauaaaggcagaaggagaaagcguggggucucugucuggcggaccaucgccccgauccucccccgacuccucugucuucccucgagacucaucuucuuccuccauggucaccuggggguccaggggggagaguuuggaguggaggucccgggagaaaggauggaaguagaggauagacaugaagaccucaagggccccacacuaucucccucagcauccccucuggcaccccuccucuccuccaccuccucccacuccacccugugcuugggugggcgcuggacccagcacagacaccccagggacuaggagcaauucucuuccuuuuuucugggucucaggugccucuuaugucaaagggaggccucccuggccuccgcuuuuaacaucucacuccucaauucccgcagcuuccccaacaaccuauccaaacuucaagaccucauucccuggccuccuaagaggcaaagccaacaccaagguuuuuugugugugcugcacugugauuucaaaggguguguuccacaguccuauaaacccaccuuucccaaggccaaugugcugggcaauauucaacaccaugccuuaaacaccacacggcuuccuagagcaucaacuguccucgauggugaggaccacccccaaauuguauuuauacaccuaaguuggaaacuucauugagugaucugcaaaaccaguaugccauuuuuaaaaugaaaacgcuaaacuucagaaagacaugccgaaggaaaacuucacaggaggcauuuaccuaucgccaucugcacaaagccuuugcaaugucauggaaauucuuugauaugauuccccagucaggcaguugaaagaucauccaucaaacagguggaugucuugauuagggcuucagaaaaauaugaauauuucagcuguaagcuuccccaugacugucaaaucugcuacucauaagacaauauccaaucucaaaauuccuagaaagcuucaaaaucccuaacccacaacucaguaugcuuaauuguaaaugcacgaaauaggagcaucuaucucagagaauggcugugaauacucaaagccugacuucugccacacauuuagagcaccucaagugcucaauacggaugaagaggaaugacacuauuagcccuuaacgcccagguuuccccuacaucugucuccucgcuucccccacagcaugccugcaaagacaaggcccugguccuguucuagaucccauauagauuuucaaaccaugccaagccuccauauucagccucccagcuccaccuaauuccuaacuuccuaagacacacccaacccugauagucuauuacaucccagccucuuucaccaauacucaauaagcucagccccaguuccuggcccuggaacugcucuccagcaccucccggggaagcacaugcuaccuacaacagugacugucacauaucagaagcuuaaucaacaucugcugacuacaggcugagggauccccaaacccucugcaguauacaaagaugcuugcuugcucauuuagaaagcaccaggcuucgcagacacacccucagcuacugagaucuucugaacagaagaaugcucugcagauacugcuagguccuaucuggaucagugguuuccccaacaacagggucauauaccaguuuagugcuucacaaauagcuuguuuuaaaaaguaaauagaacaaaauaguucuucacagcacagcacaaguaguaaguggaaaugucaauucguggaaggugaguuaauguuaauacauuauguuauauaauguuaaauacauuaugacugucuguaccaggucucaaugaaaaaauguaucuuaaugcagaucacggucaacauggcccagguuuccccuugaaaagcacuguaauagugggucuagaugacccuccagacucuuccagacuaauguagauuaauucuaacucucucaauaacccccaggguaaugcagaaucuuaaaacauuuuucauuugaauuacugucugaagggcaaguauaucuaagcugggcaaaauuuccucauucucuuuccguauuauuauucgccacaagcugcucugaccccaaaggcauucgaauuugcuccaggcaucaaaacugcauuccugcagucacauuaaagccaucuagaugguuccagguccuucuaacugcccccagccuccugucacccauuauuagacacuacccauaccuuggagaccccagacccucaguacaucucaauauuuggcgcccuucccuggugggcauaacccaacccccuagggggcccuaaaugacuucuuagcccuugaacacuccuucuaggccugauaaauggccccagacuuaugcagaccaguugcauccucaggccagcccaugcagacacuuuccagcccuaaaagacauaccccaggccucuagauggcucugaagauacucuucaggucuugcagacccuccuucaccccugggacauaucucaagaucucaagauggccccagaacccucuaaccagacccuagccuccggucagcccaaaaagacaaucuacagugucuacagacacgauccaggccagcugugugauggagggcaggccuuaggcucggucuaggcccagagacgccccaaguccucucggagacgccccauagacgcccccaggaacccacggaugcgucccggggcccugagaaggccccccucucggcgccagguuucgccgcagcugccgggcccgagaccgccccgagaagcccucuaggacccguggcuuguggggaggaccccgggacaacuagcgacccaacuccgccccgcccaccccaauaggcccgagccccgcggcccggacugccgccgccaucuuaccccgccgcucgggcugcggcuccggccccggcgcggggcggggcgggcuggggcgggguucgugagcaaaggaggagagaggcggagcuaaagcgccgccgagcuugccgggauuucaaguaccgagcacggcgacgugaaggccggcgggaaggcaaccgcacucgguuucccagaagccaaugggacacauggggcgggguccgcgcgaugcacgccgggaggcguaguccgcgcaccgccucugucgcgcggggacagcuaauggggugagaggugaagugggcggggccgcgguagcccgcgaugacgccccacagugcccugcgcgcgcgcggaaaggguggcggaacaggaggugacguaagaggcgccaggcagaacagacgcaagggaauuguaguccggcggagugagcacgacuugcuggauguugugcugcccacauucuggggcucucagaauccagauccucuaggccccccuaaauuuagaaccagacgggaugcaguggcgcacaccguagucccacucgggagacugaggcggaaggauggcuugagccuagaaguuagaagccagccuaggcaauauagggagaccccgccucuaaaaaaauaaaaauaggccaggcgcgguggcucacgucuguaaucccagcacuuugggaggccgaagcaggcggaucaucugauaucaggaguucaagaccagccugaccaacauggugaaacccagucucuacuaaaaauacaaaaauuagccuggcgugguggcuaacgccuguaaucccagcuacucgggaggcugagguaggagaaucgcuugaacccgggaagcggagguugcagugggccaagaucgcgccauugcacuccagcaugggcuacaagacggaaacuccgucucaaaaauaaacaaauaaaaauaaacuuagaaccuagaagcccgaccccauagccgccucguucaguacagagaagucugaauuccgaauccucucacucagagcaguguccagacuccuauuucccuccucccuccgacucaggagucugauucuuccuuccucggauccaagagucggucucccagacuaguccuggucucaagcucucacauacgaauucggguccccccaagccagugcccucgcucggauccagaauccuggguccccagccucuccaauuccuggaccuaagaguccaggcccccggcucccuccuuuaccgaaccuaguacgaaggaaccugucuaccuuccucccugacacccuccuccccaggacccaggaguccacaucuccagccccauuuucuccuaaggacccaggagucugggcccucugcuuccuucuccuucaagacccagaaauccuggccccaggcucuucaugacccaggcaucccuacuugggcgagcuggcucauggauuaggaaugcagugaucucacggccccucccugccccguuacccugcugucccccucuagggccccacucuccucccagucugucuuccgcuuggcugggacagcgggaaccggaagccugggucccuuagcgggcggagacucuagcuucuaacccagacgccggggucgaaagcuuggcuaggaucccaggagggagguggagcuacuccucaaaaccugcugcuuccucggagcgcccuauauacggccgcgcgcgcgagucgacgagcuccgccuaccauacuaaggccucggagacgaugccccaagcagcagugucacagggguccuuauuugcauagccccuccccugaggaacuuuccgccccgucugcugaaagaauaaauucuuauuagcauagccacgcccacagaccgcccucccgcugagagcgcguggcgccgcucagggcaaagcacaggucucucauuagcauagccccgccucauucggaauuccccuucgcagcgaacgccguucccuuucccuuauuaacauagcuccucccuuucuuuggcccgucccccuccuuaaguguccggagacgcgagcccuccuugccagagcucaugauuaugcaguagccucauuagcguagcccgcccccccgggucccgcccggcucccccgcaggcgguagcgaaggcagcagcagcgguggcgacaugagcagcggggcggcguccgggacagggcgggggcggccccggggcgggggaccugggcccggggaccccccgcccagcgagacacacaagcugguggucgugggcggcggcggcgugggcaagagcgcgcugaccauccaguucauccagguagugggcccucacccgggagggugucccccgggacccagaacugagcccuuggggggauccccgagaccccuuuucccccuugacccaucacugagacccuccuauaaggcccucuaaucuuaaaagauccccacagauuguaaccuaaacucuuggagagccuccauccccugcacgggggacccuuccuucugcacucgcaucccgagacccacuauucccucucccagugccuaagaccccgcuuaccugcugaccuggcuuugagcaccuccugggagcaugcuaaauacaaaauacucaccccauucggacccuaagcacucccaggacccccaccacgcccuuggugccaccuuccaccacccugagcccuaucucccccaaaucccaguccccaacuuccccucuaagccauugagagccuuccugggagaaugccagugcccagcaccuuugagauuccaccacguucgauucuuuuuuuucuuuuuuuuuuuuuuugagacagagucucacucacucugucacccaggcuggagugcgguggagugcaguggugcgauguuggcucacugcaaccucugccuccuggauucaagcaauucuccugccucagccucccaaguagcugagacuacaggcgagugccaccaugccuggcuaauuuuuguauuuuuuaguagagacgggguuucaccauauuggacuggucucgaacuccugaccucgugaucggccugccuuggacucccaaagugcugggauuacaggcaugagccaccgugcccggccccacguuugauucuuagccccuuccaugacugcccccagaaucuagaaauucuacccagacccuggcccugagacucuucugggacuacccaguccuaagagaguccugcucuccgacccgagauuuaaaaagacauccugccccuuggccauuccagaaaucuccaagaccccaaguccugacaaucccccauucccggaggcccaaaccuccacucucccaccccacccccaaggaaaaccagccccuccuccaucccaugcuuucuccgcugcaacucccugagccccucucagaaacccugaauagcucucaaaucaucuccauggaagaagcccccagauucuuggcacccccagaaagaucuauuccuugggaguuucucugaccccauaaaugaacucaauguuucuaagacuguauauacuauaaccucccaaaaccccugagccaccuccgggcuggcucccaguucucagcccugagcuucucacgcugugcucugaggucacgccccuaacuacccccagagccacaaucccucccagggcuugauccuuacagccucccuccaggacaagccccucaccaagcaccccucuaaccgacagaugcagccuucagaccccuagccuccacaucacccccuuuccugaaauuccaccccagcccaggaaaccuccuccccauuccugagggagguccucccagcuucaaagaaauccuagaaaagugucuuggccugacaugcuaccgcagaggccccggggccccaggacaccccccucacccccaccaagagaccccuucaagggccugggaggaagcccugcuuguguagagaaaggccccagcccugggccccuugcacccagaggcagucccagagcuggccaaaggcuuggcuggcagcgggcaggacccaggcag

SEQ ID NO: 15161 - RNA, 4885 nt, Homo sapiens
cauuagcguagcccgcccccccgggucccgcccggcucccccgcaggcgguagcgaaggcagcagcagcgguggcgacaugagcagcggggcggcguccgggacagggcgggggcggccccggggcgggggaccugggcccggggaccccccgcccagcgagacacacaagcugguggucgugggcggcggcggcgugggcaagagcgcgcugaccauccaguucauccagguagugggcccucacccgggagggugucccccgggacccagaacugagcccuuggggggauccccgagaccccuuuucccccuugacccaucacugagacccuccuauaaggcccucuaaucuuaaaagauccccacagauuguaaccuaaacucuuggagagccuccauccccugcacgggggacccuuccuucugcacucgcaucccgagacccacuauucccucucccagugccuaagaccccgcuuaccugcugaccuggcuuugagcaccuccugggagcaugcuaaauacaaaauacucaccccauucggacccuaagcacucccaggacccccaccacgcccuuggugccaccuuccaccacccugagcccuaucucccccaaaucccaguccccaacuuccccucuaagccauugagagccuuccugggagaaugccagugcccagcaccuuugagauuccaccacguucgauucuuuuuuuucuuuuuuuuuuuuuuugagacagagucucacucacucugucacccaggcuggagugcgguggagugcaguggugcgauguuggcucacugcaaccucugccuccuggauucaagcaauucuccugccucagccucccaaguagcugagacuacaggcgagugccaccaugccuggcuaauuuuuguauuuuuuaguagagacgggguuucaccauauuggacuggucucgaacuccugaccucgugaucggccugccuuggacucccaaagugcugggauuacaggcaugagccaccgugcccggccccacguuugauucuuagccccuuccaugacugcccccagaaucuagaaauucuacccagacccuggcccugagacucuucugggacuacccaguccuaagagaguccugcucuccgacccgagauuuaaaaagacauccugccccuuggccauuccagaaaucuccaagaccccaaguccugacaaucccccauucccggaggcccaaaccuccacucucccaccccacccccaaggaaaaccagccccuccuccaucccaugcuuucuccgcugcaacucccugagccccucucagaaacccugaauagcucucaaaucaucuccauggaagaagcccccagauucuuggcacccccagaaagaucuauuccuugggaguuucucugaccccauaaaugaacucaauguuucuaagacuguauauacuauaaccucccaaaaccccugagccaccuccgggcuggcucccaguucucagcccugagcuucucacgcugugcucugaggucacgccccuaacuacccccagagccacaaucccucccagggcuugauccuuacagccucccuccaggacaagccccucaccaagcaccccucuaaccgacagaugcagccuucagaccccuagccuccacaucacccccuuuccugaaauuccaccccagcccaggaaaccuccuccccauuccugagggagguccucccagcuucaaagaaauccuagaaaagugucuuggccugacaugcuaccgcagaggccccggggccccaggacaccccccucacccccaccaagagaccccuucaagggccugggaggaagcccugcuuguguagagaaaggccccagcccugggccccuugcacccagaggcagucccagagcuggccaaaggcuuggcuggcagcgggcaggacccaggcaggaagggaggggcuggggcccgaggguggggcagccucuccgcagccggauuggaaccgggaccuuccccugggaggagacgcuggaggccgccugagcaggagaaggagacgggggaggaggagacgggggaggaggaagagagggaggaagcagaagaggagggagagauauaaacaggcagucuggacaacaacgccuccgauaacugauacauucaauauuuaaugggguuuugcuccgaaucuugccagugcuggauggaguguagugcuguucuuagccuccuuuuucaaaugaggaaacugaggcucagagaggggaagugauuuguucagugucacacagcuaggauguaaucacgaugugggacauguaccuuauaccagaaagagaggaccaggagugacucagagagaagaagacugguaggagggguggggggcagggaaaggggggcaggggagcagcuacccaaagagaaggggacagagacccagagagagagaguaauagagacucagagagacagaggggacagagacccagagaaaagggggcagagacccagcaacaaggacagacaucuggagagagagagaaggacagggcagggcgcaguggcucacaucuguaaucccagcacuuugggagacccaggcgggcggaucaccugaggucaggaguucgagaccagccugaccaacacagccugaccaacacaucucuacuaaaaauacaaaauuagccaggugugguggcgcaugccuguaaucccagcuacuugggaggcugaggcaggagaaucucuugaacccaggaggcggagguugcagugagccgagaucucgccauugcacuccagccugugcaacaagagcgaaacuccgucucaaaaaaaaaaaaaaaaaaaaaagacucagagagacagacgggacagagacccagagaaaagggggcagagacccagcaacagggacagacauuuagagagagagggacagagacugagagaggcaucccaagggcagggcuucguccugucugccggggcacugcaguaacuauccucuccccaccccgccaguccuacuucgugucugacuacgaccccacuauugaggacuccuacacgaagaucugcaguguggauggcaucccagcccggcuggacagugagggcggcaaggauggaugauggauggggguggugucagugggggcugagggcucuugggggugacugcggggagccugguccccacgauggccccucucccugucucugcaguccuggacaccgcgggccaggaagaguucggggccaugagagagcaguacaugcgugcuggccacggcuuccugcugguguucgccauuaacgaccggcagaggugacagggguugcugguggcggagcaguggguggguguggggaggaccugggcucugcagcuggcuggaccucaugccuccggcuucacucgcaguuucaacgaggugggcaagcucuucacgcagauucugcgggucaaggaccgcgacgacuuccccguuguguuggucgggaacaaggcagaucuggagucacagcgccagguucgggacaccccucuuucuggggaccccaucucagucugggaggcuccuuccagcacaccugucccccaucagcauccuccucuguuccugcagugcugcgacugccacugucacacagcucaccuagauggguuacccccaaacuggaccuucaggguccccggcaucaccgagcagagggccuagcaugcaaguguccucaggagaggcugcuggacggaacaaaggacauucaccccccguccgccagcucucuuugccccuuccucgcauuccucccuuccagccaaccucccaccagccccagcaccuccccugcucauggccggcccccuccauggcuccccaguuccuccccaggugccagaugccccgcacaguugcgccccuccuuucccugcucccaucacuucccccacaacgauuuccacacagaacucauccaucuggcaaaggcucuggggauuuccaggcuuugggguuccgccugccucugccgggaacacccugacuucccugccugcccacuccugguuaucuaaggcauagcagggcaagugcccacgaagccugcccccaucccuuacuuagaagacaccaagccccugcggcaucucccuccauaaucucucaggagcucuuccucuuugaguucucacagugggucaccucuccuagaguauccagccugccugucugucucucuggcugcggucacccugagugcagggaccugacucccccguguccccccuacccccaggucccccgaucagaagccucugccuucggcgccucccaccacguggccuacuuugaggccucggccaaacugcgucucaacguggacgaggcuuuugagcagcuggugcgggcuguccggugagccaaguccccuuccugucguccuuguccccagcccuuccacuccaaacucacuggcguuuucccacaggaaauaccaggaacaagagcucccaccgagcccucccagugcccccaggaagaagggcgggggcugccccugcguccuccuguagcccaggcaagagagaagcaaccaccacaagcucucgggacuagcugccuucgcaccuugcugugugaccugaggcccucacugagccucaauuuccucaucugggucucccaggacacaucacauacccacccuuacuuccuggccucuucugggcuacugccacugugugccuucugccaacgccuccuguccccaccuaagccuggugggggugaggggcuccgggucacugcuguauauaacuccccucccccagaaaaauaaaugucacugccaacguca

SEQ ID NO: 15162 - RNA, 637 nt, Homo sapiens
ccccagagguaccaccugcagagugucauccgcaccagugccagccuggaugagggugccacugcggcacuggagcugggccuggggaggcugaaggagaagaagaaagggccagagcgggguggcgagacccccgaggggcuggccaccucuguuguccacuacggggcaggcgccaaggagcugggggccuucuugcaaaagagcccuccgcccccaccucccacggcccagucuacccagcccacuccccauggccuccuucuggaggccgggggcccugaccucccacuggugcugccuccgccucccccccagcugcuccccucgguccucagccaugcccccagucccucucccagcgccuccaaagucggcguccaccuccuugagccagccacccgcgauggggcaccccagccaccuccaccgccacccccgccuccaccacccaugccccugcagcucgaggcccaccuccgcagccauggccuggagcccgcggcccccagcccccgccugcgacccgaggagagccuggauccgccaggcgccaugcaggaauugcucggggcucuggagccgcugcccccggcgccuggggauacuggcguaggcccaccaaacucggagggca

SEQ ID NO: 15163 - RNA, 4531 nt, Homo sapiens
cccaaggggugaggugagcgggcauugggaccuccccucccuguacucccaucucugcugcggcuuuuaugcgucucuccccuucgggucccacauauccucuggugcgcuccugccucaccgcccccaccccaugccugucguccccaccucugugugaugcgcaaaguacaccuguuucuauuguaccugccucucgcgguggucugugcucuccccagcucugcaaaaccccuccuccccaugugccacaacccugggccaccguguguccuguccuguuccucucaaggcccccaucucugcggccuguguguauugggccgucuccggacgcuuccugcccacuuccuucccagcagccugggccccgguaccacugaacaggcuccaggggagccucaugaugccacuugcccacaccaccaauuuccuuacugcgauuuugaggcagcuggcgcagaggaaguuucuagaaucugagaccuguaacucagcuacucacugggacuucagguggagggcuuggccucucccagaugaguuuccucaucugcagauaggccuggugcccaacuaggcguguguggugcgugcauggggcccccauccuuggcuguaaggagggauaggaggcccaggcuaaagccaagaccuuuacacuucacagccagacaacagggccucagcacaucccacucuaccugggugagcccaugcccacagcaggggggggcugcagcuucuuccccuccccacccgagguggucaggaaagagacagaccagggccuggaggacccaggggccuccgccgucacucacuuccuccccagagaccggagggggcggggggacagcgcaacgccagguaaucagccuuauucagacaccgaaaaggugacaaggaccaaagaaggagacccaggggaaggcaggcaucucaguucaggcuccacuguccucacccacagacaugggcaggcagccucucugacagcagcucugcccaauuccccgaggcacacccccacccccaccaaugcucugguaaaggcgcggaagaucccaagucuggccugggaaugagaaaauaacuuuauuucauuguggggagcgggccgauguccagccucagaacuucuggaacugcuucuuggugccggcagccuuggugaccuugagcacguugaagcgcacugucuugcucagaggccggcacucgcccacugugacgaugucaccgaucuggacgucccuguggaggcagguagggccauguccucaggaggggccaccccagcagaccccaggaggcccucccuccccuucaccaggcuaaaggcucucugcuucggcuccaccaaaccccaaccaagcucuacucgccaauucaaccuguccccuccuuucguacaaguuuugugccaagcaccaagcucaacgcuguacacagagcaggccaccaccccuccgaggaccgcugggguggacgagcuccauuucacaagcaaacuggaggcccccaaguugucagcagccucaccacccuuccccagcagagcagcagggggauccugcagcacugacaaccacaggucccuuaucgcucagcaucaguuugggccacccuccucuccacccacaggacuccucaccuugcucccaagauccuccccgcccagagggccaccaauaucagcugcccacauccccauucugguuauacuuggcugucaucuggcacccacacugcuugaaggugcccucugagggagcaggacuuuguuccuggcucaccacugaaccccaaacaucucacaccacaccugguacgugauaagcucuaacuaaaacaugcugagggaaugaacaaacguuuaauuccaacauuucugagguucccaucugguaugacauccuaaccuuuugguucaaacgcaccugccuauuacagguucagcacccuaauccaaaaauucugaaacgcugcaaaaucugaauuugugugugugugggagagacagggucuuacucugucgcccaggccggagagcagugcugccaucucggcucacugcagccuccacuuucugggcucaagcaauccucccaccccagccgccugaagaccugagacuacaggcacaugcuaccacaccuggcaaacuuguauuuuuuguagagagaggguuuugccauguugcccaggcuggucucaaacuccugggcucaagggauccuccugccucagccuccuacagugcugggauuacuggcuugagccacggugccuggcuagaaucugaaacuucuucaauaccagcgugacaccuuugcuuuccaaugguucaauguacgcaaacuuuguuucacacagaauuauaaaacgcacugcguaagacuacuuucaggcuaugugaauaagguguauaugaaacaaaugagcuucuuguuuagaccuaugucacauccccaaaacaucucacuauguaugcgagaacauuccaaaaucugguuccaagcauuucagguagagauauucacccuguagaacgcuuugauucugaagaacauaugauauacaaauccugagauucuggggcuucccagagaugccaccucagucuuucccucccucaguuggccuuaaauugguccgaucuggaaucugaaggcugagagagcguggccugagcaaccugaugggccacugcgcucaccugaagcagggggacagguguacagacauguucuuguggcgcuucucgaagcgguuguacuugcggauguagugcagauagucucggcggaugacaaugguccucugcaucuucaucuuggucaccacgccuaggagcgggggccgaucauaggucaggucccaugggaaagagggccauagguaacccagggcaugcugggacucagaagcagcugagcagggaucccaaaaagccccauuuccggcaucaguuuuaccaaguggcuuucucagcagugcccacgugggcaucugaagaccaucgugaaaacaaacaucaucugccaauguaccuggaccuacaaguuugcauuccuaaccaccccucucacccaggacccaggagucugggccccaagacccuucuuucaguauuucaggccccagacaccaguaacucccgcacuuaccagagaggauccgcccucgaauggacacauuaccagugaaggggcauuucuugucaauguaggugcccucaauagccugaaaggauaggaaagauaaaggagugagccuugggcgggcgguuccuuaaaagagccaggggcguggccucagggaagcaacuacaauucccagcagccccagaagccacuuagaugcaggcagggcaacucgucgugggcacacgugcaggaacgccagguuccccuucuuucuucugagguuccccgcaccuccuugggugucuugaagcccagaccgauguucuuguaguaccgcgggagcuucuccuugccaguuucucccagcaggacccucuucuuguuuugaaagauggucggcugcuuuugguaggcacgcucagucuacagauuaugaggagaaaacugaugagcugcuaaguuugaagccggcagccaaccagcccuagagaccuucccagaaccucccagaccccaugcucuacauuuacuugcaaagcgccggcguccaaggccuggugccccagaaucacccucuaagacaugaccacccugaccuuaccuguaauucauacucagaucuaagcccgagguuauuucaauuuauauacuccagaaggccucucagggauugcaaaauucauccucuaaaccaggaucaacccucucacacccuggacaccuuucagcgaggaucauucuccaagacccaagaucgcccacccaggauucacuccuuauguaguacauaaggauucagaauuaaauaccagacggcaggcucccuggauuagcccuuaggaguccguuuccacagaauuaccccugaagaccggagaacuccaaaaaaaccuucuuaaacuugguuuuuaagaagguaaguccuaaaacgcuugagccuccauuaacgccaggagcccccaggaauuaggaagcacucaucuagaaacaaaagcaagcgcccuccacuccaguuaaucucuagaaaauaaucacggacgcccggaauuaacccccgaacuuggccgccgggcucugcccucccggacgcgccccugaaggccaaggcggaccccgcacccuggcauccaaccccgaguccgcaccugaauguccgccaucuucccggccgccugaaaaaaagaaaggggcagcagcguccggguuuccuuaucgauuacgcaggggcuggagaggaagugacguaaggagaaacgcagcacggccuugggcggggccucgagagcugcucugauugacaggcugcacuuaaaccagcgggcgauucgggcacugugaaggacugacgggcgggaagugcuagacggugucucgcgaga

SEQ ID NO: 15164 - RNA, 7225 nt, Homo sapiens
ugagcuaccgcaguggaugacgggacuccccgcgaaaaaccgggcgcccaggccuggggaacgcagcgagcagcgccggccgggcagacucucaccagugcgcaugcguggcucuccggcaccgguccguacuccagcgaggugaagaucucgcgggcgcggggcccugcacgcgucgcagccaucgccuaccccgaacgcuuuccgcgaagacugcggggcgcucuguguuaaggggaaccuugagguccgaagagcgacaccuccgguuccagcccaaaggggcggggcuaaugggaaugggguggggcuacaagauacagagagcagccacgcccacacuuuuuccuuaggacccgauggccccgccuacgucccccacggggaagcguauuuaggagcaugcgcacugcuuaaaacggggaggaaggggagacggcgauguggguacuuugcgaauaguuaggagggcuccggauuuaugaggaucggcguggccgggcacgauggcucuuggcuguaaucccagcacuucgggaggccgaggcgggcggaucaccuaaggucgggaguucgagaccagccugaccaauuuggugaaaccccgucucuacuaaaaauacaagcauuagccgagcugugguggugcgcgccuguaaucucagcuacucaagaggcugaggcgggagaaucacuugaacccagaagguguacguuucagugagccgagaucgcgccacugcacuccagccuggguggcaaagggagacugugucuaaaaaaaaaauaguaauaaaaaaaaagggucguccuauugaugcgucuucccagugccuuguuuuauaguagcaggaagugcagguuuuguuuuaccuuuuauuuucuugagacagggucucccucugucgcccagggcuggagugcagugguccgaucacggcuuacugucgccucgacuuuucagguuuaaacauuacuccugcgucagccugcacaguagcugggacuacaggcaggugccaucaagccuggcuaauuuuuuuuuuuuuuuuuuuuuugguagagacaggaucuugcuauguugcucaggcuggucucgaacuccugggcucaagcgauccuccuaccucggccucccagccucaaagugcagcuuuucuaauuauauugacuagaggucuagaucuagaucuagaccuggcgggucuagaucuggacguauuaggaucuagagcuggcaggaagugauaauucaaagauaaaaaggguaccuuuuaggauggacauugagauuaagguuuggaaaaugcaaccuucacugcaaaguaagggggccaguuuugguuguggaaagaguggaagucuggcgcuuuuuuuuuuuuuuuaagagauggggugugggacguuaucucauuguauugcccaagcugguuucgaacuccuggccucaagcgauccucuugcccuggccuuccaaagugcugggacuaccgguaggagccacagcgcccagccggaaguguggcuuucauagauacaggaaguguggcacucagggauccgccuugggguuuauuuuugauugaugcgaggggcguggcuugucgauaacgcgauaccagcuugugaaugaacacugggguacucggaaguguggcauacuccaguccuguguuuaccgauagaccggaaguguggcuucguuuacaguucggcacguaggacggaggguagugcgucuagagacacauauuccccacggauuugacgaugguguucggucuugaauggaaauguagucuuaggccagucuuagguuuuugaacaggauaguagguauccggagucgauugagggccagagcaggcacugggguucggauccugggcaaaguuucccacguugagggucucgaggacgccuagaucucuuucccagggccauggcgaacccgaagcugcugggaauggggcuaagcgaggcggaggcgaucggugcugauucggcgcgauuugaggagcugcugcugcaggugcagugaccggaccccuggauccuugaguauucggggauuuuggcggggugcucaaagaugggacugcaguucccagaaugcacuaaggcgggaaccaggccucggggaauugagguuaaugggcuucaaguuugcuaagaaaugggaguggggggccgggcgcgguggcucacaccuguaaucccaccacuuugggaggccgaggcgggcggaucacgaggucaggagaucgagaccauccuggcuaacacggugaaaccccgucucuacuaaaaauacaaaaaauuagccgggcgugguggcgggcaccuguaguccuagcuacuggagaggcugaggcaggagaauggcgugaacccgggaggcgaagcuugcaaugagccgagaccucggcacugcacuccagccugggcgacagagugagacuccgucuccaaaaaaaaaaaaaaaaaaaaagaaaugggaaugggguugggguuguucuucuaguucucaaaggagaaaggggaccuaaaccgucuaauuucucgcguuauccacagcucucaugcauaagaauugcuccauuugaggaacaaaugaggggucugauggcacagacuccgagccuggagguaguuuuccuuuauacaggccucgaaggagcuccagcaagcccagacaaccagaccagaaucgacacaaauccagccucagccuggugagaaaggacaccggagagagagggacaggagacccagggagaggacagagagaggaggaaggaaagagacacgaaaauaaaggccuaggguggggguggggugagcagacacccacagagaucauccuaggacagaaaggaguuggaggacagaguaggaguagguagggggccagagaaucagagauaggaagaggccaggugcgguggcacgugccuguagucccagcuacuggggaggcugagacaggagaauugcuggaacccaagaggcagaaguugcaguggguggagaucgcaccacuguacugcagccugggugacagagcgagacucugucucaaaaacaaaacgaaacaaacaacaacaacaaagauaggaagagaggcugggcacaguggcucacaucuguaauuccaucacuuugggaggccgagguggaaggauugcuugaggccaggcauucaagaccagccugugcaacauagugagaccucaucucuacuaaaaauaaacaaaauuagcuggacuuggugggugcgugccuguagucauagcuacucacgaggcugaggugggaggcucacuugagccagguggaagagacugcggugagccaagaucguaccacugcacuccaaccugggugacacagugagacccugucucaaaaaacaaacaaggagaaaacaaagaagagagggggccgggagcccagcacuuugggaggccaaggcgggaggaucaccugagggcaggaguuugagaucagccuggccaacauggugaaacuccaucucuacuaaaaauacgaaaauuagccgggcgugguggugggcgccuauaaucccagcuacuugggaggcugaggcaugagaauugcuugaaccugggagguggagguugcagugagccgagaucacgccacugcacuccagccugggugacagagugagagucugucucaaaaaaaaaaaaaaaaaagagaagugagggaucucggguggggaguggaacaaaaaagggggacagggcaaaaggaaaagagacagagccuggagacaauggauggggacugggacuugugcagaaaaggauugucaugacuaacccacucccaccagguuucugcauaaagaccaacuccucggaagggaagguuuucaucaacaucugccacucccccucuaucccuccucccgccgacgugaccgaggaggagcugcuucagaugcuagaggaggaccaagcuggguuucgcauccccaugagucugggagagccucaugcagaacuggaugcaagucagugcccucagaggacccaggagucuggcccgcuaggccccuucuucccuagaacccaagaauccugggcccaggacccuccucccucagcuccuggagaucuggccccucgaucugauucuuuucccuaugguagaucucuagugcccuggacaucccacacccgggcaguccugguucugccaccuggccaggcuggcacuuuuccaugccccacuccagggccgggaggccugggcagagugcucuucgugcauuagcggaucuccuggcuuuaguccugagccugcugucuccuucuuuuuucuuucuuucuuuuuuuuuuucuugugauggaguuucgcucuuguugcccagguucagacgauucuccugucucaggcucccaagcagcugggauuacaggugugcuccaccacacccagcuaauuuuuguauuuuuaauagagacgggguuucgccacguuggccuggcuggucucagacuccugaccucaggugauccaccgccucagccuccgaaagugcugggauuacaggugugagccacugcacccagccugcggcucucucuuucauccuguuuucuccucugcccuucucccuuucuccaucucugucuugccucaccucugucccuguuucugccucuauauccuuuuuucaauaugucucuugaagcuuucugggaccaagcucuaggcagugccccggggaauaaggaccuaugaaaugcacauuccacguuccagaaacucgcugucauggguggggcucaaggagauggaugcaguaucaauagggugugauucacgcugcuuuggaggggggcacccagcacagccuugagagggcucgucacccacaugaaggggucagggaaggcuuccuggaggagggggugugggauaagauuugaaggaacaggaggaguucagcaggcagacagaagaagguucuagguagagcggcccagagcugggagagaaugauuggauuggaucagccaguaauggagagugacugaaagaaauucagugggccgagguugcuagaagaaugaggucuucuccagaggugggaggggcagaccacauagggucuccaacgccaggcuuguggggcucagaccuucacuugggagcacuggggagccagagaagagcugugagcagggaagggauagggucaacucuagugacaucacacugauggacaggagauaagaggccagggaggaggcugggcggagaguccagagcggaaagugagugcccagcucucacuuccuuaugucucucucugcuucuuacggccgcugucccugaauguuucuucccugucugggucugggcugugggcuuccugcagagggcugggggguccucacccccuuuuucuccccgcagaaggccagggauguaccgccuacgacguagcugucaacagcgacuucuaccggaggaugcagguugggggcggggcugcgguugaggccugggcaggggucucuaccccuacccuccccgccaccgccugucuuuucccucucugucaccccagaacagcgauuucuugcgggagcucgugaucaccaucgccagggagggccuugaggacaaauacaacuugcagcugaauccgggugaggggcagguccugggcccucgggaaagaguggagccaggagcgguuuggggaacaccccuaggagaggaggggcuggcuugggcagggugcccuggagucugugcuacuaggaggggguggagucuggacgcccugagggggcggggccaggaacaucuccagggguggguuuuauuggggcauaucaugggaggggcgugacuaaggugggcgggcuuccuggagccaagccugcgggguguggucagaccccaagaguccuggugagccgguggagccuaucccgggaggcucuuggcccccacaaagggaacccugaccuguacgauguuugacggcgcuccugacccucagaauggcgcaugaugaagaaccggccauucaugggcuccaucucgcagcagaacauccgcucggagcagcguccucggauccaggagcugggggaccuguacacgcccgcccccgggagagcugagucagggugggccuucgguagauccccggucugauguuuccucaacgcucuugggaaucccucccuccauccucccacacugggugauguccuggggcccugggcacugagagagggaggagagagaacuccugacugggaaggcguccugaggccaauagggcugguuggagggagaaaagggacagcacgccaggcaaagaccuggcagcugugcucagcccuggaccuuguuccuccucaggccugaaaagccucaccugaaccuguggcuggaagcccccgaccuccucuuggccgaaguugaccuccccaaacuggugaguuuugcgcgcuggaccagagcaggggaaugaggucuggaaaggucagggacugucucugagugugagugacaagggguuguugcuggacuugucaguugcguccucucugccaggaggcccacaggccaccuucuggugcuguccugagggcgcccaagggauuguaagugcucggucguugagacuuguaauugcugucuucugucucuuccugggagauuagacccuucaaauauaguuucccagcgugugaggcuaccaugccugguccaggugaucauccuguugcuggggagggugaccugauuccgccaccucuccaggauggagcccuggggcugucgcuggagaucggggagaaccgccuggugauggggggcccccagcagcuguaucaucuagacgcuuauaucccgcugcagaucaacucucaugagagcaaggcagccuuccaccggaagagaaaggugccugggggaggggcuuggggaagcugggacauuggcggggccuggacucugucucccagggaggggggcugggagcuggacuucuggguccuggauccucauucucuuugcucugucuccucagcaauuaaugguggccaugccgcuucugccggugccuucuugaucagggugucuccuugugcuucugagauguggagaagaggcugcuggcuucccuaaaaguugaaauaaaagauuuuugccuuuguucugu

SEQ ID NO: 15165 - RNA, 12162 nt, Homo sapiens
ugaguccugugacagcccccgggccgccugcacuugcagccuccuuccccccgagcggagcugcggggccggccgggccggggcuggaccccgggaacccggacgcggccgcccgggcccgcgggcggggggaucggcgggggggacccgcggggugaccggcggcaggagccgccaccauggaguuccgccaggaggaguuucggaagcuagcgggucgugcucucgggaagcugcaccggugagccuggcgggggucccgggagaagagugggaggaucugaggaggaugcuaauucccaccugggcgcagacugacagaugaacgggcgauaccccggcauggggguccacccaucuguccaguuuucugccgugggcuccgacggcgcuguucucccuggucgagccuuguccauuauccuguuccuuuuucugcaccccaccccacccggcuccacucucucuggugcuguaaaugccucucucccgggucucuggcuccucccccaccacuucugggucucuguccccgucucuuucuggaugucucugccccuuuucucucugggucuccgucucccucuuuuuccagaucucggcucccuucucucugggccccuccuucucccuagaucucugccuccgcuucuuugcgucucugugccccucucucugguucucuggccauugcucucacuggaucucuaucaacuccugacucagagucucugucccccucuuucugggucucuccucuucccuggaucucugguccccacuucucugggucccuguccccgucucuguguuuuaauucucccaccaugggucucuccgucucucugugucuuuuuccguuucugucuggcauggaguuuaaucugcagcuaaagcggauuggggcucauagcccguuguccuugagggggugaggcuggguggaagaagucacagcacccugggucccugggagagaaaggaguuagaggccaaaaauuucggcuccugggguaggacagccuucccaaaggauacaggcuggggcugacagggacucccucccaaccagguugaugaccccagugaaccgagugucccucaggauaaucuggacaccuccccacaggcucucacccccaaccccagcuuuggcucuaagucagauaaauuacucagcugcggaaaagccuaaaaauauaucuggccacagugcacgaaggagauggccucaucagcaccaugccccugccgccgugcccucaggcccuguccccuuggcccacagcccugacccuguguuucgcugagcuucaguccaccucgcuaggccauggggguccuuugcuaagucuaacaucagucuugcuugcugcagaucaccucuuagcuccaaaguuaccccacccucuaguaacaugagagacaagaauaaggcuggacagaaguggggggaggugggcaggaggauggugcagugacggagguuggugguggaggggaagcugagauaaccucaccccuucuuuuuccaauuuuccagccccuccccacccuuuuucucgccuccuuucacgaguuucucaaaauacaucagugugaagucaggagaaugagagagagagaaagagacgugcugguggagggggcugggggguggcagcgggagggauguauuccucaggccccucccucagucucugccucuguuucucaucugugcuaggguuucucacagucaaucucucuggcucucacucucugaguuaccucuuggguccccagagacccccgggcucuggccaggaccaucagcagggaguuugugcagagaaaagcauuugcuuccaaugccugggguuugcucugaugguuggagggagaggggaauaccccauauuagagacaacagguugaucucauuuaauccucuagacaaagauggggaaacugaggcuccauucugggguuggggagaucaguggaugaguaugagccccaugauuugaacccaggucagucucccucccaagccuagaacagagcucuuccuugagaagagugaugccacagcugguggggagcuuccuugcacccagggugacuuggaacaaggacaugggggaaugggaugccagagagaugagaacccaaggugccuccuuucugagagccaggucuugggcagggggaugccgagggccaguaagggaucaggucccauugcuguucuugucugugaccuuggagugccacuucagcuccccgagccucaguuuccuuaguuguacaaugggaagagaagagagagcagagggacauaaggagacaaagacgugggggaguggacagagauccugagagaagcagagagagagagagggagagacagagaaguugagacaucucaauuugggguaauggccuccuaaguguuguuuuuccucaucgccaaguccccaggccugaguuugggguauccagggaggggagggggauuuacaucuagggucucccuucucuguccuuguccccugcaaagcaucagggccaccuucaucucuguguccuugguccucuugcucuaaaaugauugauaucaccuugaaguucccucuuuauucucuugcauuuuugcccuugucccauuuuauagaugugggauacugagacccccuguuuagacagccuugauuagagaucugacaucuccucauauuaacaaggaaucucacaucaggggcugcaaucacaucuugaguuucagggucaaauaucauccgaugucaaccugggucagucuaaucucuuugggugauggguucugauggguggggggaguuacugccauccuguacuauucguccuaguggcuucaauccccccuaucucuggcucucugucuucuuccucuuggggucucauuccuacuccuucuggguucuguccacucccuggcuucucccaccccuguuucuuaacugccccuccccaccuccuuaaguucuaggauggggagggguugcuguguucucacagcucuuccaccucccucccccuggaccgucuggcuguuccuuccucccccgucccagucucccucgccuccaucuguuccagccccuuccugggauccagcccgauccccuggcugccuacccaccucagagaggggcugcaccucacaaaucacguccccagccugucuauccuccgucucccaggcucuccaucuuucucuugcauucuggaucucuguucucaucucucugcaucuauguucuaucuccuggguuucuguccccgccucucuuugggacucugucugcuuccuucucuagguuuccaucucuucccucucugggucucugucccccuauuucuaggucucucucccccucucucugggucucugucucccucucucugggucucugucauccucugugucucugaccccuccaucucugggucucugucccccucucuaucugggucucuguuccucucucucugggucucugucucccuuucucucugggucucugucccccucuuucugggucucuggcccgcuaugucucugggucucugucccgcuguaucucugggucucugucccccucucucucugggucucugcuccccuguuauucucucucccucucucugggucucugucccccucucuaucugggucucuguuccucucucucugggucucugucucccuuucucucugggucucugucccccucuuucugggucucugucccacuaugucucugggucucugucccccuguaucucugggucucuguccccuucucucucugggucucugcucccuuguuauucucucucccucucucugggucucugucucuuccucucuagaucucugucccccuuucacuggaucucucucccuucuucugucugugacccccucucucugggccucuguacaacuccccccaucucugucacccucuuuuugggucuuucuccaccugucugaaggcaccucucucucucugcagccucucucuggguuugaggcagcccuccaaauacccucuucgucaucacagacuugauucuggauccagaacgggcgggggcgagagucacgcuggggaaugagccaaucccccuaccagggccaucuguccccugccaggacaccacccgccacucccccucccuacccccuaggcuggcagccuggacucaagguucccuagggaugccugggacgggcugcuggauucccaggguccuggacaucuccccacccccuagcaaacguggcugagaagcaucuguucuuuugacaccuuugcugaagcaucuccuuagcaccuuuugcuuccucgaauagacucuuauccgggagaggcggcuggagagucuuugggccucggagugggggcacaggcucuugaaucccaaaggguugucuggggucuaagucuccugaguugaaggauuugacagagcugggagagggggacugaagaccgucaaugugaagaaggagggggcugggggccugaauucccggucugagggagauggaggauuucuggaucaggggggcgaagggagccagggaccuggacucuuggugaaggaggaggugcgggcuuagaauucuggauguugaaaagcagguuuugcccuggauccuggucuugggggugagggggcugggggccuggacuuccgagucucuggcucuugcugucccgcagccuucuggagaagcggcaggaaggcgcggagacgcuggagcugagugcggaugggcgcccggugaccacgcagacccgggacccgccggugguggacugcaccugcuucggccucccucgccgcuacauuaucgccaucaugaguggucugggcuucugcaucagcuuuggcauccgcugcaaccugggcguggccaucgucuccauggucaauaacagcacgacccaccgcgggggccacgugguggugcagguagcucaaggccugagcccuugcagagccccgccccgcucaccgagcuccgccuacgcccccaugacgucacacucacccaccagacguccaggccacgccccuuccgaaacgcugucggaauagcuccgcccaauccgugcgccccuuaguucugaccucgccuuaggggccgccuccguuuccuaagccccguccugaucuaaaugaagucccgcccuuauuuccaggggcuugauugaaaaauguagaguccgccccaacaucagguucccuagggguugccccugccccauuuuggaccuacuagcaauuuugcucacgccuguaccccaagcucauguccccgggucacaucuauuuaaucucagucccaucucagguuccucccugaaugugauccuuuuuugaaacccugccacugccuacgucccacugcauguguugugucccuuaucuaaagacccacagggucucccaggcuacggugcaguggggccauugcucugucgcccaagcuggagugcaguggcaccaucacugcagccucgaacuccugggcucaagugacucuccugccucagccuucugagcagcugggacuacaggcgugcgccggcauacccagcuaacauuuuuauuuuuaucuuuguagagacaaggucucacuauguugcccaggcuggucucggacuccugggcucaagcgauccuccugccuuggccucccaguccugggaguacaggcgugagccaccgugcccuguccuuucuccuauuuuaauuucagcauaggccuugccccugcaucagaaaagaguccugauuugugccuuuguccuaccugaaguuccuccccuugcucccuuccaaucugguccgcccccuuggcugcuucguguccccgccuggacccugugcaggucacuccgcaaacgcucauaagcuggauauaaguggagagagucaucaucauacaugggccccuaggcuuucauggaggcaaggaagcaggcaaagcaaggcgucuagguggugauggacucuguuguuaaggcagcauaggcccuagcaacguggaagagcggaguuuguagacuuuaauugacagaaagauagugugagcuuugauuggcaggcuuuuggaggugggagggguuccucguugcugauaggucgagacgcuaagucugugggugcugauugguggagcggcagagccuggacagggcggcugauuuaauguacauuuuggcccgcagaaagcccaguucagcugggauccagagacugucggccucauacacggcuccuuuuucuggggcuacauugucacucagauuccaggaggauuuaucugucaaaaauuugcagccaacagguacagugguggggucucaaagugggcgguaacuacaguuguguggguggaguuagagggcguggucuugaauuugcgggcuggcucugguaaaugggagaagccuggauuugggggugggucuuagagaaagguggggcuugcgauugaggaagguguaagucagagagguggugggaccuggggucccggggaccacugggccuagcuugcugugggcgggaaaggcagaaucccgggcauggcuggauagcuuggauucuuuucucugacccuucccaucagaguuuucggcuuugcuauuguggcaacauccacucuaaacaugcugauccccucagcugcccgcguccacuauggcugugucaucuucgugaggauccugcagggguugguagagguaaauccccgccugauaugacccugcccucgcucggacccugccucuucucagugaccuugguuuucuccucuuuagggggucacauaccccgccugccaugggaucuggagcaaaugggccccacccuuagaacggagucgccuggcgacgacagccuuuuguggugagaggaagagggauccucacuccugaaucugagggaggagggguuggggccuggacuguugggucugagcggggaggggcugggggggcugaacuccugugucugagggaggaggaggagacucuggaccuggacucccaggucugagggaagaggggcuggggcuggacuccugggucugagagaggaggggcugggggccuggacucuugggucugagggaggagggacuggaggcccgcacuccugggucugagaggaggagcugggggccugcacuccugugucugagagaggagggguugggccuggacuccugggucugagggaggaggagcugggggccuggacuccugggucugggggaggaggagcugggggccuggauuccuggguccgagcgaggaggggcuaggccuggauuccugggucuaagggaggaggggcuguggccuguaauucagugucuggaaagggggaagcgguggggguccgcacuccuugaucugagggaagaugggccuguucucucccccgcauccucccccuuagguuccuaugcuggggcgguggucgcgaugccccucgccgggguccuugugcaguacucaggauggagcucuguuuucuacgucuacggugagggacccggaugccugguuccggguggcgcuggggcggagcggggccgguccucaccucgcucccaucccccuccugacccccccaggcagcuucgggaucuucugguaccuguucuggcugcucgucuccuacgagucccccgcgcugcaccccagcaucucggaggaggagcgcaaguacaucgaggacgccaucggagagagcgcgaaacucaugaacccccucacgguccgggaccaaaucuucggggaaggggcggggagagauagcaagccacgaaccugcacagcguguagaucagggacgguuccugcagacucuagaggagacgggacuggaacgcaaagagaggggcuagaaccuaggaggcggguugcaacccgcggaggacgagauucucaggugcugggggcaggguuaggucgggaguugagcaggauuagaaccacugacagggcauaguuaaagccagcagagaagggauuagaauguggggguuuugcuuagaccuugaguugaggcuguauuuugggagcauuuuugauaaaaagagacuccuagggcaggcucaguggcuuccgccugcaaucccaacacuuuggggguggaggcugcaggaucgcuugagcccaggaguuccagaccagcuugggcaacauggcgaaacccccgucucuacucaaaauacaaaauacaaaaaguaaaaauaaaaagaaaaaaagaaaaagacaggucccugaggggcccggacaccugcggaccugagaggcuaccauagggccaggaccccuucaucacucaagugucaccuugaggcuaggaucccuggguccccacggcaacaugguguagcccgcgccuuuggguccauagaaguuucagugcggucgggauccuuugguuucugcagaacuacacuguggucccugaagggacgcggagaagcccucagccccgcuccccgucuuagcggcccuccccucgcccccacagaaguuuagcacucccuggcggcgcuucuucacgucuaugccagucuaugccaucaucguggccaacuucugccgcagcuggacguucuaccugcugcucaucucccagcccgccuacuucgaagaaguguucggcuucgagaucagcaagguagagcccaggaggagagggcaggggggcgcggaggggucggcgggagggaacuggcggcgaucccgaggcagggaggagccgguggugcacggaccgggcagagacgccgagccggcggccccgaacccuagugucccuguacaccuguucccgcagguaggccugguguccgcgcugccccaccuggucaugaccaucaucgugcccaucggcggccagaucgcggacuuccugcggagccgccgcaucauguccaccaccaacgugcgcaaguugaugaacugcggaggugaguggggcggggccugggccggcucuaggacagccuggguggagcagagccggauugagaggugauggggagugguuacaggcggaaaccauccagccugccccaggagucccuuucuaugcaaagggccguggccaacaggguggagccggggcagggcaggccuggaugaaagggacugucacgcggccguccaaggggccaccgcgcggaagggcagggugggcgagacuucccggguggagcagagagaagaccgaguugggccuggagggacaagaccugcacaaaguugggugugguaggacaugaacuaggugaugaagaggcgcuaagagcaaggcaccuggagagacaggguccuagggggccugcugucuaacaagugagauuugcuaggcgugguggcgcgcgccuguggucccaucuacuugggaggcugagaagggaggaucgcuggagcccagaacugcgaggccgcagugagcuaugaucgcgccgcagcacuccagccugggcgacagagcgagacuuuguuucuagaaaaauuaaaauuacaauuaaaaauuaaaaaacaggcagggcaugguggcuaaccccuguuaucccagcacuuucggaggcgaaggccgguggaucacuugagcucaggaguuugagaccagccugggcaacgucgugagacuuugucucuuaaaaaaaauaaaaaaucaaaaauuaaaaaaaaaaaaaaccaaaaacucaugaguggggauugaggggaaggugugagcgugcacagcagggauccugcguguucggggaguggccuagucaagggguggagcuacgggaggggcgauggagcuggugggcguggucagggcugggucuuggagaaguaggggccugguuagggugggugcggguggcguggagggcgcgaagaggccugggcguggagguggccagacugggguggauagacgcgguuuggggcuggagcaggucuggaagggcgguguggggcagccugcgccuugcuccggccgacacucaggagacgcgggccccccccgcccccguaggcuucggcauggaagccacgcugcuguugguggucggcuacucgcacuccaagggcguggccaucuccuuccugguccuagccgugggcuucagcggcuucgccaucucuggugagaaccgcggauccgcagcuugggggacucuggucagcucuguagggaacuuccuggcucaggaacggggccucucagccucacaaaagguggaacaugaguggcggggaggggagaggguugagaacgucccagugggaaucacucgagugagauuccggugugacgccuuccgacuugucucuccgccaggguucaacgugaaccaccuggacauagccccgcgcuacgccagcauccucaugggcaucuccaacggcgugggcacacugucgggcauggugugccccaucaucgugggggccaugacuaagcacaaggugggugccgcaguccugacucagucugccuccaagugugugcuucguaccuaacugaccacgugguggcacugucucuggggugccaucccugccuuuucagccucccugggucucugccucccuuccucuaggccucccccucucuccgccucuguuucucuguccucccauuugaccucagcccuauuguccccugcagacucgggaggaguggcaguacguguuccuaauugccucccuggugcacuauggaggugucaucuucuacggggucuuugcuucuggagagaagcagccgugggcagagccugaggagaugagcgaggagaaguguggcuucguuggccaugaccagcuggcuggcagugacgacagcgaaauggaggaugaggcugagcccccgggggcacccccugcacccccgcccuccuauggggccacacacagcacauuucagccccccaggcccccacccccuguccgggacuacugaccaugugccucccacugaauggcaguuuccaggaccuccauuccacucaucucuggccugagugacagugucaaggaacccugcuccucucuguccugccucaggccuaagaagcacucucccuuguucccagugcugucaaauccucuuuccuucccaauugccucucagggguagugaagcugcagacugacaguuucaaggauacccaaauuccccuaaagguucccucuccacccguucugccucagugguuucaaaucucuccuuucagggcuuuauuugaauggacaguucgaccucuuacucucucuugugguuuugaggcacccacaccccccgcuuuccuuuaucuccagggacucucaggcuaaccuuugagaucacucagcucccaucuccuuucagaaaaauucaagguccuccucuagaaguuucaaaucucucccaacucuguucugcaucuuccagauugguuuaaccaauuacucguccccgccauuccagggauugauucucaccagcguuucugauggaaaauggcgguuucaaguccccgauuccgugcccacuucacaucuccccuaccagcagauucugcgaaagcaccaaauuucucaagacccucuucucccuagcuuagcauaaugucuggggaaacaaccaaaaucgcaauuuuaacaauaugccucucuacccccgugcacuuuuucugacaugguuuucaggucuaaauaguggcugcuccaguccaugaacucaaagguuugaagcuaccaccauugaacucccccauggugguuucaugaugcccccuccccaauuccucgcacuuuauucuccugggugguuucgaacuacccuguuucucaguggccauuuguugugucccucaggggcuuaaugacucaaaaucugggauccuuccccucucagacaccccucuuucagcuuagaauuuggggaaccuauagagaagucacagaaucccaugaaagggaauggggcaggagccagggguguuuuuucccagugcaggguugugucuuugugucucugucucugugacuguaaauccugcccugccccacucccaauaaaagcuuugguguauaggcucag

SEQ ID NO: 15166 - RNA, 5583 nt, Homo sapiens
gcggucucagacuccagccccucccaccccagggcucaggccagaggaggggucuagccaugggaacaugauauuuauucggucucagaccuuguucucugaucacagcgcaagcaucucuguauauuagacccuuuauccggggcacuacucuagcuaagcauaccagaagcgcaggguuuuccuucacuguggggaugugcagguccggcagaacucgguggggcucacacgaaguuguuggggagcguggcgggggacagggccuccagacgcugcgggcgacccccgcggggcggcgggggcagcuuugguggcagaggaggugugggcgggggcugcuugguggcgaugugggaagggacccagguauccggagcauaaaaguagaggucguaggggucuuucggggcguccaaaugcagaacugugggugcaaaggggcguggucaucucugggcugacccuccaggcccccuuccagaucaucuccagggccgcuuuugugcggccgaccgaucaggaggccggagagaggauuccgauucugcauuugaacugaguuuucaauaaaaagggugggggccgcugcagaaaccaggaggcguggcguccgaucagcagcggcggggccugcaguggagggcgggaaguacagggcuccgggccgcguaccuggaggggcaggggcggggcuggcggggacggccggcucugggccugaagccguuuccaaccgcauugggagcggcacuggacucuugggugaaauugcagacauuuagggggcuggacguugccauggaagagccagggcuuucauugaccuugggugggggaccugugcuuuuuuggcuggcgcccuguagugccgggagagaccagguuauggaaaagugcaggcauucaaggggcagggcgcucacccgguucaucuccgucguccggaagccggugaugugcgaagggccgcugucuagcugcccggcgguaaagacaccacagcagcacaaagaugccgaucagcagcgcgguccccgcgaagaacaggcagagggccccgccugcugcgccacguggucgccccaccagagucacgccugaagggggauaccagcaaucuaagcuccuaacccccuccucucucagacccagggguccaagcuccuagccccuccucccucagauccaggaauuccuguucccaaacccuucucccucagacccaggaguccagaccccagccgguccucccucgcacccaggaguccaggcccccagccccuccucccucggacccaggaguccaggcccccagccccuccucccucgcacccaggaguccaggcccccagccccuccucccucggacccaggaguccaggcccccagccccucccucagacucaggaguccggcuccugccccucaccggucuccuucacucgcuccaccacgaugaugguguugacucccucaccucggcugugccucuggggugcccgcagaguggcaggggccaacugacuggggcgcccuggaagagcagggggaccugcaauccgggcugagggaggagggacguuggacuccuuagggccagaguucuggggggccuucagcucaaccauuccuggagaaucugaagugggcaauuuuggggagucgggcuggauggcugcagguguuccugguuugggauucagggacagcucauuuagagcaguggcgucauccuugaagggcacagguguuucuggguagagacuaguggagauuugagggucggagguccuggguacaucuguugcauuuugguaguagguuguggggaauucuguuugggaaauuucgguggggcugggauugugggucacaugggauucugggugggggguuuuagaagggucaggauggagagcuuggagaaauucagaguuuggggucucaguggaguugaggucaugcuuuucuggggauuuggggucaggggucuugguaggguuaguguuugaggucucggggaguucugccugugagacuucaguggcauuaagcugcagaaucucuggggauucuugggguguaguuugcauaaggucaguguuuggggucucaggaaauucugggcgugaaguuuuggagaaguuagguuugggggucucaggggauccuggguguggcauuucaguugggccaggugugggggucucagaagacucugggugugccauuuuggagagguuaguuuugggcauguccagggauucugauauugagguugugagugagucagcuuugggggucucaggagacucugggugcgggguuucucggaggucaggguugaggggcucagugaagucaagugggaagguuuccagggaaaccguaugagguagcuuggaaggcucaggguaaggagucccaggaaauucuggguuaaggcgaucucguuuggaauuuucagaagcacccuucagaggggaagucucagaggggugggccauguccggaaagccacagcccaaaggcagaggggcugagggagcggccuuggaccucaggccggcgaggaggaagacgaggaagaggauccggcugaaugauuucauagcucuggcagauaccuauagcugcgggggagagcgggaaggaagggguuaaggccgaaggcucccaggagccccgcccacucccggaggccacgcccacuggaacacagguggaccacgucuguccggggcccagcuuggcgccagggaugggaagagaacccaaucgcaagucccuuggaggcuuguggggcgauggcccagguagccaagagagacugaggcgcggggcuacuugggagucguaguuaauuuccuuaucuguuucagcgagggguccuagaaaaauugggaaagaacgacacuucuccaggccucagaucuccucgacuucgacuuuagggagugucagggcuucgaggggacgugggaucuccuuccucuccgaggucccccgggacaccuugacucaacaguuguuuacacuacaggaggcuccuaacggcugagggcuggacucauggauuugagggaggagggagacauuugggcucuggguuaagaagguugcuggggguucagacuccugcgucuugcagggugagggggcugagguuccuggcuccugguucuuuagagaggagaaggcuggaaguucaggugccuagaauuuugagggagcaagguuugggggcuggauugcaggggugaaaggagauaagaggccuugagcucuugguuccugaguuagaaaggaauugggagcucugaguccuccagaaauagggucuggggucugggcucugcagaguagagggguagggacuugaagaagagagcuuuggggcaggacucucaagucuguuauugaagauggagcuaggauuucggcaucuccggggccagucugggcagagaagcauaggucuguguucagguggagguggaggcggccgacacaucgaugggacaggcuuacuugagguccuggggucucuuaccugcucugguguccaagguaacagcagauaagcagagcuggaugcagagaacggugaauguugcagaacagaucugggcagggcggugggagguagggucucaggggcacacaggugacgcaccucacccccucccaggggauccugggagccuagcgacagacuuagacucuuaaagggacagaaguaaaggacauuuucucugggguggggaagggaguuagaaacuggauugaucuaguggagauguggcccaaauuauuuuuuugaaaccagugguccuggcccucuacccucuccuaccugaaaacccaggggucuaguucccugguaccuuccuauuucaaguccccuaaguuguaucccccagcucccuccccccagacucagaacuccaguccucuagcuccuuccuuccucagauucaggaauccaaguccccagccuccuccuuccccagaacauaggaaucugggucccugucccauccacucuuagacucaggaguccaagcuucugccaccaccuuccuaggaaacuaggagcccaaguucccacaucccaaguuucuacugcucuguaggacuuccaaguuuugcccaucuucuccucacuguguauaaaggccccucuuuuuaaauuuuuuuuuuuuuuugagacagagucucacucuguugcccaggcuggagugcaguggugcgaucucagcucacugcaaccucccucucccagguucaagcgauuuuccugccucagccucccaaguagcugggauuacaccacaccuaauuuauguauuuuuguagagaaggaguuucgccauguuggccagucuggucucgaacuccugaccucaagugauccacccaccacggccuuccaaagugcugggauuacaggcaugagccacagcacccggcugaggccccucuuaagagucaguguggacugggugugcuggcucacgccuguaaucccaacacucugggaggccaaggagggcagaucacaaggucaggaguucaagaccagccuggccaacaguuuggcgaaacccuaucucuacuaaaaauacaaaaauuagcugggcgugauggugggcaccuguaaucccagcuacucgggaggcugaggcaggacaauggcuugaaccugggagguggagguugcagugagccgagauagugccauugcacuccagccugggcaacaagagcaagacuccaucucaaacagacaaacacacacacacaaaaagagucagugugaggaggacugggcuuuaaucuucacagcacccccaaacuccucccagauaagggcuuagacacauccuuagggcagcucaggagcccugucuguuuuccccucuucucacucucugagguuuuucugauguggucugucacuuuuccuguccucacaccccugccacacguacccuuugccauuucuugccuuuccccccucccuaccucacccucgaucuuucugggccucucgcugcuguauuuaucucugggcagcuccuuccagaccaggacguccuuccauuuccgucugucuuucugagagccuuuucuuucccuccuccaucuccaucugacuguucguuuccaucuccuucgcucucuuuucuuguuuucuuccuuuuccuuucuuuuucugucguucccauucuuucucucuauuucuuccucggccacucugucuuuguccuucucuuugugucucuguuccucugacgguccuuccgccagucucuauuuuuagcccucugacacacccccuguguccaccucucugucugucugucucucccccucccucgucucagguccagcuucuggucccaauuaguugguggcggccaaggcagcggcaggucccccacccccggcuccucauuaccgcuggcggcuccuaaugagccuggggagggggugaccccgcguccccggccccccggccugcgucacugcccggugcgggggcugcggaggcgauauaagggggcugccaccauc

SEQ ID NO: 15167 - RNA, 1267 nt, Homo sapiens
caacgcacacgcaggucgcgcaggaacuaggcgcaguccggagcgcagggcauggucuuuauuaagauggggacgggcagcgcgcucagggcgcauccaacaccagcagcuugugcauguacgaguucagccaguggcggcgcucgagggcggccagcaaccgcgcgcgcucccggaaggccgcgucguccgccagcgccaggcuccuccgcggccuggggguggcgggauccgcccaggcccguccuggggggcggaggcuguggagagacgcggugaccgcgcguccagacucgcucuugccgccgccuguccuccccgcggucuaacucgaagccccguuacugcccaguccguggaguggcucgguccggcucccccugucucucucguucucugugugggucucugucucucugcucaccagguucgaaacuccccagguacugagaccgagucugaugcacuuguccgcccacagcgcucagcgcauggccaggcgcacaccaagaacccaauaaacguugcucaaagaaugaauccguuucugcaacgacuccuuucgagccucuccacgccuuucucgggaucuaucuuucugugucucuuucccuugcugauuuucuguccauuucccgcaccaccacuaccaccaaacccuccucccgccuucccccaccccuagucucugucuucucgcugggucucggucgcccucucuuugggcuucuguuccgcuuucuggaucuuccguccccuuucucuuugguucucuucccacuucuccaaguucccaccccucccugggaguucugggacuggcaccuaccugaggaccccgaccgggggcagggcgacucccgaggcagugcggacgccccagggcaccaccagcagcagcagcagcagcagcagcagccgaacccgagggcuccuggacaccuggcgggucuccaucaccuguggagaaccagaaaggggcucaguagggcugcaucccggcccagaaccccgggccccaccaugcauccacccccagcuucccgcacaguccccuaccgugcagugggcuggggcagcgaugguggcagcccccuuauaucgccuccgcagcccccgcaccgggcagugacgcaggccggggggccggggacgcggggucacccccuccccaggcucauuaggagccgccagcgguaaugaggagccgggggugggggaccugccgcugccuuggccgccaccaacuaauugggaccagaagcug

SEQ ID NO: 15168 - RNA, 5470 nt, Homo sapiens
cgcaggggauuuauuugagguuugggugaaaaauaaucuuguggguggugguaggccgacagauggggacaggaagcuguggacgaaagccccaggucccgugggagaggugacagcagcaggggcacgcagccacguggguccccaggggaaugugaaggcggagggcuccaggcgaacuggggauuaaacaaauauuuacaggcagcagggaagugcccagcgcacgugacgggggcggggcgggacuuuggggagggcggggccuaacgguaucgagcgagccgguuguagacgugguccagguuucugcacaggaauaucgagagcgucaugaacccgagcuauagagaaaggagaugaggucagagaagucgaaggggugcuggcgagacgggggugaugcccacccgggcgagaaaggucagggguggggccgugaauugggcgggaaggggcuggagaaggggauagguagaaaagggcggggcucgacgggaacugccgcagggcuggcugaugaggcgggaauagcugcuacaaguggggguagaggcugagaaggaguaaggucggaagcaagcccaggguccuuuauuuuggaggcucaucugucuucccccucugccucagccucuaauugugccuccucuaauucugcgcccgcacuuccagugucaggcugguccucgucuugaacccacagcggccagagccccagggccaugggcagcuugcccugcggugccuugucuccccaguuggggcaggcacccgccaugccccagccaccccacagacugccgcugugcccgccgccgccgucagcgaucaggcugggcccggggcucgaauccccagcgcccggcacgugcggcucgcauuuccggcggagugcccugcgcuguagcuguacgcucagcaccaugacagucaucugcggagaaaggggagggagaucgcagccaauagcaggaggcuuucccugcguacacccaaucagggcucccugaagcugggccgcccccacccuccggugcuggguggagcggcgggagggccggggugggcugcgcuccgcccugagcucguccuucccaggcaaccgaaggacgcgaaaugaagggcagggccaucuagggauuuagggccgaucgcgggugggggcggggccagaucaccucgaguaggccgacgcccaggcaaaugcccacuauggaaauaagguuguugugcagccacuucuggaggcccugcgcgcagcccugggggguguagggaaaaguuaaagggauucuuucugggacucucaagcccaggcccagcguucuuuucaggccaacccucaccgucuucaggcaucuacccgcuccccuagucaccagggcacucuagucuccuuacuagugcacccucgcuucaccuuuuccaagccuggccccucccuagacaucuguauuccagagccagcccagccuuuucuuuaggcccugcccuuccugcagaccccgcccccuucagagggccccgccccuccugccguaccuuuccuuuucucguagaccccgcccuuucucaggccgcuacucacugacagcccucccccucccgcaggccccgccccauucgacagguuuaugcuccgaaccccugcccaccucgcgguagauguggcucucugcagggacagcgcagaugucugcacugugucuggaccgcgccagguguccaagccugcugagcuggggcaagaucaccuuaucuaggauuguggagucguuggucgccgacaaguuguagcaggagcagggcacgcggugcgccuccgacccguuaccucucaggaugaggacuuggaaccaguccugcggguagugccagccgcagcagcgcagcugggagagggauacgagucagagggaccgggacuggagacauaugauguuggggaucaggggacaaggugauggguaugaggucaggucggggagcaggggacuaagugguggguguggagugggggacagugggcuggggucacgauggggccggagccaggggacauuacgggaacauggggcugggaaagacgagucacggggugaccuggggcuggggaaggagcugcagggucgcgcuguggacuagagauuggguggguggugcaauugagccucugauacccgacaggugaauaggagugcgagaccaugugagucucaucgggggcgggguccgguggaagccagagucacuacgggguaggaagccgugucucgcuagggucuugggacuaggggccugacaaccucuggucggggcgggggcgggggcggagucucucgagguagauggcgaagccacgccagggucuggguacugggagaccaggcgacgccggggacaguugugucaucuggggaguggggagcgucgggccugggagggauugggguguguuaggaucguagagcugggggucgggcccacguugggguggagucuccuccaagcacagggcugaggcgggucaguccgggagggaacuggaggaggggggcuuaccuggaacugcacauagucccagcucuccucggccgcggucuccucgggguuggugccguacuuuuggaugguuuucucuacgacgucccgcaagcuucgcuccagcugagaggccaccagugaggcugggccuuaucuuccccgccccaccccucccccucucaggcugugccagccucaggcgggcccugugcaucucugggccagucucaaauccuuacugaauggcuagcucuguguacuucaggucugucuuucuguuucuuccacuauuucuacggcucauaagucucugucucuucuuucagggcgucuauuucuuucucuuguucucucuuuuucccguguguuucccuuuggagcuguuuaugccugucucccuugguccaggucggugugucuuucuauuaauuuauuuuuugagacagggucucacucugucacccaggcugagugcauggcucacuguagccucaaacucccuggcucaagugauccucccaccucgaccucccaaguagcugggaccccaggugcacaccaucacacccggauuuuuuuuuuaaauauagauggggucucacuauguugcccaggcuggucucaaacuccuggacucccaccucagccucccaaagugcugggauuaugggauuacaggcgugagccaccaggcccagccucuuauuucucuuuaucuagguuagccccugucugcccuuguuucggucucucuccacccucucccaccacucccuucccucuccucccugcugggggugggugguggccacugcaggaagcucaccugggcccgcugaguggagaugaggauucccagggugaucuguguggcaaacaggagcagcagcaucccaaaauacuggggagcagaguggagagaucaggcugaccaccccugcaaccccggcccaggccauuuuugaggguggggauaggaguguuccuagggacggagagggauggugcacucaccaggcccaggaggcagcggagcuccuugagggcccccacacaacccaggagggcgaugcccauggugaagauuccugagauggccaggacuuuggaccagaucugcagaggcacgaaggccaagccugggagaggugaggggagugaugaugagcuguguggcacagcuccaggcagccccauuucccaccuaggcagccacccaaguggggagcaguaucuuggugccccucucucugggacucugucccugccccacccugagucccuguuuccuucugaaacuuucucuucuuucugggccuguuucccgucccuggaucucugucucucuuccucuuacccucuccuuccuccuucagcuccuccucguccccaguaguuucagcccuaucacuuguucugugacauuggcuuggcuccuuaaaccucccugaggcauaggagaugauaucuauuucuuaggguuuuuuuuugaguuggagccucgcucugucccccaggcuggagugcagugaugugaucucggcucacugcaaccucugccucccagguucaagugauucuccugccucagccucccuaguagcugcgacuacaggcaugugccaccaugccuggcuaacguuuuguauuuuugaguagagacaggguuucaccauguuggccaggcuauucucgaacuccugaccucaagugauccaccugccucggcuucccaaagugcuggaauuacaggugugagccaccgcgcccggccccuagggucauuuugagagacacaugaggacauguguucaacccaguccucaacacagggcaaagacuucuuaaauaugagcguuuaggguuauauuucauuauuauuuagggucauacuucauuauuauuuuccuauuauuaauguuauuuuggcucuuuuacguccuugcuguaugacauccaucaaggggcuuccccucucugaaccucaagcgaggggaagguuugugggggcaucugaccagccacaagucccgacagauaggaagugcuugagaaauggcucucaugaucauuguuguuuguaugcacaaccccauuugccggaagaagacucaggcuccaagaagccuccggugagcaguggaugggagccuguagccugccugcagaguagggcaccguaggucucccugagacaagggagaccccaggaaguugcuuggguugggggaggcccucccaccugccccagccccccucacccacaaaggacacgaagcuggucuugucaaugaggauccagaugccgaagcagaagaucaggcugccgaggaccuggggagaggagaugcggauacgggggugggccacaggggaagaugagggcuggguuagcggcaggggcugggccccggcuggguagccaugaggcaacucacgaagaagaagagguugaaaacgaagaggaaguacuugaugaggcugaggcagcucuccugggcugacaucuucaccuagugggguaagcgguccacucaccacacagaagaggugcugacagugggggagacagggagaaagaaagaggcugagagagaaagagagacggagagcugagagagaaaggaagaaccccaaaagaggaaguuccagggguggggcuccacccacucccgcuucauguaagguggcuuucugucucucucucugucccugucucccucaccugcuccacugggacacaugcucugguaccugaggggccuuggaauuugugggcaccaaggacucauggggcagucccucccaggucuccaugucucaggcgcugggggaucuaaagggaccccugaucuacuggaacccaccucugggcauggggaccucagggcugacccuggacagcagcugaccucacagacac

SEQ ID NO: 15169 - RNA, 5470 nt, Homo sapiens
gugucugugaggucagcugcuguccagggucagcccugagguccccaugcccagagguggguuccaguagaucaggggucccuuuagaucccccagcgccugagacauggagaccugggagggacugccccaugaguccuuggugcccacaaauuccaaggccccucagguaccagagcaugugucccaguggagcaggugagggagacagggacagagagagagacagaaagccaccuuacaugaagcgggaguggguggagccccaccccuggaacuuccucuuuugggguucuuccuuucucucucagcucuccgucucucuuucucucucagccucuuucuuucucccugucucccccacugucagcaccucuucuguguggugaguggaccgcuuaccccacuaggugaagaugucagcccaggagagcugccucagccucaucaaguacuuccucuucguuuucaaccucuucuucuucgugaguugccucauggcuacccagccggggcccagccccugccgcuaacccagcccucaucuuccccuguggcccacccccguauccgcaucuccucuccccagguccucggcagccugaucuucugcuucggcaucuggauccucauugacaagaccagcuucguguccuuugugggugaggggggcuggggcaggugggagggccucccccaacccaagcaacuuccuggggucucccuugucucagggagaccuacggugcccuacucugcaggcaggcuacaggcucccauccacugcucaccggaggcuucuuggagccugagucuucuuccggcaaaugggguugugcauacaaacaacaaugaucaugagagccauuucucaagcacuuccuaucugucgggacuuguggcuggucagaugcccccacaaaccuuccccucgcuugagguucagagaggggaagccccuugauggaugucauacagcaaggacguaaaagagccaaaauaacauuaauaauaggaaaauaauaaugaaguaugacccuaaauaauaaugaaauauaacccuaaacgcucauauuuaagaagucuuugcccuguguugaggacuggguugaacacauguccucaugugucucucaaaaugacccuaggggccgggcgcgguggcucacaccuguaauuccagcacuuugggaagccgaggcagguggaucacuugaggucaggaguucgagaauagccuggccaacauggugaaacccugucucuacucaaaaauacaaaacguuagccaggcaugguggcacaugccuguagucgcagcuacuagggaggcugaggcaggagaaucacuugaaccugggaggcagagguugcagugagccgagaucacaucacugcacuccagccugggggacagagcgaggcuccaacucaaaaaaaaacccuaagaaauagauaucaucuccuaugccucagggagguuuaaggagccaagccaaugucacagaacaagugauagggcugaaacuacuggggacgaggaggagcugaaggaggaaggagaggguaagaggaagagagacagagauccagggacgggaaacaggcccagaaagaagagaaaguuucagaaggaaacagggacucaggguggggcagggacagagucccagagagaggggcaccaagauacugcuccccacuuggguggcugccuaggugggaaauggggcugccuggagcugugccacacagcucaucaucacuccccucaccucucccaggcuuggccuucgugccucugcagaucugguccaaaguccuggccaucucaggaaucuucaccaugggcaucgcccuccuggguugugugggggcccucaaggagcuccgcugccuccugggccuggugagugcaccaucccucuccgucccuaggaacacuccuauccccacccucaaaaauggccugggccgggguugcagggguggucagccugaucucuccacucugcuccccaguauuuugggaugcugcugcuccuguuugccacacagaucacccugggaauccucaucuccacucagcgggcccaggugagcuuccugcaguggccaccacccacccccagcagggaggagagggaagggaguggugggagaggguggagagagaccgaaacaagggcagacaggggcuaaccuagauaaagagaaauaagaggcugggccugguggcucacgccuguaaucccauaaucccagcacuuugggaggcugaggugggaguccaggaguuugagaccagccugggcaacauagugagaccccaucuauauuuaaaaaaaaaauccgggugugauggugugcaccuggggucccagcuacuugggaggucgaggugggaggaucacuugagccagggaguuugaggcuacagugagccaugcacucagccugggugacagagugagacccugucucaaaaaauaaauuaauagaaagacacaccgaccuggaccaagggagacaggcauaaacagcuccaaagggaaacacacgggaaaaagagagaacaagagaaagaaauagacgcccugaaagaagagacagagacuuaugagccguagaaauaguggaagaaacagaaagacagaccugaaguacacagagcuagccauucaguaaggauuugagacuggcccagagaugcacagggcccgccugaggcuggcacagccugagagggggagggguggggcggggaagauaaggcccagccucacugguggccucucagcuggagcgaagcuugcgggacgucguagagaaaaccauccaaaaguacggcaccaaccccgaggagaccgcggccgaggagagcugggacuaugugcaguuccagguaagccccccuccuccaguucccucccggacugacccgccucagcccugugcuuggaggagacuccaccccaacgugggcccgacccccagcucuacgauccuaacacaccccaaucccucccaggcccgacgcuccccacuccccagaugacacaacuguccccggcgucgccuggucucccaguacccagacccuggcguggcuucgccaucuaccucgagagacuccgcccccgcccccgccccgaccagagguugucaggccccuagucccaagacccuagcgagacacggcuuccuaccccguagugacucuggcuuccaccggaccccgcccccgaugagacucacauggucucgcacuccuauucaccugucggguaucagaggcucaauugcaccacccacccaaucucuaguccacagcgcgacccugcagcuccuuccccagccccaggucaccccgugacucgucuuucccagccccauguucccguaauguccccuggcuccggccccaucgugaccccagcccacugucccccacuccacacccaccacuuaguccccugcuccccgaccugaccucauacccaucaccuuguccccugauccccaacaucauaugucuccagucccggucccucugacucguaucccucucccagcugcgcugcugcggcuggcacuacccgcaggacugguuccaaguccucauccugagagguaacgggucggaggcgcaccgcgugcccugcuccugcuacaacuugucggcgaccaacgacuccacaauccuagauaaggugaucuugccccagcucagcaggcuuggacaccuggcgcgguccagacacagugcagacaucugcgcugucccugcagagagccacaucuaccgcgaggugggcagggguucggagcauaaaccugucgaauggggcggggccugcgggagggggagggcugucagugaguagcggccugagaaagggcggggucuacgagaaaaggaaagguacggcaggaggggcggggcccucugaagggggcggggucugcaggaagggcagggccuaaagaaaaggcugggcuggcucuggaauacagaugucuagggaggggccaggcuuggaaaaggugaagcgagggugcacuaguaaggagacuagagugcccuggugacuaggggagcggguagaugccugaagacggugaggguuggccugaaaagaacgcugggccugggcuugagagucccagaaagaaucccuuuaacuuuucccuacaccccccagggcugcgcgcagggccuccagaaguggcugcacaacaaccuuauuuccauagugggcauuugccugggcgucggccuacucgaggugaucuggccccgcccccacccgcgaucggcccuaaaucccuagauggcccugcccuucauuucgcguccuucgguugccugggaaggacgagcucagggcggagcgcagcccaccccggcccucccgccgcuccacccagcaccggagggugggggcggcccagcuucagggagcccugauuggguguacgcagggaaagccuccugcuauuggcugcgaucucccuccccuuucuccgcagaugacugucauggugcugagcguacagcuacagcgcagggcacuccgccggaaaugcgagccgcacgugccgggcgcuggggauucgagccccgggcccagccugaucgcugacggcggcggcgggcacagcggcagucugugggguggcuggggcauggcgggugccugccccaacuggggagacaaggcaccgcagggcaagcugcccauggcccuggggcucuggccgcuguggguucaagacgaggaccagccugacacuggaagugcgggcgcagaauuagaggaggcacaauuagaggcugaggcagagggggaagacagaugagccuccaaaauaaaggacccugggcuugcuuccgaccuuacuccuucucagccucuacccccacuuguagcagcuauucccgccucaucagccagcccugcggcaguucccgucgagccccgcccuuuucuaccuauccccuucuccagccccuucccgcccaauucacggccccaccccugaccuuucucgcccgggugggcaucacccccgucucgccagcaccccuucgacuucucugaccucaucuccuuucucuauagcucggguucaugacgcucucgauauuccugugcagaaaccuggaccacgucuacaaccggcucgcucgauaccguuaggccccgcccuccccaaagucccgccccgcccccgucacgugcgcugggcacuucccugcugccuguaaauauuuguuuaauccccaguucgccuggagcccuccgccuucacauuccccuggggacccacguggcugcgugccccugcugcugucaccucucccacgggaccuggggcuuucguccacagcuuccuguccccaucugucggccuaccaccacccacaagauuauuuuucacccaaaccucaaauaaauccccugcg

SEQ ID NO: 15170 - RNA, 4214 nt, Homo sapiens
cagagggguguccagagccaggcagcaaggaccagaggaagguggacagagaccgaaaggacaaaggagagacacagagaaaaaaagagaccaaccccaaagggacaaagaccccaacguuuguccacauugccgcagaggcagcuggagccagugcugccuguccguccccaugggccaccauaggccauggcugcacgcuucuguccucugggcugggguggccagccugcuccuccccccggccaugacccagcagcucagaggggaugggcuaggcuucagaaaccggaacaacagcacuggagucgccgggcucuccgaggaggcaucagcagagcuucgccaccaccuccacagcccuagagaccauccagaugagaacaaggauguuuccacagagaaugggcaucauuucuggagccacccagaccgugaaaaggaggaugaagaugucuccaaggaauaugggcaccuacucccaggccacaggucccaagaccacaaagucggagaugagggugucucaggugaggaggucuuugcagagcauggugggcaggcccgugggcacagaggccacgggagugaagacacggaagacucagcugagcacaggcaccaccuccccagccacaggagccacagccaucaagacgaggaugaggaugaaguuguguccagugagcaucaccaucauauccucaggcauggacaccgaggccaugauggggaagaugaugaaggagaagaggaggaggaggaggaggaggaggaagaggaggccuccacugaguauggacaccaggcccacaggcaccgaggccaugggagugaagaggaugaggaugucucagauggacaccaucaucauggccccagccacaggcaccaaggccaugaagaagaugacgaugaugaugaugaugaugaugaugaugaugaugaugaugaugucuccauugaauauagacaccaggcucacaggcaccaaggccacgggauugaagaggaugaagaugucucagauggacaccaucaucgcgaccccagccacaggcaccgaagccaugaagaagaugacaaugaugaugaugaugucuccacugaguauggacaccaggcccacaggcaccaagaccacagaaaggaagagguugaggcugucucaggugaacaccaccaucaugucccugaccacaggcaccaaggccacagagacgaggaagaagaugaggauguguccacugaacguuggcaccaggguccccaacauguccaccauggccuuguagaugaggaagaggaagaagaggagaucacaguccaguucggccacuauguugcaagccaccaaccucgaggccacaagagugaugaagaggacuuccaagaugaguauaaaacagaagucccucaccaucaccaccacagaguccccagggaggaagaugaggaggucucugcugagcuuggccaccaggcccccagccacaggcaaagccaccaagaugaagaaacuggccauggucaaagaggguccaucaaagagaugagccaucaccccccaggacacacaguggucaaggauagaagccauuugaggaaggaugauucugaggaggaaaaggagaaggaagaggaccccggcucccaugaggaagacgaugaaaguucagagcagggagagaaaggcacccaucauggcagccgggaccaggaagaugaggaggaugaggaggaaggucauggccucagccugaaccaggaggaggaagaagaggaagacaaggaggaggaggaggaggaagaagacgaggagaggagggaagagagggcugagguuggggccccacugagcccagaccacagcgaggaggaagaggaggaggaggaggggcuggaggaagaugagccccgcuucaccaucauccccaacccacuggacaggagagaggaggcuggaggugccuccagcgaggaggaaagcggugaggacacagguaaguggccugggcuggugugggugggaaggaaccgagucagccugggucacugcugcccuccuguccccgcagguccacaggaugcucaggaguaugggaacuaccagccagggucccuguguggcuacugcuccuucugcaauguauguccccagcccagauccacccaccaagguguccccagaaucugucccaggggcccugggguggugcugugggagggcucagagcaagggcaggccagggucaguucugaaagaaaagagauccuucugcaggcaugugaggugaggacagacugaaggcugggaggcuggggcagugguccaggaaggagaggacaagacccaagcugcaucuugggguguggggacagagacaggggucuguggcaaagagagucgggggaaggagggauggcacaggggcugauaggcuagggggagaauaggcagagagcggguggagagagcaccugagcccacccugacagggagacauggggucgcccugagauagaaaaccaggggcagggccgggugugguggcucacgccuguaaucucagcacuuuaagaggccagggugggcggaacacgaggucaggagaucgagaccauccuggcuaacacggugaaaccccauuucuacuaaaaaauacaaaaaaauuagccgggcgugguggcacgcaccuguaaucccagcuacucaggaggccgaggcaggagaaucgcuugaacccgggagacggagguugcagugagcugagguugcgccacugcacuccagccugggcgacagagagagacuccgccucaagaaaaaaaaggaaaaaaagggaaaggaaggaaaccaggggcaggggaggggaggggaggcugguuuggggggcagauacagagcucaguguuagagauaaagaggguagagucuggggaagcguccagggugcaggggugggccaggggcggguaccucccaaguggcguuagaguuuccaucuaaccaggcucccccgguccccagcgaugcacugaaugugagagcugucacugugaugaggagaacaugggugagcacugcgaccagugccaggugagaccucaccucacacucaaggcuccacugggccucaggaugcaccgggacccucugaggacccccagcccuaaauccuggccucugacccaaccccuuaccccugaugcaaccuugacuccacaagcgauccugacuccaaccuuaaccuagaccuagccucugguccgggucuggucccggccccauccuaacuccgcccccggccacgccccacgcucacucucucuccccguccccgccuccagcacugucaguucugcuaucucugcccgcuggucugcgaaacggucugcgcuccaggugagcaugggcggggcccuggaaaaaccugaggaaggugccgggcccagcguggugaauccuggugggggcggagccuggcccgguaggcugguggggcggggcuaagaggggaggcguggccaaggcucugagcacgugggccggggccuggcucgaggaacaccagguggaguugcuggagccaagggacagaaaugaguggaggguugagaugcgggcuuagagccuaaugggcgaggccaacucaaguaggaaucgaaggggcggggcuacuggagaacggaaucacccagaacgaaaaagggguccgguagaagggauucaguuggaagaaggaauuagggaaaaggagguggagcuagcacuaaucucgcacgcuauacugaguggcugccuaauuuugcucgugcaguaccccucaagccucuuuucucugcugucccacaggaagcuacguugacuauuucuccucgucccuuuaucaguaaguguguaaaaggggagcguguaaaagccccguuuagagaagugcuugucucgcuaugaguuaucagaugacucugggacuccauuuccccguccaugaaaugggcagguuaaugaucucuaagcguccuggggugggcuuugaacaccagcugucuaacuucuggcguucucgucuccagggcccuggcagacaugcuggaaacgccggaacccugacccagucgcucgacugcgacgcagguguaccucccccugccuuccaaccccuuuccacgagcuauauuuauuucuccgaauaaacgugcuccccgaaacc

SEQ ID NO: 15171 - RNA, 1540 nt, Homo sapiens
cggcugcggcugcagcagcaagccccgugccgucgcggucgucgcggaagucaggcagcgucucgaggcagaagacgacgauggagacgaggaugaccagcacggagacuacggcgagcacgcgcgcggccugagagcucucgggaaacucgaaaagcagccacagcuggcgggcgaaggcgcggcggggcagggggcgcucgggcggcaccgggcagcccucguccucgcgcaggcgugccagggccgccgcgcccagcccguagaaggccaccucuuccaggaagacgucgagcggcacgugcgccggccgccgcagccgcccaccggacugguaguaguagagcacggcgucgaagcugggccggugccggucgaagaaauacucgcggcgcgcgucgucguagaagcggccgcggcgcgcuggguccccuagcagaguguccgggaagcggcccagcgugcgcgcccgcgucucgaagcgcagcccggccacguugagcaccagccgcucgcagcagccgcacggcggcgggcaccgcggcuccauggcgcgcgcagccccggcgacccgcgaaccgacguguggccccgacgcccggccccggugcggccccgccucggccgccucggccgccgccgccgccgccccagcccgguguccgguguccgguguccgcgcguaaaaauagcccggcagggcggcuagggcgcgagggagggggcacugugaccccggcggggcggagggcgacagggcgaccgcgcgcccucugccgggacgcccgcccugcccugccccgccgccgccgccgcccgcgccugcucugcgccuuucccgucccgggguccccuuucucuccguccuucugccgccgggauccuguccugcgucucuccaaguuuccgugugcguguguuucgucagaaucaggcuucaguugcagucgccucuuuucuuuucucuuucuucuuucuuucugucuuuuuuuuuuuuuuuuuuuuugagacacaguuucccucugucgcccgggcuggagugcaguggcgcgaucucggcucacugcaacaaccuccaccucccgggaucaagcgauucucgugccucagccucccuaguagcuggaauuacaggcgccaccaagcccagcuaauuuuuuuucuuuuuucuuuuuuaguugagaagggguuucaccauguuggccaggcaggucugguacucccgaccucaagugaucugcccuccuuggccucccgaauugcugggguuacaagcgugagccacggcgcccggccuggagucgcccuguuugcaccuuugucucucacucucuugugugucuguguccggcuguccccucugggucucugucucuuuugggauguaucucugaguaucucuaugggucauuuauuucugagauucgucguucugggggccucuguaugggucccucugccagccucuacgucucggucuccgccuuuauuuugacucuuggucugucuccguuuaucucuugucucucuuggucucuuu

SEQ ID NO: 15172 - RNA, 44814 nt, Homo sapiens
cugacaccagcgcugacuccuucagcacgugcgggaaggguuggggagccccggggacaucuggaaaucguuaccccgaggugggcaggccuggcagagggaggaagcagccaggagguucuggacccuggagcaaagggggguguuucucauggauguccugaggugcugggggcagugcaggggucucugucuguaucucugacacccccaggucucuguccuucuuucugugucucugucucccccacccccugggucucugaaauccugaacuucuccauccccuucuguccgccucuuucugacucuccaucccccacuccguguuucucugugccccucuuggagucccugucucucugucucugggucucuuaaucacuccauccauccaugugccugcaggccuuucauuggcuggauuggggugggcggguucugucaccuggggcaacagcaacaaaccagcuccugcuuggcuacagggaggggguggaaccauggccaguggcacccuggcugugcgcuguggccccccguggucuuucaucucugcaaccgagaugccugaauccuggcccaacuggcaucucaccagcagcuacguuacccauggcauuaucccacccguacccuuccccccgcccacggugcaggugggcagacccuaggcugaagcccugcggggccuggggacccagaaagaugggggcugagaaaaggggauugggagcuuggacuccucucugaaggaggaggguccuggaguccugggucugagagaggaggcgccagggaauuuggaugccagggacugcagaggaaagggcugggggccgacuggaagaggucagaguuugggguggggggugauagggacuccugagucuuucuagcugaugugcggcgccuucucuccaguccacggucgcggacccucuaccuccgacugcaaagcaggauucucgcaucugggcuuucgacgagguccucagcagaugggagacaaccucuggcucggccuacgugcccaagacccauggcgggcccugcgcccagcccagagccccagagccugcagaccccacgcggacuguggggaucaaggauucaggagaaaagguaagauuuggggagcgccggagucugcgggggacugcauuugaguccccugcuccuucacaugagucucuggguugccuuuccgcagcucagacaccgcagcugaacccuccuacugaccacaaaguaccagagcagcgagacgagggcgcaguacacuugcucucccggcccggacgcgcgcgcccccaaauacgucgggccccagccccucacaacucucggaccaccaccgcggggggccuucccaggugucuggguggaagccggcgcuggcgagaccagcggagcuccgggagccuggggcggggccagaaggaaaucacagcuuuggggcguggcuaaaggaucuggggcgggaucgggagguuagaggagcgggaggaagggcugggcauccacgccaggccagaaggaccaggggcuggaaacucgccuucagggcuccuaagcugcugcggagcuagacggcgggcuguggguggggaggagacuagaauauucugagacgugguagggugggaguuaggagagguaaccuggaguuguugcccaagaugcagcucagcuccaguggccacaccaagaaggcuugagaccgggggcagaaccagggggauuuugugguggcugggggccugcauuugaguuccuugaccagcaggagggcuuggauuuagggaggugaggcugggaaggguucggguaugagaaaggaagcugaaguucccuggcguggguggcaggaagggcucugacccuggggcggggugugagggccguggccgucauggcugucgaggccgaaggagagggauucugaacucgggacccaggacuugggaugggguaugaaaucuaugucuuggguaugccuccucccccaaucuugcucaggcucuaaucgccugcacgaagaaccccgcgcugucuggcccacccuucacaguauccgaccggggcguccugaaccgccgccagcucuaucugaccaccucggcgcgggacuuucgguucuaucccaaguaagccgggcucucgcucggcaccgccuccugcacagcccccgccauggccggugcacgccgagccccugggcuggcucccauucccugaccgguggucucagucucgacuccuauagcagcaacaaccacaguucagaccccagccccucccucuuuuagcacccaggaguccuuagugucaccuccaggaaccgcgguagggacaggaagccugcacagcggcucgaggggauucuggaucugagggcagggccuccuucgguacuugagcccccacaugcuccuucgcaaggaagcgaaagcccccguuuccuucccuaggaugcgaaagcucagcuuccaggacguuaaguaccucgaggacccaggaacgcaggcaacgcgugcccggucgcguccuuccuaaggggugcucgccuggaaaugcaggaguuugaaugugcagacuccuuagaucccgaggucugaaacucguccccaaggauccagcuguauccucaccaucccgcccugcucccacaggacggagccguccggauacccccgcaaggacuaccugaccuacuggagcuuagaagagacgccccaacucuggagucacgacccgcagcggcagcccugucucugcucuuccaggccgccucgagcgccgcacggcgggccaugucuccggcucaggaaaccuacagcuccucgccgcacccgcuccgccggcucgaccgcuuccgcccgcuggaggcgacuugggguggcccccacuggaagccccugccgggcauacacagcgucccgaaagccuacagcaccgagaacucccgcucaggccgcuguaagccggggcuagugggagccugccgggccagccccaccccagacacgcccccuggcgugggggcggagcagagcucugggcagccgcucacuacgcggugucggaccuaggugggcucgcacucauuaagucuauccgcaguguggggacaggacuagcccagacacgcccacucagcugcggcuggaucgcggggaagggacuaaguccagacaauguccuccgaggcugcggccccgcgggcaggacacaccuccugcgggccuauucaauaaucaguuaaaucaccugaagcacacgcauuuccggggaccgcuccgggcauccuggcuugaggguagggugggcggagguuccuaagggagagguggggcucgggcugaaucccucguuggggggcaucugggucaaguggcuucccuggcagcacagucacggggagacccucucucacugggcagaagcuaaguccgaagccgcgccccuccuguuagguuggacuguggugcaggaauggcucaaguagaggaggguugaggcuucaguccagcaccuuucucgggucacggccuccuccugguucccaagaccccaccauaggcagaggcaggccuuccuacacccuacucucugugccuccagccucgacuagucccuagcacucgacgacugagucucagaggucacuucaccguggucuccgccucauccuuggcgcuagaccacugaggggagaggacuggggugcuccgcugagccacuccugugccucccuggccuugucuacuucucgccccccgaaggguuaguguccagcucacuccagcauccuacaaccuccugguggccuugacgcccccacaaacccgagguauaaagccagguacaccaggcaggggacgcaccaaggauggagauguuccagguaagacugcagggccccugggcaccuuccaccuccuuccaggccaucacuggcaugagaaggggcagaccagugugagcuguggaaggacgccucuuucuggaggagcgugacccccaauaagcuucacguggggcaguuccugaggguggggaucugaaauguuggggcaucucaggucccucgggcuguggggugggcucugaaaggcagguguccgggugguggguccugaauaggagaugccgggaagggucucugggucuuugugggugguguacccugggggaugggaaggccagggcucagggcuguggucucaggcccgggugaagcaguguccuugucccaggggcugcugcuguugcugcugcugagcaugggcgggacaugggcauccagggagaugcuucggccacggugccgccccaucaaugccacccuggcuguggagaaggagggcugccccgugugcaucaccgucaacaccaccaucugugccggcuacugccccaccauggugagcugcccggggcccgggcaggugcugccaccucagggccagacccacagaggcagcgggggaggaaggguggucugccucucuggucaggggcugcggaauggggugugggagggcaggaacagagggcuuccuggaccccugagucugagaccugugggggcagcuggggagcucagcugaggcgcuggccccaggcacaugcucauucucccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggccuccucuuccucaaaggccccuccccccagccuuccaaguccaucccgacucccggggcccucagacaccccgauccucccacaauaaaggcuucucaauccgcacucuggcggugucuuucugugggcucagggcaaccacacacacacaggguggguccagcuuccaaaccauuuuauacaaagucacaguaucagaacucugguagaaaacaggguggacggcggggcgcgguggcucacgccuguaaucccaccacuuugggaggccgaggcaggcugaucaugaggucaggagaucgagaccauccuggcuaacacggugaaaccccaucucuacuaaaaauacgaaaacuuaucccggcuugguggugggcgcuugcaguccaagcuacuugggaggcuguggcaggagaauggagugaaccugggagggggagcuugcagugagccgagaucacaccacugcacuccagccugcaugacggagcgagacuccaucucaaaaaaaaaaaaaaagaaagaaagaaagaaggaaagaaagaaaaagaaaagagagugaagaugggggacgacauccagcucaggagguguccauggucuggccuucuguggggagaaggaaggccacaugauugguguggcccagggggcagggccucagccuccuaagccgagcuccgucuuccucccucugacguuggcacuggcagugcagguguggggggggagcggcuuggggacuugaaugggaugaaggggccgagggggaugucaucucuuccauucuccuucauccacugccucucccuuccccuccuccccccuccccuccguccaucugccucccaucccagccaggagccaucaccuaaguagaaaaggggccucuggaaagggggcggggccuugacucuuggguacccugcacuugaagaggaacucugggaggggguuguucagggauuuggccccuuccccaucuggcuguauaaccuuccugugcuuuucuuccccuagccgguuaccccucccucuccugagaugucaggaaagagggggccaccugcguccuccacagugguccccgaagccugggguucccagccccagagcuccgagguggaagaguugcuacagcucuggugaccacugguuguuucccagucuucuccacgccaaccuuucccagaaccacaggcuuccagaauguuguagggaaacugcaaaauccgcgccuccaccagccucucccagcgccaggucaauuucacacacagggaaacugaagccugccucagaggggcagcguuuuaccuccuuaguggcaguuuugaggugaaucagggucucccuaggauuccagguuguggacuuucucuaaauuguggaauguggccaggcaugguggcuugagucuguagucccagcuacucaggagccacagcaggaggauggcuugagcccaggaguucaagugcaguggggaaacauagggagaccucgucuuaaagcaauuuguuuggggccaggcguggugucucaggccuauaaucccagcacucugggaggccagggcaggaguaucacuggagguugggaguuugagaacagucuggccaaugucgugaaaccgcaucucuacuaaaaauacaaaaauuagcugggcacgguggcaggugcuuuuaauuccaguuacucagaaggcugaggcaggagaaucgcuugaaaccaggagacaggcguuacagugagccgggauugugccacuguacuccagccuggccagacagagugagacucuguuucaaaaaaaaaaaaaaaaacaacaaaacaaaacaaacaaaaaaaaauugggccgggcgcaguggcucaugccuguuaucccagcacuuugggaggccgaggugggcagaucacaaggucagcagaucaagaccauccuggcuaacacggggaaaccccgucucuacuaaaaaauacaauaaauuagccagacgugguggcaggccccugcagucccagcuacucgggaggcuaaggcaggagaauggcuugaacccgggaggcagagcuugcagugagccgagaucgagccacugcaguccagucugggugagagagugagacuccaucucaaaaaaaaaaaaaaaaaauugguuggaacauccuccaagaugcaagacucucgguuccucagaguucuacgggaaggauggcagaaugcaguugcccagaggugaagucccaucucugucauuugcugccuaugugaccaggcaaaaagcauuaauuucucugagccuguauuuuacccucuguugcuauugaguaauuguaguuggcuauuuucuauuuuuauuuuuauuucaucuuuuuuuuuuuuuuuuuuuuugagacggagucucgcccugucacccagucuggagugcaguggcgcgcucuuggcucacugcaccuaugcuucccggguucaagcaauucaccugccucagacucccgaguagcugggacuacaggugugcaccaccacacccagcuaauuuuuguaauuuuuuuaguagacacagcguuucgccacguuggccaggcuagucccaaaguccugaccucaggugacgcacccgccucggcgucccauagugcugggauugcaggcaagagccacuguccccggccgaacaauuuuuaucuuuauuuuaugauuauuauuauuauuuuuuuaagauggagcuuuguuuuuguugcccaagcugaagugcaauggcgcgaucuuggcucacuucaaacuccgccuccugggauuaagcgauucuccugccucagccucccaaguggcugggauuauaagcaugcagcaccacgccggaggauauuuuguauuuuuaguagaggugcgguuucucuauguuggucaggcuggucuggaacuccucaccucagcugauccacccacugcagccuccgacaaugcugggauuacaagugugagccaccaugcccggccuuauuuauuuauuuuuuuugagagagagucucacuguguuguccaggccgaagugcagugacacgaucuuggcucacugcaaucucagcccucccggguucaagcgauucuccugccucagccucccgaguagcugagaucacaggcgugcagcaccaggccuggcuaauuuugguauuaucaguagagauguuguuucacaguguuggccaggcugcucucgaacuccugaccucaagucauccacccgccucagccucccaaagugcugggacuacaggugugagccauagugccugaccuguaguuguugaauauuuauuauuaaucuacaaguugggugugaugcaaguccuuuauauggagucccccaaacuucuagagcaagggcuuccccauaauccuggcaggcaggccuccccugggguuuccaacuucugaccccacugaaguguuuauccucuucucuaaucccagccuccuuuucccugucuccgugugcugagaggugcucugagagaugcucccgcucccccaggcucccucugcaucccccucauuuucuuccuccccagugugucaaugggguccuaaccccacccucggcacugucaccuuuuccugauccaaaguaggaccuucuuuuccccugagugguccugucuaggggugccgcugccgggcccccucuggucuuccugcugcagacuggggccuuuugggagucagcaggcgcccgggccaaccgcagccagcgugaggcgagcgaugcuucaccggcgagucaucagggugaggcuggccgugugugaugcagucagugucugggugacagaucccgggaccgcuguggacuugggugugcucgagguggagguguugggcgaggugccugcagcuggcggcaguucccucugccagcacuucuuugucaccgcuucgaggccgauaacucugaggaagguagccgugggguagguggagggggcugccgccaggguguggaccggggggcacugggugucugagugcaaggccaagcaguccuaugugcgggcauugaccgcugaugcccagggccguguggacuggcgauggauucaaauuggcacugccugugucugcacacuccucagccggacuggccgggccugagacuuauacccaggaacuggucaggcagaaaaagaacagagcuggaugcugagagaccucaggguuggcccagcugcucuacggaccccaguuugggaacucaucaaaucaucacaaaaucacaacucucugaauuugagcucagucucugcaggaugggugccaccacgugggguuuugaagguugaauaggaguucuccagggggaaauugagaguaaucaugaugaugaugaugauaauaauagccacuauuuacugaguguuuacucuuucguagcccuaauacauaacuccucagaucaacucucauggauuugaucauuggugaccuuugguguuaaguugcugacugcucagucacagaggacaccaccuugcucauccuggggagugggagggcacauuucacgauguggauggggguggagagaaacuggagcaugcaagcagauggccaggggaccuugaggacauggucuacagaaggccuuuaaguaucugggagcugggguucaaaugagaaaucuuacuuggugagagcaggcagggguuggcuuagaauauucuguuuugagauaaugagcuaccgaucacagggggaguauaagcaagguucaaugagaagcgaucaagaugcugcacaguucagcccuggguggggagcgcaagucagguuucuagcccucuuugcugugccaaccuauacccuacauugggaaagaaacagaccuuaaaauuguccagcuugauggcaucgcggggaagggacuaaguccagauaauguccuccgaggcuucggccccgugggcaggacauaccuccugcgggccuauucaauaaucaguuaaaucaccugaagcacacgcauuuccggggacagcuccgggcauccuggcuugaggguagagugggcggaggucccuaagggagagguggggcucgggcugaaucccuccuugggggcaccagggucaaguggcuucccuggcagcacagucacggggagacccucucucauugggcagaagcuaaguccgaagccgcgccccuccugggagguuggacuguggugcaggaaagccucaaguagaggaggguugaggcuucaguccagcaccuuucucgggucacggccuccuccuggcucccaggaccccaccauaggcagaggcaggccuuccuacacccuacucccugugccuccaggcucgacuagucccuagcacucgacgacugagucucugaggucacuucaccguggucuccgccucacccuuggcgcuggaccagugagaggagagggcuggggcgcuccgcugagccacuccugcgccccccuggccuugucuaccucuugccccccgaaggguuagugucgagcucacuccagcauccuacaaccuccugguggccuugccgcccccacaaccccgagguuuaaagccagguacacgaggcaggggacacaccaaggauggagauguuccagguaagacugcagggccccugggcaccuuccaccuccuuccaggcaaucacuggcaugagaaggggcagaccagugugagcuguggaaggaggccucuuucuggaggagcgugacccccaguaagcuucagguggggcauuuccugaagguggggaucugaaauguugggguaucucagguccucugggcuguggggugggcucugaaaggcagguguccgggugguggguccugaauaggagaugccgggaagggucucugggucuuugugggugguguaccacgugggaugggaaggccaggacucggggcugcggucucagacccgggugaagcaguguccuugucccaggggcugcugcuguugcugcugcugagcaugggcgggacaugggcauccaaggagccgcuucggccacggugccgccccaucaaugccacccuggcuguggagaaggagggcugccccgugugcaucaccgucaacaccaccaucugugccggcuacugccccaccauggugagcugcccggggccggggcaggugcugccaccucagggccagacccacagaggcagcgggggaggaaggguggucugccucucuggucaggggcugcggaauggggugugggagggcaggaacagagggcuucccggaccccugagucugagaccugugggggcagcuggggagcucagcugaggcgcuggccccaggcacaugcucauucucccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggacuccucuuccucaaaggccccuccccccagccuuccaaguccaucccgacucccggggcccucggacaccccgauccucccacaauaaaggcuucucaauccgcacucuggaggugucuuucugugggcucagggcaaccacacacacacaggauggguccagcuuccaaaccauuuuauacagagucacaguacagaacucugguagaaaacaggguggacggcugggcgugguggcucacgccuguaaucccaccacuuugggaggccgaggcaggcggaucaugaggucaggagaucgagaccauccuggcuaacacggugaaaccccgucucuacuaaaaauacgaaaaguuauccgggcuugguggugggcgcuugcaggagaaugcagugaaccugggagcgggagguugcagugagcagagaucgcgccacugcacuccagccugcacgacagagcgagacuccaucucaaaaaaaaaaaaaaaagaaagaaagaaagaaaaagaaaagaggguggagaugggggaugacauccagcucaggagguguccauggucuggccuuccguggggagaaggaaggccacacgauugguguggcccagggagcagggccucagcauucuaagccgagcucccucuuccacccucugagguuggcacuggcaguccaggugggggcuuggggaucugaaugggaugaaugggccaagggggaugucaucucuuccauucuccuucauccacugccucucccuuccccuccuccaccccucccacccccgguccaucuaccucccaucccagccaggagccaucaccuaaguagaaaaggggccucuggaaagggggcggggccuugacucuuggguacccugcgcuugaagaggaacucugggaagggguuuuuucagggaguuggccucuuccccaccuggcuguauaaccuuccugugcuuuucuuccccuaaccgguugcugcucccucuccugcgaugucaggaaagagggggccaccuguguccuccacaguggcccccgaagccugggguucccagcagagcucagaggugaaggaggugcuacagcucuggugaccacugguuguuucccagucuucuccaugccacccuuuccaaaaacaacaaaacaaaacaaaacaaacaaaauugggccuggcgcagugguucaugccuguaaucccagcacuuugggaagccgagacgggcggaucacaaagucaggagaucaagacuauccuggcuaacacggggaaaccccgucucuacuaaaaaauacaacaaauuagcgaggcguccuggugggcgccuguagucccagcuacuugggaggccgaggcaggagaauggcaggaaccugggaggcggaucuugcagugagccgagaucgcgccacugcaguccagucucaacaacagagcgagacuccgucucaaaaaaaaaaaaauugauuggaacauccuccaagaugcaagacucucaguuccucagaguucuacaggaaggauggcagagugcaguugcccagaguugaagucccaucucugccauuuguuggcugugugaccaggcacaaaucauuaauuucucugagccuguauuuuaccaucuguugcuauugaguaauaguaguggacuauuuucuauuuuuauuuuuauuuuauuuuauuuauuuauuuuuuuugagacggagucucacccugucacccaggcuggagugcaguggcgugaucucagcucacugcaccuaugcuuccgggguucaagucauucuccuuccucagcuuccugaguagcuggaacuacaggcgcgcaccaccacacccagcuaauuuuuuuuuuuuuuuaguagagacaggguuucaccauguuggccaggcuggucucaaaguccugaacucaggugaugcacccgccucagccucccaaagugcugggauugcaggcaugagccacugcgccuggacgaacguuuuuaauuuuuauuuuauuauuauuauuauuauuacuuuuugagauggagcuuuguuuuuguugcccaggcugaagugcaauggcgggaucuuggcucacugcaaccuccgccuccuaggaucaagagauucuccugccuuagccucccaaguaccugggaguauaggcaugcaccaccacgcucgacgauguuuucuauuuuuaguagagaugggguuucuccauguuggucaggcuggucuggaaccccucaccucagcugauccacccaccacagccuccgacaauuacaggcgugagccaccgcgccuagccguccacccuguuuucuaccagaguucuguacugugacucuguauaaaaugguuuggaagcuggacccauccugugugugugugauugcccugagcccacagaaagacaccuccagagugcggauugagaagccuuuauugugggaggaucgggguguccgagggccccgggagucgggauggacuuggaaggcuggggggaggggccuuugaggaagaggaguccuggaagcgggggucaucacaggucaaggggugguccuugggacccccgcagucaguggugcugcggcggcagagugcacauugacagcugagagccacggcguaggagaccacgggguucacgccgcgcgggcagccagggagccggauggacucgaagcgcacaucgcgguaguugcacaccaccugaggcagggccggcaggacccccugcagcacgcgggucuggaagccgugugagugggggaaugagcaugugccuggggccagcgccucagcugagcuccccaguugcccccacaggucucagacucagggguccgggaagcccucuguuccugcccucccacaccccauuccgcagccccugaccagagaggcagaccacccuuccucccccgcugccucugugggucuggcccugagguggcagcaccugcccgggccccgggcagcucaccaugguggggcaguagccggcacagauggugguguugacggugaugcacacggggcagcccuccuucuccacagccaggguggcauugauggggcggcaccguggccgaagcggcuccuuggaugcccaugucccgcccaugcucagcagcagcaacagcagcagccccugggacaaggacacugcuucacccgggucugagaccgcagccccgaguccuggccuucccaucccgcgugguacaccacccacaaagacccagagacccuucccggcaucuccuauucaggacccaccacccggacaccugccuuucagagcccaccccacagcccagaggaccugagaugccccaaaauuucagauccccacccuuaggaacugccccaccugaagcuuacugggggucacgcuccuccagaaagaggccuccuuccacagcucacacuggucugccccuucucaugccagugauugccuggaaggagguggaaggugcccaggggcccugcagucuuaccuggaacaucuccauccuuggugcguccccugccucguguaccuggcuuuauaccucgggguugugggggcggcaaggccaccaggagguuguaggaugcuggggugagcucgacacuaacccuucggggggcaagagguagacaaggccaggggggcgcaggaguggcucagcggagcgccccagcccucuccucucacugguccagcgccaagggugaggcggagaccacggugaagugaucucagagacucagucgucgagugcuagggacuagucgagccuggaggcacagggaguaggguguaggaaggccugccucugccuauggugggguccugggagccaggaggaggccgugacccgagcaaagugcuggauugaagccucaacccuccucuacuugaggcuuuccugcaccacaguccaaccucccaggaggggcgcggcuucggacuuagcuucugcccaaugagagagggccuccccgugacugugcugccagggaagccacuugacccagaugccccccaacgagggauucagcccgagccccaccucucccuuaggaaccuccgcccacucuacccucaagccaggaugcccggagcgguccccggaaaugcgugugcuucaggugauuuaacugauuauugaauaggcccgcaggagguguguccugcccacggggccgaagccucagaggacauuaucuggacuuagucccuuccccgcgaugccaucaagcuggacaauuuuaaggucuguuucuuucccaauguaggguauagguuggcacagggaagagggcuagaaaccugacuugagcuccccacccagggcugaacugugcagcaucuugaucgcuucucauugaaccuugcuuaaacucccccugugaucgguagcucauuaucucaaaacaaaauauucuaagccgaccccugcccacucucaccaaguaagauuucucauuugaaccccagcucccagauacugaaaggccuucuguagaccauguucucaagguccccuggccaucugcuugcauguuccaguuucucuccucccccaugcacaucgugaaaugugcccucccacuccccaggaugaggaaggugguguccucugugacugagcagucagcaacuuaacaccaaaggucaccaaugaucaaauccaugagaguugauccgaggaguuauguauuauggcuaagaaagaguaaacacucaguaaauagugccuauuauuauuaucaucaucaucaugauuauccucaaguucccccaggagaacuccuauucaaccuucaaaaccccaugugguggcacccauccugcagagauugagcucaaauucagagaguugugauuuugugaugauuugaugaguucccaaacugggguccguagagcagcugggccaacccugaggucucucagcauccagcucuguucuuuuucugccugaccaguuccuggguauaagucucaggcccggccaguccggcugaggagugugcagacacaggcagugccaauuugaauccaucaccaguccacacagcccugggcaucagcggucaaugcccgcacauaggacugcuuggccuugcacucagacacccagugccccccgguccacacccugcggcagccccuccaccuaccccugggccaccuucuucagaguuauuggccucgaagcaggugacaaagaaguguuggcagagggaacugccgccagcugcaggcaccucgcccaacaccuccaccuccagcacaccugaguccacagcgguccgggggucugucacccagccagugacugcaucacacacggccagccucacccugaugacucgccagugaaguauugcucaccccucgcuggcugcgguuggcccgggcgccugcugacucccgaaaggccccagucuccagcaggaagaccagagggggcccggcagcggcaccccuaggcaggaccacucaggggaaaagaaggucccacuuuggaucaggaaaaggcgacaaugucgagggugggguuaggaccccauugacacacuggagaggaagaaaaugagggggauguagagggagucugggggagcgggagcaucucucagagcaccucucagagcacauggagacagggaaaaggaggcugggauuagagaagaggauaaacacuucaguggggucagaaguugggaaccccaggggaggccugccugccaggauuauggggaagcccuugcucuagaaguuugggggacuccauauauaggacuugcauaacacccaacuuguagauuaauaguaaauauucaacaacuacaggucaggcauuauggcccacaccuguaaucccagcacuuugggaggcugaggcggguggaugacuugaggucaggacuuugagaccagccuggccaacauggugaaucccugucucuacuaaaaaaaauacaaaaauuagcugggugugguggugggcaccuguacucccagcuacucaggaggcugaggcaggagaaucgcuugaaccccggaagcagagaugcagugagccaagagcgcaccacugcacuccagccugggugacagggccagacucugucucaaacaaaaauaaaaauaaaaauaaaaauaaauaaaaauacauaauagucaacuacuauuacucaauagcaacagaugguaaaauacaggaucagagaaaguaaugauuugugcccggucacacagccaacaaauggcagagaugggacuucaccucugggcgacugcacucugccauccuuccuguagaacucuaaggaaccgagagucuugcauccuggaggauguuccaaucaauuuuuuuuuuuuucagggggagucucacuugucacccaggcuggacugcaguggcucaaucucggcucacugcaagcuccgccucccagguucacaccacucuccugccucagccucccgaguagcugggacuacaggcgcccgccaccaugccuggcuaauuucuuguauuuuuuaguagagacgggguuuccccauguuagccaggauggucuugaucuccugacccugugaucugccuuccucggccucccaaagugcugggauuacaggcaugagccacugcacccggcccaauuuuuuuuucuuuuuuuuuuuugagacagagccucacucugucuggccaggcuggaguagaguggcacaaucccggcgcacuguagcgccugccuccuggguucaagugacucuccugccucagccuucugaguaacuggaauuacaagcgccugccaccgugcccugcuaauuuuuguauuuuuaguagagaugcaguuucacaacauuggccagacuggucucaaacucccaaccuccagugauacuccugcccuggccucccagagugcugggauuauaggccugagaaaccacgccuggccccaaacaaauugcuuuaagacgaggucucccuauguuuccccacugcacuugaacuccugggcucaagccauccuccugcuguggcuccugaguagcugggacuacagacucaagccaccacgccuggccacauuccacaauuuagagaaagugcacaaccuggaauccuagggagaccccgauucaccucaaaacugccacuaaggagguaaaacgcugccccucugaggcaggcuucaguuucccugugugugaaauugaccuggcgcugggagaggcugguggaggcgcggauuuugcaguuucccuacaacauucuggaagccugugguucugggaaagguuggcguggagaagacugggaaacaaccaguggucaccagagcuguagcacccccuccaccucggagcucuggggcugggaaccccaggcuucggggaccacuguggaggacgcagguggcccccucuuuccugacaucucaggagagggagggguaaccggcuagcagaagaaaagcacaggaagguuauacagccagauggggaaggggccaaaucucugaacaaccccuucccagaguuccucuucaagugcaggguacccaagagucaaggccccguccccuuuccagaggccccuuuucuacccagguccuagcugggaugggaggcagauggacggaggggaggggggaggaggggaagggagaggcaguggaugaaggaggauggaagagaugacaucccccucggcccauucaucccauucagguccccaagccgcgccccccaccccgccccaccugcacugccagugccaacgucagagggaggaagagggagcucggcuuagaaggcugaggcccugccaccugggccacaccgaucauguggccuuccuucccccacagaaggccagaccauggacaccuccugagcuggaggucauccuccaucuccacccuguuuucuuuuucuuucuuucuuucuuuuuuuuuuuuuugagauggagucucgcucugucguggaggcuggagugcaguggcgugaucucugcucacugcaagcucccccuccuagguucacuccauucuccugccucagccuuccaaguagcuuggacuacaggggcccgcgaccaagcccagauaaguuuuuguauuuuuaguagagacgggguuucaccguguuagccaggaaggucucgauccccugaccacaugauccgcccgccugggccucccaaaguggugggauuacuggagcgcagcaccacgcccagcuaauuuugguauuaucaguagagauguuguuucacaguguuggccaggcugcucucaaacuccugaccucaagucaaacacccgccucagccucccaaagugcugggacuacaggugugagccauagugccugaccuguaguuguugaauauuuauuauuaaucuacaaguugggugugaugcaaguccuuuauauggagucccccaaacuucuagagcaagggcuuccccauaauccuggcaggcaggccuccccugggguucccaacuucugaccccacugaaguguuuaucuucuucccuaaucccagccuccuuuucccugucuccaugugcucugagagaugcucugagagaugcuccugcucccccaggcucccuccgcaucccccucauuuuccuccuccccagugugucauuggaguccuaaccccauccucgacauugucgcguuuuccuccuccagagugggaccuucuuuucccccgagugguccugucuaggggugccgcugccgggcccccucuggucuuccugcuggagacuggagccuuucgggagucagcaggcgcccgggccaaccgcagccagcguggggugagcgauacuucaccggugagucaucagggugagcuggccgugugcgaugcagucacugucugggugacagaccccuggacugcuguggacuugggugugcucgagguggagguguugggugaggugccugcagcuggcagcaguucccuccgccagcacuucuuuguuacccgcuucgaggccgauaaaucuaaggaagguggcccggggguagguggaggaccugccgccgggguguggaccggggggcacugggugucugagugcaaggccaagcaguccuaugggcgggcauugaccacugaugcccagggccguguggacuggcgauggauucaaauuggcacugccugugucugcacacuccucagccggacuggccgggccugagacuuauacccaggaacuggucaggcagaaaaagaacagagcuggaugcugagagaccucaggguuggcccagcugcucuacggacggaccccaguuggggaacucaucaaaucaucgcaaaaucucaacugucugaauuugagcucaaucucuguaggaugggugcaacaaugugggguuuugaagguugaauaggaacucucccgggggaacuugaggguaaucaugaugaugaugauaauaauaauagccauuauuuacugaguguuuacucuuucguagcccuaauacauaacuccucggaucaacucucauggauuugaucauuggugaccuuugguguuaaguugcugacugcucagucacagaggacaccaccuugcucauccuggggagugggagggcacauuucacgaugugcaugggggaggagagaaacuggaacaugcaagcagauggccaggggaccuugaggacauggucuacagaaggccuuuaaguaucugggagcugggguucaaaugagaaaucuuacuuggugagagcaggcagggguuggcuuagaauauucuguuuugagauaaagagcuaccgaucacacggggaguauaagcaagguucaaugagaagugaucaggaugcuggagaguucagcccugggcggggagcucaagucagguuucuagcccucuucccugugccauccuauacccuacauugggaaagaaacagaccuuaaaauuguccagcuugauggcaucgcggggaagggacuaaguccagauaauguccuccgaggcugcggccucgggggcaggacacaccuccugcgggccuauucaauaaucaguuaaaucacccgaagcacacgcauuuccggggaccgcuccgggcauccuggcuugaggguagagugggcagaggucccuaagggagagguggggcucgggcugaaucccucguuggcggcaccagggucaaguggcuaaccuggcagcacagucacggggaggcccucucucauugggcagaaacuaaguccgaagccgcgccccuccugggcgaggagguuccaccuccuagguuccugugauucuccugccucagcccgaguagugggacaucccacuugcucccgccauucuguuuaccacaggugacgaccgccauggcugacaggcagggaggucccccgaggaccgagcaaggcucgguaucccaaaaaaaaaaaaaaagauacauugaaguaauuuaaaaacacuuaggaagaugucauuucuuccuaucaaggcguccucccuuuauguuuuguuguuauauagggaacgauaaaaaaauuuuuuuuuuuuuuccuaccaauggggcccagguugaccucgaacuccagucccucacacccucgccuagccuugagagcccgagggcaggcucaaucggccggagccacaauggcuccgguugucgggcccauccuuucuucccuuugaucuuacgcagggugauggagccaaucacaagaggcucaucccugacgucacccaguccccagggccagugagggcccugcguuccguggcgcccccuggagggaggaaggggaacugcaucugagagagagcagccaauuggguccgcugacucuggccagguucccgugccgcguccaacaccccucacucccugucucacucccccacggagacucaauuuacuuuccauguccacauucccagugcuugcggaagauaucccgcuaagagagagacaugucaaagguaggguagauccacauuuccgggcaccaaagauggagauguuccaggaaagacugcagggccccugggcaccuuccaccuccuuccaggccaucacuggcaugagaaggggcagacccgugugagcuguggaaggaggccucuuucuggaggagcgugacccccaguaagcuucaggugggucaguuccugagggugcggaucugaaauguugggguaucucagguccucugggcuguggggugggcucugaaaggcagguguccgggugguggguccugaauagaagaugccgggaagggucucugggucuuugugggugguguaccaugcgggaugggaaggccaggacugggggcugcagucucagacccgggugaagcaguguccuugccccagaggcugcugcuguugcugcugcugagcaugggcgggacaugggcauccaaggagccgcuucggccacggugccgccccaucaaugccacccuggcuguggagaaggagggcugccccgugugcaucaccgucaacaccaccaucugugccggcuacugccccaccauggugagcugcccggggccagggcaggugcugccaccucagggccagacccacagaggcagcgggggaggaaggguggucugccucucuggucaggggcugcggaauggggugugggagggcaggaacagagggcuuccuggaccccugagucugagaccugugggggcagcuggggagcucagcugaggcgcuggccccaggcacaugcucauucccccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggacuccucuuccucaaaggccccuccccccagccuuccaaguccaucccgucucccggggcccuaggacaccccgauccucccacaauaaaggcuucucaauccgcacucuggaggugucuuucugugggcucagggcaaucacacacacaggguggguccagcuuccaaacuauuuuauacagagucacaguacagaacucugguagaaaacaggguggacggcugggcgugguggcucacgccuguaauugucggaggcugcgguggguggaucagcugaggugagggguuccagaccaacaugaccaacauggagaaaccccaucucuacuaaaauuacaaaauaucgucgggcgugguggugcaugccuauacucccagguacuugggaggcuuaggcaggagaaucucuugauccuaggaggcggagguugcagugagccaagaucccgccauugcacuucagccugggcaacaaaaacaaagcuccaucucaaaaauuaguaauaauaauaauaauaauaauaauaauaauauaauuaaaaacguucguccaggcgcaguggcucaugccugcaaucccagcacuuugggaggccgaggcaggugcaucaccugaguucaggacuucgagaccagccuggccaacauggugaaacccugucucuacuaaaaaaaaaaaaaaaaauuagcugggugugguggugcgcgccuguaguuccagcuacucaggaagcugaggcaggagaaucgcuugaacccgggaagcauaggugcagugagccgagaucacgccacugcacuccagccugggugacagggcgagacuccgucucaaaaaaaaauaaaauaaauaaaauaaaaauaaaaauagaaaauaguccacuacuauuacucaauagcaacagaugguaaaauacaggcucagagaaauuaaugauuugugccuggucacacagccaacaaauggcagagaugggacuucaacucugggcaacugcacucugccauccuuccuguagaacucugaggaacugagagucuugcaucuuggaggauguuccaaucaauuuuuuuuuuuuuuuugagacggagucucgcucuguuguugagacuggacugcaguggcgcgaucucggcucacugcaagauccgccucccggguuccugccauucuccugccucggccucccaaguagcugggacuacaggcgcccaccaggacgccuggcuaauuuguuguauuuuuuaguagagacggaguuuccccauguuagccaggauagucuugaucuccugacuuugugauccgcccgucucggcuucccaaagugcugggauuacaggcaugaaccacugcgccaggcccaauuuuguuuguuuguuuuguuguuuugggaaaggguggcauggagaagacugggaaacaaccaguggucaccagagcuguagcaccuccuucaccucugagcucuggggcugggaaccccaggcuucggaggccacuguggaggacgcagguggcccccucuuuccugacaucucaggacagggaggggcaaccggcuaggggaagaaaagaacaggaagguuauacagccagguggggaaggggccaaaucccugaacaaccccuucccagaguuccucuucaagcgcaggguacccaagagucaaggccccgcccccuuuccagaggccccuuuucuacuuaggugacggcuccuggcugggaugggagguagauggaccgggggugggaggggggggaggaggggaagggagaggcaguggaugaaggagaauggaagagaugacaucccccuuggcccauucaucccauucagguccccaagcccccaccuggacugccagugccaaccucagaggguggaagagggagcucggcuuagaaugcugaggcccugcccccugggccacaccaaucguguggccuuccuucuccccacggaaggccagaccauggacaccuccugagcuggaugucaucccccaucuccacccucuuuucuuuuucuuucuuucuuucuuuuuuuuuuuuuuuugagauggagucucgcucugucgugcaggcuggagugcaguggcgcgaucucugcucacugcaaccucccgcucccagguucacugcauucuccugcaagcgcccgccaccaagcccggauaacuuuucguauuuuuaguagagacgggguuucaccguguuagccaggauggucucgaucuccugaccucaugauccgccugccucggccucccaaaguggugggauuacaggcgugagccaccacgcccagccguccacccuguuuucuaccagaguucuguacugugacucuguauaaaaugguuuggaagcuggacccacccugugugugugguugcccugagcccacagaaagacaccgccagagugcggauugagaagccuuuauugugggaggaucggggugucugagggccccgggagucgggaugggcuuggaaggcuggggggaggggccuuugaggaagaggaggccuggaagcgggggucaucacaggucaaggggugguccuugggacccccgcagucaguggugcugcggcggcagagugcacauugacagcugagagccacggcguaggagaccacgggguucacgccgcgcgggcagccagggagccggauggacucgaagcgcacaucgcgguaguugcacaccaccugaggcagggccggcaggacccccugcagcacgcgggucuggaagccgugugagugggagaaugagcaugugccuggggccagcgccucagcugagcuccccagcugcccccacaggucucagacucagggguccaggaagcccucuguuccugcccucccacaccccauuccgcagccccugaccagagaggcagaccacccuuccucccccgcugccucugugggucuggcccugagguggcagcaccugccccggccccgggcagcucaccaugguggggcaguagccggcacagauggugguguugacggugaugcacacggggcagcccuccuucuccacagccaggguggcauugauggggcggcaccguggccgaagcggcuccuuggaugcccaugucccgcccaugcucagcagcagcaacagcagcagccccugggacaaggacacugcuucacccgggucugagaccgcagccccgaguccuggccuucccaucccgcgugguacaccacccacaaagacccagagacccuucguggcaucuccuauucaggacccaccacccggacaccugccuuucagagcccaccccacagcccagaggaucucagauaccccaacauuuuagauccccacccucaggaacugccccaccugaagcuuacugggggucacgcuccuccagaaagaggccuccuuccacagcucacacuggucugccccuucucaugccagugauggccuggaagcagguggaaggugcccaggggcccugcagucuuuccuggaacaucuccaucuuuggugccuggaaaugucgaucuacccuaccuuugacaugucucucucuuagcgggauaucuuccgcaagcacuggggauguggacauggaaaguaaauugagucuccgugggggagugagacagggagugagggguguuggacgcggcacgggaacccggccggagucagcggacccaauuggcugcucucucucagauacaguuccccuuccucccuccagggggcgccacggaacgcagggcccucacuggcccuggggacugggugacgucaggggugagccucuccugauuggcuccaucacccugcguaaggucaaaaggaagaaaggagauccccgacaccccgagcuauuguggcuccgaccgguugcgcgugcccucgggcccucagggaggggaggguucgaggguacgaguucgaggccaaccggguccacauugguugagaaaaaaauuuuuuuaucguucccuauauaauaacaaaacauaaagggaggacgccuugauaggaagaaaugacaucuuccuaaguguuuuuaaauuacuucaauguaucuuuuuuuuuuuugggagaccgaggcuugcucgguccucgggggaccucccugccugucagccauggcggucgucaccugugguaaacagaauggcgggagcaagugggaugucccacuacucgggcugaggcaggagaaucacaggaaccuaggagguggaaccuccucgcccaggaggggcgcggcuucggacuuaguuucugcccaaugagagagggccuccccgugacugugcugccagguuagccacuugacccuggugccgccaacgagggauucagcccgagccccaccucucccuuagggaccucugcccacucuacccucaagccaggaugcccggagcgguccccggaaaugcgugugcuucaggugauuuaacugauuauugaauaggcccgcaggagguguguccugcccccgaggccucagccucagaggacauuaucuggacuuagucccuuccccgcgaugccaucaagcuggacaauuuuaaggucuguuucuuucccaguguaggguauagguuggcacagggaagagggcuagaaaccugacuugagcuccccgcccagggcugaacucuccagcauccugaucacuucucauugaaccuugcuuauacuccccgugugaucgguagcucuuuaucucaaaacaaaauauucuaagccgaccccugcccacucucaccaaguaagauuucucauuugaaccccagcucccagauacuuaaaggccuucuguagaccauguccucaagguccccuggccaucugcuugcauguuccaguuucccuccucccccaugcacaucgugaaaugugcccucccacuccccaggaugagcaaggugguguccucugugacugagcagucagcaacuuaacaccaaaggucaccaaugaucaaauccaugagaguugauccgaggaguuauguauuagggcuacgaaagaguaaacacucaguaaauaguggcuauuauuauuaucaucaucaucaugauuacccucaaguuccccugggagagcuccuauucaaccuucaaaaccccacguuguugcacccauccuacagagauugagcucaaauucagagaguugugauuuugcgaugauuugaugaguuccccaacugggguccguccguagagcagcugggccaacccugaggucucucagcauccagcucuguucuuuuucugccugaccaguuccuggguauaagucucaggcccggccaguccggcugaggagugugcagacacaggcugugccaguuugaauccaucgccaguccacacggcccugggcaucagcggucaaugcccgcacauaggacugcuuggccuugcacucagacacccagugccccccgguccacaccccagcggcagccccuccaccuaccccugggccaccuucuucagaguuaucggccuugaagcaggugacaaagaaguguugguggagggaacugcugccagcugcaggcaccucacccaacaccuccaccucgagcacaaccaaguccacagcgguccgggggucugucacccagacacugacugcaucgcacacggccagcucacccugaugacucgccggugaaguaucgcucaccccucgcuggcugcgguuggcccgggugccugcugacucccaaaaggccccagucuccagcaggaagaccagagggggcccggcagcggcaccccuagacaggaccacuugggggaaaauaaggucccacucuggaggaggaaaaggggacaaugucaaggguggggguuaggacuccauugacacacuggggaggaagcaaaugagggggaugcagagggagccugggggagcgggagcaucucucagaggacauggaaacagggaaaaggaggcugggauuagagaagaggauaaacacuucagugaggucagaaguugggaaccccaggggaggccugccugccaggauuauggggaagcccuugcucuagaaguuugggggacuccauguaugggacuugcaucacacccaacuuguagauuaauaauaaauauucaacaacuacaggucaggcacuauggcucacaccuguggucccagcacuuugggaggcugaggcggguguuugacuugaggucaggaguucaaaagcagccuggccaacacugugaaacaacaucucuacuguuaauaccaaaauuagcugggcguggugcugcgcuccuguaaucccaccacuuugggaggcccaggcgggcggaucauguggucaggggaucgagaccuuccuggcuaacacggugaaaccccgucucuacuaaaaauacaaaaacuuaucugggcuuggucgcgggccccuguaguccaagcuacuuggaaggcugaggcaggagaauggagugaaccuaggagggggagcuugcagugagcagagaucgcgccacugcacuccagccuccacgacagagcgagacuccaucucaaaaaaaaaaaaaaaaagaaagaaagaaagaaaaagaaaacaggguggagaugcaggaugaccuccagcucaggagguguccauggucuggccuucuguggggagaaggaaggccacgugaucgguguggcccagguggcagggccucagccuucuaagccgagcucccucuuccucccucugauguuggcacuggcagugcagguggggcggagaggggcgcggcuuggggaccugaaugggaugaaugggccgagggggaugucaucucuuccauccuccuucauccacugccucucccuuccccuccuccccccuccccuccguccaucugccucccaucccagcuaggacccaucaccuggguagaaaaggggccucuggaaagggggcggggccuugacucuuggguacccugcacuugaagaggaacucugggaagggguuguucagggauuuggccccuuccccaccuggcuguauaaccuuccugugcuuuucuucugcuagccgguugccccucccucuccugagaugucaggaaagagggggccaccugcguccuccacaggggccccgaagccugggguucccagccccagagcucggagguggaggaggugcuacagcucuggugaccacugguuguuucccagucuucuccacgccaaccuuucccagaaccacaggcuuccagaauguuguagggaaacugcaaaauccgcgccuccaccagccucucccagcgccaggucaauuucacacacagggaaacugaagccugccucagaggggcagcguuuuaccuccuuaguggcaguuuugaggugaaucggggucucccuaggauuccagguugugcacuuucucuaaauuguggaauguggccaggcgugguggcuugagucuguagucccagcuacucaggagccacagcaggaggauggcuugagcccaggaguucaagugcaguggggaaacauagggagaccucgucuuaaagcaauuuguuuggggccaggcgugguuucucaggccuauaaucccagcacucugggaggccagggcaggaguaucacuggagguugggaguuugagaccagucuggccaauguugugaaacugcaucucuacuaaaaauacaaaaauuagcagggcacgguggcaggcgcuuguaauuccaguuacucagaaggcugaggcaggagagucacuugaacccaggaggcaggcgcuacagugagccaggauugugccacuguacuccagccuggccagacagagugaggcucugucucaaaaaaaaaaaaaaaaaaauugggccgggugcaguggcucaugccuguaaucccagcacuuugggaggccgaggcaggcagaucacaaggucaggagaucaagaccauccuggcuaacacggggaaaccccgucucuacuaaaaaauacaacaaauuagccaggcauaguggugggugccuguagucccagcuacucgggaggcugaggcaggagagugguguaaacccgggagguggaccugcaguuagccgagaucgcgccacugcaguccagccugggcgacaagugagacacccccucaaaaaaaaauugauuggaacauccuccagggugcaagacccucgguuccucagaguucuacaggaaggauagcagagugcaguugcccagaggugaagucccaucucugccauuuguuggcugugugaccaggcacaaaucauuaauuucucugagccuguauuuuaccaucuguugcuauugaguaauaguaguugaauauuuucuacuuuuauuuuuauuuuauuuuuauuuuuauuuuuuuugagacggagucuggcccugucaccuaggcuggagugcaguggcgcgcucucggcucacuacaccucugcuucauggguccaagcgauucuccugccucagccuccugaguagcugggaguacaggugcgcaccaccauacccagcuaauuuuuguguuuuuuuuuuaguagagacagggauucaccauguuggccaggcuggucucaaagucuugaccucaggugaugcacccaccucggccucccaaagcgcugggauugcaggcgugaaccacugcacccggccgaacauuuuuaucuuuauuuuaugauuauuauuauuauuuuuuuaagauggagcuuuguuuuuguugcccaagcugaagugcaauggcgcgaucuuggcucacugcaaccucugccuccugggaucaagugauucuccugccuuagccucccaaguagcugggauuauaagcaugcagcaccacgcuggaggauauuuuguauuuuuaguagaggugcgguuucucuauguuggucaggcuggucuggaacuccucaccucagcugauccacccacugcagccuccgacaaugcuggcauuacaagugugagccaccaugcccggccuuauuuuuauuuuuauuuuuuuugugagacagagucucacucuguuguccaggcggaagugcaguggcaccaucuuggcucacugcaaucucggccucccggguucaagcgauucuccugccucagccuccugaguagcugagaccacaggcgugcagcaccaggccuggcuaauuuugguauuaucaguagagauguuguuucacaguguuggccaggcugcucucgaacuccugaccucaagucauccacccgccucagccucccaaagugcugggauuacaggugugagccauagugccugaccuguaguuguugaauauuuauuauuaaucuacaaguugggugugaugcaaguccuauauauggagucccccaaacuucuagagcaagggcuuccccauaauccuggcaggcaggccuccccugggguuuccaacuucugaccccacugaaguguuuauccucuucucuaaucccagccuccuuuucccugucuccaugugcucugagagaugcucugagagaugcucccacucccccaggcucccuccgcaucccccucauuuuccuccuccccagugugucaauggaguccuaaccccauccucgacauugucgccuuuuccuccuccagagugggaccuucuuuucccccgagugguccugucuaggggugccgcugccgggcccccucuggucuuccugcuggagacuggagccuuucgggagucagcaggcgcccgggccaaccgcagccagcgaggggugagcgauacuucaccggcgagucaucagggugagcuggccgugugcgaugcagucagugucugggugacagaccccuggacugcuguggacuugggugugcucgagguggagguguugggcgaggugccugcagcugucggcaguucccuccgccagcacuucuuuguugcccacuucgaggccgauaaaucugaggaagguggcccggggguagguggagggggcugccgccgggguguggaccggggggcacugggugucugagugcaaggccaagcaguccuaugugcgggcauugaccgcugaugcccagggccguguggacuggcgauggauucaaacuggcacagccugugucugcacacuccucagccggacuggccgggccugagacuuauacccaggaacuggucaggcagaaaaagaacagagcuggaugcugagagaccucaggguuggcccagcugcucuacggacggaccccaguuggggaacucaucaaaucaucacaaaaucacaacucucugaauuugagcucaaucucugcaggaugggugccaccacaugugguuuugaagguugaauaggagcucucccaggggaacuugaggguaaucaugaugaugaugaugaugaugauaauaauaauagccacuauuuacugaguguuuacucuuucguagcccuaauacauaacuccucggaucaacucucauggauuugaucauuggugaccuuugguguuaaguugcugacugcucagucacagaggacaccaccuugcucauccuggggagugggagggcacauuucacgaugugcaugggggaggagggaaacuggaacaugcaagcagauggccaggggaccuugaggacauggucuacagaaggccuuuaaguaucugggagcugggguucaaaugagaaaucuuacuuggugagagcaggcagggguuggcuuagaauauucuguuuugagauaaagagcuaccgaucacacggggaguauaagcaagguucaaugagaagugaucaggaugcuggagaguucagcccugggcggggagcucaagucagguuucuagcccucuucccugugccaaccuauacccuacauugggaaagaaacagaccuuaaaauuguccagcuugauggcaucgcggggaagggacuaaguccagauaauguccuccgaggcuucggccccaugggcaggacacaccuccugcgggccuauucaauaaucaguuaaaucaccugaagcacacgcauuuccggggacagcuccgggcauccuggcuugaggguagggugggcggaggucccuaagggagagguggggcucgggcugaaucccucguuggcggcaccagggucaaguggcuucccuggcagcacagucacggggaggcccucucucauugggcagaaacuaaguccgaagccgcgccccuccugggagguuggacuguggugcaggaaagccucaaguagaggaggguugaggcuucaguccagcaccuuucucgggucacggccuccuccuggcucccaggaccccaccauaggcagaggcaggccuuccuacacccuacucccugugccuccagccucgacuagucccuagcacucgacgacugagucucugaggucacuucaccguggucuccgccucacccuuggcgcuggaccagugagaggagagggcuggggcgcuccgcugagccacuccugcgccccccuggccuugucuaccucuugccccccgagggguuagugucgagcucaccccagcauccuaucaccuccugguggccuugccgcccccacaaccccgagguauaaagccagguacacgaggcaggggacgcaccaaggauggagauguuccagguaagacugcagggccccugggcaccuuccaccuccuuccaggcaaucacuggcaugagaaggggucagaccagugugagcuguggaaggaggccucuuucuggaggagcgugacccccaguaagcuucagguggggcauuuccugaaggugcggaucugaaauguugggguaucucagguccucugggcuguggggugggcucugaaaggcagguguccgggugguggguccugaauaggagaugccgggaagggucucugggucuuugugggugguguaccacgcgggaugggaaggccaggacucggggcugcggucucagacccgggugaagcaguguccuugucccaggggcugcugcuguugcugcugcugagcaugggcgggacaugggcauccaaggagccgcuucggccacggugccgccccaucaaugccacccuggcuguggagaaggagggcugccccgugugcaucaccgucaacaccaccaucugugccggcuacugccccaccauggugagcugcccggggccggggcaggugcugccaccucagggccagacccacagaggcagcgggggaggaaggguggucugccucucuggucaggggcugcggaauggggugugggagggcaggaacagagggcuuccuggaccccugagucugagaccugugggggcagcuggggagcucagcugaggcgcuggccccaggcacaugcucauucccccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggacuccucuuccucaaaggccccuccccccagccuuccaagcccaucccgacucccggggcccucggacaccccgauccucccacaauaaaggcuucucaauccgcacucuggaggugucuuucugugggcucagggcaaccacacacacacaggauggguccagcuuccaaaccauuuuauacagagucacaguaugagaacucugguagaaaacaguguggggucgggggaugacaucgcaacuuuacucuacauugggaaagaaacagaccuuaaaauuuuccagcuugauggccaggugcgauggcugaugccuguaaucccagcacuuugagaggccaagacaggcgaaucaccugagguuaggaguucaagaccagccugguuaacauggugaaaccccgucucuacuaaaauuacauaaagaaauuagcugggcguguaggcgggugccuguaaucccagcuacucuggagggugaggcaggagaaucgcuugaacccgggaggcggagguugcagugagcggagacugugccauugcacuccagccugggcaaaaagagggaaaguccgucucaaaaaaaaaaaaaaauuguccaguuugagugggacaugagguucugacuaacucgccgucccccuggcuaggaucaggggguuauucgucauugagagcccuugaguagggucagcaaaauccaacagaagggccccagaagcaugauucagggaggaacaguaagugggauugugggccuggcugcagaaggcagccucagguuuccuugucugaagaaugggcucgugggaugagauaaugaggguugaggaggcagaggccuagaccaaaagcuauuuuuuuuuuuuuuuuugagauggagucuugcucuguccccuaggcuggagugcaguggcaugaucucagcucacugccaccuucaccuccugaguucaagugauucuccugccuuaguugggauuacaggugugcgccaccaugccuggcuacuuuuuauauuuuucgauagagacaggguuuugccauguuggccaggcugguuucaaacuccuaaccucaaguuaucugcccgccucugccucucaaagugcugggauuacaggagugagucaucgugcccggugaccaaaagcucuauauggugaagaaaugacaagggaagccagggacagaccacaggaguucacaguagcccuucaccuaugaccccuauuacccaucucccuacauguguugccaacacacagacauacagacacacacacacucacucucucucucucucucugguccacaggacuucacaauagcccuucaccuauuacccaucuccccacauguguugccaacacacagacagacacacacacacacacacacucugucucucucucucucucucucuuucucucugucugggacagaccacaggacuucacaauagcccuuuaccuauuacccaucuccccacauguguugccaacacacagacacagacacacacacacacucucucucucucacuuucucucccccucucucucucucagguccagcuuugagcaaaggacauaggcacccccuccaccaaucuguacagaccaggccccucggcagggagggguguggcugccuccguuucuacaucuccuuguuaccaucucugauuuugcucuuuuuugccgccuuucucucugucucuaacuuccgguggcucuagccucugggugaguacuaauagcuccguuuccagcguggucugugucuuccucccugucucucuccucucuuguauuucuuucucacucaucaaagcccauguuuuucgcuaugguccggugcacuucucugugggugccucccuguuuccacaccccgccuacccagguggaacuuuucaagccaaucaaaggcaggcaggacagccaaugcuagugcugauuacuucagcacgugcaugcagggagggucggggagccccggggaugucuggaaaucguuacccugaggugggcaggccugguagagggaggaagcagccaggagcaucugggcccuggaagaaagggggguguuucucauggauguccugaguugcuaggugcagcgcaggggucucugucucucugucuggaucucugacaccuccaggucccugucccucuuuuuggguuucucucucccccacccccugggucucugaaauacugaacuucuccuucccuuuccacccuccuaucuuugagucuccauucccccuccuuguguuucuuuguaccccucuuggggucccugucucugggucucuuucucauuccauccauccaggugccugcaggcccuugauugacuagguucugggugggcggguucugucaccuggggcaacaaccacaauaagccagcuccugcuuggcuacggaguggggguggaaccauggccaguggcacccuggcuccgggcugucguaucucugcaaccgagguaccuggauccaggcccaacugccaucucaccagcagcuacuuuucccaccgcauuaucccacccauacccuucaccccgcccacggugcaggugagcggacccuacgcugcagcccugccgggccuggagacccagaaagauaggggcuaaauaaagcggauugggagcuuggacuccucucugaaggaggaggguccuggaguucugggucugagagaggaggcaccagggaagcugaaugccagggacugcagaggaaagggcugggggccgacuggaagaggucagaguuugggguggggggugauagggacuccugagucuuucuagcugaugugcggcgccuucucuccaguccacggucgcggacccucuaccccaaguugcaaagcaggauucucacaacugggcuuucgacgagguccucagcagaugggagacaaccucuggcucggccuacgugcccaagacccauggcgggcccugcgcccagcccagagccccagagccugcagaccccacgcggacuguggggaucaaggauuuaggagaaaagguaaaguuuggggagugccggaguccgcaggggacagggcgggggacugcauuugaguccccugcuccuucacgugagucucugggucgccuuuccgcagcucagacaccgcggcuggcgccucccacugaccacaaaguaccagagcagcgagacgagggcgcaguacacuggcucucccagcggggacccgcgcgccccggaauacuucgggccccagcccccacaacucgcagaccaccaccgcggggguccuucccaggugucuggguggaagccggcgccggcgagacggggcggagcuccgggagccuggggcggggccagaaggaaucacggcuuuggggcguggcuaaagggucuggggcgggaucgcgagguuagaggagccgggggaggggcugggcauuaggccaggccagaaggaccagggacuacaaacucaccuucagggcuccuaagcugcugcggagcuagacggcgggcuguggguggggaggagacuagaauauucugagacggggucaggugggaguugggagagguaacuuggaguugcugcccaagaugcagcucagcuccaguggccacaccaagacgguuuaagacagagcggaaccagggagguuguuuuugguggcugggggcuuggguuugaguuccuugaacagcagaaggugcuuggauuuagggaggugaggcugggaaggguucggguaugagaaaggaagcugaaguucccuggcguggguggcaggaagggcucuaacccuggggcggggugugagggccguggccgucauggcugucgaggccgaaggagagggauucugaacucgggacccagggcuugggaugggguaugaaaucuaugucuuggguaugccuccucccccaaucuugcucaggcucuaauugccuggacgaagaaccccgagcugucuggccggccuuucacaguauccgaccggggcguccuggaccgccgccagcucuaucugaccaccucggcgcgggacuuucgguucuaucccaaguaagccgggcucucgcucggcaccgccuccugcacagcccccgccguggccggugcacgccgagccccugggcuggcucccauucccugagccgguggucucagccucgacuucuguagcagcaagaaccaaaguucaggccucagccccucccuuuuuuuuuuaagcacccaggaguccuuagugucaccucucaggaaccgcgguagggacaggaagccugcacagcggcucgaggggauuccggaucugagggcagggccuccuucgguacuugagcccccagauacuccuucccaaggaagcgaaaguccccuuuuacuucccuaggaugcgaaagcucaguuuccaggacguuaaguaccucgaggacccaggaacgcaggcaacgcgugccgggucgcguccuuccuaaggggugcucgccuggaaaugcaggaguuugaaugugcagacuccuuagaucccgaggucugaaacucguccccaaggauccagcuguauccucaccaucccgcccugcucccacaggacggagcuguccggauacccccgcaaggacucccugaccuacuggagcuucgaagagacgccccaggucuggagccacggcccgcagcggccgcccuguccgcgcuccucccggccgccccgaccaccgcggguccgcgugccgcgcgucagcccggugaccucggccaugccgcaccggggagcccugucucuggcucaggaguccuacagcccccugcugcacccgcuccggcggcucgaccgcuucugcccgcuggaggcgcccuggggcggcccgcacuggaagccccugcggggcaucuacagcgugccgaaagccuacaguaccgagaacuccagcuauggcagcuugaagccggcgcuggugugagccgucagggccagccccaccccagacccgcccccagggccgcgcugccgagcggagcucgggaccuccgcucacuaggaaggguuccggacccagccugagucgcacucauuacgucuauuggcaacgugggggcgggacuagcccagacacccacucagcugcggcaucacggagaggggacuaaguccagauaauguccuugcaggcuguggccccgggggcaagacacgcacccugcgggcguauuaaauaaugaguuaaaucaccugaaccacacccacuuccggggacgcuccgggcauccuggcuugaggguagggugggcggaggucccuaagggagagguggggcucgggcuuaaucccuccuugggggcaucugggucaaguggcuucccuggcagcacagucacggggagacccucucucacugggcagaagcuaaguccgaagcagcgccccuccuguuagguuggacuguggugcaggaaagccucaaguggaggguugaggcuucaguccagcaccuuucucgggucauggccuccuccuggcucccaagaccccacaauuggcagaggcaggccuuccuacacccuacucccugugccuccaggcucgacuagucccuagcacucgacaacugggucucugaggucacuucaccguggucucugccucaccucuggcgcuagaccacugaggggagagggcuggggcgcucugcugagccacuccugcgccucccuggccaugugcaccucucgcccccggggggauuaguguccagguuaccccagcauccuaucaccuccugguggccuugccgcccccacaaccccgagguauauagccagauacacgaggcaggggaugcaccaaggauggagaugcuccagguaagacuacagggccccugggcaccuuccaccuccuuccaggccaucacuggcaugagaaggggcagacccgugugagcuguggaaggaggccucuuucuggaggggcaugacccccaguaagcuucagguggggcaguuccugaggguggggaucugaaauguuggggcaucucagguccucugggcuguggggugggcucugaaaggcagguguccgggugguggguccugaauaggagaugccgggaagggucucugggucuuugugggugguguaccacgcgggaugggaaggccaggacucggggcugcggucucagaccugggugaagcaguguccuugucccaggggcugcugcuguugcugcugcugagcaugggcggggcaugggcauccagggagccgcuucggccauggugccaccccaucaaugccauccuggcugucgagaaggagggcugcccagugugcaucaccgucaacaccaccaucugugccggcuacugccccaccauggugagcugccuggggccaggggcagaugcugccaccucagggccagacccacagaggcagcgggggaggaaggguggucugccucucuggccugcgguuggggaauggggugugggaaggcaggaacagagggcuuccugggcuccugaguccaggaccuguggggucagcuugggagcucagcugaggcgcuggccucaggcacaugcucauucccccacucacacggccuccagaugcgcgugcugcaggcgguccugccgccccugccucagguggugugcaccuaccgugaugugcgcuucgaguccauccggcucccuggcugcccgcgugguguggaccccguggucuccuucccuguggcucucagcugucgcuguggacccugccgccgcagcaccucugacugugggggucccaaagaccaccccuugaccugugaccacccccaacucucaggccuccucuuccucuaaagacccuccccgcagccuuccaaguccaucccgacuccuggagcccugacaccccgauccucccacaauaaaggcuucucaauccgcacucuggaggugucuuucugugggcucagggcaaccacacauacacagggugggugcagcuucccaaccauuuuauacagagucacagugucagaacucugguggaaaacaggguggggucgggggaugacauccaacucaggagguguccauggucucgccuucuguggggagaaggaaggccacauggucagugucgcccagguggcagggccugagccuucuacgccgagcucccucuuccucccucugagguuggcucuggcagugcaggugcgggguggggauucuuacugaguucguugaagaggaaggcguccugguacuccuucauguacugcguggagcgggacucguccaggaagagugaguagacccgcuugaugucauccaccugcacuucuguacccuggagggggagggcgaguccucaguugggccccucuccgugaggcucaaggcacagaccccagcguaugccaccuccaugcucuaggcagcagaguguggcaugugaggggagggcauucugggccagauugccuggguucaaauccugccuggccaucuccuuguugugggcccagccucuucauuccucaguuucuuuaucuguaagguggaccuaacagcaucuacuuaagucaagagagauuuacugauaccuacuauaggccaggcuggaugauacagaagccaaccugagggaugaaaauucccugcgucugaaaacguacauucuaggaugaaaucggaacccuggaagccccugaaguacugugucacucacugccgccaucuggcccugcuggcuaauucggccggcugaccuugcguuuccggcacaccaagcuggcagcugugaugagcuggauggcguagcgcagugacgucuccagcccgaugcgggucagcaccguguaggcguccucacucaucuccacaucuucuuccucgcaccugcaagcagugggggacagggguggcucagccggggcccagccucugacugcagcagaaguggccacagcaacccucuggcccuuccccacugggaauauguggcgccugcaucuuagaaccauagaaugcugaggcuagaagagccacggagacaggggcugggcuggaccuaaaaccgaggccuccugaccacccccagggcgcuggccccaacaccagucacggguaccucgccucccuuucccaccguggcuccugcucccggaucggaggccaccgucugggugcccgcucagcccucucuccuguaggcccagccaccaugccacuccgcuggaccucagugucagcauuugucaaacaggguagaccccagcccugcgucucaggcgcacggccugguccugcccgcaccggaugcggaggaucugcuucgugucuuucucgcuguagggggugguggagacgauaagcagccgguccagcaggucuauggggaugccgugagggcucugguagcuggugccccggauucugaggaagaggcagaaagagggggcu

SEQ ID NO: 15173 - RNA, 44814 nt, Homo sapiens
agcccccucuuucugccucuuccucagaauccggggcaccagcuaccagagcccucacggcauccccauagaccugcuggaccggcugcuuaucgucuccaccacccccuacagcgagaaagacacgaagcagauccuccgcauccggugcgggcaggaccaggccgugcgccugagacgcagggcuggggucuacccuguuugacaaaugcugacacugagguccagcggaguggcaugguggcugggccuacaggagagagggcugagcgggcacccagacgguggccuccgauccgggagcaggagccacggugggaaagggaggcgagguacccgugacugguguuggggccagcgcccuggggguggucaggaggccucgguuuuagguccagcccagccccugucuccguggcucuucuagccucagcauucuaugguucuaagaugcaggcgccacauauucccaguggggaagggccagaggguugcuguggccacuucugcugcagucagaggcugggccccggcugagccaccccugucccccacugcuugcaggugcgaggaagaagauguggagaugagugaggacgccuacacggugcugacccgcaucgggcuggagacgucacugcgcuacgccauccagcucaucacagcugccagcuuggugugccggaaacgcaaggucagccggccgaauuagccagcagggccagauggcggcagugagugacacaguacuucaggggcuuccaggguuccgauuucauccuagaauguacguuuucagacgcagggaauuuucaucccucagguuggcuucuguaucauccagccuggccuauaguagguaucaguaaaucucucuugacuuaaguagaugcuguuagguccaccuuacagauaaagaaacugaggaaugaagaggcugggcccacaacaaggagauggccaggcaggauuugaacccaggcaaucuggcccagaaugcccuccccucacaugccacacucugcugccuagagcauggagguggcauacgcuggggucugugccuugagccucacggagaggggcccaacugaggacucgcccucccccuccaggguacagaagugcagguggaugacaucaagcgggucuacucacucuuccuggacgagucccgcuccacgcaguacaugaaggaguaccaggacgccuuccucuucaacgaacucaguaagaauccccaccccgcaccugcacugccagagccaaccucagagggaggaagagggagcucggcguagaaggcucaggcccugccaccugggcgacacugaccauguggccuuccuucuccccacagaaggcgagaccauggacaccuccugaguuggaugucaucccccgaccccacccuguuuuccaccagaguucugacacugugacucuguauaaaaugguugggaagcugcacccacccuguguaugugugguugcccugagcccacagaaagacaccuccagagugcggauugagaagccuuuauugugggaggaucggggugucagggcuccaggagucgggauggacuuggaaggcugcggggagggucuuuagaggaagaggaggccugagaguuggggguggucacaggucaagggguggucuuugggacccccacagucagaggugcugcggcggcaggguccacagcgacagcugagagccacagggaaggagaccacgggguccacaccacgcgggcagccagggagccggauggacucgaagcgcacaucacgguaggugcacaccaccugaggcaggggcggcaggaccgccugcagcacgcgcaucuggaggccgugugagugggggaaugagcaugugccugaggccagcgccucagcugagcucccaagcugaccccacagguccuggacucaggagcccaggaagcccucuguuccugccuucccacaccccauuccccaaccgcaggccagagaggcagaccacccuuccucccccgcugccucugugggucuggcccugagguggcagcaucugccccuggccccaggcagcucaccaugguggggcaguagccggcacagauggugguguugacggugaugcacacugggcagcccuccuucucgacagccaggauggcauugaugggguggcaccauggccgaagcggcucccuggaugcccaugccccgcccaugcucagcagcagcaacagcagcagccccugggacaaggacacugcuucacccaggucugagaccgcagccccgaguccuggccuucccaucccgcgugguacaccacccacaaagacccagagacccuucccggcaucuccuauucaggacccaccacccggacaccugccuuucagagcccaccccacagcccagaggaccugagaugccccaacauuucagauccccacccucaggaacugccccaccugaagcuuacugggggucaugccccuccagaaagaggccuccuuccacagcucacacgggucugccccuucucaugccagugauggccuggaaggagguggaaggugcccaggggcccuguagucuuaccuggagcaucuccauccuuggugcauccccugccucguguaucuggcuauauaccucgggguugugggggcggcaaggccaccaggaggugauaggaugcugggguaaccuggacacuaauccccccgggggcgagaggugcacauggccagggaggcgcaggaguggcucagcagagcgccccagcccucuccccucaguggucuagcgccagaggugaggcagagaccacggugaagugaccucagagacccaguugucgagugcuagggacuagucgagccuggaggcacagggaguaggguguaggaaggccugccucugccaauuguggggucuugggagccaggaggaggccaugacccgagaaaggugcuggacugaagccucaacccuccacuugaggcuuuccugcaccacaguccaaccuaacaggaggggcgcugcuucggacuuagcuucugcccagugagagagggucuccccgugacugugcugccagggaagccacuugacccagaugcccccaaggagggauuaagcccgagccccaccucucccuuagggaccuccgcccacccuacccucaagccaggaugcccggagcguccccggaagugggugugguucaggugauuuaacucauuauuuaauacgcccgcagggugcgugucuugcccccggggccacagccugcaaggacauuaucuggacuuaguccccucuccgugaugccgcagcugagugggugucugggcuagucccgcccccacguugccaauagacguaaugagugcgacucaggcuggguccggaacccuuccuagugagcggaggucccgagcuccgcucggcagcgcggcccugggggcgggucugggguggggcuggcccugacggcucacaccagcgccggcuucaagcugccauagcuggaguucucgguacuguaggcuuucggcacgcuguagaugccccgcaggggcuuccagugcgggccgccccagggcgccuccagcgggcagaagcggucgagccgccggagcgggugcagcagggggcuguaggacuccugagccagagacagggcuccccggugcggcauggccgaggucaccgggcugacgcgcggcacgcggacccgcgguggucggggcggccgggaggagcgcggacagggcggccgcugcgggccguggcuccagaccuggggcgucucuucgaagcuccaguaggucagggaguccuugcggggguauccggacagcuccguccugugggagcagggcgggauggugaggauacagcuggauccuuggggacgaguuucagaccucgggaucuaaggagucugcacauucaaacuccugcauuuccaggcgagcaccccuuaggaaggacgcgacccggcacgcguugccugcguuccuggguccucgagguacuuaacguccuggaaacugagcuuucgcauccuagggaaguaaaaggggacuuucgcuuccuugggaaggaguaucugggggcucaaguaccgaaggaggcccugcccucagauccggaauccccucgagccgcugugcaggcuuccugucccuaccgcgguuccugagaggugacacuaaggacuccugggugcuuaaaaaaaaaagggaggggcugaggccugaacuuugguucuugcugcuacagaagucgaggcugagaccaccggcucagggaaugggagccagcccaggggcucggcgugcaccggccacggcgggggcugugcaggaggcggugccgagcgagagcccggcuuacuugggauagaaccgaaagucccgcgccgagguggucagauagagcuggcggcgguccaggacgccccggucggauacugugaaaggccggccagacagcucgggguucuucguccaggcaauuagagccugagcaagauugggggaggaggcauacccaagacauagauuucauaccccaucccaagcccugggucccgaguucagaaucccucuccuucggccucgacagccaugacggccacggcccucacaccccgccccaggguuagagcccuuccugccacccacgccagggaacuucagcuuccuuucucauacccgaacccuucccagccucaccucccuaaauccaagcaccuucugcuguucaaggaacucaaacccaagcccccagccaccaaaaacaaccucccugguuccgcucugucuuaaaccgucuugguguggccacuggagcugagcugcaucuugggcagcaacuccaaguuaccucucccaacucccaccugaccccgucucagaauauucuagucuccuccccacccacagcccgccgucuagcuccgcagcagcuuaggagcccugaaggugaguuuguagucccugguccuucuggccuggccuaaugcccagccccucccccggcuccucuaaccucgcgaucccgccccagacccuuuagccacgccccaaagccgugauuccuucuggccccgccccaggcucccggagcuccgccccgucucgccggcgccggcuuccacccagacaccugggaaggacccccgcggugguggucugcgaguugugggggcuggggcccgaaguauuccggggcgcgcggguccccgcugggagagccaguguacugcgcccucgucucgcugcucugguacuuuguggucagugggaggcgccagccgcggugucugagcugcggaaaggcgacccagagacucacgugaaggagcaggggacucaaaugcagucccccgcccuguccccugcggacuccggcacuccccaaacuuuaccuuuucuccuaaauccuugauccccacaguccgcguggggucugcaggcucuggggcucugggcugggcgcagggcccgccaugggucuugggcacguaggccgagccagagguugucucccaucugcugaggaccucgucgaaagcccaguugugagaauccugcuuugcaacuugggguagaggguccgcgaccguggacuggagagaaggcgccgcacaucagcuagaaagacucaggagucccuaucaccccccaccccaaacucugaccucuuccagucggcccccagcccuuuccucugcagucccuggcauucagcuucccuggugccuccucucucagacccagaacuccaggacccuccuccuucagagaggaguccaagcucccaauccgcuuuauuuagccccuaucuuucugggucuccaggcccggcagggcugcagcguaggguccgcucaccugcaccgugggcggggugaaggguaugggugggauaaugcggugggaaaaguagcugcuggugagauggcaguugggccuggauccagguaccucgguugcagagauacgacagcccggagccagggugccacuggccaugguuccacccccacuccguagccaagcaggagcuggcuuauugugguuguugccccaggugacagaacccgcccacccagaaccuagucaaucaagggccugcaggcaccuggauggauggaaugagaaagagacccagagacagggaccccaagagggguacaaagaaacacaaggagggggaauggagacucaaagauaggaggguggaaagggaaggagaaguucaguauuucagagacccagggggugggggagagagaaacccaaaaagagggacagggaccuggaggugucagagauccagacagagagacagagaccccugcgcugcaccuagcaacucaggacauccaugagaaacaccccccuuucuuccagggcccagaugcuccuggcugcuuccucccucuaccaggccugcccaccucaggguaacgauuuccagacauccccggggcuccccgacccucccugcaugcacgugcugaaguaaucagcacuagcauuggcuguccugccugccuuugauuggcuugaaaaguuccaccuggguaggcgggguguggaaacagggaggcacccacagagaagugcaccggaccauagcgaaaaacaugggcuuugaugagugagaaagaaauacaagagaggagagagacagggaggaagacacagaccacgcuggaaacggagcuauuaguacucacccagaggcuagagccaccggaaguuagagacagagagaaaggcggcaaaaaagagcaaaaucagagaugguaacaaggagauguagaaacggaggcagccacaccccucccugccgaggggccuggucuguacagauugguggagggggugccuauguccuuugcucaaagcuggaccugagagagagagagggggagagaaagugagagagagagagugugugugugugucugugucuguguguuggcaacacauguggggagauggguaauagguaaagggcuauugugaaguccuguggucugucccagacagagagaaagagagagagagagagagagacagagugugugugugugugugugucugucuguguguuggcaacacauguggggagauggguaauaggugaagggcuauugugaaguccuguggaccagagagagagagagagagugagugugugugugucuguaugucuguguguuggcaacacauguagggagauggguaauaggggucauaggugaagggcuacugugaacuccuguggucugucccuggcuucccuugucauuucuucaccauauagagcuuuuggucaccgggcacgaugacucacuccuguaaucccagcacuuugagaggcagaggcgggcagauaacuugagguuaggaguuugaaaccagccuggccaacauggcaaaacccugucucuaucgaaaaauauaaaaaguagccaggcaugguggcgcacaccuguaaucccaacuaaggcaggagaaucacuugaacucaggaggugaagguggcagugagcugagaucaugccacugcacuccagccuaggggacagagcaagacuccaucucaaaaaaaaaaaaaaaaauagcuuuuggucuaggccucugccuccucaacccucauuaucucaucccacgagcccauucuucagacaaggaaaccugaggcugccuucugcagccaggcccacaaucccacuuacuguuccucccugaaucaugcuucuggggcccuucuguuggauuuugcugacccuacucaagggcucucaaugacgaauaacccccugauccuagccagggggacggcgaguuagucagaaccucaugucccacucaaacuggacaauuuuuuuuuuuuuuugagacggacuuucccucuuuuugcccaggcuggagugcaauggcacagucuccgcucacugcaaccuccgccucccggguucaagcgauucuccugccucacccuccagaguagcugggauuacaggcacccgccuacacgcccagcuaauuucuuuauguaauuuuaguagagacgggguuucaccauguuaaccaggcuggucuugaacuccuaaccucaggugauucgccugucuuggccucucaaagugcugggauuacaggcaucagccaucgcaccuggccaucaagcuggaaaauuuuaaggucuguuucuuucccaauguagaguaaaguugcgaugucaucccccgaccccacacuguuuucuaccagaguucucauacugugacucuguauaaaaugguuuggaagcuggacccauccugugugugugugguugcccugagcccacagaaagacaccuccagagugcggauugagaagccuuuauugugggaggaucgggguguccgagggccccgggagucgggaugggcuuggaaggcuggggggaggggccuuugaggaagaggaguccuggaagcgggggucaucacaggucaaggggugguccuugggacccccgcagucaguggugcugcggcggcagagugcacauugacagcugagagccacggcguaggagaccacgggguucacgccgcgcgggcagccagggagccggauggacucgaagcgcacaucgcgguaguugcacaccaccugaggcagggccggcaggacccccugcagcacgcgggucuggaagccgugugagugggggaaugagcaugugccuggggccagcgccucagcugagcuccccagcugcccccacaggucucagacucagggguccaggaagcccucuguuccugcccucccacaccccauuccgcagccccugaccagagaggcagaccacccuuccucccccgcugccucugugggucuggcccugagguggcagcaccugccccggccccgggcagcucaccaugguggggcaguagccggcacagauggugguguugacggugaugcacacggggcagcccuccuucuccacagccaggguggcauugauggggcggcaccguggccgaagcggcuccuuggaugcccaugucccgcccaugcucagcagcagcaacagcagcagccccugggacaaggacacugcuucacccgggucugagaccgcagccccgaguccuggccuucccaucccgcgugguacaccacccacaaagacccagagacccuucccggcaucuccuauucaggacccaccacccggacaccugccuuucagagcccaccccacagcccagaggaccugagauaccccaacauuucagauccgcaccuucaggaaaugccccaccugaagcuuacugggggucacgcuccuccagaaagaggccuccuuccacagcucacacuggucugaccccuucucaugccagugauugccuggaaggagguggaaggugcccaggggcccugcagucuuaccuggaacaucuccauccuuggugcguccccugccucguguaccuggcuuuauaccucgggguugugggggcggcaaggccaccaggaggugauaggaugcuggggugagcucgacacuaaccccucggggggcaagagguagacaaggccaggggggcgcaggaguggcucagcggagcgccccagcccucuccucucacugguccagcgccaagggugaggcggagaccacggugaagugaccucagagacucagucgucgagugcuagggacuagucgaggcuggaggcacagggaguaggguguaggaaggccugccucugccuauggugggguccugggagccaggaggaggccgugacccgagaaaggugcuggacugaagccucaacccuccucuacuugaggcuuuccugcaccacaguccaaccucccaggaggggcgcggcuucggacuuaguuucugcccaaugagagagggccuccccgugacugugcugccagggaagccacuugacccuggugccgccaacgagggauucagcccgagccccaccucucccuuagggaccuccgcccacccuacccucaagccaggaugcccggagcuguccccggaaaugcgugugcuucaggugauuuaacugauuauugaauaggcccgcaggagguguguccugcccauggggccgaagccucggaggacauuaucuggacuuagucccuuccccgcgaugccaucaagcuggacaauuuuaaggucuguuucuuucccaauguaggguauagguuggcacagggaagagggcuagaaaccugacuugagcuccccgcccagggcugaacucuccagcauccugaucacuucucauugaaccuugcuuauacuccccgugugaucgguagcucuuuaucucaaaacagaauauucuaagccaaccccugccugcucucaccaaguaagauuucucauuugaaccccagcucccagauacuuaaaggccuucuguagaccauguccucaagguccccuggccaucugcuugcauguuccaguuucccuccucccccaugcacaucgugaaaugugcccucccacuccccaggaugagcaaggugguguccucugugacugagcagucagcaacuuaacaccaaaggucaccaaugaucaaauccaugagaguugauccgaggaguuauguauuagggcuacgaaagaguaaacacucaguaaauaguggcuauuauuauuaucaucaucaucaucaucaucaugauuacccucaaguuccccugggagagcuccuauucaaccuucaaaaccacaugugguggcacccauccugcagagauugagcucaaauucagagaguugugauuuugugaugauuugaugaguuccccaacugggguccguccguagagcagcugggccaacccugaggucucucagcauccagcucuguucuuuuucugccugaccaguuccuggguauaagucucaggcccggccaguccggcugaggagugugcagacacaggcugugccaguuugaauccaucgccaguccacacggcccugggcaucagcggucaaugcccgcacauaggacugcuuggccuugcacucagacacccagugccccccgguccacaccccggcggcagcccccuccaccuacccccgggccaccuuccucagauuuaucggccucgaagugggcaacaaagaagugcuggcggagggaacugccgacagcugcaggcaccucgcccaacaccuccaccucgagcacacccaaguccacagcaguccaggggucugucacccagacacugacugcaucgcacacggccagcucacccugaugacucgccggugaaguaucgcucaccccucgcuggcugcgguuggcccgggcgccugcugacucccgaaaggcuccagucuccagcaggaagaccagagggggcccggcagcggcaccccuagacaggaccacucgggggaaaagaaggucccacucuggaggaggaaaaggcgacaaugucgaggaugggguuaggacuccauugacacacuggggaggaggaaaaugagggggaugcggagggagccugggggagugggagcaucucucagagcaucucucagagcacauggagacagggaaaaggaggcugggauuagagaagaggauaaacacuucaguggggucagaaguuggaaaccccaggggaggccugccugccaggauuauggggaagcccuugcucuagaaguuugggggacuccauauauaggacuugcaucacacccaacuuguagauuaauaauaaauauucaacaacuacaggucaggcacuauggcucacaccuguaaucccagcacuuugggaggcugaggcggguggaugacuugaggucaggaguucgagagcagccuggccaacacugugaaacaacaucucuacugauaauaccaaaauuagccaggccuggugcugcacgccuguggucucagcuacucaggaggcugaggcaggagaaucgcuugaacccgggaggccgagauugcagugagccaagauggugccacugcacuuccgccuggacaacagagugagacucugucucacaaaaaaaauaaaaauaaaaauaaggccgggcaugguggcucacacuuguaaugccagcauugucggaggcugcaguggguggaucagcugaggugaggaguuccagaccagccugaccaacauagagaaaccgcaccucuacuaaaaauacaaaauauccuccagcguggugcugcaugcuuauaaucccagcuacuugggaggcuaaggcaggagaaucacuugaucccaggaggcagagguugcagugagccaagaucgcgccauugcacuucagcuugggcaacaaaaacaaagcuccaucuuaaaaaaauaauaauaauaaucauaaaauaaagauaaaaauguucggccgggugcagugguucacgccugcaaucccagcgcuuugggaggccgaggugggugcaucaccugaggucaagacuuugagaccagccuggccaacauggugaaucccugucucuacuaaaaaaaaaacacaaaaauuagcuggguaugguggugcgcaccuguacucccagcuacucaggaggcugaggcaggagaaucgcuuggacccaugaagcagagguguagugagccgagagcgcgccacugcacuccagccuaggugacagggccagacuccgucucaaaaaaaauaaaaauaaaaauaaaauaaaaauaaaaguagaaaauauucaacuacuauuacucaauagcaacagaugguaaaauacaggcucagagaaauuaaugauuugugccuggucacacagccaacaaauggcagagaugggacuucaccucugggcaacugcacucugcuauccuuccuguagaacucugaggaaccgagggucuugcacccuggaggauguuccaaucaauuuuuuuuugagggggugucucacuugucgcccaggcuggacugcaguggcgcgaucucggcuaacugcagguccaccucccggguuuacaccacucuccugccucagccucccgaguagcugggacuacaggcacccaccacuaugccuggcuaauuuguuguauuuuuuaguagagacgggguuuccccguguuagccaggauggucuugaucuccugaccuugugaucugccugccucggccucccaaagugcugggauuacaggcaugagccacugcacccggcccaauuuuuuuuuuuuuuuuuuugagacagagccucacucugucuggccaggcuggaguacaguggcacaauccuggcucacuguagcgccugccuccuggguucaagugacucuccugccucagccuucugaguaacuggaauuacaagcgccugccaccgugcccugcuaauuuuuguauuuuuaguagagaugcaguuucacaacauuggccagacuggucucaaacucccaaccuccagugauacuccugcccuggccucccagagugcugggauuauaggccugagaaaccacgccuggccccaaacaaauugcuuuaagacgaggucucccuauguuuccccacugcacuugaacuccugggcucaagccauccuccugcuguggcuccugaguagcugggacuacagacucaagccaccacgccuggccacauuccacaauuuagagaaagugcacaaccuggaauccuagggagaccccgauucaccucaaaacugccacuaaggagguaaaacgcugccccucugaggcaggcuucaguuucccugugugugaaauugaccuggcgcugggagaggcugguggaggcgcggauuuugcaguuucccuacaacauucuggaagccugugguucugggaaagguuggcguggagaagacugggaaacaaccaguggucaccagagcuguagcaccuccuccaccuccgagcucuggggcugggaaccccaggcuucggggccccuguggaggacgcagguggcccccucuuuccugacaucucaggagagggaggggcaaccggcuagcagaagaaaagcacaggaagguuauacagccagguggggaaggggccaaaucccugaacaaccccuucccagaguuccucuucaagugcaggguacccaagagucaaggccccgcccccuuuccagaggccccuuuucuacccaggugauggguccuagcugggaugggaggcagauggacggaggggaggggggaggaggggaagggagaggcaguggaugaaggaggauggaagagaugacaucccccucggcccauucaucccauucagguccccaagccgcgccccucuccgccccaccugcacugccagugccaacaucagagggaggaagagggagcucggcuuagaaggcugaggcccugccaccugggccacaccgaucacguggccuuccuucuccccacagaaggccagaccauggacaccuccugagcuggaggucauccugcaucuccacccuguuuucuuuuucuuucuuucuuucuuuuuuuuuuuuuuuuugagauggagucucgcucugucguggaggcuggagugcaguggcgcgaucucugcucacugcaagcucccccuccuagguucacuccauucuccugccucagccuuccaaguagcuuggacuacaggggcccgcgaccaagcccagauaaguuuuuguauuuuuaguagagacgggguuucaccguguuagccaggaaggucucgauccccugaccacaugauccgcccgccugggccucccaaaguggugggauuacaggagcgcagcaccacgcccagcuaauuuugguauuaacaguagagauguuguuucacaguguuggccaggcugcuuuugaacuccugaccucaagucaaacacccgccucagccucccaaagugcugggaccacaggugugagccauagugccugaccuguaguuguugaauauuuauuauuaaucuacaaguugggugugaugcaagucccauacauggagucccccaaacuucuagagcaagggcuuccccauaauccuggcaggcaggccuccccugggguucccaacuucugaccucacugaaguguuuauccucuucucuaaucccagccuccuuuucccuguuuccauguccucugagagaugcucccgcucccccaggcucccucugcaucccccucauuugcuuccuccccagugugucaauggaguccuaacccccacccuugacauuguccccuuuuccuccuccagagugggaccuuauuuucccccaagugguccugucuaggggugccgcugccgggcccccucuggucuuccugcuggagacuggggccuuuugggagucagcaggcacccgggccaaccgcagccagcgaggggugagcgauacuucaccggcgagucaucagggugagcuggccgugugcgaugcagucagugucugggugacagacccccggaccgcuguggacuugguugugcucgagguggagguguugggugaggugccugcagcuggcagcaguucccuccaccaacacuucuuugucaccugcuucaaggccgauaacucugaagaagguggcccagggguagguggaggggcugccgcugggguguggaccggggggcacugggugucugagugcaaggccaagcaguccuaugugcgggcauugaccgcugaugcccagggccguguggacuggcgauggauucaaacuggcacagccugugucugcacacuccucagccggacuggccgggccugagacuuauacccaggaacuggucaggcagaaaaagaacagagcuggaugcugagagaccucaggguuggcccagcugcucuacggacggaccccaguuggggaacucaucaaaucaucgcaaaaucacaacucucugaauuugagcucaaucucuguaggaugggugcaacaacgugggguuuugaagguugaauaggagcucucccaggggaacuugaggguaaucaugaugaugaugauaauaauaauagccacuauuuacugaguguuuacucuuucguagcccuaauacauaacuccucggaucaacucucauggauuugaucauuggugaccuuugguguuaaguugcugacugcucagucacagaggacaccaccuugcucauccuggggagugggagggcacauuucacgaugugcaugggggaggagggaaacuggaacaugcaagcagauggccaggggaccuugaggacauggucuacagaaggccuuuaaguaucugggagcugggguucaaaugagaaaucuuacuuggugagagugggcaggggucggcuuagaauauuuuguuuugagauaaagagcuaccgaucacacggggaguauaagcaagguucaaugagaagugaucaggaugcuggagaguucagcccugggcggggagcucaagucagguuucuagcccucuucccugugccaaccuauacccuacacugggaaagaaacagaccuuaaaauuguccagcuugauggcaucgcggggaagggacuaaguccagauaauguccucugaggcugaggccucgggggcaggacacaccuccugcgggccuauucaauaaucaguuaaaucaccugaagcacacgcauuuccggggaccgcuccgggcauccuggcuugaggguagagugggcagaggucccuaagggagagguggggcucgggcugaaucccucguuggcggcaccagggucaaguggcuaaccuggcagcacagucacggggaggcccucucucauugggcagaaacuaaguccgaagccgcgccccuccugggcgaggagguuccaccuccuagguuccugugauucuccugccucagcccgaguagugggacaucccacuugcucccgccauucuguuuaccacaggugacgaccgccauggcugacaggcagggaggucccccgaggaccgagcaagccucggucucccaaaaaaaaaaaagauacauugaaguaauuuaaaaacacuuaggaagaugucauuucuuccuaucaaggcguccucccuuuauguuuuguuauuauauagggaacgauaaaaaaauuuuuuucucaaccaauguggacccgguuggccucgaacucguacccucgaacccuccccucccugagggcccgagggcacgcgcaaccggucggagccacaauagcucggggugucggggaucuccuuucuuccuuuugaccuuacgcagggugauggagccaaucaggagaggcucaccccugacgucacccaguccccagggccagugagggcccugcguuccguggcgcccccuggagggaggaaggggaacuguaucugagagagagcagccaauuggguccgcugacuccggccggguucccgugccgcguccaacaccccucacucccugucucacucccccacggagacucaauuuacuuuccauguccacauccccagugcuugcggaagauaucccgcuaagagagagacaugucaaagguaggguagaucgacauuuccaggcaccaaagauggagauguuccaggaaagacugcagggccccugggcaccuuccaccugcuuccaggccaucacuggcaugagaaggggcagaccagugugagcuguggaaggaggccucuuucuggaggagcgugacccccaguaagcuucagguggggcaguuccugaggguggggaucuaaaauguugggguaucugagauccucugggcuguggggugggcucugaaaggcagguguccgggugguggguccugaauaggagaugccacgaagggucucugggucuuugugggugguguaccacgcgggaugggaaggccaggacucggggcugcggucucagacccgggugaagcaguguccuugucccaggggcugcugcuguugcugcugcugagcaugggcgggacaugggcauccaaggagccgcuucggccacggugccgccccaucaaugccacccuggcuguggagaaggagggcugccccgugugcaucaccgucaacaccaccaucugugccggcuacugccccaccauggugagcugcccggggccggggcaggugcugccaccucagggccagacccacagaggcagcgggggaggaaggguggucugccucucuggucaggggcugcggaauggggugugggagggcaggaacagagggcuuccuggaccccugagucugagaccugugggggcagcuggggagcucagcugaggcgcuggccccaggcacaugcucauucucccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggccuccucuuccucaaaggccccuccccccagccuuccaagcccaucccgacucccggggcccucagacaccccgauccucccacaauaaaggcuucucaauccgcacucuggcggugucuuucugugggcucagggcaaccacacacacaggguggguccagcuuccaaaccauuuuauacagagucacaguacagaacucugguagaaaacaggguggacggcugggcgugguggcucacgccuguaaucccaccacuuugggaggccgaggcaggcggaucaugaggucaggagaucgagaccauccuggcuaacacggugaaaccccgucucuacuaaaaauacgaaaaguuauccgggcuugguggcgggcgcuugcaggagaaugcagugaaccugggagcgggagguugcagugagcagagaucgcgccacugcacuccagccugcacgacagagcgagacuccaucucaaaaaaaaaaaaaaaagaaagaaagaaagaaaaagaaaagaggguggagaugggggaugacauccagcucaggagguguccauggucuggccuuccguggggagaaggaaggccacacgauugguguggcccagggggcagggccucagcauucuaagccgagcucccucuuccacccucugagguuggcacuggcaguccaggugggggcuuggggaccugaaugggaugaaugggccaagggggaugucaucucuuccauucuccuucauccacugccucucccuuccccuccuccccccccucccacccccgguccaucuaccucccaucccagccaggagccgucaccuaaguagaaaaggggccucuggaaagggggcggggccuugacucuuggguacccugcgcuugaagaggaacucugggaagggguuguucagggauuuggccccuuccccaccuggcuguauaaccuuccuguucuuuucuuccccuagccgguugccccucccuguccugagaugucaggaaagagggggccaccugcguccuccacaguggccuccgaagccugggguucccagccccagagcucagaggugaaggaggugcuacagcucuggugaccacugguuguuucccagucuucuccaugccacccuuucccaaaacaacaaaacaaacaaacaaaauugggccuggcgcagugguucaugccuguaaucccagcacuuugggaagccgagacgggcggaucacaaagucaggagaucaagacuauccuggcuaacauggggaaacuccgucucuacuaaaaaauacaacaaauuagccaggcguccuggugggcgccuguagucccagcuacuugggaggccgaggcaggagaauggcaggaacccgggaggcggaucuugcagugagccgagaucgcgccacugcaguccagucucaacaacagagcgagacuccgucucaaaaaaaaaaaaaaaauugauuggaacauccuccaagaugcaagacucucaguuccucagaguucuacaggaaggauggcagagugcaguugcccagaguugaagucccaucucugccauuuguuggcugugugaccaggcacaaaucauuaauuucucugagccuguauuuuaccaucuguugcuauugaguaauaguaguggacuauuuucuauuuuuauuuuuauuuuauuuauuuuauuuuuuuuugagacggagucucgcccugucacccaggcuggagugcaguggcgugaucucggcucacugcaccuaugcuucccggguucaagcgauucuccugccucagcuuccugaguagcuggaacuacaggcgcgcaccaccacacccagcuaauuuuuuuuuuuuuuuuuaguagagacaggguuucaccauguuggccaggcuggucucgaaguccugaacucaggugaugcaccugccucggccucccaaagugcugggauugcaggcaugagccacugcgccuggacgaacguuuuuaauuauauuauuauuauuauuauuauuauuauuauuacuaauuuuugagauggagcuuuguuuuuguugcccaggcugaagugcaauggcgggaucuuggcucacugcaaccuccgccuccuaggaucaagagauucuccugccuaagccucccaaguaccugggaguauaggcaugcaccaccacgcccgacgauauuuuguaauuuuaguagagaugggguuucuccauguuggucauguuggucuggaaccccucaccucagcugauccacccaccgcagccuccgacaauuacaggcgugagccaccacgcccagccguccacccuguuuucuaccagaguucuguacugugacucuguauaaaauaguuuggaagcuggacccacccugugugugugauugcccugagcccacagaaagacaccuccagagugcggauugagaagccuuuauugugggaggaucgggguguccuagggccccgggagacgggauggacuuggaaggcuggggggaggggccuuugaggaagaggaguccuggaagcgggggucaucacaggucaaggggugguccuugggacccccgcagucaguggugcugcggcggcagagugcacauugacagcugagagccacggcguaggagaccacgggguucacgccgcgcgggcagccagggagccggauggacucgaagcgcacaucgcgguaguugcacaccaccugaggcagggccggcaggacccccugcagcacgcgggucuggaagccgugugagugggggaaugagcaugugccuggggccagcgccucagcugagcuccccagcugcccccacaggucucagacucagggguccaggaagcccucuguuccugcccucccacaccccauuccgcagccccugaccagagaggcagaccacccuuccucccccgcugccucugugggucuggcccugagguggcagcaccugcccuggccccgggcagcucaccaugguggggcaguagccggcacagauggugguguugacggugaugcacacggggcagcccuccuucuccacagccaggguggcauugauggggcggcaccguggccgaagcggcuccuuggaugcccaugucccgcccaugcucagcagcagcaacagcagcagccucuggggcaaggacacugcuucacccgggucugagacugcagcccccaguccuggccuucccaucccgcaugguacaccacccacaaagacccagagacccuucccggcaucuucuauucaggacccaccacccggacaccugccuuucagagcccaccccacagcccagaggaccugagauaccccaacauuucagauccgcacccucaggaacugacccaccugaagcuuacugggggucacgcuccuccagaaagaggccuccuuccacagcucacacgggucugccccuucucaugccagugauggccuggaaggagguggaaggugcccaggggcccugcagucuuuccuggaacaucuccaucuuuggugcccggaaauguggaucuacccuaccuuugacaugucucucucuuagcgggauaucuuccgcaagcacugggaauguggacauggaaaguaaauugagucuccgugggggagugagacagggagugagggguguuggacgcggcacgggaaccuggccagagucagcggacccaauuggcugcucucucucagaugcaguuccccuuccucccuccagggggcgccacggaacgcagggcccucacuggcccuggggacugggugacgucagggaugagccucuugugauuggcuccaucacccugcguaagaucaaagggaagaaaggaugggcccgacaaccggagccauuguggcuccggccgauugagccugcccucgggcucucaaggcuaggcgagggugugagggacuggaguucgaggucaaccugggccccauugguaggaaaaaaaaaaaaaauuuuuuuaucguucccuauauaacaacaaaacauaaagggaggacgccuugauaggaagaaaugacaucuuccuaaguguuuuuaaauuacuucaauguaucuuuuuuuuuuuuuuugggauaccgagccuugcucgguccucgggggaccucccugccugucagccauggcggucgucaccugugguaaacagaauggcgggagcaagugggaugucccacuacucgggcugaggcaggagaaucacaggaaccuaggagguggaaccuccucgcccaggaggggcgcggcuucggacuuaguuucugcccaaugagagagggccuccccgugacugugcugccagguuagccacuugacccuggugccgccaacgagggauucagcccgagccccaccucucccuuagggaccucugcccacucuacccucaagccaggaugcccggagcgguccccggaaaugcgugugcuucgggugauuuaacugauuauugaauaggcccgcaggagguguguccugcccccgaggccgcagccucggaggacauuaucuggacuuagucccuuccccgcgaugccaucaagcuggacaauuuuaaggucuguuucuuucccaauguaggguauaggauggcacagggaagagggcuagaaaccugacuugagcuccccgcccagggcugaacucuccagcauccugaucacuucucauugaaccuugcuuauacuccccgugugaucgguagcucuuuaucucaaaacagaauauucuaagccaaccccugccugcucucaccaaguaagauuucucauuugaaccccagcucccagauacuuaaaggccuucuguagaccauguccucaagguccccuggccaucugcuugcauguuccaguuucucuccucccccaugcacaucgugaaaugugcccucccacuccccaggaugagcaaggugguguccucugugacugagcagucagcaacuuaacaccaaaggucaccaaugaucaaauccaugagaguugauccgaggaguuauguauuagggcuacgaaagaguaaacacucaguaaauaauggcuauuauuauuaucaucaucaucaugauuacccucaaguucccccgggagaguuccuauucaaccuucaaaaccccacauuguugcacccauccuacagagauugagcucaaauucagacaguugagauuuugcgaugauuugaugaguuccccaacugggguccguccguagagcagcugggccaacccugaggucucucagcauccagcucuguucuuuuucugccugaccaguuccuggguauaagucucaggcccggccaguccggcugaggagugugcagacacaggcagugccaauuugaauccaucgccaguccacacggcccugggcaucaguggucaaugcccgcccauaggacugcuuggccuugcacucagacacccagugccccccgguccacaccccggcggcagguccuccaccuacccccgggccaccuuccuuagauuuaucggccucgaagcggguaacaaagaagugcuggcggagggaacugcugccagcugcaggcaccucacccaacaccuccaccucgagcacacccaaguccacagcaguccaggggucugucacccagacagugacugcaucgcacacggccagcucacccugaugacucaccggugaaguaucgcucaccccacgcuggcugcgguuggcccgggcgccugcugacucccgaaaggcuccagucuccagcaggaagaccagagggggcccggcagcggcaccccuagacaggaccacucgggggaaaagaaggucccacucuggaggaggaaaacgcgacaaugucgaggaugggguuaggacuccaaugacacacuggggaggaggaaaaugagggggaugcggagggagccugggggagcaggagcaucucucagagcaucucucagagcacauggagacagggaaaaggaggcugggauuagggaagaagauaaacacuucaguggggucagaaguugggaaccccaggggaggccugccugccaggauuauggggaagcccuugcucuagaaguuugggggacuccauauaaaggacuugcaucacacccaacuuguagauuaauaauaaauauucaacaacuacaggucaggcacuauggcucacaccuguagucccagcacuuugggaggcugaggcggguguuugacuugaggucaggaguuugagagcagccuggccaacacugugaaacaacaucucuacugauaauaccaaaauuagcugggcguggugcugcgcuccaguaaucccaccacuuugggaggcccaggcgggcggaucauguggucaggggaucgagaccuuccuggcuaacacggugaaaccccgucucuacuaaaaauacaaaaacuuaucugggcuuggucgcgggccccuguaguccaagcuacuuggaaggcugaggcaggagaauggagugaaccuaggagggggagcuugcagugagcagagaucacgccacugcacuccagccuccacgacagagcgagacuccaucucaaaaaaaaaaaaaagaaagaaagaaagaaaaagaaaacaggguggagauggaggaugaccuccagcucaggagguguccauggucuggccuucugugggggaaggaaggccacaugaucgguguggcccagguggcagggccucagccuucuaagccgagcucccucuuccucccucugacguuggcacuggcagugcagguggggcgggguggggggcgcggcuuggggaccugaaugggaugaaugggccgagggggaugucaucucuuccauccuccuucauccacugccucucccuuccccuccuccccccuccccuccguccaucugccucccaucccagcuaggaccuggguagaaaaggggccucuggaaaggggacggggccuugacucuuggguacccugcacuugaagaggaacucugggaagggguuguucagagauuuggccccuuccccaucuggcuguauaaccuuccugugcuuuucuucugcuagccgguuaccccucccucuccugagaugucaggaaagagggggccaccugcguccuccacagugguccccgaagccugggguucccagccccagagcuccgagguggagggggugcuacagcucuggugaccacugguuguuucccagucuucuccacgccaaccuuucccagaaccacaggcuuccagaauguuguagggaaacugcaaaauccgcgccuccaccagccucucccagcgccaggucaauuucacacacagggaaacugaagccugccucagaggggcagcguuuuaccuccuuaguggcaguuuugaggugaaucggggucucccuaggauuccagguugugcacuuucucuaaauuguggaauguggccaggcgugguggcuugagucuguagucccagcuacucaggagccacagcaggaggauggcuugagcccaggaguucaagugcaguggggaaacauagggagaccucgucuuaaagcaauuuguuuggggccaggcgugguuucucaggccuauaaucccagcacucugggaggccagggcaggaguaucacuggagguugggaguuugagaccagucuggccaauguugugaaacugcaucucuacuaaaaauacaaaaauuagcagggcacgguggcaggcgcuuguaauuccaguuacucagaaggcugaggcaggagagucacuugaacccaggaggcaggcgcuacagugcgccgggauugugccacucuacuccagccuggccagacagagugaggcucugucucaaaaaaaaaaaagaaaaaaaaauugggccgggugcaguggcucaugccuguaaucccagcacuuugggaggccgaggaaggcagaucacagggucaggagaucaagaccauccuggcuaacauggggaaaccccgucucuacuaaaaaauacaagaaauuagccaggcaugguggcgggcgccuguagucccagcuacucgggaggcugaggcaggagaguggugugaaccugggaggcggagcuugcagugagccgagauugagccacugcaguccagccugggugacaagugagacucccccugaaaaaaaaaaaaauugauuggaacauccuccaggaugcaagacucucgguuccuuagaguucuacaggaaggauggcagagugcagucgcccagaggugaagucccaucucugccauuuguuggcugugugaccgggcacaaaucauuacuuucucugauccuguauuuuaccaucuguugcuauugaguaauaguaguugacuauuauguauuuuuauuuauuuuuauuuuuauuuuuauuuuuguuugagacagagucuggcccugucacccaggcuggagugcaguggugcgcucuuggcucacugcaucucugcuuccgggguucaagcgauucuccugccucagccuccugaguagcugggaguacaggugcccaccaccacacccagcuaauuuuuguauuuuuuuuaguagagacagggauucaccauguuggccaggcuggucucaaaguccugaccucaagucauccacccgccucagccucccaaagugcugggauuacaggugugggccauaaugccugaccuguaguuguugaauauuuacuauuaaucuacaaguuggguguuaugcaaguccuauauauggagucccccaaacuucuagagcaagggcuuccccauaauccuggcaggcaggccuccccugggguucccaacuucugaccccacugaaguguuuauccucuucucuaaucccagccuccuuuucccugucuccaugugcucugagaggugcucugagagaugcucccgcucccccagacucccucuacaucccccucauuuucuuccucuccagugugucaaugggguccuaaccccacccucgacauugucgccuuuuccugauccaaagugggaccuucuuuuccccugagugguccugccuaggggugccgcugccgggcccccucuggucuuccugcuggagacuggggccuuucgggagucagcaggcgcccgggccaaccgcagccagcgaggggugagcaauacuucacuggcgagucaucagggugaggcuggccgugugugaugcagucacuggcugggugacagacccccggaccgcuguggacucaggugugcuggagguggagguguugggcgaggugccugcagcuggcggcaguucccucugccaacacuucuuugucaccugcuucgaggccaauaacucugaagaagguggcccagggguagguggaggggcugccgcaggguguggaccggggggcacugggugucugagugcaaggccaagcaguccuaugugcgggcauugaccgcugaugcccagggcuguguggacuggugauggauucaaauuggcacugccugugucugcacacuccucagccggacuggccgggccugagacuuauacccaggaacuggucaggcagaaaaagaacagagcuggaugcugagagaccucaggguuggcccagcugcucuacggaccccaguuugggaacucaucaaaucaucacaaaaucacaacucucugaauuugagcucaaucucugcaggaugggugccaccacaugggguuuugaagguugaauaggaguucuccugggggaacuugaggauaaucaugaugaugaugauaauaauaauaggcacuauuuacugaguguuuacucuuucuuagccauaauacauaacuccucggaucaacucucauggauuugaucauuggugaccuuugguguuaaguugcugacugcucagucacagaggacaccaccuuccucauccuggggagugggagggcacauuucacgaugugcaugggggaggagagaaacuggaacaugcaagcagauggccaggggaccuugagaacauggucuacagaaggccuuucaguaucugggagcugggguucaaaugagaaaucuuacuuggugagagugggcaggggucggcuuagaauauuuuguuuugagauaaugagcuaccgaucacagggggaguuuaagcaagguucaaugagaagcgaucaagaugcugcacaguucagcccuggguggggagcucaagucagguuucuagcccucuucccugugccaaccuauacccuacauugggaaagaaacagaccuuaaaauuguccagcuugauggcaucgcggggaagggacuaaguccagauaauguccucugaggcuucggccccgugggcaggacacaccuccugcgggccuauucaauaaucaguuaaaucaccugaagcacacgcauuuccggggaccgcuccgggcauccuggcuugaggguagagugggcggagguuccuaagggagagguggggcucgggcugaaucccucguuggggggcaucugggucaaguggcuucccuggcagcacagucacggggaggcccucucucauugggcagaagcuaaguccgaagccgcgccccuccugggagguuggacuguggugcaggaaagccucaaguagaggaggguugaggcuucaauccagcacuuugcucgggucacggccuccuccuggcucccaggaccccaccauaggcagaggcaggccuuccuacacccuacucccugugccuccaggcucgacuagucccuagcacucgacgacugagucucugagaucacuucaccguggucuccgccucacccuuggcgcuggaccagugagaggagagggcuggggcgcuccgcugagccacuccugcgccccccuggccuugucuaccucuugccccccgaaggguuagugucgagcucaccccagcauccuacaaccuccugguggccuugccgcccccacaaccccgagguauaaagccagguacacgaggcaggggacgcaccaaggauggagauguuccagguaagacugcagggccccugggcaccuuccaccuccuuccaggcaaucacuggcaugagaaggggcagaccagugugagcuguggaaggaggccucuuucuggaggagcgugacccccaguaagcuucagguggggcaguuccuaaggguggggaucugaaauuuuggggcaucucagguccucugggcuguggggugggcucugaaaggcagguguccgggugguggguccugaauaggagaugccgggaagggucucugggucuuugugggugguguaccacgcgggaugggaaggccaggacucggggcugcggucucagacccgggugaagcaguguccuugucccaggggcugcugcuguugcugcugcugagcaugggcgggacaugggcauccaaggagccgcuucggccacggugccgccccaucaaugccacccuggcuguggagaaggagggcugccccgugugcaucaccgucaacaccaccaucugugccggcuacugccccaccauggugagcugcccggggcccgggcaggugcugccaccucagggccagacccacagaggcagcgggggaggaaggguggucugccucucuggucaggggcugcggaauggggugugggagggcaggaacagagggcuucccggaccccugagucugagaccugugggggcaacuggggagcucagcugaggcgcuggccccaggcacaugcucauucccccacucacacggcuuccagacccgcgugcugcaggggguccugccggcccugccucagguggugugcaacuaccgcgaugugcgcuucgaguccauccggcucccuggcugcccgcgcggcgugaaccccguggucuccuacgccguggcucucagcugucaaugugcacucugccgccgcagcaccacugacugcgggggucccaaggaccaccccuugaccugugaugacccccgcuuccaggacuccucuuccucaaaggccccuccccccagccuuccaaguccaucccgacucccggggcccucggacaccccgauccucccacaauaaaggcuucucaauccgcacucuggaggugucuuucugugggcucagggcaaucacacacacacaggauggguccagcuuccaaaccauuuuauacagagucacaguacagaacucugguagaaaacaggguggacggcuaggcgcgguggcucacgccuguaauugucggaggcugugguggguggaucagcugaggugagggguuccagaccagccugaccaacauggagaaaccccaucucuacuaaaaauagaaaacaucgucgagcgugguggugcaugccuauacucccagguacuugggaggcuaaggcaggagaaucucuugauccuaggaggcggagguugcagugagccaagaucccgccauugcacuucagccugggcaacaaaaacaaagcuccaucucaaaaaguaauaauaauaauaauaauaaaauaaaaauuaaaaacguucguccaggcgcaguggcucaugccugcaaucccagcacuuugggaggcugaggcgggugcaucaccugaguucaggacuuugagaccagccuggccaacauggugaaacccugucucuacuaaaaaaaaaaaaaaauuagcugggugugguggugcgcgccuguaguuccagcuacucaggaagcugaggaaggagaaugacuugaaccccggaagcauaggugcagugagcugagaucacgccacugcacuccagccugggugacagggugagacuccgucucaaaaaaaauaaauaaauaaaauaaaauaaaaauaaaaauagaaaauaguccacuacuauuacucaauagcaacagaugguaaaauacaggcucagagaaauuaaugauuugugccuggucacacagccaacaaauggcagagaugggacuucaacucugggcaacugcacucugccauccuuccuguagaacucugaggaacugagagucuugcaucuuggaggauguuccaaucaauuuuuuuuuuuuugagacggagucucgcucuguuguugagacuggacugcaguggcgcgaucucggcucacugcaagauccgccucccagguuccugccauucuccugccucggccucccaaguagcugggacuacaggcgcccaccaggacgccucgcuaauuuguuguauuuuuuaguagagacgggguuuccccguguuagccaggauagucuugaucuccugacuuugugauccgcccgucucggcuucccaaagugcugggauuacaggcaugaaccacugcgccaggcccaauuuuguuuguuuuguuuuguuuuguuguuuuuggaaaggguggcauggagaagacugggaaacaaccaguggucaccagagcuguagcaccuccuucaccucugagcucugcugggaaccccaggcuucgggggccacuguggaggacacagguggcccccucuuuccugacaucgcaggagagggagcagcaaccgguuaggggaagaaaagcacaggaagguuauacagccagguggggaagaggccaacucccugaaaaaaccccuucccagaguuccucuucaagcgcaggguacccaagagucaaggccccgcccccuuuccagaggccccuuuucuacuuaggugauggcuccuggcugggaugggagguagauggaccgggggugggagggguggaggaggggaagggagaggcaguggaugaaggagaauggaagagaugacaucccccuuggcccauucaucccauucagauccccaagcccccaccuggacugccagugccaaccucagaggguggaagagggagcucggcuuagaaugcugaggcccugcucccugggccacaccaaucguguggccuuccuucuccccacggaaggccagaccauggacaccuccugagcuggaugucaucccccaucuccacccucuuuucuuuuucuuucuuucuuucuuuuuuuuuuuuuuuugagauggagucucgcucugucgugcaggcuggagugcaguggcgcgaucucugcucacugcaaccucccgcucccagguucacugcauucuccugcaagcgcccaccaccaagcccggauaacuuuucguauuuuuaguagagacgggguuucaccguguuagccaggauggucucgaucuccugaccucaugauccgccugccucggccucccaaaguggugggauuacaggcgugagccaccacgcccagccguccacccuguuuucuaccagaguucuguacugugacucuguauaaaaugguuuggaagcuggacccauccugugugugugugguugcccugagcccacagaaagacaccuccagagugcggauugagaagccuuuauugugggaggaucgggguguccgagggccccgggagucgggauggacuuggaaggcuggggggaggggccuuugaggaagaggaguccuggaagcgggggucaucacaggucaaggggugguccuugggacccccgcagucaguggugcugcggcggcagagugcacauugacagcugagagccacggcguaggagaccacgggguucacgccgcgcgggcagccagggagccggauggacucgaagcgcacaucgcgguaguugcacaccaccugaggcagggccggcaggacccccugcagcacgcgggucuggaagccgugugagugggagaaugagcaugugccuggggccagcgccucagcugagcuccccagcugcccccacaggucucagacucagggguccgggaagcccucuguuccugcccucccacaccccauuccgcagccccugaccagagaggcagaccacccuuccucccccgcugccucugugggucuggcccugagguggcagcaccugccccggccccgggcagcucaccaugguggggcaguagccggcacagauggugguguugacggugaugcacacggggcagcccuccuucuccacagccaggguggcauugauggggcggcaccguggccgaagcggcuccuuggaugcccaugucccgcccaugcucagcagcagcaacagcagcagccccugggacaaggacacugcuucacccgggucugagaccgcagccccgaguccuggccuucccaucccacgugguacaccacccacaaagacccagagacccuucccggcaucuccuauucaggacccaccacccggacaccugccuuucagagcccaccccacagcccagaggaccugagauaccccaacauuucagauccccaccuucaggaaaugccccaccugaagcuuacugggggucacgcuccuccagaaagaggccuccuuccacagcucacacuggucugccccuucucaugccagugauugccuggaaggagguggaaggugcccaggggcccugcagucuuaccuggaacaucuccauccuugguguguccccugccucguguaccuggcuuuaaaccucgggguugugggggcggcaaggccaccaggagguuguaggaugcuggagugagcucgacacuaacccuucggggggcaagagguagacaaggccaggggggcgcaggaguggcucagcggagcgccccagcccucuccucucacugguccagcgccaagggugaggcggagaccacggugaagugaccucagagacucagucgucgagugcuagggacuagucgagccuggaggcacagggaguaggguguaggaaggccugccucugccuauggugggguccugggagccaggaggaggccgugacccgagaaaggugcuggacugaagccucaacccuccucuacuugaggcuuuccugcaccacaguccaaccucccaggaggggcgcggcuucggacuuagcuucugcccaaugagagagggucuccccgugacugugcugccagggaagccacuugacccuggugcccccaaggagggauucagcccgagccccaccucucccuuagggaccuccgcccacucuacccucaagccaggaugcccggagcuguccccggaaaugcgugugcuucaggugauuuaacugauuauugaauaggcccgcaggagguauguccugcccacggggccgaagccucggaggacauuaucuggacuuagucccuuccccgcgaugccaucaagcuggacaauuuuaaggucuguuucuuucccaauguaggguauagguuggcacagcaaagagggcuagaaaccugacuugcgcuccccacccagggcugaacugugcagcaucuugaucgcuucucauugaaccuugcuuauacucccccugugaucgguagcucauuaucucaaaacagaauauucuaagccaaccccugccugcucucaccaaguaagauuucucauuugaaccccagcucccagauacuuaaaggccuucuguagaccauguccucaagguccccuggccaucugcuugcaugcuccaguuucucuccacccccauccacaucgugaaaugugcccucccacuccccaggaugagcaaggugguguccucugugacugagcagucagcaacuuaacaccaaaggucaccaaugaucaaauccaugagaguugaucugaggaguuauguauuagggcuacgaaagaguaaacacucaguaaauaguggcuauuauuaucaucaucaucaucaugauuacucucaauuucccccuggagaacuccuauucaaccuucaaaaccccacgugguggcacccauccugcagagacugagcucaaauucagagaguugugauuuugugaugauuugaugaguucccaaacugggguccguagagcagcugggccaacccugaggucucucagcauccagcucuguucuuuuucugccugaccaguuccuggguauaagucucaggcccggccaguccggcugaggagugugcagacacaggcagugccaauuugaauccaucgccaguccacacggcccugggcaucagcggucaaugcccgcacauaggacugcuuggccuugcacucagacacccagugccccccgguccacacccuggcggcagcccccuccaccuaccccacggcuaccuuccucagaguuaucggccucgaagcggugacaaagaagugcuggcagagggaacugccgccagcugcaggcaccucgcccaacaccuccaccucgagcacacccaaguccacagcggucccgggaucugucacccagacacugacugcaucacacacggccagccucacccugaugacucgccggugaagcaucgcucgccucacgcuggcugcgguuggcccgggcgccugcugacucccaaaaggccccagucugcagcaggaagaccagagggggcccggcagcggcaccccuagacaggaccacucaggggaaaagaagguccuacuuuggaucaggaaaaggugacagugccgagggugggguuaggaccccauugacacacuggggaggaagaaaaugagggggaugcagagggagccugggggagcgggagcaucucucagagcaccucucagcacacggagacagggaaaaggaggcugggauuagagaagaggauaaacacuucaguggggucagaaguuggaaaccccaggggaggccugccugccaggauuauggggaagcccuugcucuagaaguuugggggacuccauauaaaggacuugcaucacacccaacuuguagauuaauaauaaauauucaacaacuacaggucaggcacuauggcucacaccuguagucccagcacuuugggaggcugaggcggguggaugacuugaggucaggaguucgagagcagccuggccaacacugugaaacaacaucucuacugauaauaccaaaauuagccaggccuggugcugcacgccugugaucucagcuacucgggaggcugaggcaggagaaucgcuugaacccgggagggcugagauugcagugagccaagaucgugucacugcacuucggccuggacaacacagugagacucucucucaaaaaaaauaaauaaauaaggccgggcaugguggcucacacuuguaaucccagcauugucggaggcugcaguggguggaucagcugaggugaggaguuccagaccagccugaccaacauagagaaaccgcaccucuacuaaaaauacaaaauauccuccggcguggugcugcaugcuuauaaucccagccacuugggaggcugaggcaggagaaucgcuuaaucccaggaggcggaguuugaagugagccaagaucgcgccauugcacuucagcuugggcaacaaaaacaaagcuccaucuuaaaaaaauaauaauaauaaucauaaaauaaagauaaaaauuguucggccggggacaguggcucuugccugcaaucccagcacuaugggacgccgaggcgggugcgucaccugaggucaggacuuugggacuagccuggccaacguggcgaaacgcugugucuacuaaaaaaauuacaaaaauuagcugggugugguggugcacaccuguagucccagcuacucgggagucugaggcaggugaauugcuugaacccgggaagcauaggugcagugagccaagagcgcgccacugcacuccagacugggugacagggcgagacuccgucucaaaaaaaaaaaaaaaaaaaaagaugaaauaaaaauaaaaauagaaaauagccaacuacaauuacucaauagcaacagaggguaaaauacaggcucagagaaauuaaugcuuuuugccuggucacauaggcagcaaaugacagagaugggacuucaccucugggcaacugcauucugccauccuucccguagaacucugaggaaccgagagucuugcaucuuggaggauguuccaaccaauuuuuuuuuuuuuuuuuugagauggagucucacucucucacccagacuggacugcaguggcucgaucucggcucacugcaagcucugccucccggguucaagccauucuccugccuuagccucccgaguagcugggacugcaggggccugccaccacgucuggcuaauuuauuguauuuuuuaguagagacgggguuuccccguguuagccaggauggucuugaucugcugaccuugugaucugcccaccucggccucccaaagugcugggauaacaggcaugagccacugcgcccggcccaauuuuuuuuuguuuguuuuguuuuguuguuuuuuuuuuuuuuuuugaaacagagucucacucugucuggccaggcuggaguacaguggcacaaucccggcucacuguaacgccugucuccugguuucaagcgauucuccugccucagccuucugaguaacuggaauuaaaagcaccugccaccgugcccagcuaauuuuuguauuuuuaguagagaugcgguuucacgacauuggccagacuguucucaaacucccaaccuccagugauacuccugcccuggccucccagagugcugggauuauaggccugagacaccacgccuggccccaaacaaauugcuuuaagacgaggucucccuauguuuccccacugcacuugaacuccugggcucaagccauccuccugcuguggcuccugaguagcugggacuacagacucaagccaccaugccuggccacauuccacaauuuagagaaaguccacaaccuggaauccuagggagacccugauucaccucaaaacugccacuaaggagguaaaacgcugccccucugaggcaggcuucaguuucccugugugugaaauugaccuggcgcugggagaggcugguggaggcgcggauuuugcaguuucccuacaacauucuggaagccugugguucugggaaagguuggcguggagaagacugggaaacaaccaguggucaccagagcuguagcaacucuuccaccucggagcucuggggcugggaaccccaggcuucggggaccacuguggaggacgcagguggcccccucuuuccugacaucucaggagagggagggguaaccggcuaggggaagaaaagcacaggaagguuauacagccagauggggaaggggccaaaucccugaacaacccccucccagaguuccucuucaagugcaggguacccaagagucaaggccccgcccccuuuccagaggccccuuuucuacuuaggugauggcuccuggcugggaugggaggcagauggacggaggggaggggggaggaggggaagggagaggcaguggaugaaggagaauggaagagaugacaucccccucggccccuucaucccauucaaguccccaagccgcuccccccccacaccugcacugccagugccaacgucagagggaggaagacggagcucggcuuaggaggcugaggcccugcccccugggccacaccaaucauguggccuuccuucuccccacagaaggccagaccauggacaccuccugagcuggaugucgucccccaucuucacucucuuuucuuuuucuuucuuuccuucuuucuuucuuucuuuuuuuuuuuuuuugagauggagucucgcuccgucaugcaggcuggagugcaguggugugaucucggcucacugcaagcucccccucccagguucacuccauucuccugccacagccucccaaguagcuuggacugcaagcgcccaccaccaagccgggauaaguuuucguauuuuuaguagagaugggguuucaccguguuagccaggauggucucgaucuccugaccucaugaucagccugccucggccucccaaaguggugggauuacaggcgugagccaccgcgccccgccguccacccuguuuucuaccagaguucugauacugugacuuuguauaaaaugguuuggaagcuggacccacccugugugugugugguugcccugagcccacagaaagacaccgccagagugcggauugagaagccuuuauugugggaggaucggggugucugagggccccgggagucgggauggacuuggaaggcuggggggaggggccuuugaggaagaggaggccuggaagcgggggucaucacaggucaaggggugguccuugggacccccgcagucaguggugcugcggcggcagagugcacauugacagcugagagccacggcguaggagaccacgggguucacgccgcgcgggcagccagggagccggauggacucgaagcgcacaucgcgguaguugcacaccaccugaggcagggccggcaggacccccugcagcacgcgggucuggaagccgugugagugggagaaugagcaugugccuggggccagcgccucagcugagcuccccagcugcccccacaggucucagacucagggguccaggaagcccucuguuccugcccucccacaccccauuccgcagccccugaccagagaggcagaccacccuuccucccccgcugccucugugggucuggcccugagguggcagcaccugcccgggccccgggcagcucaccaugguggggcaguagccggcacagauggugguguugacggugaugcacacggggcagcccuccuucuccacagccaggguggcauugauggggcggcaccguggccgaagcaucucccuggaugcccaugucccgcccaugcucagcagcagcaacagcagcagccccugggacaaggacacugcuucacccgggccugagaccacagcccugagcccuggccuucccaucccccaggguacaccacccacaaagacccagagacccuucccggcaucuccuauucaggacccaccacccggacaccugccuuucagagcccaccccacagcccgagggaccugagaugccccaacauuucagauccccacccucaggaacugccccacgugaagcuuauugggggucacgcuccuccagaaagaggcguccuuccacagcucacacuggucugccccuucucaugccagugauggccuggaaggagguggaaggugcccaggggcccugcagucuuaccuggaacaucuccauccuuggugcguccccugccugguguaccuggcuuuauaccucggguuugugggggcgucaaggccaccaggagguuguaggaugcuggagugagcuggacacuaacccuucggggggcgagaaguagacaaggccagggaggcacaggaguggcucagcggagcaccccaguccucuccccucaguggucuagcgccaaggaugaggcggagaccacggugaagugaccucugagacucagucgucgagugcuagggacuagucgaggcuggaggcacagagaguaggguguaggaaggccugccucugccuaugguggggucuugggaaccaggaggaggccgugacccgagaaaggugcuggacugaagccucaacccuccucuacuugagccauuccugcaccacaguccaaccuaacaggaggggcgcggcuucggacuuagcuucugcccagugagagagggucuccccgugacugugcugccagggaagccacuugacccagaugccccccaacgagggauucagcccgagccccaccucucccuuaggaaccuccgcccacccuacccucaagccaggaugcccggagcgguccccggaaaugcgugugcuucaggugauuuaacugauuauugaauaggcccgcaggagguguguccugcccgcggggccgcagccucggaggacauugucuggacuuagucccuuccccgcgauccagccgcagcugagugggcgugucugggcuaguccuguccccacacugcggauagacuuaaugagugcgagcccaccuagguccgacaccgcguagugagcggcugcccagagcucugcuccgcccccacgccagggggcgugucugggguggggcuggcccggcaggcucccacuagccccggcuuacagcggccugagcgggaguucucggugcuguaggcuuucgggacgcuguguaugcccggcaggggcuuccagugggggccaccccaagucgccuccagcgggcggaagcggucgagccggcggagcgggugcggcgaggagcuguagguuuccugagccggagacauggcccgccgugcggcgcucgaggcggccuggaagagcagagacagggcugccgcugcgggucgugacuccagaguuggggcgucucuucuaagcuccaguaggucagguaguccuugcggggguauccggacggcuccguccugugggagcagggcgggauggugaggauacagcuggauccuuggggacgaguuucagaccucgggaucuaaggagucugcacauucaaacuccugcauuuccaggcgagcaccccuuaggaaggacgcgaccgggcacgcguugccugcguuccuggguccucgagguacuuaacguccuggaagcugagcuuucgcauccuagggaaggaaacgggggcuuucgcuuccuugcgaaggagcaugugggggcucaaguaccgaaggaggcccugcccucagauccagaauccccucgagccgcugugcaggcuuccugucccuaccgcgguuccuggaggugacacuaaggacuccugggugcuaaaagagggaggggcuggggucugaacugugguuguugcugcuauaggagucgagacugagaccaccggucagggaaugggagccagcccaggggcucggcgugcaccggccauggcgggggcugugcaggaggcggugccgagcgagagcccggcuuacuugggauagaaccgaaagucccgcgccgagguggucagauagagcuggcggcgguucaggacgccccggucggauacugugaagggugggccagacagcgcgggguucuucgugcaggcgauuagagccugagcaagauugggggaggaggcauacccaagacauagauuucauaccccaucccaaguccugggucccgaguucagaaucccucuccuucggccucgacagccaugacggccacggcccucacaccccgccccagggucagagcccuuccugccacccacgccagggaacuucagcuuccuuucucauacccgaacccuucccagccucaccucccuaaauccaagcccuccugcuggucaaggaacucaaaugcaggcccccagccaccacaaaaucccccugguucugcccccggucucaagccuucuugguguggccacuggagcugagcugcaucuugggcaacaacuccagguuaccucuccuaacucccacccuaccacgucucagaauauucuagucuccuccccacccacagcccgccgucuagcuccgcagcagcuuaggagcccugaaggcgaguuuccagccccugguccuucuggccuggcguggaugcccagcccuuccucccgcuccucuaaccucccgaucccgccccagauccuuuagccacgccccaaagcugugauuuccuucuggccccgccccaggcucccggagcuccgcuggucucgccagcgccggcuuccacccagacaccugggaaggccccccgcgguggugguccgagaguugugaggggcuggggcccgacguauuugggggcgcgcgcguccgggccgggagagcaaguguacugcgcccucgucucgcugcucugguacuuuguggucaguaggaggguucagcugcggugucugagcugcggaaaggcaacccagagacucaugugaaggagcaggggacucaaaugcagucccccgcagacuccggcgcuccccaaaucuuaccuuuucuccugaauccuugauccccacaguccgcguggggucugcaggcucuggggcucugggcugggcgcagggcccgccaugggucuugggcacguaggccgagccagagguugucucccaucugcugaggaccucgucgaaagcccagaugcgagaauccugcuuugcagucggagguagaggguccgcgaccguggacuggagagaaggcgccgcacaucagcuagaaagacucaggagucccuaucaccccccaccccaaacucugaccucuuccagucggcccccagcccuuuccucugcagucccuggcauccaaauucccuggcgccuccucucucagacccaggacuccaggacccuccuccuucagagaggaguccaagcucccaauccccuuuucucagcccccaucuuucuggguccccaggccccgcagggcuucagccuagggucugcccaccugcaccgugggcggggggaaggguacgggugggauaaugccauggguaacguagcugcuggugagaugccaguugggccaggauucaggcaucucgguugcagagaugaaagaccacggggggccacagcgcacagccagggugccacuggccaugguuccacccccucccuguagccaagcaggagcugguuuguugcuguugccccaggugacagaacccgcccaccccaauccagccaaugaaaggccugcaggcacauggauggauggagugauuaagagacccagagacagagagacagggacuccaagaggggcacagagaaacacggagugggggauggagagucagaaagaggcggacagaaggggauggagaaguucaggauuucagagacccagggggugggggagacagagacacagaaagaaggacagagaccugggggugucagagauacagacagagaccccugcacugcccccagcaccucaggacauccaugagaaacaccccccuuugcuccaggguccagaaccuccuggcugcuuccucccucugccaggccugcccaccucgggguaacgauuuccagauguccccggggcuccccaacccuucccgcacgugcugaaggagucagcgcuggugucag

SEQ ID NO: 15174 - RNA, 29696 nt, Homo sapiens
gaugggguuggggaggcaccauagggaggcucugggcuucagccucauaucuucacucauccgugguucucccauuugcaggcagaugucuauagacuuaagccucagcucucuuaucuucuguuuccauaucugcugcuaauuucucaccugcugccuuagccuuacuucucuauuugcaugauuuauuccugcuacacauuuuuuccaucucuguugcaauauuuuccgugcccccugcuuacuuucuuucuuucuuuuuuuugagauggagucucacucuguggcccaggcuggagugcaguggugcgaucucagcucacugcaaccucugucucccggguucaagcaauucuccugccucagccucccaaguagcugggauuacaggcacccgcucccacaccuggcuaauuuuuuuuuuuucuugagacggagucuggcucuguugcccaggcuggagugccguggcaugaucucggcucacugcaaccucugccuccuggguucacaccauucuccugccucagccucccgaguagcugggacuacagcggcccgccaccacgcccggcuacuuuuuuuuguauuuucaguagagacgagguuucacuguguuagccaggaugaucuccauuucccgaccuugugauccgcccgccucggcgucccaaagugcugggauuacaggcgugagccaccgcacccagccuccuguuuaauuccuguaacugcuacccuucucccacucgcugccuccuuucucugcuuauaaccacauaugucacauguccugugucuaugcccccacugcccugucuggccacucugcaaaucauuuccccuaccugcugccuuguuucuguacuugcugccacauuucucuuaccaaccaucugcaucucccacugucuuuucuuucugaugcuaauuccuuccacgggaugcuucuuuuuuguuuucagacagggucucgcucuguugcccaggcuggagugcaguggugugaacaugguucacuauagccucaaccucccuggcucagucaauccucccaccucaccuccuacaggcgugggccaccaugccaggcugauuuuuuaauuuuuuguggagauggggucucacuauguugcccaggcugaucgugaacuccugcguucaagcaguuuucuugcuuagccucccaaaguguugagauuagaagugugagccaccuaaagcaggcccuuuuuuauuuucagagacggggucuugcucuguccuccagccuggaagggaguggugcaauuacgguucacugaagcuucgaucucccaggcucaagcaauccuuccaccgcagcuucccacguagcugggaccacaggcacaagguaucacaucccggcuaauuuuuaacuuuuuuguaaggacaggguuucaccauguugcccaggcuggucucaaacuccuggccucagccuaccaaagugcugggauuacaggcgugagcuacugcacccagccuguaaugauucucuuacuguucaugcugccacuuuucuuccccaugaugccuuguuucuguuccuuucaucacauaucugucaccugcgaccucuuuccucuauccauaggcccauuuuguaguccacagccuccuuccuuccuuccuugcuuccuuccuuccuuccuucccucucucccuccuucccucccucucuccuuuuucuuucuuucuuccauuuuuuuuuguuuguuuuuguuuuugacagggucucacuccggucacccaggcuggagugcaguggugcaaucauggcucacugggcugggcgcgguggcucacgccuguaauccuagcucuuuggggggccgaggcgggcggauugccugagcucaggaguuugagaccagccugggcaacauggugaaacccugucucuacuaaaauacaaaaaauuagccgggcguggcagcaugugccugaggucccagcuacuugggaggccgaggcaggagaauugcuugaacgcgggaggcggagguugcagugagucgagauuguaccacugcacuccagacucagcgacagagugagauucuaucugaaaaaaaaaaaaaaaaaauuauggcucacuacagccuccacaucccauccucccaccucagccuccugaguaacugggaucacgagcacgcaccaucaugccuggcuaauuuuuuguauuuuuaguagagacagaguuucgccauguugcccaggugggucaggaacuccugggcucaagcuauccucucaccucggccucccaaagugcugggauuccaggcaugagccaccgcccucggccacgccacacauuucuaacauagcccauccucuguccgugccccagggcugcauuuuucuagccacugccguguuucuaagacuugcugucucacuucugccucugccacauuucuccaguuggcuguuuuccucccugagaccauggcuuugguucugggccugcugccacagcaguggagaagcagccccgcuccucgccgaccuggcuuuuugcugccuggagccucgcucugaggucccucccccucccagcuguugucugcccuuuugcugggggggggggggggcuauucuuaggcccccagcacgugggaagcagcugcccucaggaagcgacugggcuguucuggguucccuuagggacacagucggaccugaauggauuccagaccccaccccaaaccagaggcugugaaugaguaaaggaaccacagugccucuccauccccagccuggaccugucugucccuuagcccugccgccugauggcuuucuccuuggacaacagcgugccgccugauggcuuucuccuuggacaacagcgugucucuuuccgucuucacccuggggcccuggaacucccccuccucucuaaucccugaucugcccaucucagacucuguccugugggucuguccacugaccucuccucucuuccccgauauuccaugcuucucucuccuucuaggacuggcuuucugaaacaucugguggccucucuucuguccccagucuauuacucuugccuguggcuccauccacccuucucccuuggucugccugucccccucacucuccaagcuuggcuguuaguaacaauaaugacgaugaucauaacaaugacaaucaccgcccacacaaugugcuaccuucaugccaagaacucuacuaaccacuuuguccuuauuaacuguuuccuccucccagcaccgcuagaagguagacgcuauuagcauguccauuagccaaggacacacaggcagcaaguggagggugaacuugaacuucaagcuccagaauccugcuccuuccugaccucaggcccacuucuccccagcucugccuggcuggcuggcauucuuuucugagacagagucucgcuccgucgcccaggcuggagugcaguggcccaaucgcagcucacugcaaccuccgccucccggguucaagcgauucuccugccucagccucccgaguagcugggauuacaggcacccgccaccacacccagcuaauuuuuguauuuuugguagagacgggguuucgccauguugaccaggcugucuuucgaucuugcucucuuucucucugggucugaggaccuuggccucuuggaucuccgucucagucugucucauacuugccaucugucuguccauucgcccaugucugggauccacccacccacuuccaggcccugcaucugucuggguguccuaucacgccuccuuccuguguccaagccugccucgcucucuggcuggggcuguccacccugcacccucuccgucuguggcucccaccccgauggcaggcuguccacccgcuucugcccugggcugggccacgucccaccuugcagcccuugcuguucauggaauccaguguccucuucagggccggggugggggccuccagcaguuccaccuggguccucacgcccugcuccguguacggccccaccaggaaguaguugucgccccauucguccccugucaccuucgccuucgucugcagcaccguguagaugccacccacugugggcccaagcgugugagggcaggccccggccgagguccauaguucuggggccugggguggggugggccggggauguagggggcacucaggccccagaccucuagcucagggggaagaggggacugggagcccauaguuuggaguagggguuggaagcuuggaugaggggaacacgagggcuggagggcaguccuccugggucuaagggagaagggggcuggggucaggacccugaaggaggagggggcucaggcuagacuucugggucugagagagaaggggcugggugccgggaccccuuggucugaaggaauuaggcacuggggcucuaaggauggcagagcugaggacugacuacccggacucagguucccgaguucccagcucacaggagcuggguuuaaaucgcagccaggcuccaaaacccagugagggagacccccucauggccaauccagcuucucaccauugcccaagagaagccugcauggucauucccugcccccagggaccuugcugaccugccucccaauuuccucucccugacuagggacaccagcaugcagggcucugccucucccaugacccuaucccagacccaggagccccagcccccagccuccucccauccuggagcccaggcccuggcgauacccggcuggguguucacgggcccccucuccuccugggagacacagucccuuucuccuccaagacccagcaaagcaaccccccagacccugcucuuugaggugugagauuggcuuguuccuggggauuucagccccagccuucuccaaggccagaaccucagcuuucugaagcccaagacacagaaaugcaggcuccuagccccucccauccuagggcccagccucugacuaacuuaggacuucccagccuuccccuauuccaguacgcaugugucccaggccaugggcuccucuacuccuaggaacuaauagcucaggcccucagcuccuucaaagcccaggcauucauuacagucuccagcccgucccaucuuuauucuuaagcagccagauccucagguccucccaccgccgcucaggccuccuaucucccagucagcucucucucaaaucuggaguuuuauccccuagaccaugcuguuagggucauaggucugaaaccccggcagcuucccagguuugcacgcagaaaucccauccccccauccccuucccuguucaggacccagguaucuagucucucggaagccugccuccaggaccuaggagucucauuuuagcgcccucuucccuaggacccagaacccgggcuuccagccuccuuucaucuuaagucaaacgaaccaucccucucccacccaccuccggcuucccagccccuccucaaggacacagccuccuugcccaggucacaaggguuccccuaguagccccguccuccuacaacucagaguuccgggcccccauccacuacuguccuucucgucaagggccccgacgccuggcgugcucacccuuguuagccaccucccaggccacuucgaagagcacugcguucuccaggucgaauucauccucccaguccuccaguccuggcagugaggacauggacaaagugcgguuuaaaggcauggcuggcgcaggaaggggggcuccggggaucuccagguagggaccccggaggugucuagggaaugcaccagguagggugcggggccgaguagcuggugcccgacgggaagcuugcaagacgcucggcuuccuauugcaagaccgcaccccugccccgaagcguugggaccuaggcagaaggaggccgcagcgucacugagcccacuggcgccccugcagugaaaccucgcagccgccaggaggcgguggccgccccccccagccagcgccauuggcccacgcccgggggcggggauuuccgcguguccucauugguggaacggguuggagucgcugugucccggccccgccucggccgugagaccuccagggggcggagcuugccgcugcgcuuuacggaaacgaguggccuucagcucugucaaucuggagcuggaggccucaaaguggggaggaggaggagggugggauaaagaggaaaggagcguggaggacgugugguuacucaaagaacagcuaagaauuuugcaaucggccugagcggggcggugguggggcugagcaaaaggaggaggagccaggagacauugggaauggacccaggaguuccggacgcccgucuuccagcgcagccucggugggagggcggggcauaaagucccgccacgcccccacaauauuuacauauuuaugaggaaccaucgagaucuuugaagaaccagcuagccuagaggagccagaacaucucgcuccucgcgcguuuccguuuccgcuaggacucuggcaguuggugagcaucauggcaaccguuguaagugugggugcauggagggugaggagcgagcuagcagucucgaguuugagagaggaggaugcuggaggcccugacuccugggucugagggaggggggaucuggggguucagacuccugggucugaaagaggaggaagcucggccacccagaucugggggagaaggggacaugggggcuggacuucuggaucugaggcggggagggggcugggaucccagaaucucgggucuggccccaucaugcuauaggaacuccaacuuucaaaaucaucuuggcgcaacggccgguuccgcaguccuuggcgccagugugugaugaggaggguuguaggaccuugcgcuucgagccauuugggagccuuggauuguuaguggugccaauggcacuugaguuccaagcuggaagcacaggcagguaccuguucagugugucugagagcgcgagggcgccuagugagccuuuagugggaagaaauugucgaggaacaagagagucuuaguggagaggacugaaggauuagggacccagaaaucgggaucuugucaugcuaccguuuuggccauuuucauauuuccaguauuucacacgggcuacgucucaguguaaaugcucaauaaauuaucacuugaauauuugaaugaaugaauacaugugaaugaaggagaggccaggaaacuuggccuggcaccugcucaauuaccugaauaaagaagcgauuuuggccuggcgugguggcucaugccuguaaucccagcacuuugggaggccgaggcgggcggaucacuucaggucaggaguucguggccaacauugcgaaaccccgucucuauuaaaaauacaaaaauuagccaggugugguggugcaggccuguaaucccagcuacucagaaggcugaggcaggagaaucgcuugaaccugggaggcagaaguugcagugagccaagaucgcgccacugcauuccagccugggcgacaaagcgagacucugucuccaaaaaaaaaaagguaaugugaccugaacuuagggacugggcugggcuuacaggugccucaauuuccaugaugagcccagucaagauggaggaagggagggggagaaaguuguugguagcuggggaugagauuugagucuguugcugucaccagggcaaggaggaggaggagguggauagggaaguagaagaggaaggcuaugaccagaacuaccguggagaaaguauuggaaguaugaggggacggugugugcugaguuuugaaaugaccuugguuuucaugggaacagcgggcagcaagguuuuggagagacuuaugaugaaagagaaagucuuuauaggagacaguccuugguaaggggccuguuuauguugagagagcuacauuugggauuccuggauucaugucuuuuuugugggguggggaugccuagucuucugcuuguagucuggggguaauguucuaugcuccuggguuccagcuuccuauaggagacgguaggugggaagguucacacagugacagggaaagcuugugaccauugauggccagaaagucuaaacgauuggcuccagagggaggaggcuuccucugggcuggauaacugcauguccucucuaggggaagaagagaagaaagaccugugggcugggcacaguggcucacgccuguaaucccacacuuugggaguccgagguagaaggauugcuugagcccaggaauuuaagacuagcccuggcaacauagcgaaacccugucucuacaaaaaaauaagaaaauuaggccgggugcgguggcucacaccuguaaucccagcacuuuggggggucgaggcgggcaggucaugaggucaggaguuugagagcagccuggcuaauauggugaaaccccgucuuuauuaaaaauacaaaaaaaauuagccgggcgugguggcacaugccuguagucccaacuacucuggaggcugaggcaggagaauugcuugaacccgggaggcgaagguugcagugagccgagaucgcgccacugcacuccagccugggugacagaguaaggcugugucucaaaaaaaaaaaaaaaagaaaagaaaagagaagaaaauuagccaaguguggugggacacaccuguagucccaacuacuugggagacuaaggugggaggauugcuugagccugggagguggaggccacagcaguccagccugggggacaaaaugagaucuuaucucaaaaaaaaaaacacaaaccugugggaaggaaggagaccuggggauggguggccucgguuagcaugcuagcuucuuaggcuuccuuuuccuuauuagaaauuaugaacuauuccaaagugucagaaaauaauguaacagacaugcaaagauccaccauccaggauuguuuuuuuguuuuuucuuuuuuucaagacagagucucacucugucucccaggcuggagugcaguggugugaucuuggcucccugcagccucugccucucucccauguucaaaugauccuccugccucagccuccugaguagcugggacuacaggugcgcgucaccacgcccagcuaauuuuuguaucuguguguguguguguguguguguguguguguguguguguuagugauagagucuugcucugaugcccaggcuggagugcaguggcgcgaucucugcucgcuacaaccuccgccuccuggguucaagcaauucuccugccucagccucccaaguaccugggauuacaggcaccugccaccacgccuggcuaauuuuuuguauuuuuaguguagacuggguuucaccauguuggccaggcuagucucgaacuccugaccucaagugauccaccugccuugaccucccaaagugcugggauuacgggcgugagccaccgugccugaccuaauuuuuguauuuuuaguagagacaggguuucaccauguuggccaggcuggucucgaaccccugaccucaagugauuugccugcuucagccucccaaagugcugguauuacaggugggagccacuacgcccagccuguuguuuuuuuuuuuucuuaauagcuuuauugagauagaauucacguacuacauaauucacccauuuaaaguauacagcucaguguuuucuaguauauucacagacuugugcagccauuuccacagucaauuuuagaacauugucgucaccccaaaaagaaaccccaugccucuuaccugucaccgcuaauccuuccauaccucccaucuucaguucuaggcagccacuaaucuuucucuguauauggauuugccuauuguggcuacuucauauagauggaaucauaccauaugugucuuucguguguggcuucuuucagucaguauaauguuuucaaaguucauccacguuguagcauguaucagaacuccauuccuggccgggcgcgguggcucacgccuauaaccccaacgcuuuggggugccaaggcagguggaucaccugaggucaggaguucaagaccagccuggccaacauggugaaaccccaucucuacuaaaaaauacaaaaaaauauuagccaggugugguggcggacaccuguaaucccagcuacucgggaggcugaggcagaagaaucacuugaacccaggaagcagagguuguagugagccaagauugcgccauugcacuccagccuaggugacagagugagacuaugucucaaaaaaaaaaaaaaaagaaaagaaaaaagaacuccauuccuuuuuaugacugaauaauauuccuuugcacaaauagacccuguuuuauuuugccauucaucagcugauggacauguggguuguuucuaucuuuuggcuguugugaauagugcugccgugaacacucguguccauguuuuguguggaccucuggggggguccugaauugucccgggugguguuuacucaccucccucccccaugugagaaggggugguagcuggcuccucucuguggagaacugucaacaugggaagccucgguauauucuuguugaaugagcucagcacuuuagaguaucacuuagcaaaccacagacauugagucccgaggugaacaagagagaacaggccgugcccuucaugggacucauguccacuggagcagagaauauugauccauccaucucccucgggaaugugagaucacacagggagaucgggcucccagggaggccuuucaucugucugaaugucuagagguccuagaacuagccuggcagggcuguuggacagaaagggccuccccuagggggcagcacuugaucuaauucagugagagggcagggagagcagucuggacucaggggccagcaugugcaaggccuggugguugagaacuggggccgccugguacaagggaugcugggaaauuagcaggggccagagcauguccagcuccaugccugcuccucauuggugucuguccuuauggagcucacaguuauuagaaauggggaggacuugucugggcacggugguucacaccuguaaucccagcacuuugggaggccuuggugggcagaucacuugaggucaggaguucgagaccagccuggccaaccccaguagagaugggcgaaaccccaucucuauuaaaaauacaaaaaaaauuagccaagugugguggugugcgccuguagucccagcuacucaggaggcugaggcgggagaaucgguuaaacccaggaggcggagguugcaaugagcugagaucgggccacugcacuccaaccugggcgacagagcagacuccgucucaaaaaauaagaaaaaaaaaaaagaaauggggaggacuuagccgggcacaguggcucacgcccauaaucccagcacucugggaggccaaggcugguguaucacuugaggccaggaguuugagaccagccuggccaacauggcaaaaccccaucucuacuaaaaauacaaaaauuagccggguguguugaugcgcgccuguaaucccagcuagucaggaggcugaggcagagaauuucuugaacccaggaggcggagguugcagugagccgagauugggccacugcacuccagccugggugacagagcgagacuucaucucaaaaaaaaaaaaagaaacagggaggauuucauucauucaccaaauaaccaaauaugugcuggacccugaggaccaagcugucgaugagacagacaguccuugucuuccuggggcucaaccaaccagccauuaggcagugacaggcaagaggggugggggugacuggugccugucccaucgccugccugugaggggaaggaguggaaaggaccaucucaugggagggacagaggagggguuggugaaagcugggaccacacuaguccucugacacaucuucuugcacccccagacagccacaaccaaagucccggagauccgugauguaacaaggauugagcgaaucggugagugaguugggucaggaauaggaccuaagcccugccugccaugugcccugacagagcaaaccuauugaggaccccuaagauggagagggagguggccugcacaccaacugugcccccacuaccauucccccacucgcccuaucuaaugggggaggaggauccucaguuccagaguugggucagaugaugcacuggggaccaggcugcuauccuggcuauccuggugggguucccggguauguuugccuggaagucauagauauuuacugggugcuuuacuggguuuggccucguauacccaguacacacuguggggugaguucccugagggcagggacgaggucgugucauuccuagcugugucccuagcacaggaccuaacagagcagaugaucaagagauaaccauugaaugcacgaguuugcguccuguggagcccucgcaguagccgcaugaggugcauauuguaacuguuagcugagggaacugauuuucaggacagcuaaaucacuggccccggcucacacagagcaggaaguugagacgcagugaggccagcagggugcgcucucacaaagagcuuuaccggcagggaagugaccgcauucauucaugcagcaggcucacugauucagggcauccgagaaaggcaguaagggcuucuggcugugaagauggguuuuagaagcccagugcuggauuccuggagcuuagcucugccacuuucccaccauguggccagggacuaguuccucucugugccucaguuuccuuaucugcaagacgaagcuaagauaguuuaccucaucaguuaauguaagauucaguaagguaguucauauaaagcauuuugggucugugugccaacacuguuucaucuauuaaaagugcuggggcacugggugcaguggcucaugccuguaauuccagcacuuuggaaggccaaggugggcggaucaccugaggucaggaauuugagaccagccuggccaacauggugaaaccucgucucuacuaaaaauacaaaaauuugcugggcgugguggcgcgugccuguaaucccagcuacucgggaggcugaggcaggaaaauugcuugaacgaggagguggagguugcagugagccaagaucaugccauugcacuccagccugggugacaagagugaaacucugucucucaauaaauaaauaaauaaaagugccgagacugggugcuguagcucacgccuguaaucccagcacuuugggaggccgaggcggguggaucaccugaagucaggaguuugagaccagcuuggccaacauggugaaacccugucucuacuaaaaauacaaaaauuagccaggcaugguggugcaugccuauagucccagcuacuagggaggauggcuugaaccugggaggcagagguugcagugagccaauaucgugccacugcacuccagcuugggugacagagugacuccaucucaaaaacaaacaaaaagugccaaguauggccgggcaugaugggucacgccuguaauccuagcacuuugagagguggagucaggaggauugcuugaaucaggaguucaagaccagccugagucacauagugugauccugucucuaaaaaaaaaauaaaaaaauuagccggcaguggugguccaugccugagucccagcuacuugggagaacugcuugaaccaaggagguucaggauguggugagaugugacugcaccaugcacuccagccugggugacagagugagacgcucucucaaaaaauaaaaauaaaaacauuuuuuuuuuuuuuuggagacggagucucgcucugucgcccaggcuggagugcaguggcgcaaucucggcucacugcaagcucugccucccggguucacgccauucuccugccucagccucccgaguagcugggacuacaggcgcccgccaccaugcccggcuaauuuuuuugcguuuuuaguagagauggaguuuccccguguuagccaggauggucucgaucuccugaccucgugauccgcccgccucggccucccaaagugcuggaauuacaggcaugagccaccgcgccuggccaaaaaacaauaaaaaauuaaaaaaaaaaaaaaaggaugaagagccaagcaccgcuugugagcugaggacccaguagagacuagcugcacccaggagccucccuuggggugcucacagucaagcacuggggucagcaaaucuuuccuuauuuuauuuuauuuuuuuuuuugagacggagucucauucugucccccaggcuggagugcaguggcgcaaucuuggcucacugcaagcuccaccucccggguucacaccauucuccugucagccuuccgaguagcugggacuacaggcgccugacaccacggccgucuaauuuuuuauauuuuuaguagagacgugguuucacuguguuagccaggauggugucuaucuccugaccucgugauccgccugccucggccucccaaaaugcugggauuacaggcgugagccaccacgccuggacccuagcaaaucuuucuuaaagggucagaugguaaauccuuccucuguugaaacuacucaacucuccucuugcagugcgaaggcagccacagacaguauauaaauggcaguguuccaauacaaagauuuuuugguugguuuuuuguuguuuuuuuuuugagauggagucucacuguguugcccaggcuggagugcaguggggcgaucucaguucacugcaaccuccaccucccugguuuaagugacucucaugccucagccucccgaguaucugagacuacaggugcaugccaccacgccaggcuaauuuuuguauuuuuuaguagagacgggguuucaccauguuggccaggcuagucucgaacuccugaccucaggugaucugcuugccucugccucccgaagugcugggauuauaagcgugagccaccguacccagcuccaauaaaauuuuauuugcaaaaacagguggcuggccuccaggcugagguuugcucaacccucaucuaauguaaagcaugggaaucccaucuuccccucucgcuggcuguguggcuggggcaugggaccuaaccucucugagcucccuccccauucauaucaauagguucugggacuguugccauuuugauacucagaagugcuuucagggugauagcagccagggcucuuguuucauuuuauuuuguuuuacugagacaggucuugcucugucauccaggcuagaaugcaguggcacaaucuuggcucacugcaaccuccgccucccagguucaagcaauucuccugccucagccuccugagaagcugggauuacagucaucugccaccaugcccagcuaauuuuuguauuuuuaguagagacaggguuucaccauguuggccaggcuggucucgaacuccugaccuccagugauccgcccgccucggccucccaaagugcugggauuauaggcaggagccacugcgcccggccccagccagggcucuuuuuuugcaggaucauauggaauaaacugagaacaugugggugcuguguaaaccauaaacaugaaguaauugugaucauuagcccuugugguuagaucuuaguacaauuaugugcuuaaucaggccucagugacuuuuguuuaacuaggaugcauccucagagcagcuccaguucauugagcauuuaccacauucagccaucuuccuagggaggugccaauuugggauauccuuuccaugugccccuucauucccccaaccccugcucccuacucccacccaccccuuugacaaagaaggaaaccagggcucagaggggucaggccacaugugcagcaagcuggcuaguaacugagucuuuguucuuucccuucauguaggugcccacucccacauccggggacuggggcuggacgaugccuuggagccucggcagguagagcagaggaggcuggggugugagggccucuccaugaaggucuuggguaguggguacccaggguccuggggaguguggggacuauguuacggucuucuggaccuuuggcuacauacccauaaacuucaaccacauguggguuuucuugguacuaaagaauugauuaggcuaggugugguggcucaugccuguaaucucagcacuuugggaggccaagguggguggaucaccugaagucagagucaagaccagccugaccaacauggugaaacccugucucuacuaaaaauacaaaaauuagccgggcaugguggugcaugccuguaauuccagcuacucaagagccuaaggcaggagaauugcuugaaccugggagguggagguugcaaugagccgagauugugccacugcccuccagccugggugacaucucggaaaaaaaaaaaaagaauugggaguggguagcaauugcuuugccaccuuaaaaaaaaguuagacugggugcaauggcucacacuuguaaucccaauacuuugggaggcugagaugggaagauugcuugagccuaagagcuugaggccagccuggguaacauagugacaccuccuuucuacaaaaaauuuuaaaaauuagcuggacaugguggugcacauuuguggucccagcuacucaagaggcugagguggaaggaucucuugaucccuagaggucaaggcuacagugagccaugauuguaccacuguacuucagccugggugacagagcgagaucuugucucaaaaaaaaaaaaaaaaaaaaaaaaagcagggaaagcuuuuuuggcuuuuccuagaagucccagcuaguaaugucugcuuccaucucacuagcuuccugaugugguagaaaugccaugguagccccacaggaaaucaccucaugugcgccucccacccacaggcuucgcaaggcauggugggucagcuggcggcacggcgggcggcuggcguggugcuggagaugauccgggaagggaagauugccggucgggcaguccuuauugcuggccagccgggcacggggaagacggccaucgccauggguaagaaaccucccagggcaggaacucuccuguuuccugcuaaauaacuccuccuguguaagucagggucaggaugagccgccuuuaacagaugacccaaaauggcaguggcuuaaacacucaggauucauucuugcccauggaagaaucuagagguaggccauuuggggcuuauuaagcaguuccaggaagucuuccaucuuccugccucaccauccucugcacuugguuccagucaagaggacgccauguuccaagagggcugccagagcuccagccuucccacucauaacccaggcagcaggaagaaaggaguugccaugaggaugaacccccucgaguuggcuuccuuuaaacagucauuggaaauccuccaugcuucugcuuauaucucauuaucucauugacuagaauguaaucauaugaucacacucugcuucaggggaggcuggcacauuaaauguuuuuuaaaauuucauaauuuggaccauuuuugccuuaagaaaaugaggauucuucuguugggcaaaagguuguuguaaaaauaaaaaauuaaaaaaaaaaaaacaggaaagaaaaugaggguucuagaacuaaggaagaaggggaagguggguauugaggagucacccagcagucuuuguugcaguccgcuagugguuuaugaucuuuucacucccagcuguuccucuucuuccuuguugaacuccuauuuauccuucaaaacccuacuucagcaucucugccccauugaagcuuuuccuaacccacugcucuucccacucacucccaccucugugcugaggcuggggccaggcagggagaaucagaguaacagccaggucuucagugaagauaaagcagugccuguuggggugcucggacuggacacuggggacccauagaugaguuagaccaaggccugacuucaaagagcuccuggucuggaggagguggucauggacacgaucccuuccaaggcgacauguguuacaaugcagguagcaugugacagaggaggcuccugaccuugguaggaaaacggggcaugugguggcauuuguugcuagaggcuuccagagaagcggauaccugagcuaagccuaguaggauggccaggaggcuccugggcggacacuggggacagcauguccaggcccagaauguggcacacacaguaacuuccuucccuccauccuuucugcuuuccuacucuucuucauuuuuuuuuuuuuuugagacaguuucacucugucgcucaggcuggagugcaguggugugaucuucgcucacugcaaccucugccuccuggguucaagugauccuccugccucaaccucccaaguagcugggauuacagaugugugccaccacacccaacugauuuuuguauuuuuaguagaaaugggauuucaccauguugaccaggcuggucccgaacuccugaccucaggugauccaccccccugccucggccucccaaagugcugggauuacaggcgggagccuguagacuuuauuuuuuaggcauguugugacugugcccggccucgccuuuccucuucuugugucucccgcaggccuccugcaggccaaacccugugcugggcagcacuggggugaggcuagccucgcccuggcggggacgcuucuuagucuagugaaagaggcagagaggaccccugguguccccagauggcaugggccgugcucguccacucagcccucagcagauacuugcugaguucugugaugagggccauuguguauccgcaaagaggacuaagaacaggucccacuugacacugggcaggaggguguggugucagccugucugaaagggcgugccccacauuggaccaaaccuuguggccagggaacuggaaggaaaggucuggcguucagagcuauugcuggagacagaccugcuuccugccagccaccccaggccaccggcgguagagcguccugcccugugccaguuucaggcugcgcaaccguguuacugcugagcaccagugccugccugccugccugcccauagucacuccuaagcagggugucaucccaugcuggcacguguucuguuaucauccccauuagacagagggggagacugaggcucagggagcaguucagaucgcucaagaucccacggcgccaccugcacuuaagugguggaucugggaugggagccgaggcagucugccuucaucacuuguagcuaucgugugggcuccuuggccuucgucccugguccccuucguccagcucugaggcuaaacagcucguagaggcugggagacugagguguggcgagguucuaggguguacccucugggcaaugugggauucuaagccaggccugccggagcaaccugcccugccuggcuucucacucacugucugccucauggcugaaccccgcucuccaguucccccuccccagcgcucugcucagcucggagccaaguccuuacauguaggauggcacugaacccucuuuccuggggugggagaaaagcuaguuugccacagagcaggugucggggaccuggugccagagcggcuucaccuacacagacugccuccuucccaggcauggcgcaggcccugggcccugacacgccauucacagccaucgccggcagugaaaucuucucccuggagaugagcaagaccgaggcgcugacgcaggccuuccggcgguccaucggcguucgcaucaaguaagcgggggacccgaggcgggugccagaccccagagccugggagcaaccccgcaccccgggcggcucguccuuugucccagagcucauggaagguugugauucccgaggguccaggugucaggcugucuccucagaucugcucucuggcuagggaggagacggagaucaucgaaggggaggugguggagauccagauugaucgaccagcaacagggacggugagucugugugagucuguacccugcugaggccaccuccagcgccaggguuggagagaguagauaucaggucugcacugaggucagaaucccauggaauguucuagcugcagacuagagccauguacaugccuacaguaggaggucaguuaacuugacaauggcuuauccccuuaugaaggacauuaugggcaauagaaacugaggcgguaaaauaaugagagagaucuguuagugaguucccaacagaccucaaaacccaacagacuucaaaacucguuccguggccgaaaggcauguccuguccaucuuacaugauacaggugauuugcucucucuuuuuuuuuuguuuucgagacagagucucccucugucccccagacuggaaugcaguggugcaaucucggcucacugcaaccucugccucccagguucaagugauucuucugccucagccuuccgaguagcugagauuacaggugugugcaugccaccacgcccggcuaauuuuuguacuuucaguagagacgggguuucaccauguuggccaggcuggucuugaacuccugaccucgugaucugcccaccuuggccucccaaagugcugggauuacagccgugagccaccauaccuggccucuuuuuuuuuuuuuuuuuuuuuuuuuacaauuucuguuuucuccuuuuugcauagcuguguuuucugauuuugugaucaacaaaaacacuuuuuauuuggguauaaaauaggaaugucaaagugugacauuuggcaauuuugcgagaccucgggccuauguuguuuuugauagacuuuauuuuuuaggcauguuguuuguuuacuauuuuuauuuuuuauuuuuauuuuauuuuauuauaauuuuuuuuuugagauggagucuugcucuguugcccaggcuggagugcaguggcacaaucucagcucacggcaagcucugccucccggguucaugccauucuccugccucagccucccgaguagcugggacuacaggcaccugccaccacgcccggcuaauuuuuuguauuuuuaguagagacgggguuucacuguggucucgaucuccugaccuugugaucugcccgccucggccucccaaagugcugggauuacaggugugagccacugcacccugccuguuuacuauuuuuauuaagagcuuuauugaguuuuggccaggcgcaguggcucacaccuguaaucccagcacuuugggaggcugaggugggcgaucacuugagaucaggaguucgaaacgagccugacuaacauggugaaacccugucuauacuaaaaauacaaaauggcugggcgcggugguucaugccuauaaucccagcacuuugggaggccgaggcggguggaucaccugaagucaggaguucaagaccagccugaccaacauggugaaacccugucucuacuaaaaauacaaaaaauuagcugggcgugguggugggugcuuguaaucccagcuacuugggaggcuaaggcaggagaaucgcuugaaucugggaggcagaaguugcaguaagccgagaucacaccauugcacuccagccugggcaacaagagcgaaacuccaucucaaaaauaaauaaauaauaaaaacacaaaacaauuagcuggguaugguggcacacaucuguaaucccagcuacuugggaggcugaggcaggagaacuacuugaacccgggagauggagguuggagugagcugagaucacaccacugcacuccagccugggcgacagagcaagacucuaucucaaaaaaaaaaaaaaaaaaaaaaaaaaaaaaaaaaaagagcuuuauucaccaggcgcaguagcucacuccuguaaucccagcacuuugggaggccgaggugggcagaucacaaggucaggagaucgagaccauccuggcuaucacagugaaaccccaucucuacuaaaaauacaaaaauuagccaugcgugguggcgggcgccuguagucccagcuacucgggaggcugaggcaggagaauggcgugaacccgggaggcagagcuugcagugagccgagaucaugcuacuacacuccagcgugggcgacagagcaagacuccgucucaaaaaaaaaaagaacuuuauugaguuuuaauugacauacagaaagcuguacacauugcaaguguccaguaugguccguugggacauacauguucagccgcggagccaucaccgcgucaggcuggugagcgcaccguaugucuucccuggagagcuuccuuguguugugcccauuuugaagcuguggaagcagaggccagagcagagccagaagcuuaucaacacugggggcacuggggcaacaucagggcccucucugagccccaucccuggcuuguccccacucucagggcuccaaggugggcaaacugacccucaagaccacagagauggagaccaucuacgaccugggcaccaagaugauugagucccugaccaaggacaagguccaggccgggugagcagucaggggccaugccaggcagccagggggaugggcgagcuugggcccauuccuuuccuuacccuaccccccaucccccuguagggacgugaucaccaucgacaaggcgacgggcaagaucuccaagcugggccgcuccuucacacgcgcccgcgacuacgacgcuaugggcucccaggugcggccgggacucccgggauccccucgcccccagcacugggguguuuucaucuccuccaucacccccuugacccauggggucuggaucuuccuguuacccugacuguuuguccugguacuccugggucuucccuguaacccuaggacagcagggccccucagccuggcacuauagcuucgcauggccacauguggccuguggcuucuaagguccuccgggagcccccgugacccucagcgcucuggaaugucccuaguccugacuaccuccugggccugggguuuccagaugaccccauuuagccucccagcuccauuuccuggagcuccagucucccccagacagagggcuuuaggggcccccuucaugcccuucccugcccugucuccgccguucuucccccacccccgccccauagaccaaguucgugcagugcccagauggggagcuccagaaacgcaaggagguggugcacaccgugucccugcacgagaucgacgucaucaacucucgcacccagggcuuccuggcgcucuucucaggugaggccccuccugcccugcccugcccugcccugccccaggccuagcagccucccucgggcucccucuguuccugagcuccgaguguggcccaccugcuccacgcuguuuccuguaacuccggcccguggcugccucuguucuccaccugcaaguccgcuccguccccaccccugcuggugcugugauggguguggcccugcccucuccccuccuguguucucugccucuguuccuccucuuuggggauguuucaggcuccucaucccuccuugcuuugcuccccuuccuccaucccuggcaucauccuucucugucuuagccacacucuggcccuggaacccgccuccucucuggcuucccugaugcaaccugugccucccauaggugacacaggggagaucaagucagaaguccgugagcagaucaaugccaagguggcugaguggcgcgaggagggcaaggcggagaucaucccuggagugaggacccaggacauggccggggcggguggugggguggaggugggccggggaaguggggacgcggguggugacucucacacacaccccaauccaaggugcuguucaucgacgagguccacaugcuggacaucgagagcuucuccuuccucaaccgggcccuggagagugacauggcgccuguccugaucauggccaccaaccguggcaucacgcggugagccggcuacaggggccucuggggaaaacaggaugcucugggcaguggguguggucagagggucaaugggagccuguguugacaccgggucagggagggacgcgugacugcagugugcgcucuuugcuuacaaaaggcgggugggaggcagcucugcuucccgaggaagcccagagacuguguucuugcugccuuucugucuugcugcuccuuuagcccccaaggcugcagucuucaaacugcgugccgaggcaccccagggugcugcaggaaacucacaggagugcugugggauguuuucuagucuugagggaagcacagugacaucuguuagacauaacauaaacuacgauuguucagucacuucgacccagcaacuccauuaacagaacucuuagcguuguguuuggccuaaggaugccagggacagauucccaugacacagaggguaccgugcucugcugaagccugggaaccucaucucccagguguugccagcacccugugcacggggaacucuuaauguuguguuuggccugaggaugccggggacagauuccugugacacagaggguacugugcugugcugaagccugggaaccucgucucccagguguugccagcacccuguguagcugggauuacgggcaccugccaccaugcccgcuggcugucuucuccaccucgccacauuuuggcccgcaggaagcagggggauguggagggcaggcagcccccauaggcugugauccacaggcugcaccccaaccuugcacccccauuccauugcccggcacugcuugggcucagugcuguaccugguggcaaagaaggcuggguacugucagcuccagcccugcagccuugggcccagcugaaacugggcgguugggaugggcaucacaaaagggaagaagcgggcacccuacagaggaugcugggccgcugggccuggcucuguguuuggcucuuuuaacuccuuggauccgcagaagaagcucagaagguagauaucaccucagccccauuuuauagggcaggacagugaggcccagugacuugcccaggucacaagucuagaagguagcagggccguaauuuggucucuggauggcuggacacuggaagagacccccagggcugaugguguuuucacagaaacugcaggucagggccuggggacugcccaggggcaccuccugugggaggcagcagcuacgggcagcccugauuguucguagacucuguaucugagaaucucgcuugcuaagauuuauuuguaauccccaaauaaauaucugcccugcuuucggcaacaaauucaagucaccugacacccacuuucccagcugagugugaacgaggcaacacugccugcucccuuagcgcucaugcuguaaauaaguguccuuguuguauucuauuuagugcuacguuugucacuuuuguucuuugagacagggucuugcucugucgcccaggcuggagugcagaggcacgaucauggcacacugcagccucagugcccaccacacacacacacacacacacacacacacacacacacacaccaccccugggacucaaucaguccucuggccucagccuccucaucagcugggaccacgggcaugcaccacuaugccuagcuaauuucuguuuuuguuuugagacggagucuagcucugucaccaggcuggagugcaguggcacgaucucggcucacugcaaccucugccuucuggguucaagcaguuuuccugccucagccuccugaguagcugggauuaugggcacccgccaccaugcccagcuaauuuugguauuuuuaguagagacaggguuucaccauauuggccaggcuggucucgaacuccugaccucgugaucugcccaccucagccucccaaaguguugagauuacaggggugagucaccgcguccggccuaauuuuuuuuuuuuuuuuguagagaugguguuuugccauguugcccaggcuggucucaaacuccugggcucaagcaauccacccgccucagccucccaaaguguugucacuuuuuuugugccuuuuuuuuuuaaacuuuuuggggccauuuguuggugauauugccauuuaaaguguccccugugcacaguguugaagugcugucuaguauccuaagugcaaggaggcugugaagccugacggagaaaaugccauguuacagacgcuucgcugagcccaaguuagaaugcuguugacacgagcuccauguuagagaauaaacagugauguuacauaacaaacacauggaaauagaaacacacauacaugaggccaggcgcgguagcucacaccuguaaucccagcacuuugggaggccgagguggguggaucacgaggucaagagaaugagaccgucccggccaacauggugaaacccugucuguauuaaaaauagaaaaaacuagcugggcgugauggcgugcgccuguagacccagcuacuugggaggcugaggcaggaggaucgguugaacccgggaggcggagguugcagugagccgagaucgcgccacugcacuccagccucgcaacagagcgagacuccgucucaaaaaacaaaccaaaaagaccagaaacacacaaaugaaaauacgcauagacccagauuauauauauauggauugaugaaaauacuguaagccgaggcucgagagagccuaacccuguauuccaguaggagcaguggcucaggaucagcuaauuggaguguucacgaugacuuucuagaaccucacuacugugaauaaggggaacugacuguauccccuggcaccagcccugggcuggccccgcugcagcagggaacaagacaggugcaguccccuccuuugugaagcuuugugucgagcacgggagugggaccuugauccaguaauccuggaggcagagaucuagcuuaaagcagcccagcuccgcggaaaggugcccuugggggacugacgcagcuguggaaggcugcgucaucaggggugaugucaucaugugacaggagacgcgagcuaaagguuaagugguguugggcccagugaguggguggcgaugggaggugagaguguucccagcaaagggaaugaagagggaacaugccccugacagcccccucuuucugccucuuccucagaauccggggcaccagcuaccagagcccucacggcauccccauagaccugcuggaccggcugcuuaucgucuccaccacccccuacagcgagaaagacacgaagcagauccuccgcauccggugcgggcaggaccaggccgugcgccugagacgcagggcuggggucuacccuguuugacaaaugcugacacugagguccagcggaguggcaugguggcugggccuacaggagagagggcugagcgggcacccagacgguggccuccgauccgggagcaggagccacggugggaaagggaggcgagguacccgugacugguguuggggccagcgcccuggggguggucaggaggccucgguuuuagguccagcccagccccugucuccguggcucuucuagccucagcauucuaugguucuaagaugcaggcgccacauauucccaguggggaagggccagaggguugcuguggccacuucugcugcagucagaggcugggccccggcugagccaccccugucccccacugcuugcaggugcgaggaagaagauguggagaugagugaggacgccuacacggugcugacccgcaucgggcuggagacgucacugcgcuacgccauccagcucaucacagcugccagcuuggugugccggaaacgcaaggucagccggccgaauuagccagcagggccagauggcggcagugagugacacaguacuucaggggcuuccaggguuccgauuucauccuagaauguacguuuucagacgcagggaauuuucaucccucagguuggcuucuguaucauccagccuggccuauaguagguaucaguaaaucucucuugacuuaaguagaugcuguuagguccaccuuacagauaaagaaacugaggaaugaagaggcugggcccacaacaaggagauggccaggcaggauuugaacccaggcaaucuggcccagaaugcccuccccucacaugccacacucugcugccuagagcauggagguggcauacgcuggggucugugccuugagccucacggagaggggcccaacugaggacucgcccucccccuccaggguacagaagugcagguggaugacaucaagcgggucuacucacucuuccuggacgagucccgcuccacgcaguacaugaaggaguaccaggacgccuuccucuucaacgaacucaguaagaauccccaccccgcaccugcacugccagagccaaccucagagggaggaagagggagcucggcguagaaggcucaggcccugccaccugggcgacacugaccauguggccuuccuucuccccacagaaggcgagaccauggacaccuccugaguuggaugucaucccccgaccccacccuguuuuccaccagaguucugacacugugacucuguauaaaaugguugggaagcugcacccacccuguguaugugugguugcccugagcccacagaaagacaccuccagagugcggauugagaagccuuuauugugggaggaucggggugucagggcuccaggagucgggauggacuuggaaggcugcggggagggucuuuagaggaagaggaggccugagaguuggggguggucacaggucaagggguggucuuugggacccccacagucagaggugcugcggcggcaggguccacagcgacagcugagagccacagggaaggagaccacgggguccacaccacgcgggcagccagggagccggauggacucgaagcgcacaucacgguaggugcacaccaccugaggcaggggcggcaggaccgccugcagcacgcgcaucuggaggccgugugagugggggaaugagcaugugccugaggccagcgccucagcugagcucccaagcugaccccacagguccuggacucaggagcccaggaagcccucuguuccugccuucccacaccccauuccccaaccgcaggccagagaggcagaccacccuuccucccccgcugccucugugggucuggcccugagguggcagcaucugccccuggccccaggcagcucaccaugguggggcaguagccggcacagauggugguguugacggugaugcacacugggcagcccuccuucucgacagccaggauggcauugaugggguggcaccauggccgaagcggcucccuggaugcccaugccccgcccaugcucagcagcagcaacagcagcagccccugggacaaggacacugcuucacccaggucugagaccgcagccccgaguccuggccuucccaucccgcgugguacaccacccacaaagacccagagacccuucccggcaucuccuauucaggacccaccacccggacaccugccuuucagagcccaccccacagcccagaggaccugagaugccccaacauuucagauccccacccucaggaacugccccaccugaagcuuacugggggucaugccccuccagaaagaggccuccuuccacagcucacacgggucugccccuucucaugccagugauggccuggaaggagguggaaggugcccaggggcccuguagucuuaccuggagcaucuccauccuu

SEQ ID NO: 15175 - RNA, 3694 nt, Homo sapiens
gcugcucgcuacaaaucaaaaggcuuuauuccuuauauaaacccacacuuagaaaaaauaaauaguuaauaaauuauaggcaaaccaguuggucucagccacgccucccacugagguccagggcagccgcugcagcagcagacgagcgggaagguguggccacagcuuggcucaagggcguggucuggacuggggacgaagggacagaggaggaaggcaaggucugggugagggcagggaugggggcuaaagguggguuccugaggcgugcccaggcucuggcccgggcagcaggggugaggcaggggcucagcuccuccugggccugggugaugcggcgugcgaagcggcugcgaucccgagcaagcugcucccaggggcccuggcgggcggccugggccggcccugcccagacagccaggaaauggacagugaccuucucggagaagcgcaccugcgggcagacauggggacacaggcaggagaugcacacagccacgggaauccggauggggagggcggggaagagagagagagaagcaaacaaaaauuaguuauuacacaaaaaugcuuucuaucuggcuagucacuugccugucacugucacgggauucucuaucuaucugacucacugaaggaagaggugguuuccuggggcugcugugagccacagcugcucccuccucccccaggggccuggccucuuacaagggauugcgugacagcguacacagccuucuccauggagaugacaugcaacccucugcaacauacagggacccagaagucucggcccccagcccccuuucuuucuaagacucaagaaucugggcucucagccagaugugguagcucacgccuguaaucccagcacuuugggaggcugagauggguggaucacgugaugucaggaguuugagaccagccuggccaacauggcaaaacccccgucucuacuaaaaauacaaaaaaaauuagcuggguguggugucaugcgccuguaaucccagauacucuggaggcugaggcacgagaaucgccugaacuugggcggcagagguuggcagugagccaagaucaugccgcugcacuccagccugggugacagcccaagacuccaacucaauuaaaaaaaaaaaaaaaauagaaucugggcucucagcaccuaccuuucuggccuuuaggggagucucaggguccggaucaugaguagggguuucugggcgcuugagccgccuuugcagucggaggggcagccuaggaggagcccagggaggcgguggcuucucuccagguacauagauggccacucggaaggggcagggcucagcuucuccccaguccucagcagcuuccucuuccucugucucuuuuccaggucgauauccccagccccugaagugggcccucugguccgggugggagggaugugggucugacucagcuucucccaaggcugcuucugaaucaucuuccuuauccucacuauccacauccucaucuuccuccuccuccguguccucuccuggccgauacacccaggccuucaagaaagcacuugcaggggguguggaagcagaagucucagcuucucuuucauccucggcugauccuguaucacuguccucaucuuccuccuccucuguguccucuccuggcugauagacccaggacuucaagaagacaccuguagcaggaguggaagaggaagccucagcuucucccucuuccucaucugauccagagucacuguccucaucuucuuccucaucuuccucuuccucuguguccucuccuggccaauacacccaggccuucaggaaggcacuugguggggggaugcagggaggacacucagcuucuccauccuucucagcugcccccaaagccuugaccucacccuccucuucaucacuggguuggcaccaccaggacuugagcuggggccucugggcuggggcugaggauugcggcccuggggcagcuucuccuuucccaguuucuuugugugccuuuuccuccuucuccucggacgccucuccugaacgauacucccaggaccuggggucggagccugaagaucggggggacacggaggucuuccuggcuccuuuacuucuuucuguucuuuuauccuccguggcuugauucucuuccuccccugggcaagacacccaagugcugggcuuggauccuggagacaaggcagaaguagagguucugugagcuucuuucuuuacagcuucuucaucguccuccuccuccacggcuggacaacacucccggugugaugguggauaagagaacuuguuaacucccuccucuucagcaacucccucuuccucggcuuucuccuccccuggguucuuaucagaaccuugcaguguccuuaucagaaggcugggagacaggggagcacgcuggccaucugcaaauugacuucccugcccucuagggacacugguugccucucgcucaccauacaugccaucaucaucauccaaaaguccccaggcuucaggaagggaacugcugguuuucagccccaguguuucucuguccucuccagggccuccacugucuucagccuccucuucagggcgucugccccaagggguaugggggauugccagaggaguccuagcuucucccuccaggccagcuucuaccagagcugcuccuuuuacugcuuccaccagccagggcucuagaggucccaggccccucaggcggcuccaggcgcggcugaggaggcccaucacuggggacaggaggaagaaagggugggcaucccuccacgggguagccugauggggugcuuggccuggggccaugugucugggcuggaaaagggggagaaaaaaauaaaguuuaggggccauuuagaggauggcauccgggcgugacuaugagucauagcaacggaaauaguaacacaacuauuguaaauagcaacgcgagagucccaaauuccuuucugaucucggccacgcccaucucugucccuuggcucuguucuuaucucucaauagccaggagucugagccccuaguucugccuuagauccaaggguccaagcccccagcccucucuuucuucagacgcagaacucccagucccaagaaccaagaacaaaagucuuuacuugcuucccuuggcgacaaagucauagucccuagcucucucauucugcugaagauugacaaaucaaacccucacacccuccucccucgcagacugaaacauucugacccgacccccuacuuggcagaugauuccuucacgggggacccaagaaucuggcuuccagaucccuccucccucaggcucaggacuccaggcucccaaccccuucuccuuucuaaauccgggcccccagccccguggggacccaggcguuccgaccccuuacucaccggcugggagcugcgcgucaccccgggggcaggagcgccgguucggucugccagaagcgaucacagguccggacgguuagggaggccagcgcguucaucucacccucaggcgucgggcuccgaguaacucagaguaucuccggcugccucaagugccguggcgacaagcgggcgcggggucgugcagcgucuugcauaagaucaacaacugggaugggaaccgauaagagcaacgaacacaauggccacuaggcuuuuauagccuaccgcgcccggcg

SEQ ID NO: 15176 - RNA, 6197 nt, Homo sapiens
ggaggaggaaauagggaauaguucacuuuauucaaaguuggaggaaagcacugucuucauuaaggagauuccauuguagaaagaagauccccgccaggcgugcggcugacucucauaaucccagcacuuugggaggucaagguggaagaauugcuugaggccaaaaguucgagaccagccuggacaacauagugagauccugucucuaccaaaaauuaggccuggcgcaguggcucacgccuguuaucccagcacuuugggaggccuugguggguggaucaccugagguugggaguucaagaccaaccugaccaacauggagaaacccuguauguacuaaaaauacaaaauuagccgggugugguggcgcacgccuguaaucccagcuacucaggaggcugaggcaggggaaucguuugaacccggaaggcagagguugcggugagccaagaucguuccauugcacuccagccagggagacagagcaagacucugucucaaaaaaaaaaaaaaagaaagaaaaaaaagccgggcgugguggugugcaccuguggucccagcuacucgggagacugaggcaggaggaucucuugagcucaggaggucgaggcuuccgugagcuaugauggcaccacuguaccaucaccagccugggugacacacaaaggcccugucuccaaaauaaauuuuuuuaauaaacuuuuuuuuuuuugucggagucucucucugucgcccaggcuggacuccaguggcgcgaucucggcucacugcaagcucugucuccuggguucacgccauucuccugccucagccucccgaguagcugggacuacaggcgcccgccaccaugcccagcuaauuuuuuuguauuuuuaguagagaugagguuucaccguuuagccaggauggucucaaucucuugaccucgugauccgcccgccucggccucccaaagugcugggauuacuggcguaagccacugugcccggccuaaaaaaauuuuuuaaugaaaaauuuuuuaaaagaaagauccccuuggaaauaucuauuucuugaaucuauuucuugagagggaguaacaggggaguccaccuucuagggcagggaagucauuuguugccugggaucacguucuggauaagccuguguuuucuucguaggagugcacugcccccucccccccacacuuuuuuuuuuuugagauggauucucagucugucacccagccggacugcaguggugcgaucuuggcucacuacaaccucugccucccagguucaagcaauucuccugccucggccuccugaguagcugggauuauaggcgccugccaugaugcccagcuaaauuuugcauuuuuaguagagacagggugucgccauguuggccaggcuggucucugaacuccugaccucaagugauccaccugccuuggccucccaaagugcugggauuacaggcgugagccaccgcucccggccagcacugacccauuuuuagaaggugaugcuuuacauuggaacaauuugaccacuauugauggaggcaggugguauugauccuucuaucuauuuuacauagcuggguaccaacagaacuugauugguacaaaagaggaagaaaggauuggugguugaggaucagugggaaguuacugcacuaauagaaauguaacauguugucugggcacaguggcucacuccuguaaucccagcacuuugggaagccaaagcaggaguaacacuugagaccagaaguuugggaccagccugggcaacagugaaaucuugucucuacaaaaaaggacaagaaauuacccagauguaguggcaccuaucuguagucucagcuacccaggaggcugaggcaggagaauccccugagcccagggaggucuaggcugcaguaagcugugaucacaccacugcacuccaggagggagagugaguaauguguuauuggaaauauucauuuaugugcagugaucgggugaauuauccuuaugguguggccaacugaugguuaacaaugguacagccaagcuaaacaaguacagcugggaccaauggcaaaaccuugucucuauaaaaaaugaaaaacaaaaagaaggugguguagcuuauucgacaguuccauuuuuacggucacagaaagauccaauuggguuaggcagcuugacuguguauaugggugagaagguaagacucucuucaggaaagagcuuguauggaagaauucauuccuccuugugggggcaaggagauggggagagcucacuguaguaagaggauugcauauauuauaacagccauuccucuggacaaggcuggagaacacgaaggucucuuuugggaagguggucaaauuggaaggacauauucuuccagguggcaguucaaaguaagccugggcaacauagugagaccucaucuguauaaaaaacggaaaacaggcugggcgcgguggcucaugccuguaaucucagcacuuugggaggcugaggcaggcggaucacgaggucaugagaucgagaccauccuggcuaacacggugaaacccuaugucuacuaaaaauauaaaaauuagcugggcgugguggcgggcacguguagucccagcuacucaagaggcuaaggcaggagaauggcgggaaccugggaggcggagcuuguagugagccgagaucgcgccacugcacuccagccugggcaacagagagagacuccgucuuaaaaaaaaaaaaaagaaaaacagaaacaaaaauuagccagguguggugguguaugccugucauucuagcuacuugagaggcugagguaggaggaucacuugagcccaggagguggagucugcaagucugcagugaaccaagauaaugccacugcacuccagucugaugacagagugagagacccugucucaaaaaagaaaaaaaaaaaagagauuaaaaaaaaaagguuucauuugaauuguucauuccuuggaggcaggaauaccaggugaaucuauuguaggaauucauuugguuugccgauucauggaguggcugugaagugaaaguucacuguaggugccaagaaagcaucccuuccuggguuagggagcaggagagcccauuguagaaagggggcuuuuauuuugggucaucccauuccuucagacaggaaugaagaacaggagagucuaccuucagaaggugguaagacuggaaagacccauuuuucuacaaggguagaugagcaaaucuuuuggagguaggagucuuuuuggaaacacccauucaugggguagggguaaugguagaauuuaguguagaagggggaucuaugcauaucaagaugccuguugucucagacaugguuggcgaauggaagggggucagauugagugguucuacauuuauggaauggagaugagaguccauuuuuuaggacgaggucuucuggaaugccugucuucauuugauaaaugagauggaacacuccaugguaagagguuguccgugaaggcauuuauuuauccguggaaugaccagaagagcccacuguauggagaucuuuuuggagauguccuuuuuggggauuggaauauugagaacguccauugauggaagggggguuaucucuuugaaauccuccguugggggagugggaguaauaggugaguccauuguaggaguccauuguaggaauauugagaacauccauugauggaagggggauuaucucuuugaaauccucuguuaggggggugggaauaauaggugaguccauugcaggacuuaacuccugcaaccuccaccucccagguucaagcgauuuucccgccucagccucccgaguagcugggauuauaggcaugagccaccucaccuggcuaauuuuguauuuuuaguagagagaggguuucuccacguuggucaggcuggucucgaacucccuaccucaggugaucugccggccuuggucuccacugcgcccggccucuuuuuuuugagucucacucuguugcccaggcuggagugcaguagccugaucuuggcucauugcaaccucugccuccuggguucaagcgauucuugugccucagccucccaaguagcugggacuacagucaugcgccaccaugccuggcuaauuuuuguauuuuuaguagagacagguuucaccgugucuggucuugaacucuugaccucaggugauucaccugccucggccucccaaagugcugggauugcaggugucagccacuaugcccaguccaagggaaucucuuuaaaaguacccauucauugcuugaggaauauugagaaaaacuauuauuggaaggggaaauauaucuggaagccuuuaccaugguggggugggggugaaauaauggacaggugggaccagggauggggaaaaggagauuuccuuggaaagguccauucuuugagggugaggguaguugcacaguucauuuuagaaauagggaucuccuugaaagcaucuaaugcuugagggaaagaaaugguagagcccauguuaagaaaugggucucuggcugggugugguggcucacaccuguaaucccagcacuuuaggaggccaaggcaggcggaucacaaggucaagagaucgagaccauccuggccaacauggugacccugucccuacuaaaaauacaaaaauuagcugggcgugauggugcgcgccuguagucucaacuacucgggagguugaggcaggggaaucgcuugaacccgggaggcggagguuggagugagccgagaucgugccacugcacuccagccuggcaacagagcgugacucugucucaaagaaaaaaaggggggucuccuuguacauagccggucuucgggauggguguuaugggaccauccaccauacaaagugccugggaagaguccacucaguggcguugcgggugcuuagagaguccuuugagauccagaucuccuuggagugucuauucaaagucgguggggggccgggcgcgauaguucacgccuguaaucccagcacuucgggaggccgagguagguggaucaccugagaucaggaguuuaagaccagccuggccaacauggugaaacccuuucccuacuaaaaauacaaaaauuagccgggugugguggcaggcgccuguacucccagcuacucaacagacugaggcaggagaauugcuugaacucaggaggcagagguugcagugagccgagaucgugccacuggacuccagccuggaggacagagcgagacuccaucucaaaaaaaaaaaaaaaaaaaaaaagaagaagaaggaaaaaaaaaguuggugggaauagaaaaguuguuguagaaaacagagagaacagaucugaagauauggauugaagugauguccuuagugcauccucguuuccccuccaggacuuugugguguaugugaugacgcgagagcagcacguguuugggcgaggugggaacucgucuggccgcgggggguccccggcucccuauguggacaccuuccucaacgccccggacauccugccgcgucacugcacagugcgcgcgggcccugagcacccggccauggugcgcccgucccggggcgccccagucacgcacaacgggugccuccugcugcgggaggcugagcugcacccgggcgaccuccuggggcugggcgagcacuuccuguucauguacaaggacccccgcacugggggcucggggccugcgaggccgccguggcugcccgcgcgccccggggccacgccgccaggcccuggcugggccuucuccugucgccugugcggccgcggccugcaggagcgcggcgaggcacuggccgccuaccuggacggccgugagccaguccugcgcuuccggccgcgcgaggaggaggcgcugcugggcgagaucgugcgcgccgcagccgccggcucgggagaccugccgccccucgggcccgccacgcugcuggcgcugugcgugcagcauuccgcccgugagcuggagcugggccaccugccacgacugcugggccgccuggcccggcucaucaaggaggccgucugggugagcgccccccaaucgccguccagccccaccagcgccccaagucccuucuccagccucccuucccuaccuucaacccuuuucauagcugggcuggauacuacuguucccaugacgccucgggaagga

SEQ ID NO: 15177 - RNA, 6913 nt, Homo sapiens
gcuucuaauuuuuucaucuccaaccagaacccagggaggucaggguccggcucccccauucucccucuccacucuuucuugcuccucuccugcauccaaaaggcauaaccaccuuccaggcuccccaaacaacagggagccaucuaccggggucgggggcauguaagaacauccaugaggucucugaaggaagcagcaagcagcuuguuugccguggccagcagcaaaagaagccccccaaccauaccacgccggagggggaucauaaggaggccagguaggcaaaguuaaggcaguugcaugucagcagcacuucaggaggcaggugggguuggagguugucuccgauccugugucugcgguaggaggggcucugcugguaguucccucuccucccacaaggagcuucucuccacccccaucaguucucugucucuguaaauccuagaauccaucaccauggauccuccagcaggucccacagccggcugcugcuggagucagauaagucagcggagaagaugcuggggggugggggaccagaacccagaggaggacccccgcucagggccuccagccaguccagggaguccguggggucccugggagaaggggaggaggaguucgugggagacgggagugaagaggagaaaacagaugagaggccuucagaguccggggagggggacagcacgucgaaggagccagggaaguccaggggaauagggggcagggggucugcgggauaaagaaugguacaugagcuuggaaagucagggguccgggcgccagccccccauaccccauuuccaggauccagcuccccagcucacgccucccuuggacgcaggaguccagaaccucagcccccaccuccccuaaaucuagcaguuuggauccuaccaucaggcuccaccugauccuccaggaugucaucgaugccccgguuaggaagcaacugcggauggagaaauuuggcgugaacucgggacugcgaccuggaccugacuggagaacccuagccggauucaacccacacccucuuaccugcgcccuccggaucgcuuccugcagcuccuccuccagagucagagccgcugagcccggcccugaggaaggggucagggcuggagcugcagcaggagccggagugggaguuggagccggagccguccccgggguauccgcggcacguggaagagguggccugugagaugcugcgcugggcuugaccuagagcagccaagagggcgagcgcccauaagccaugcccacagggcgcaaccccacccacucgcaacguguggcuccaccccuugauccucucgcgaccccucgcucaucaaccccuuuggccucgcccccuauucuuucauuggcuccucuucucuaaagauccgcccccuguuagucugaaccacguccccucgccuucaaggcuuccuaccgcugguccucgcccccacacuucauuggcuaguuuuuucgacaccccgccccggcccacuuugcuuucucuucauugguccgcaagcucauagccccgcccucaccgagcccugacgccgggcggcugccagggccuugggcuugaggcgcggccagggagcacccgcgggacuguccucgcgccgcggcuucggccgcucgcggggcggcgcgccgccgcgcaugcgcuccaggagcauagacuugguccccgacacugggaggccccgcaggcgcagcugcugccggagcucugagaccuggggaggggcggggcgugggaagaggcagugcugggcgggcucccgggcgcaggcaggagcuggacaggauauuuggaaaccgagaaaggaggcacuggggguccggacuccugggacccuaaaacaggaugggacuggguacccgaucuccuggauuuccagagggcagaggcugcgggguuggaauucugggaccccaccgaaggagagagaaggccuggaaaguuacaccccaaacucaccgucagcuccuccaguuuaagggucugaaguuccaacuuguguggggggggcgaggggcuagggacuccuggugggcagggagugaggggagagggcuucauccuggugauaaucgugaggggcgaacaaagguuagagagguagagggggaaaaggcguucugggguccucaaagacggggagcuggggaagaugcagaaaagugaggguccagaauucugggucuccaagggcgcaaacauggggcuagauuucugugcaugggggaggaggaacuaggcguucagacucgggucugaagggcgaagggaggggcugggauccuggacucuuaaacccugggagaagagaggguugggggccccaauccccuaaucuuggacucgagguuugagggaggaggaugcugggaccugaauuucugggucccgggagaacagaagugggugucauaccuaggauguggcugcugcgagucugucccuucccacagagauggcccaggaggacccagggcggaccccucggcuuggggguccgcccuggaucccugucucggcucugggggcauguacuggugguaugucaaguucccccugggcuuggacucccuccaacguugggagaucuugggagacuccugaaagagcaggugugauguuuuaggcuucagcgcggcucccaccuuccggccccaggacuacaugcaaaguauggggucagcucggugccaccgaagaggagcaaaaauggcagcagcaacaagggagacaaagacuaggcucucagagggaccucucccuccagucgagacucaccuucuuuggggaccuccaaggaggacaauauucuggcucggggagcaggaccccagggcugaagaggaaaggggccgugcccgagggcaaggccggggccagaggagggucugaggcugagauccacggguccggauccgagacuggagagacggugaaggacccugagaggccugcaggcagcaagccaggccgggaggagcaaggcuguguggaaagcggggcuccagggugccggagggcaggccagggagcaagacuugauugcugggagaugggcgccugaacuggaucugagggcggaggugugggggggcuccgguugcuacauucucaaguaaagcaggaauuuucuaucacaaaggggugugguagcugaggaucacagaugucugagguuuugcuaggacagggguggggccugcacuccugguucuuggggagagggagaggcugaaagcuacauccaggccggccgcgguggcucacgccuguaaucccagcaguuugggagacugaggcgggcggaucacuugaggucaggaguucaagaccagcccggccaacauggugaaacuccgucucuacuaacaauacaaaaauuagccaggcgugguggcacgugccuguaaucucagcuacucaggaggcugaggcaggagaaucgcuugaaccugggagguagagguuucagugagcuuagauugagccaugacacuccagccuggcgacagagcaagauuccaucucaaaaaaaaaaaaaaaaaaaaaagcuauauccagagcuucucauguauaccaaauguggagaccaggaugccugucuucuccaaagaagcaggauccaaguucaagcaucucauuaggguggagaagcaggaagcagagcuccuaggggugggguggccagagaccuggacccuggauccuugggaaaggacaggaugggauuuuggucugucccaggggauggagacugagcugcaggaaccaaugagggguaucuggcagcuguauuccaggauaucccaguggggaguggggggucaccauccccucccuuuuggggcccauacuuacucugcuccugauuccgucuguggauccgaagcuggaggacuguggagggaggagggaggugggaggaggaaggcgggaagggaguguccaggagccuggccuggcaggcuggugggagcugcaguuguuggcgggauaugcgugcccagcccccuuacacagccugugcaggcgggugggcgggcagcaggcucccuuccucgggccucccgccugcucccugccagcgcagcgccgcgggccagcgccauucuggggcuacgagccagccagcgugcaggcuggaggcagcccugcccccggcuccaccugcccccuccaugagcaagcgugugcccaccccacccccugcgcaaucgcuaucuuggcagccuggccccuuugcaccucgccucccuuuauccaugcacuccugcuacuuucugugcuaucucggggccuucccacagucaacacucuccgcauauccacauuuucaguaugcaucucucugggcucuaguuuugcacacaugccauuuuuacgcacuugcauguuuuugcagacucuucauccuugacucacucugccucagcauccauguuaacacuguuuuuuuuuccuuuuuuuaauuuguuuuauuuuuuuagagacaaggucucacucuguaacccaggcuggagugcaggggugugaucauagcucacugcagccuugaacuccugggcucaauccauccucccaccuaagucuccugaguaccugggacuaccuaaauuuuuuuguuuuguuuuuuaauuuuuuguagagacagggucuugcuguguugcccaggaugaauguuaacuaucuuuuuuuuuuuuuuuuuugagacaaagucucgcucugucacccaggcuugaggacaaugucacaaucucagcucacugcaaccucugccucccagguucaagcgauucuccugccuuaaccucccaaguagcugggauuacaggugcucaccaccacacccggcuaauuauuauuauuauuauuuuuugagacagaguaucgcucugucacccaggcuggagugcaguggugcgaucucagcucacugcaaccuccaccucccgggugcaagcaauucuccugccucagccuccccaguagcugggacuagaggugcacgccgccacacccggcuaauuuucuguauuuuaguagagaugggguuucaccguguugcccaggcuggucucgaacuccugagcucaggcaauccgcccgccuuggccucccaaagugcuaggacuacaggcaucagccaccuugcccggcgucauuuuuuuguauuuuuaguagagacaugguuucgccauguuggccaggcuggucuugaacuccugaccucaggugauccaccugccuuggccucccaaagugcugggauuacagguaagagccaccgcgccccaccuggaugaauguucacuuucuuaugugcacagucaggguuugucccccaauuugggagcaaggaucucucugcacauuucugcuuuucucuggacauaugcgccuuuuuguauacuccuugcucuuugauugcuggugucuuuguacccauccaaccacauaggcacgcucacgugcacacucaaguacccuuugccuucucaggaacugaucuguaguucgaaacacuugcacacuucuuuuuuuuuuuuuuuuuuuuuuuugagauggaguuucgcucuuguugcccaggcuggagugcaauggcgugaucucggcucaccgcaaccuccuccucccggguucaagcgauucucccgccucaaccucccaaguagcugggauuacaggcaugcgccaccacacccggcuauacuugcagacuuuuugccugcccugggaccuaaaacaagaccuuugacacuuucacagcuugacagcucauuguccccucacccaaacucccacacugguccucugaggucccuccucugcucuucugccccugcgugugcgccaguauaagccuuuguuucucuucagugcuugagcccucugcacgccuaccccuggccuccaauccccauugcuccccccgugagcaugcuacuagccauuugcacacucguugauccaccacagccggaccccugugcuugggccuccuuuaugcaacaugaccuuuugcacaaaaaacacaggccucaugggaccuaccaccccucccuucccaccccagaguacagcauucucaggaucccaucccccacgcauaaagagagcccucucucaccagaucggaacuuggagcgaaugauuugggaacgcugggaggaagccgccagggucauugccaaggccgggauggggaccuggacggagagggggcagggcaggggccccauagagggcuggcucagaguggaggucaggaggccgccccugagagugaauucagcagggaaagggcccgaaggaggugggaauaggagcagccuugggccauaacuuccggaucccaggggcuguagaggagggggcugcacacccggacaccuugcuccgaggaaggaggaagcuggggacccagacaccuggucugaaagacagggcugagggucucaacccugggauccugggaggggagggaccuggaaucugggacuccuggguccugaggaggaaggguugcggguugggaccccugugucuaggaaagggaggaagcagaggggccuggagucuggaaucuugaaggagaaggagguuaagggcuggaacucaauacucuuaggagaugagaauccaagauccuggguggagaggggaacggggcccugacagguuucugaggaauagaagggccccugugaccugcaucugagaaggagugaguagggugucagccaccagguucucuggggaagggacugggaccagagaggggauagaaccguugaggagugcgccccccccguccaccccaggggcuucucaccaggugggcucggcgaagcugugcucuggggcggguugagucuagag

SEQ ID NO: 15178 - RNA, 8177 nt, Homo sapiens
cuggaggccgacacugagggagggcgggaggaggugaagaaggagagaggggagaagaggcaggagcuggaaaggagagagggaggaggaggaggagaugcgggauggagaccuggaguuagguggcuugggagagcuuaaugaaaagagaacggagaggagguguggguuaggaaccaagagguagcccugggggcagcagaaggcugagaggaguaggaagaucaggagcuagagggagacuggaggguuccgggaaaagagcagaggaaagaggaaagacacagagagacgggagagagaagaagaguggguuugaagggcggaucucagucccuggcugcuuuggcauuuggggaacugggacucccuguggggaggagaggaaagcuggaaguccuggagggacagggucccagaaggaggggacagaggagcugagagaggggggcagggcguugggcaggggucccucggaggccuccuggggaugggggcugcagcucgucugagcgccccucgagcgcugguacucugggcugcacugggggcagcagguaagaccugggguucccgggaggagcccccgagggaggguggagguggggaugccaaggagagggauucaggcugcucucuucccagcucacaucggaccagcaccugaccccgaggacugguggagcuacaaggauaaucuccagggaaacuucgugccaggugccgccaaggcggggacccaggaguccggcccucccggcgccuccuucuucagacucaggaaccuggguucccagcucccuccucccccccaggaccaggagucccagcccccuccucugucccucaggagucgggccagcuucugaaccccaggggcucaccaugggacauuauacaugcgcauuucaaguagugagugggagugaguggaaggaaaguguggggguggagauuauguguguguuugccgggagaggaagguccuggcuccugcuaggaaccagaggcuggguggccccgucccccaccuuguccagccuucucuugcagcuccucuccccaacacauuaauaauaauccagcugugggauaagagcgauuaaaaaaaagaacuacaacucccacggggcucuggggcagguaggcagcagagggguaggcugguagcacuggggccugcugggaguuguaguuccaucuacaguggcuuaagauggguuugaucggcugggcgcgguggcucacgcuugaaaucccagcacuuuaggaggccgagguggguggauuaccuguggucaggaguucaagaccagccuggccaacuuggugaaacccgucucugcuaaacuuggaaacuauuccaagauucuucuaggacccagaauucuggaucugagcccaguccucccucagacccaggagucuaggucccuagccccuccuccccugggaucugggaguccagaccacagcccacucagcagauaccagcccugggauccagucucuauuucugacuccuuguccuccuacuccgaccccacccccagggccuccuuucuggggccuggugaaugcagcguggagucugugugcuguggggaagcggcagagccccguggauguggagcugaagaggguucuuuaugaccccuuucugcccccauuaaggcucagcacuggaggagagaagguaaggggcuuggagggaggagcuauugaacccacuggggaugggcaugaauagaggcuggggaauggggugcugagguaggagagcagccuugggggaggaggggacacccaguggguggagaggaggcugcuuacacuguaaaauggaucacccauucuucccaucccaagcaugguccccuagucuccccaucucugcagaagcaaugaaaagcagaacauuuccugugccaggcagauuuaaaaccuugauaagccucucaucucauaaccaccccacaaaauggguacaauuauuauuauuguuauuauuauuauuauuauuuugagauggaguuuugcucuuguugcccaggcuggagugcaaugaugugaucucagcucacugcaaccuccaccucccagguucaagcgauucuccugccccagccucccgaguaguugggauuacaggcaugcgcaccaucacgcccagcuaauuuuuuguauuuuuagcagagauggguuuucuccauuuuggucaggcuggucuugaacuccugaccucaggugauccaccugccucggccucccaaagugcuaggauuacaggcaugagccacugcguccagccaaaauggguacaauuauuaaccuuauuauauacaugcagaaacugacacacagagguuaaguuacuugccuaggaucacacagagagccagcacuggcauucaaaccaagcagcguagcaugaaugcugggaccugcuuuauaguaccaugcugggaaccauacuuuuuuuuuuuuuuuuuggaauugggaucucacucugugacccaggcuggagugcaguggcccagucauagcucacuguaaccucaaauuccugggcccaagugaucuuccuaccucagccucaaaaauagcuaggacaugccuggguguggugguucaugccuguaaccccagcacuucgggaggccgagguggguggaucacgagguuaggaguucgagaucagccuggccaacauggugaaaccccaucucuacuaaaaauacaaaaauuagccgggugugguggcaugugccuguaaucccagcuacuugagaggcugaggcaggagaauugcuugaacccgggaggcggagguugcagugagcugacaucacgccacuggacuccagccugggugacagaacaagacuccaucucagaaagaaauaaauacagagagagagggagagaaaagaaagagagagagcgagaaagaaagagagaaagagagaaggaaggaaggaagggaaggaaggaaaggaaggaagaagccaggacugcaggcacaugccaguaugcuuggcuaacuuuuuaaguuuuuuguagagguggggucucacuauguuguccaggcugaugucgaacuccuggguucaagugauccuccuugccuuggcuucccaagguacuggaauuacagcugugauccaccgcgccuggccaauaccauuucuuauaagagccggcacugccuuucauuuagcugccccagccaaaagccucaaagccauuccccauccuauccucucucccucauguccauuuccaauccauguucuuucuagccuugcugcuaaauauuauucaaauccuuucaccuaucacgcccucuacugcccccagucucauguaggcaccaucaucucccaccuggacugguggcguacccuccucacuggccugccucucaacuuccugcaaucuauucaccccacagcuagagagauguuuaaaacacaaauaagaucauaucacuccugcucaaaauccuccuauuaggauauguaauaacagcaaacauuuacauagcacuuacuauauguuuggcauucuggcaaauguguuauauauaugcaguuuauuuauuuuuauuuuauuuuauuuuuugagucggagucucgcucugucgcccaggcuggaguguaauggaaugaucucagaucacugcaaccuccgccuccuaggaucaagcgauucuccugccucagccucccaaguagcugggauuacaggcgcccaccgccacacccagcugguuuuuguauuuuuaguagagaugggguuucaccauguuggccaggcuggucucaaacuccugaccucuggugaucugcccaccucagcuucccgaagugcugggauuacaggcgugagccaccacauccagccuauauaugcaguuuauuuaaauaaaaauacaaaacucucuacuguuuuccacaagguccugcaccauucagcccccauaaccucucucuccucuguucacuggacuuugaugaagucucuuugcuguuacucaaacaggccaccucagggccuuugcacuugcuguucccucuucuuggaaugcccuucucuuuguucuuuugcaagucaccccugcuuauccuucagguccccauuaaaaugucaccuuuggccaggugcagugcuucaugcguguaauuccaguauuuuucagaggcuaaggcaggaugaugacuugagcccaggaauuuaagaccagccugggcaacauagggagaacccucucuaccaaaaaaaaaaaaaaaaaaaaaagaaaauugaaaauuaguugggcauggugguaugugacuguggucccagcuacuugagaggcugaggcaggaggaucguuugagcccaagaguuugaggcugcagugagcugugauggcaccacugcaaucuagccugggugccagaaugagacuuugucucaaaauaauaaauaaauaaaaauaaaaugucaccuuugcagggaagcuuuuccugacaucccccaucuaagcugagcuccccaugacaccucagagcucccaguucccccaaacaugagcucaggauguaguuaauuaagcaguuacuuaugugauucacaauugucugucuugccuucauuagaacauaaacuccauaaggcccaggacuuuugucuacuuguuuauugcucuauucuugcauccacggcacauagcaccagcucagucaauauuuguuaaucaaacaaauucaccaauauugggcaccaacuuacaaacuggcacagagccuggaaaguggucaguguucaaauuauguugaaugauuaaauuacuguuggaggccaggcacgguggcucacgccuguaaccccagcacuuugggaggccaaggugggcagaacaccugaggucaggaguuugagaccagccuggccaacacagugaaacccugucucuacuaaaaauacaaaaauuggcugggugugguggcacacaccuguagucccagcuacucgggagccugagggaggagaaucgcuugaacccaggagucagagguugcagugaggcgagaucucaccacugcacuccagccucggcagcagagugagauucuauuuaaaaaaaaaaaaaacaaaaacaaaaagccgggcgcgguggcucaugccuguaaucccagcacuuugggaggcugaggcgggcggaucacgagguccggagauccagaccauccugguuaacacggugaaaccccgucucuauuaaaaauacaaaaaauuagccgggugugguggcgggcgccuguagucccagccacucuggaggcugaggcaggagaauggcgugaacccgggaggcggagcuugcagugagcggagcucucgccacugcacuccaacccgggcgacagagcgagacuccgucuccccccagaaaaaaaaaaaagaccgggugcgguggcucacgccuguaaucccagcacuuugggaggcugaggcggguggaucaccagaggucgggaguuugagaccagccugaccaacguggagaaacccugucucuacuaaaaauaaaaaauuagccgggcaugguggcgcaugccuguaaucccagcuacucggaaggcugaggcaggagaaucgcuugaacccgggaggcggagguugcggugagccgagaucacgccacugcacuccagccugggcaacaagagcgagacuccguuucaaaaaaaaaaaaaaaaaaaaaaaagacuguuggaaucagaaaauguaggcgugggaaacgagagauaaaagaucucucccugcccccugacagcucccgccucucccacagcuccggggaaccuuguacaacaccggccgacaugucuccuuccugccugcaccccgaccuguggucaaugugucuggagguccccuccuuuacagccaccgacucagugaacugcggcugcuguuuggagcucgcgacggagccggcucggaacaucagaucaaccaccagggcuucucugcugagguaguggccacugauuguuuacccgccacccuccgcccugagucaccccaauuccucccaccucacccucuuagugucucaccccauccuccuccacagaacuggccucccacccuaagcacuaauccucagccugauucgggcccccaaagcuggggucaugcucuccuccccuucugcugggggaccccaugcucugugcuacccccaggugcagcucauucacuucaaccaggaacucuacgggaauuucagcgcugccucccgcggccccaauggccuggccauucucagccucuuugucaacgugagcggaggcgagauucagagggagggagcaguugggugccuggaacccggggucugagggaagcggggugcugggaggcccagacuccuggguccugggggaggagaagguugagggcuuggacuucugggcuccuguguccucaccucguacccccacacagguugccaguaccucuaacccauuccucagucgccuccuuaaccgcgacaccaucacucgcaucuccuacaagaguaagucccuggcgugcugggggcaguggucacacacgaggggguucaagagugccaucccucuuuacucuggccugauauucccgcagaugaugccuacuuucuucaagaccugagccuggagcuccuguucccugaauccuucggcuucaucaccuaucagggcucucucagcaccccgcccugcuccgagacugucaccuggauccucauugaccgggcccucaauaucaccucccuucaggugacccucuguccgcaccgcccuuccuaggccuggguacuccacucacuggccugggcauccccuugcucaccugcccucccucuccucauagacugaacucaaguagguaagagggucagaccaccuuggggguggguggggcugagaacagaccccgcccaccugcucccaggggcgggguuuccugcgugacgucaccaagaccauucacuauucacucccaguuucccacccuccuuccacugcagaugcacucccugagacuccugagccagaauccuccaucucagaucuuccagagccucagcgguaacagccggccccugcagcccuuggcccacagggcacugaggggcaacagggacccccggcaccccgagaggcgcugccgaggccccaacuaccgccugcaugguaugguccagucugcacccccucuaagucuugggcuaacccucuuauaugugucuccccuuggugucucagugugauucagucccauccuccuuccugcgucuauauggucuagccucgugagcugucucuuuuucucucuuucccuacaugucuaugugguacaguccaccugccagcccuaggccauugcuagcccacgauuugucuuuccucuucacugcuuuguaacuuggucuauaacccuugaccccugccuuccuaugguccaauuaccuacuguucugugcuuccuauuacugugaauuuccaaaaugguacaauuuggauccucucucccuuuccaagucguacuaccuuacgcuguuccacaaucugaugcucccuucccccuuacugagaaucuacaagguacaaccccuucccuccaccucugccucccugugguuuagcccaggaaucucacacacccccggcuucgcaacaugguacaguccacacccccccccccccaugaagaccuucaaguaguucagccuacugcugaaucuggacgucccgauuccccccuccuauuggcuucuugugguucagcccagugcuucucgaccuaguacauucugguuccccgcucgcagacuuccgacgguagggcccagcgcggcgcagcccacgcccccugcacaccccccgccccuuccauccuauacugacgcccccugccguuguucucugucuuacaguggauggugucccccauggucgcugagacuccccuucgaggauugcacccgcccguccuaagccuccccacaaggcgaggggaguuaccccuaaaacaaagcuauuaaagggacagaauacuuccuguuuucucaguggucugauucuaggcgcgguggggaaacauuuggguauuaaagaacagacuucuuccggaaa

SEQ ID NO: 15179 - RNA, 8177 nt, Homo sapiens
uuuccggaagaagucuguucuuuaauacccaaauguuuccccaccgcgccuagaaucagaccacugagaaaacaggaaguauucugucccuuuaauagcuuuguuuuagggguaacuccccucgccuuguggggaggcuuaggacgggcgggugcaauccucgaaggggagucucagcgaccaugggggacaccauccacuguaagacagagaacaacggcagggggcgucaguauaggauggaaggggcggggggugugcagggggcgugggcugcgccgcgcugggcccuaccgucggaagucugcgagcggggaaccagaauguacuaggucgagaagcacugggcugaaccacaagaagccaauaggaggggggaaucgggacguccagauucagcaguaggcugaacuacuugaaggucuucauggggggggggggguguggacuguaccauguugcgaagccgggggugugugagauuccugggcuaaaccacagggaggcagagguggagggaagggguuguaccuuguagauucucaguaagggggaagggagcaucagauuguggaacagcguaagguaguacgacuuggaaagggagagaggauccaaauuguaccauuuuggaaauucacaguaauaggaagcacagaacaguagguaauuggaccauaggaaggcaggggucaaggguuauagaccaaguuacaaagcagugaagaggaaagacaaaucgugggcuagcaauggccuagggcuggcagguggacuguaccacauagacauguagggaaagagagaaaaagagacagcucacgaggcuagaccauauagacgcaggaaggaggaugggacugaaucacacugagacaccaaggggagacacauauaagaggguuagcccaagacuuagagggggugcagacuggaccauaccaugcaggcgguaguuggggccucggcagcgccucucggggugccgggggucccuguugccccucagugcccugugggccaagggcugcaggggccggcuguuaccgcugaggcucuggaagaucugagauggaggauucuggcucaggagucucagggagugcaucugcaguggaaggagggugggaaacugggagugaauagugaauggucuuggugacgucacgcaggaaaccccgccccugggagcaggugggcggggucuguucucagccccacccacccccaagguggucugacccucuuaccuacuugaguucagucuaugaggagagggagggcaggugagcaaggggaugcccaggccagugaguggaguacccaggccuaggaagggcggugcggacagagggucaccugaagggaggugauauugagggcccggucaaugaggauccaggugacagucucggagcagggcggggugcugagagagcccugauaggugaugaagccgaaggauucagggaacaggagcuccaggcucaggucuugaagaaaguaggcaucaucugcgggaauaucaggccagaguaaagagggauggcacucuugaacccccucgugugugaccacugcccccagcacgccagggacuuacucuuguaggagaugcgagugauggugucgcgguuaaggaggcgacugaggaauggguuagagguacuggcaaccuguguggggguacgaggugaggacacaggagcccagaaguccaagcccucaaccuucuccucccccaggacccaggagucugggccucccagcaccccgcuucccucagaccccggguuccaggcacccaacugcucccucccucugaaucucgccuccgcucacguugacaaagaggcugagaauggccaggccauuggggccgcgggaggcagcgcugaaauucccguagaguuccugguugaagugaaugagcugcaccuggggguagcacagagcauggggucccccagcagaaggggaggagagcaugaccccagcuuugggggcccgaaucaggcugaggauuagugcuuagggugggaggccaguucuguggaggaggauggggugagacacuaagagggugaggugggaggaauuggggugacucagggcggaggguggcggguaaacaaucaguggccacuaccucagcagagaagcccuggugguugaucugauguuccgagccggcuccgucgcgagcuccaaacagcagccgcaguucacugagucgguggcuguaaaggaggggaccuccagacacauugaccacaggucggggugcaggcaggaaggagacaugucggccgguguuguacaagguuccccggagcugugggagaggcgggagcugucagggggcagggagagaucuuuuaucucucguuucccacgccuacauuuucugauuccaacagucuuuuuuuuuuuuuuuuuuuuuuuugaaacggagucucgcucuuguugcccaggcuggagugcaguggcgugaucucggcucaccgcaaccuccgccucccggguucaagcgauucuccugccucagccuuccgaguagcugggauuacaggcaugcgccaccaugcccggcuaauuuuuuauuuuuaguagagacaggguuucuccacguuggucaggcuggucucaaacucccgaccucuggugauccacccgccucagccucccaaagugcugggauuacaggcgugagccaccgcacccggucuuuuuuuuuuuucuggggggagacggagucucgcucugucgcccggguuggagugcaguggcgagagcuccgcucacugcaagcuccgccucccggguucacgccauucuccugccucagccuccagaguggcugggacuacaggcgcccgccaccacacccggcuaauuuuuuguauuuuuaauagagacgggguuucaccguguuaaccaggauggucuggaucuccggaccucgugauccgcccgccucagccucccaaagugcugggauuacaggcaugagccaccgcgcccggcuuuuuguuuuuguuuuuuuuuuuuuuaaauagaaucucacucugcugccgaggcuggagugcaguggugagaucucgccucacugcaaccucugacuccuggguucaagcgauucuccucccucaggcucccgaguagcugggacuacaggugugugccaccacacccagccaauuuuuguauuuuuaguagagacaggguuucacuguguuggccaggcuggucucaaacuccugaccucagguguucugcccaccuuggccucccaaagugcugggguuacaggcgugagccaccgugccuggccuccaacaguaauuuaaucauucaacauaauuugaacacugaccacuuuccaggcucugugccaguuuguaaguuggugcccaauauuggugaauuuguuugauuaacaaauauugacugagcuggugcuaugugccguggaugcaagaauagagcaauaaacaaguagacaaaaguccugggccuuauggaguuuauguucuaaugaaggcaagacagacaauugugaaucacauaaguaacugcuuaauuaacuacauccugagcucauguuugggggaacugggagcucugaggugucauggggagcucagcuuagaugggggaugucaggaaaagcuucccugcaaaggugacauuuuauuuuuauuuauuuauuauuuugagacaaagucucauucuggcacccaggcuagauugcaguggugccaucacagcucacugcagccucaaacucuugggcucaaacgauccuccugccucagccucucaaguagcugggaccacagucacauaccaccaugcccaacuaauuuucaauuuucuuuuuuuuuuuuuuuuuuuuuugguagagaggguucucccuauguugcccaggcuggucuuaaauuccugggcucaagucaucauccugccuuagccucugaaaaauacuggaauuacacgcaugaagcacugcaccuggccaaaggugacauuuuaauggggaccugaaggauaagcaggggugacuugcaaaagaacaaagagaagggcauuccaagaagagggaacagcaagugcaaaggcccugagguggccuguuugaguaacagcaaagagacuucaucaaaguccagugaacagaggagagagagguuaugggggcugaauggugcaggaccuuguggaaaacaguagagaguuuuguauuuuuauuuaaauaaacugcauauauaggcuggaugugguggcucacgccuguaaucccagcacuucgggaagcugaggugggcagaucaccagaggucaggaguuugagaccagccuggccaacauggugaaaccccaucucuacuaaaaauacaaaaaccagcuggguguggcggugggcgccuguaaucccagcuacuugggaggcugaggcaggagaaucgcuugauccuaggaggcggagguugcagugaucugagaucauuccauuacacuccagccugggcgacagagcgagacuccgacucaaaaaauaaaauaaaauaaaaauaaauaaacugcauauauauaacacauuugccagaaugccaaacauauaguaagugcuauguaaauguuugcuguuauuacauauccuaauaggaggauuuugagcaggagugauaugaucuuauuuguguuuuaaacaucucucuagcuguggggugaauagauugcaggaaguugagaggcaggccagugaggaggguacgccaccaguccaggugggagaugauggugccuacaugagacugggggcaguagagggcgugauaggugaaaggauuugaauaauauuuagcagcaaggcuagaaagaacauggauuggaaauggacaugagggagagaggauaggauggggaauggcuuugaggcuuuuggcuggggcagcuaaaugaaaggcagugccggcucuuauaagaaaugguauuggccaggcgcgguggaucacagcuguaauuccaguaccuugggaagccaaggcaaggaggaucacuugaacccaggaguucgacaucagccuggacaacauagugagaccccaccucuacaaaaaacuuaaaaaguuagccaagcauacuggcaugugccugcaguccuggcuucuuccuuccuuuccuuccuucccuuccuuccuuccuucucucuuucucucuuucuuucucgcucucucucuuucuuuucucucccucucucucuguauuuauuucuuucugagauggagucuuguucugucacccaggcuggaguccaguggcgugaugucagcucacugcaaccuccgccucccggguucaagcaauucuccugccucagccucucaaguagcugggauuacaggcacaugccaccacacccggcuaauuuuuguauuuuuaguagagaugggguuucaccauguuggccaggcugaucucgaacuccuaaccucgugauccacccaccucggccucccgaagugcugggguuacaggcaugaaccaccacacccaggcauguccuagcuauuuuugaggcugagguaggaagaucacuugggcccaggaauuugagguuacagugagcuaugacugggccacugcacuccagccugggucacagagugagaucccaauuccaaaaaaaaaaaaaaaaaguaugguucccagcaugguacuauaaagcaggucccagcauucaugcuacgcugcuugguuugaaugccagugcuggcucucugugugauccuaggcaaguaacuuaaccucugugugucaguuucugcauguauauaauaagguuaauaauuguacccauuuuggcuggacgcaguggcucaugccuguaauccuagcacuuugggaggccgaggcagguggaucaccugaggucaggaguucaagaccagccugaccaaaauggagaaaacccaucucugcuaaaaauacaaaaaauuagcugggcgugauggugcgcaugccuguaaucccaacuacucgggaggcuggggcaggagaaucgcuugaaccugggagguggagguugcagugagcugagaucacaucauugcacuccagccugggcaacaagagcaaaacuccaucucaaaauaauaauaauaauaauaacaauaauaauaauuguacccauuuuguggggugguuaugagaugagaggcuuaucaagguuuuaaaucugccuggcacaggaaauguucugcuuuucauugcuucugcagagauggggagacuaggggaccaugcuugggaugggaagaaugggugauccauuuuacaguguaagcagccuccucuccacccacuggguguccccuccucccccaaggcugcucuccuaccucagcaccccauuccccagccucuauucaugcccauccccaguggguucaauagcuccucccuccaagccccuuaccuucucuccuccagugcugagccuuaaugggggcagaaaggggucauaaagaacccucuucagcuccacauccacggggcucugccgcuuccccacagcacacagacuccacgcugcauucaccaggccccagaaaggaggcccuggggguggggucggaguaggaggacaaggagucagaaauagagacuggaucccagggcugguaucugcugagugggcuguggucuggacucccagaucccaggggaggaggggcuagggaccuagacuccugggucugagggaggacugggcucagauccagaauucuggguccuagaagaaucuuggaauaguuuccaaguuuagcagagacggguuucaccaaguuggccaggcuggucuugaacuccugaccacagguaauccacccaccucggccuccuaaagugcugggauuucaagcgugagccaccgcgcccagccgaucaaacccaucuuaagccacuguagauggaacuacaacucccagcaggccccagugcuaccagccuaccccucugcugccuaccugccccagagccccgugggaguuguaguucuuuuuuuuaaucgcucuuaucccacagcuggauuauuauuaauguguuggggagaggagcugcaagagaaggcuggacaaggugggggacggggccacccagccucugguuccuagcaggagccaggaccuuccucucccggcaaacacacacauaaucuccacccccacacuuuccuuccacucacucccacucacuacuugaaaugcgcauguauaaugucccauggugagccccugggguucagaagcuggcccgacuccugagggacagaggagggggcugggacuccugguccugggggggaggagggagcugggaacccagguuccugagucugaagaaggaggcgccgggagggccggacuccuggguccccgccuuggcggcaccuggcacgaaguuucccuggagauuauccuuguagcuccaccaguccucggggucaggugcugguccgaugugagcugggaagagagcagccugaaucccucuccuuggcauccccaccuccacccucccucgggggcuccucccgggaaccccaggucuuaccugcugcccccagugcagcccagaguaccagcgcucgaggggcgcucagacgagcugcagcccccauccccaggaggccuccgagggaccccugcccaacgcccugccccccucucucagcuccucuguccccuccuucugggacccugucccuccaggacuuccagcuuuccucuccuccccacagggagucccaguuccccaaaugccaaagcagccagggacugagauccgcccuucaaacccacucuucuucucucucccgucucucugugucuuuccucuuuccucugcucuuuucccggaacccuccagucucccucuagcuccugaucuuccuacuccucucagccuucugcugcccccagggcuaccucuugguuccuaacccacaccuccucuccguucucuuuucauuaagcucucccaagccaccuaacuccaggucuccaucccgcaucuccuccuccuccucccucucuccuuuccagcuccugccucuucuccccucucuccuucuucaccuccucccgcccucccucagugucggccuccag

SEQ ID NO: 15180 - RNA, 6976 nt, Homo sapiens
gguguuuugguuuggauuuuuuuuuccgcgaaagaaguuugcuuuggccacgccucaaggcggccgccuccuccugcccccuccuccgccccuccgcgcacaccucucggugcagauugcaaagcgccuuccguugcgagagcugcagauuuugcaagagccaggcucgcccaccuuguagaaggagcgccuugaguccccucucacccucgguugcaaagagccgaccgcuugaucuggacacccccucgcccagauugcaugaucucccgggacccucuugaguugcacguuucugcaccgaggaccucaaauccccgucgcuccuaggauuugcagcguucuggauacuggaggguugcaggcuacacucgcccgccccugggcagacacucguccaaaccacuggagugugcuggugacuggcaggccagcccuucgccucuccaugaacccgugagccugggggcaggugccaggcgauggcgcggccugugagcgacaggaccccggccccucugcugcugggcggcccggccgggacacccccuggcgggggagcgcugcuuggguugcggagccuucugcaggggaccagcaagcccaaagagccggccagcugugaguucuaacccccaucucacccacuucggacacccuacccccuuagggacucaggugccgugggguggggucccauagaaaccugcgugcggggaguccaucuucccaaccuuaaucuacucaauuacucagguguuuaggccccuagaucccuuagcgcccaggacccaaaagcgccggcucugaagcccguccacccuaaggacccaggcaccaacguccccaacguccuccccgcuuaguucacaagaguguaggccccagccuccucuuccuuuugguccgggagucuggaccccuggggucccagggagggggugugucgggugcucacacgguggugacacgggcuugggcggggcgucauggggucacauggagucuagggaugagggaugugccccaggaauagagccccuuccugccccuuacagauggugggggaggggaaggggguacagcgcgcaggggauggggguuggguaauuacagugaaauuacagagcugucauuuuuucucucaccugcccaacccuccaccuacccugucccugccccccuauuccugaacuuccgucucucuuucucugguucgcugucuuucugugugucuauuccuucccggcauucuguccccaucucugugaaucuguccaccugucucugccacccccgucuccauucuuucugggucucucucccacucugcgucuccgucccuuuuucucccgucucuccucuccgaccccccguccccucuuucucuggaucuccgcccugugccucucggacucggggucucuucuccaucucuaucucccccaccucacccucaucccaacccgucuuucccggcccgcaggucuccugaaggaaaaggagcgcaaggcggcccugccugcagccacaaccccugggccaggccuggagacugcgggcccggcggaugccccggcuggggcaguggugggcggaggguccccgcgggggcgcccggggccggugcccgccccgggucuguuggcgccacugcugugggagcgcacgcugccguucggcgauguggaguacguagaccuggacgccuuccugcuggagcacgggcucccgcccagcccgccgccccccgguggcccgucgccggagccgucgcccgcgcggacgcccgcacccuccccagggccggguucgugcggcucggcuuccccccgcuccucuccugggcacgcccccgcccgggcugcccucgggaccgccagcggccaccgcgcaggugcggcgaagggggcggggcggguccugacggggcggggcuuggacucagggggcggggcugugcgacgcugggggcugggaccgugggaccuggcugcggccucgaauucuguguccaguugucgagaggugucgugggagggggccagauucggugucucuuaaugggucagggaccaauggauccaugggggaggagagacuuggaacccuaaauuccaggaagccugcccaaugagauuuuguggguuuuucugugggacuuggggacaaacgauguggauacucgugaagccagaacuggaaguccggaacaccagaguuauuuacuggggaguggacugacccccgaaucugggcccauaaucgauggaacugggauaggacuggagccccuagguccuuuacaggggcaaaggcaaaggagaggcacagaauucuguuuacccaggacauaagagacuggcagcccaggucccugggucccccaguggggcgugcugcagccccgggucccagaguucuucagaagggaaaacguuagggauguuguuucuggauccuccaauuggggcuggggccaagcuuccuauauuccuaggagaggccugggaucccagaaucgugguagcccaguggcggggguucugggaagguccaggaggccgaugcuccccggagagcaggggguugggaaucuuuggagguugaguggaacuaagugacuggaagagcaagaggaaagauguuucccuuugggcacauugaggucuccagggacggacugcaggucggggauuccugggcacaccugcuccagguccgaccuccgggccgaaccagggcccuacccuucccagcggcacauuccugcgccacgugaguccucccaucccuccuccgcgcuucgcgcaggcgccuucaagcgcgaggggggcggggccgggggaacgugagggcgccgauggcgggggccugggaggaagggaggaggagggaagcaggcgucagcacgugacucggcccugaaccuguguccuuagcuggccccggcuggcuggugcuuaaagguacaggcgccuccuuucgaaccaaucuucuggaaccuuagagcagcuucuccuccucuuuccagcgaguagcucuuagacucuaacuugagagcuuuucagugcaguagauucuuuuucucuggacagucuggggucuaagcuuaggucguggauucgguaaguaggauucaggcuagacugugcaucugaaguccugagguuuuagaagcaauagccccaucgcuucucggccuuuuggcuaagaucaaguguagaagcaauagcccugauucguguguuaccuagggcaagucaguuaugacugggacucaguuuccuuguuuguaaagguggauauggcuccaugaucucuaagcaucuuuauggcuuaggggaaccuucauuuuucucguuauuuuggagacggagucucgcucuguuguccgggcuggagugcagugguaugaucucagcucacugcaaccuccaccuccaggguccggguucaagcaauucuccagccucagccucccuaguagcugggcuuaccggcacccgccacuacaccugggcaauuuucguacuuuuaguaaagaugagguuucuccauguuggccaugcuggucuugaacuccugacuaaaggugauucgccgccucggcuucccaaacugcugggguuacaggcgugagccacugcgccuggccaagggaaccuucauauuuuauauuagggagauuaaucccuggccgaauuuaugcuagaucccagaaggacuuuccauguggcuaugauaccacagcaaaaaguagcuucaggaaacccccuccuuaaaauacacacucagcugacacgugcuguuuccccaaggccugaccucucgggacacacccagcccuguggacccagacaccguggagguguugaugaccuuugaacccgacccagcugaucuugcccuaucaagcauuccuggccacgagaccuuugacccucgaagacaucgcuucucagaagaggaacuuaagccccagccaaucaugaagaaggcaagaaaaauccaggugccggaggagcagaaggugagcagagcuggaugugggagauagacuuggcuggagacaugccccacagccagggaggggccuuuucucacagucaagccugggcuucuccuugggauuagugcucagccucuccuggccugcagccacagauuaguccuccuuggccacggggcacaagggggcaggggccugagguuuauaaagacagugucaacugggcgaggggccucacucguguaaucccagcauuuuagggggcugaggcaggaggaucucuugagcucgggaguucaagaccagccugggcaacauggcaaaaccccauuucuacaagccacuugggaggcugaggugggaggacugcuugugccugggagauugaggcugcagugagccaagauuacaccacugcacuccagccugggcaacagagggagaccuugucuuaaaacaaaagacagugucacuguggggugcugacucagccagcucugcuaggucuacuuguagagacuuggagcuucuccuauuacuuggguccagagcuccaccaggcacacuugcaaaggacagucuuccuuuggcaaugggauaucagccuguggccugucucuccuuacucagcaggccuuugaucucugaugugggacuuccuuuggagugauugcauuuggcuaggaugaagacugugccagccccuuuaggccuuguuuccugggccuggacuucucacuggugggagacuucaggcuucuguuagcagccagugccacuuucugauuuggggugauuugagcagucauugcaucuuugcaugauuuuguuuuuugccauuacuggagucuucccuagcaagaguugcuugggcuucuguuacaagacuuugucauuccgggccaggcgcguuggcucacgccuguaauccuagcacuuuaggaggcugaggugggcggaucacuugaggucaggaguuugagaccagccuggccaacauggugaaaccucgccucuacuaaaaguacaaaaauguuccggguguggugucucacaccuguaaucacagcacuuugggaggccgaggcggacagaucacgagaucaggagaccauccuggccaacauggugaaaccccgucucuacaaaaaaauacaaaaauuagcugggcaugguggcacucaucuguagucccagcuacuugggaggcuaauguaggaaaaucgcuugaacccaggagacggagguugcagugagccgagaucgcgccacugcacuccagccugggcgacagagugagaacuccaucucaaaaaaaaaaaaaaagaacaaaaauuagccggacaugguagcgggcaccuauaaucccagcuacuugggaggcugaggcaggagaaucgcuugaaccugggagguggagguugcaaugagccgagaucaugccacugcauuccagccugaacgacagagcgagacuccaucucaaaaacaaacaagacuuugccauacccuugcguaacacauagcuacuugaagcaccuaggacuggccuggaagucagaucuacaccagugguuucuccuucuagagggcccuguugcuagggacuggauuuacccucacaagcaggaacugggcuuuaauuaaauaguggaguagagagcaucuuucugagccccgugguccuugguuacuaaggaggagucuuccuuaggaaccaacuuccaggaugggaggacuuuagguauaauccucuggggaggucucaggauaguccccuuuccuaagagacagcucuucucucagucagguccuacuggggaggaggcuauucucuggccucaguucaaggccagcaggucagaggcuggccacagucauugaaaccacuuagaccucacuuuuguuugccaaggauggaugagguugccuuggcaaccaggucagaaggccccagcucugcgaggauuuuaugggacaccaaaccccaucaccagggcaccaagcuuuccuuagcaaccaggaucuggaaaggcaaugugcagggcagggcagugcucuucauugggagaagcccucagaccaugaaggccuuguugcuagggaacaagcauccuuagcaagcaagagcuaacugcaugcaggccuuuaucauguggggagggcugggguccgcuuugcagaguggagacuugaagcgaguugcuugaggguggggggucuaucucaugccuuuacuguugcuaggggcccaaucuccuuagcaaccagggcccuagaaaggcagacccuuggguaccuaucccagcagagaccuggugugguuuaggccccgcugcuggggcucccuuccucucucgcugggaccugggucccucuggaccucagugcucucccccucuucuccugcaggaugagaaauacuggagccggcgguacaagaacaacgaggcagccaagcggucccgugacgcccggcggcucaaggagaaccagauaucggugcgggcggccuuccuggagaaggagaacgcccugcugcggcaggaaguuguggccgugcgccaggagcugucccacuaccgcgccgugcugucccgauaccaggcccagcacggggcccugugaggcugccccacauccccaccuggcggagcucuccuccgccuugcugagacuuacgcccuguucccuuccugcccuguggcccacgggccggccagcugggugccccagggacgugauaaugcagauaaauacauuuauauuuuuaagaaaaagcgagccuccccccucccuugcgggggcggggaggguucucuguguguguccccggcacgucagggacccuauccucccaccgccuccguuaacacgauccugaauaaaucuugagaaccccagagccagcuguuguggaagaagagggcagcucccuggcauacuggcugcagcccgugggca

SEQ ID NO: 15181 - RNA, 12029 nt, Homo sapiens
uugaggguggggggucuaucucaugccuuuacuguugcuaggggcccaaucuccuuagcaaccagggcccuagaaaggcagacccuuggguaccuaucccagcagagaccuggugugguuuaggccccgcugcuggggcucccuuccucucucgcugggaccugggucccucuggaccucagugcucucccccucuucuccugcaggaugagaaauacuggagccggcgguacaagaacaacgaggcagccaagcggucccgugacgcccggcggcucaaggagaaccagauaucggugcgggcggccuuccuggagaaggagaacgcccugcugcggcaggaaguuguggccgugcgccaggagcugucccacuaccgcgccgugcugucccgauaccaggcccagcacggggcccugugaggcugccccacauccccaccuggcggagcucuccuccgccuugcugagacuuacgcccuguucccuuccugcccuguggcccacgggccggccagcugggugccccagggacgugauaaugcagauaaauacauuuauauuuuuaagaaaaagcgagccuccccccucccuugcgggggcggggaggguucucuguguguguccccggcacgucagggacccuauccucccaccgccuccguuaacacgauccugaauaaaucuugagaaccccagagccagcuguuguggaagaagagggcagcucccuggcauacuggcugcagcccgugggcagcuccgggcugucguccauagagggcaggcgcugcuggaagugcuggagucugaguccucccgcgggcugucggauggaggaagggcagaaggucugagaggaaugaagcgacugccuuuauugcauagaccuuuucaauugcuuuuuagauuggggacggaggacgcgcaugagacgaacaggggauaugaauuuccccgcccccacccgcggggagaggaacauuagugcaaauccuagcgccggccccggggaaccugccccuccugggcugauuggccagcuaaauggaggcaccggaguggauggggcgaggcugcgggcccugaccggccgacucacugaggccuaccccagccaguacauuccagguccugucauugggcgacgcguaaaauagacuccgcccucagccauccuggccggguaggagcagguggcaagcgucaggacugagcccugccccguaagggcggccccagaucagacgccaggccccgcccucauugaucaggcacuacccucgggacgagcccauuucucuuuaaccgugacgacgcccaccuuccagcaucacgucuggucccaugaaagcgagcgcaauccugagacggggccagggccccugccaccacaacucuagcagccaggccacacccccuagcucaggcuccgccccauuggaauguaggccccgcccccggcggguaccaagcuuguuuaguuucagggcucccgccccgggcagccaggaggcccagugagcaguguaccgaugccagggugcaucugugccuguagcggcccauacuccaccugcuccccguccacugugagcacgccgcguggugugagcggcucuaggcggaaggcacgggccgcggcguagcccagcugcggacagcccaggcugaaguggcuaccacgcuccauggccaagaaaaggcgcagcagcgcagcccgcgagaugccgcuacgcacccagcacaggugcaccaggccgucgucgaagcgcgcaugcggagcugccaccaggucagcgccuagguggcugggcgagauggccaacaugagcacaaagucccccuccagcgucacccagucugggggcagcggggugcccagcggaggcagcagguggucgggcgggccgcagguggaggccccuacccgggcaucaggggugggaagugggagcccagaggaugggggaauuacgggggccccuucggagacgggugaguguagagcugccuugggagagccaggaggugaagacagcaguggguccggggacagcggagcauccccagccccaccccaguccccagccagcucugggcccccaccguugagggacaggaugggcagggguucuggcgagccaggagaggccagggcaggcuggggcaggggaagaggcaggucagacacagaacgaugcaggggugagugggccaugggcggggcugggucugggguuagggucagcuccgacuuggcacgaggcaggcuaugggcaggggugggcgaggcagguuccacaguggcggggagguaggagaggcguccgcgguaggugugcaguguggcgaggcccagcaccgugcccagugugaagcgggcacugcccaaggcccugaagcgcucgcucuggauauccacaucugacacgaagccccaggccacagacaggaaggagaaacagcgggagcccgaggccagcgucacggagagcagguccaguggguggccaccaccccggcacagcaacagugagcaguugagcaacaggucgaggcccagggcuggcucaaaucuucacagccggagauggacggacacacagaaggaaggagcaaacagggguuggggaaagagacagguaggaaagcagcuggcaaugagaccacgaaggccauggcccaggcccaccacagccguggggccaccuccaggcgacuccuuacggggccagguuccuggucaucuuucauuugcucccuacaauucacugagugccucccaugccaggcagaguucugggcgcucgggauacagcugggaagcaggcaggcaaaaauguccaggagcugggggugagcaucccacaggcaggcugauuuacuugacugacuguggguuuggcugagugggagauauaggggucccuaucaccccaggaggggcucaucccucccuucgugguauccucaaccuaccccccgugcugguucacugcuccggccagcgcguugcccgagccgcaggggaggaugcccacaggcaucuucacagcuuccucccagucagggcgaucuaggagcccguucagcaccuggagggugggagaccagaagccuggguccugguggcagucucuauagucccccagggcccagggcuaggggcagggugcuccugcucuaccucauggagcagcccgucucccgagaccgugacgaugccaucccacucacucaggcucagccccuggaccagcucccgggcgugguucugucguucugaagugggauaccgggcuguuaggcaggcugucccaccccagccccauagacccaggagucccacccaccacuuugcucccuuaggacucagcugucccagcccccagcucccauucucacuggcccuuaccugucuggaugagguugaaggacagcccagcuucagagaucaugggaagcacgugguucuuacaccacugccaggccaggccccgacccccaaagggauugaccaauagaagcaaccggggcggccgagguagcaggucaggggugaucucuguggagagagguuagggucugcagaggccagugacccaggccccccaccuuggaaacagucccuucaucagcccccaacggaauugguggagggcuggccccugggaccugcuggcucucauguggccaggccuagguaugcagcccugccccaacuccuagcugcugagacaaaggcagggcuuaggugugaaaccaaaugcccuuuguccccaugugugggaggagcuguaguucagagcugugguucccacuuuccucaccccaaacaccuauuacccaggauuagguuacuuccagcccuuaggggccccaggcaggauuagaugccaccucugaacuccagggaagcccuagaccucuguuggcacccaucacucugggugguaccugguccugucucaggcugcugcucucaccacccugggugacucaccuguggucaagacccaugcaaaggggaagaggauaggagacagaaacauaaaucuagcaagagaacagcagauguaaaucacuuuucucugccugcguuuuuguuuuguuuugcuuuuugugauggaguaucggucuugucgcccaggauggagugcaauggugcaaucucggcucacugcagccucugccucccggguucaagugauucuccugccucagccucccgaguagcuggaauuacaggcauccgucaccaugcccggcuaauuuuuguauuuuuaauagagacaggguuucgccauguuggccaggcuggucucgaacucccgaccucaggugaucugccugccuuggcuucccaaagugcugggauuauaggcaugagccacugcacgcgaccucugccugugcuuuuuuuuuuuuuuuuuuuuuuuuuggagacagaguuuugcucuuguugcccaagcuggagugcaauggcacgaucucagcucacugcaaccucugccuccuggguucaagcgauucuccugccucacccuccuguagcugggauuacaggugcgcagcaccacacccggcuaauuuuuuguauuuuuaguagacaugggguuucaccauguuagccaggcuggucucgaacuccugaccucaggugauccacccgccucagccucccaaauugcuaggauuacagacaugagccaccacauccgguccucuugucuuuuuguuccuucuguagcccaucccuguguaucacuccuaacggauccagagagauacaucacccagacacacagaaaaauaaagacacagcugccuauggaggaaauucugcagagacaccaagguggcuccaggauagagcagcugcccagcaccucacccccauccccgggcaguggcaguccucggagcagacaggugagggcaguggcccagcgcugggccucggcacgguucucuucguagguggcggccccaucugcccggaaggugcgaguggcucugcgccgggccccgcgccggccccgaggguagguguagaugcagaaguaggccgcugagucugaggggcugcggcuucgcagggugcagcagccugagaccucggccaacgggaccaggccaccccggggccuggcuucagguuuggggcgcagccgcuguaugugcagggccugcgauguaagggugagggcaaagcgugggccucgggcuggguaggagccaaacucgccauggaggagcggggugcuggcagccaguggcggugggggcggggccauggccuuagcccugaccagggugcuccuaggcccguggccccagcucccggucagcuccuggucuggccucugugggaagggaggagagaaggggugagaauucaggaccccauggcaggggcagggaggggcaggggcuguggacaggaggagacaaugaggggcaguggcaggugagacaggagcaucagagacagacaggcucagacaggugugggcagaccuugaggaugcgggacagaggccagcaucccagagggggccggagacccgggcaugcaaacauccaaucauuuauuccccaguaaguauucaguacccuuuaugugccaaucacggugcuaggccuagcaaacacagcaggagacaaaauagccccaaauccuugccuucauaggaauagauaaacaagagaaaggauugaaauauacaggugguugggugaugauaacgggcuuugggggaaaagaaggcacaggaaggggaauggauagugggauuggauaugcagaaacagacaugcaaagacugaaagacacaccuccccgacacccccaccccccauacggugcaguggguaaaacagcaaaacaaucacaaacgcaauagagauagggucugagagccagagaaacacugagaggagacaaacagggucaaugaggugaaacucaggcgaugaaagauacuuaagagaguaagacuuuuucaccccaacgagaaaggcaagacagaguggaagggagagcaaauaggagggguacgaggcaggcauggagacagcuggagagaagggauaugacagggacuacgggguccgagaggagccacaugcgagcgccugcaaggggcaggggccaagagcuggucccugagcacugaccugggugucuggccgccugcucuccagggagcgggugggagcaggacugaggucccuuccccacaggcccucucccugcccucugcccggauucugccuccuccuuucgcucaccuuuguuccccacugccccgcccagccaccugccaguccugccccucacauuccccaggcccagagcgccaggacagccccccaccccccaccgccuguggacucacccuuaggaacuacaucugccccccuauccccagcggcucucucggguccaggacgucugcuucacccccaaaccugcccuggccccauuaugggaaccucaaaucagguucaagcacagagcccuagauguccuccagucuugggccugggucucugucccuggguccccgagaccuggaccugggucuccauccauugguccccaauccauaggccugcgugucuggcccugggcccccaaaccgccauccgcacucuuauuuccagaacccagucccaggccuggcuggguucaguccuggcccagguuuuccauuuccaucucccaccccggugccccagucccgggccugagucucuguuccucuuggucccucaguccccuagacuccggucccugccccgacccccgcacccuccucacacgccggguccuccuccaggcggucccgcaagucagcaccaacagcccccaucagaccuagggguggggggagggugugcauccgcucagccaauggccgugcagccggccugggccgcaccaauacgagggcgcgggggguggagccagucagcucgcgagcuuggugcagggaccggccgcgggagaggccgagagcugggcggggccucgcgcuucgggagacuggccgccaucgugggugagggccgacgcgcagcggagacgacgucgcggccccauagacagcgccguugucgccaucuuuguuaagggagagugggccugucucauccauugaauucacaaaagaaaaggggcgugagggaggaggucuuuagcugcaaagacagagacucuaacacgcguaacaaaggcccagagauccgauccagacacagagcaaggcagagacccacagagguuggaugaggcaauaagagagcugggaggagagggagaguggggaaagugaaggauacuuuuuuuucggacaguuacagagucagagagacccagagaaaagcagagauauaaacaagagaccaaaacagugggauugagaaugugcaagguaaggauacaagaaaacccugaaaaugacagacacggagacagauggagacagacacuucuggaauggaagccgcgaaggagaggcucauuaauucagacuuauuuaucucaggcucaaaccagaauggaagcggcaugagauaaacaucugcccagugaaugaaccagucacauggcaagacagagacagagagauggggacaguaucucuaggucaaaggugagggagggagagaauauuggaagcccaggggcugggaggaacugggacagaaagugaagauguugacagaugcaccgaggcaaagacauggugaaauugaaagaaaggcaaguauauauuaggagacuuagaaacagaauugcauagagagaaagagauaugcauuaggagacaaggacagagcucacuagaaagugacaaauguaggcuguaggccaggcgugguggcuuacgccuguaaucccagcacucugggaggccgaggcggguggaucgccaggucaggaguccgagaccagccugaccaacauggagaaacccccgucucucucucuuuuuuuuuuuuuuuuuuugagauggagucuggcucugucacccaggcuggagugcagcggcacgaucuaggcucacugaaccgccugccugguucaagcgauucuccugccucagccuccugaguagcugggacuagaggcacgugccaccacguccggcuaauuuuuuacauuuuuaguagagacaggguuucaccguguuagccaggauagucuggaucuccugaccucgugauccauccgccucagccucccaaagugcugggauuacaggcgugagccaccucacugguccaaaacccccaucucuacuaaaaauacaaaaauuagccaggugugguagcacgcaccuguaaucccagcuacucaggaggcugaggcaggagaucgcuugaacccaagaggcggagguuacagugagccgagaugaugccacugcacuccagccugggcaacagaccaagacucugucucaaaaaaaaaaaaaaaaaaaaaaaaaagagagacaaauguaggaagaaguuugcuuauugccaaaucauguaccuagcauccaacccacaguagcaacagcaccagauaguaugugccaaggaaugacacggagagaagggggaacagaaacccaguaagacugagacuggggcacagcaacugagcuuggggcccugggagaaggaaaggcagagacacugggcaaagaagcugagauucaaacauagagccuaagucacacagacgagaggacagggaggaggaaaaggagaaaggacccugcagcucacacacacuugcugugugacugcugggaagccccugaauucuuggccucagcuguccugucugggaaguagggagaaagcuauucacacugaaacaggaauuaaaagaaauuaaagaauguguaagcaaaaacucaguuguauguaaaaaacccaauucccccugaggaagagaaagagauugaguccuuuauuuuuuuuuauuuuuuuuuuuuuugagacggaguuucgcucugucgcccaggcuggagugcaguggcgcgaucucgacucacugcaagcuccgccucccggguucacgccauucuccugccucagccucccguguguagcugggacuacaggcgcgcgccaccaugcccggcuaauuuuuuuuguauuuuuaguagagacgggguuucaccguguuagccaggauggucucgaucuccugaccucgugauccgcccaucucggccucccaaagugcugggauuacaggcgugagccacugcgcccggcccgagauugaguccuuuaaaaauuaacugccuguuuuucuguuuguggcuagugagccuuaucuaacucccuuucccaggcaucgugaagacccuguuucucuaacugugcagcugcaaggucacuagacaggauaaacucaaguccuaaaacauguuuuuccuugaaaaguaagaaauaauguaaugcaugucucaauugaauaacugucuuuguuucucgcugcuauaauaugcuucccccugcacagaucucccccuaccccacgaaauacuuaaaauguaacuugacucuuuguucggugcucagucuuuuucgauguuaaucugacugggccagugcaccuaaauaauaaauaauaaguauccuccucaaccccucaguuucucugauuccuaaauuaucccacuggaacaccugccuggagagaaggucugaaaucacuuauggaagggcucccaggcugggcgcgguggcucaugccuguaagcucaacacuuugagagacugaggugggagaaucccuugagcucaggaguucaagaccagccugggcaacagagggagaccuagucucuagaaaaaauaaaaaaauuggccgggugcaguggcucaugccuguaaucccagcacuuugggaggccgaggccggcguaucaccugaggucgggaguuugagaccagccugaccaacauggagaaaccucaucucuaugaaaaauacaaaaguagcugggugugguggcgcaugccuguaaucccagcuacuugggagguugaggcaggagaacugcuugaacccgggaggcggagguugcagugagccaagaucgugccauugcacuccagccugggcaacaagagcgaaacuccaccucaaaauaaauaaauaaauaaaaauaaaaaaauuagccagccaugguggaggcuacuugggaagcugaggugggaagaucacuuuagcccaggagguugcagcugcaguaggcugugauugugccacugcuuuccagccugggcaagagugagacccuguuuuuucuuuuuuuuuuuugagacggagucucacucugucacccaggcuggagugcagcgcgaucucggcucacugcaaccucugccucccggguucaaaugauucuccugccucagucucccgaguagcugggauuacaggugcgcaucaccaugccuggcuaauuuuuguauuuuuaguagagaugggguuucaccauguuggccaggcugaucucgaacuccuggccucaggugauccgcaggccuuggccucccagagugcugggauuacaagcuugagcuaccacgccuggccuccaauuuuuuuuuuuuuuuuuuaaagaaaagcuucagauuuugucuuuccacaguaugaggaucuuggcuuuuagauggucccuuaccugguccugcugcuccucugcuucaagguguccauucaucugcugguccucugcucuguuacaucaacgggacccuggcccugggucuuaagccauaguaggcugguaggagcaaggagucaggucucacuguccuggccugaccuucagcucuguggaggagagguaagugaggagcagcauugacagccaacugcaggaggcccuuccaggcucaaugugccugagaaccaagaggcaggggccucccuggcggguggggggaagaguagauaagucauuuuaaucacugccccagccaguccaucugguugcacacaauauguaugcuauaauaggagugaaggcuaauuuuuauugagcacuuauuaugugcaaaauauugaccucagcaguuuuauuaacuuucauaauccugaaaaacaccccugugugccaggccuguugucauccccuuuuuguccauaaggagaguaaggcccaaagaaguuaagugauuuucccaagaucacagagagguuaaaugacuugcccaaucaccccauuaguaacuagcagagccaggauuugaauuugguuauagccuugcaaggccccaucucaccaucuuucuuugccacuacuucucccugggucuccaucucaccccucuuucuaggucuccuuccuacccuuugggccuccauuccccccacccccaagccacggagucuccauuuugccuccccuaugaaacucugucucccucuuucuaggucagggaagggccaucuaggggccgggggagaaggagaagcggaacucaaaggaugggaauacaggaugcuauagauugaggugcagcaagaucaucucggguuagaccuuaaguaggacuucccaagcagcggcugcgccuacgaagugcagcgcgagaucagggagcggugaaccugauaaggaaacgcccgaagcguggggucggaaauuuccagaugccccgacuagcccugccagccccgccuccucaccuccaacacugggcccgccggguccuccgggagccacugagaggccgucggcgucgggccagagcgucaccgcgcgacgcaucgugcuagcuacacgcaucucgcucccagaucccuuucuuccggaaagcuaucgagaacacggccuggguagggccagagaggcccccgacgugcuggcccuucccucuuggacguugcgcuuguuccugcgcucuaugcucucugccguuaucgcccggcuagucagucguccaacucaccacagagaaguccggaucgugguagagcgccgcgucgcacccaugugacgu

SEQ ID NO: 15182 - RNA, 722 nt, Homo sapiens
agaucacucauuccauucacagacucuuguugggcagcagccacccgcucaccuccauccccaggacuuagagggacgcagggcguugggaacagaggacacuccaggcgcugacccugggaggccaggaccagggccaaagucccgugggcaagaggaguccucagagguccuucauucagcgguuccgggaggucugggaagcccacggccuggcuggggcagggucaacgccgccaggccgccaugguccugugcuggcugcugcuucuggugauggcucugcccccaggcacgacgggcgucaaggacugcgucuucugugagcucaccgacuccaugcaguguccugguaccuacaugcacuguggcgaugacgaggacugcuucacaggccacggggucgccccgggcacugguccggucaucaacaaaggcugccugcgagccaccagcugcggccuugaggaacccgucagcuacaggggcgucaccuacagccucaccaccaacugcugcaccggccgccuguguaacagagccccgagcagccagacagugggggccaccaccagccuggcacuggggcuggguaugcugcuuccuccacguuugcugugaccaacagggaggacagggccugggacuguucucccagauccgccacuccccauguccccauguccuucccccacuaaauggccagagaggcccuggacaac

SEQ ID NO: 15183 - RNA, 8136 nt, Homo sapiens
caaaggaccagagucucaaauacaccucaggccucuuccugguccuuuauugcugcucaggagcccugaccuuccucccgacacagcaccagccucuaaagucagggaggaggggagagggucgcauguagcccccacacggagaaauccuggccaaacccagcuggcaggaagacaacgggcagaagcaaauuguguuggaggaacccacaccuccaauuuggugcagccacuguauaucccccgaguccccugcugggaaccagcagccaaaacuggguccugagccggacgcgguggcucacgccuguaaucccaacccagcacucugggaggccggggcggacagaucacuugagaucaagaauuugagaccagccuggccaacauggugaaaccccgucucuacuaaaaauacaaaaauuaacggggugugguggcacaugccuguaaucccagcuaccugggagacugagcugagagaaucacuuuaacccaggaggcggagguugcagugagccaagaucgugcuacugcacuccagccugggcgacagaccaagacuccgucucaaacaaacaaacaaaaaacuggguucuggggacacaggucaaaugggucacagcugacaggaaggaauccgacacacaggccacaccaggccacacaagucucugggugggaguggucuuacagagcccugguuaaaccgaguucuuuggugagaggggucacuggaucagagccaggccuucuagagaacaauacgucaaacagaauccaucacggcagcccacaggccggccagucucagucaacagaccugaaugaaccccuuccaggggagcccaauucgacuucaguuuccaagcaggaagcaagaucagagccagugggacgccucagacgcugauggugcggaagauggugaagccugacagcgccgugcugaccaggagcccugggcacugcgggugccagugcagcuccuucagcucggucucgcccuggugcacgaacagcagcugcugcgggaggucggccaguccggggucggccuccacgucgcccgccucagggucccgcuccacugccaggucccacugugugaucugguggucugcacccgaggcugcaaagaccccgcuguccugggggugccacucgacggaggucacgggggccacgugcugcuugaagguggccacuggggaaccagacuagagggagaggaugggaggaacgggcucugaaugccucagccugacucuggggaggacccaggcagaagccccaacccuucuccagccucaggguucagccagggccccaccccuuaagcccucacaagcccagaguccaggaaagggacacaggguaauucuggcugcuaagaaggcugaccagcccagggguugcugggaacugugauucaccugcaaagaagccccucccagcucagguagcaaaacccccgccccugcucuucccucugccugccuguuuucuuccuuguaaaaggagggcaugggcugggugcgguggcucacgacuguaaucucagcaccuugggaggccaaggcggguggaucacccgaggucaggaguuggagaccagccugaacaacauggugaaaccccaucucuacuaaaaauacaaaauuagccgggcuggugucacaugccuguaaucccaguuacucaggaggcugaggcaggagaaucgcuugaacccaggagcgggagguugcagugagccgagauugcgccacugcacuccagccugggaaacaagagcaaaacuccaucgcaaaaaaaaagaaaaaaaaaaaaaaaaagaaaaaaaggagggcauggcucucccagagcucucccagcagauucuacaaaggccucaaaggaggcagaaacacaauccccggaagccgacccaaagaaagacuaagaaugacagcacuuucacuacagcaaaggccccgcucaauuggcgucucucucauuaggagaggcugcucugaaguuccaauggucaacaagcugggcccugugugaccuggugggccugggaggcuggaauccgucuccagccuccuccccagggcugacgcuauagaaacgaucaaacuggaggagaaaaaggaugacaucauggcagcccgggaaggcagagccacacaaagcugcggcuuuguccagagggaugccggacgcugcaacuucuccugcacagggacccucccagcuccacaaugucaaccucuagcuuggcugucaugucacagcggcuccuguccuuucugugccucagucuucuccuacaacgagcaggcugggccccgauucucaguugcaucuagaaaucuacaacucucugaagcucucagcacuggccguacagacaccuguacuucugcccacaggcagaugagaguccuagucucugcugccccagccccuuccaucucuugucagcuguuccccugguagagugagugaccccaagaguggagacccgccacccuuccucuugcugagccucaguuuccuccucuguacccugaagaggcaggagucuaguucuaagggcucuccagcucugguuguguaaaacuauucaaggaggaaaaauccuacaaaucccaggggcugcugggagcaagcuucucuagcccccagguguccggcugggaaaauaccuugaacugccgaaggucccagaucuugagggccccaucauccccgccacugagcaggaagggcucccggcggcuccagcugaugacauugacguccccaucaugggcgguggcuguggugagcaugcaggccuugcugggggcugcccggaugucccagaugcggauggaggcgucagcugagcaggaggcaaacaccugggggaggcggagucugaguggucccaaugccccccagcccgcagugaagcccaagcgccagcggugggcuacucucucuuucacuguuccccuuacuaugacuuggccuggaaacuaaaccuccgucaggcucccagcccucuuuucccucagaccuaggauucuaggucccuggccuagaauccaucagaacuaaacgaccagaaccccacccucccucaccguguucucagucggugaccacugcagguccuccacagagcguguguggcccacgaauggccgcugguccacgugccaggagccgccguccguagguguccagagguggauguucuuuugacagucaccggucagcaggcgaccuggggaagggagucaggaaaugaccucgccccaccuggccgcagcucgcuccccuccuuggagucuaagcgcccggccccuuguugcagacccugcucccccgaccucccgggacuccugaacaccccagggacucaccggucacccggggggaccagucaagggcaaagcccucgcccauguguccagcgaaggagaagaugggcuucauuugggccugcucaucccggaggaaggcugccagggccuggggcuccuccaccaccugcagaagccgccgcagcgcaaacaccuccaccuggcccuucucugaccacaccccagccacaggcucuucacccagccaugacaccugcagaagagcggugggggaagggugaugugaagcgaggggagaggaggaucaaggcacugaccccacgcuccccauaucccagagaaccagaagugcgcuuccucagaucucccaggccugggacuacagcuccuugaaaccucugugggaagaaaaucacaaccugcaaaaaccagcaugguaacugggacagcucuccacagggggugggagugggugggggagcugaggugggaggauagagccccaggaugccugggaguugaggcugcaauucccaccagcccuugggaggguguucaggcuccuggucucgguaacccucuaaaugcuagaaggccacaagacucaguccucggaucuccuugccucuguguuuguucacuaggagacccaguccagccacgagguuuccaauaccccuagcccugaccucuccccugggcuccagacucuuacugcauugaccguucaaacuuuuuuguuuuugagacagggucccgcucuguugcccaggacggagugcagugaugccauaauggcucacugcagccucaaccuccugggcucaagugauccucucaccucagccucccaaguaguugggacuauggguaagcaccaucacaucuggcuuuuaaaauuuuuuuguagagacagggucucacuuuauugcccaggcuggucuggaacuccuggucucaagcgauccuucugcaucagcuuuccaaagugcugggauuacaggcaucagccacugugccagccugaccauucaaacuugauacaaccaaagccaagcuccuaauugccaccugcaacugcucucucuccaccucaggccccaaaauucagaacucauucuugguccucaugcccagcaccuaugcugacuacaguaaaaaugcucacuuccagggccaggcgcgguggcucgcaccuguaaucccagcacuuugggaggccgaggagggcagacugccugaggucaggagcgagaccacccuggccaacaugaugaaaccccgccucuacuaaaaaugcaaaaauuagucgggcgugcugguggguggcuguaaucccagcuacuuaggaggcugaggcaggagaaucgcuugaacccaggagucagagguugcagugagccgagaucgcaccauugcgcuccggccugggcgacaaaagcgagacucugucucaucuaaaaaaaaaagcucacuuccaacccccuucucaugaugucuauugcugucacacuacuacugaugucauccuuccccugaauaccguaagucuccccacaggauucuuuccuccgacccuuaccucucugcaauugauauuuaaggacagcagccagagggaccacuuuaaaacagaagucagacccugucuuuccucugccugaaacccuccaacgucucccaauuaaaagcuggaguccuuacaguggccgacaaggcucugaacaaugucuucucugugcccgcuccccaaauugugucauucucccuuuuguucauucugcuccagacagacuggacacucccgcuucacuugaaacucuucaaacaugccaagcucaccccagggccuuugaacuuguguuuuuccuugccugcaaauucuuuuacaggguucacugccccacuaccugugaguaucuaugcaaauggcauuuuaugacagaauacuuuccuaaccacacuguuuaaaaauagcaccccacuccuggagcacccuaacccucuuccccuacuucauuggauuuuuuccaggauaguuaacaccuuuggacaugguacacauuuacuuaguuucaucucguucccuucccccacuaguguguaaguugauggagccagagaccuuuugcuugcugcuaaauccucugcaucuagaacaguacugaaacauaguaaaaauaauuucauggaaacagacagccccagcuaucagccaaguacugcucuaagugcucuucauauaccguaucauuguacuuacaagucuaccugaucagaagauguuuuagcuuugaagcaaaaaacaaauaaacaggcuggacacagugccucaugccuauaaucccagcauuuugggggcgaaggugggcagaucacuugagcucaggaguucaagaccagccuggccaacauaaugagacuccauuucuacuaaaaauacaaaaauuacugggcaugguggugugcacuugugaucccagcuacucgggaggcugaggcaggagaaucacuugaaccugggaggcagagguugcagugagccaagaucacgccacugcacuccagccugggcaaugggagugaaaccaugacucaaaaacaaaacaaacagccacaaccaaaaacaguuccugaauaguaacagaaaauacauaccucauauuacaaccaggugcuauucuaggcacuauauguuauuucauuugaccucaugccagccccaucagauaaguucuauaacucacuauguuaccaaagagaaaagugaagaacauaaaccauauccucauaaucuaaaacaguaccuaacauguaaugacacugaucauaauagcuaaauuguauaaaacuaugugacaaguacuuuucuaaaaacugaaggaggccgggugugguggcucacgcuuguaaucccaugacuuugggugcccgaggcgugcggaucaaucacucgaggucaggaguuugagaccagccuagccaacaaggcgaaaccuugucucuacuaaaaauacaaaaaauuggccagaugcgguggcucacgccuguaaucucagcacuuugggaagccgaggcaggcggaucacgaggucaggaguucaccaccagccugaucaacauugugaaaccccgucccuacuaagaauacaaaaauuagccgggcgugguggcgcgcaccuguaaucucagcuacuuggcugaggcaggagaaucgcuugaaccugggaggcagagguugcagugagcugagaucaugccauugcccuccagucuaagcgacagagcaagacuucaucucaaaaaaaaaccaaaaaacaaaaaauuagaagggccugguggcaggcgccuauagccccagcuacuugggaggcugaggcaggagaaucccuugaaccugggaaggggagguugcagugagccaagaucgcaccacugcacuccagccuggacaacagagcgagacuccaucucaaaaaaaaaaaaaaaaaaaaugggccaggcacgguggcucacgcuuguaaucccagcacuuugggaggcagagguugcagugagccgaggcugcgccacugcacuccagccugggugacagagcgagacuacgucucaaaaaaaaaaaaaaaaaaaagaacaugaggagguguugggaguuauggacacaggggaugggucagauguguuucagaguaugcagagcaggcuccugggaccauacuuacccgaacucgguugaugccaccauaguggggcaccauggccagcuccagcugagguuuccgcucuucuucauccucuucaucuuccuccucuucuucuucaucacugcccucugagggugggggcuuugucccaugcagauugugcauccgaagcaucaucagucugggagaaauuguggggugaguuaggcacuagauuccaggauucuuaggaaggagagaggcuggaaacccagacuccuggaucugcgagaggcagaaacuggaagcccuaacuccugggugcugaggaaggggcuggaaacugagccuccugguccuggaaaagccucgggucuuaccuguugcucugggcgcucucagccugggucccagcacacaaguaaaguguaagaggaagcucuguccgguugucucccaggugaucccggacuaugucaaagcugagacagggggcgccuggggauggaaggcgggguuuacgaguuaagacgggacaguaagagcucaguccccaccucccucauggaucaaccgccuccgguaugaaaucacuucucuuagaccccagccuucucuucccgagcaccucucagguuaaaggcucgggaucagccaccucaggacccuggaguccggacucagcccuaccagucugcgcucggugguagagcacauaggccuccucguccaugaccagcuccuccccuucgcguagcggcggcccccggccgggcagguagaccugggccgggcccucggaacuugugucgccggacucggcuuccauggguuccccgguuucacacgugcgccgccgacccuugcgcgccgccaucuucgaacccucucgcugcugacacccgguaagagcgucacuuccggguuucgcuuuccgccuaaugagauccgcccuacugcgcgguuaccuuggaaacuccugggaccgcuaaucggagagggugcggaaacgcuggaggagaacucagguaauggcgccagcgaaagaagccugcggauacggagaaacugcaucuucgcgugacuuuggg

SEQ ID NO: 15184 - RNA, 8136 nt, Homo sapiens
cccaaagucacgcgaagaugcaguuucuccguauccgcaggcuucuuucgcuggcgccauuaccugaguucuccuccagcguuuccgcacccucuccgauuagcggucccaggaguuuccaagguaaccgcgcaguagggcggaucucauuaggcggaaagcgaaacccggaagugacgcucuuaccgggugucagcagcgagaggguucgaagauggcggcgcgcaagggucggcggcgcacgugugaaaccggggaacccauggaagccgaguccggcgacacaaguuccgagggcccggcccaggucuaccugcccggccgggggccgccgcuacgcgaaggggaggagcuggucauggacgaggaggccuaugugcucuaccaccgagcgcagacugguagggcugaguccggacuccaggguccugagguggcugaucccgagccuuuaaccugagaggugcucgggaagagaaggcuggggucuaagagaagugauuucauaccggaggcgguugauccaugagggagguggggacugagcucuuacugucccgucuuaacucguaaaccccgccuuccauccccaggcgcccccugucucagcuuugacauaguccgggaucaccugggagacaaccggacagagcuuccucuuacacuuuacuugugugcugggacccaggcugagagcgcccagagcaacagguaagacccgaggcuuuuccaggaccaggaggcucaguuuccagccccuuccucagcacccaggaguuagggcuuccaguuucugccucucgcagauccaggagucuggguuuccagccucucuccuuccuaagaauccuggaaucuagugccuaacucaccccacaauuucucccagacugaugaugcuucggaugcacaaucugcaugggacaaagcccccacccucagagggcagugaugaagaagaagaggaggaagaugaagaggaugaagaagagcggaaaccucagcuggagcuggccauggugccccacuaugguggcaucaaccgaguucggguaaguauggucccaggagccugcucugcauacucugaaacacaucugacccauccccuguguccauaacucccaacaccuccucauguucuuuuuuuuuuuuuuuuuuuugagacguagucucgcucugucacccaggcuggagugcaguggcgcagccucggcucacugcaaccucugccucccaaagugcugggauuacaagcgugagccaccgugccuggcccauuuuuuuuuuuuuuuuuuuugagauggagucucgcucuguuguccaggcuggagugcaguggugcgaucuuggcucacugcaaccuccccuucccagguucaagggauucuccugccucagccucccaaguagcuggggcuauaggcgccugccaccaggcccuucuaauuuuuuguuuuuugguuuuuuuuugagaugaagucuugcucugucgcuuagacuggagggcaauggcaugaucucagcucacugcaaccucugccucccagguucaagcgauucuccugccucagccaaguagcugagauuacaggugcgcgccaccacgcccggcuaauuuuuguauucuuaguagggacgggguuucacaauguugaucaggcugguggugaacuccugaccucgugauccgccugccucggcuucccaaagugcugagauuacaggcgugagccaccgcaucuggccaauuuuuuguauuuuuaguagagacaagguuucgccuuguuggcuaggcuggucucaaacuccugaccucgagugauugauccgcacgccucgggcacccaaagucaugggauuacaagcgugagccaccacacccggccuccuucaguuuuuagaaaaguacuugucacauaguuuuauacaauuuagcuauuaugaucagugucauuacauguuagguacuguuuuagauuaugaggauaugguuuauguucuucacuuuucucuuugguaacauagugaguuauagaacuuaucugauggggcuggcaugaggucaaaugaaauaacauauagugccuagaauagcaccugguuguaauaugagguauguauuuucuguuacuauucaggaacuguuuuugguuguggcuguuuguuuuguuuuugagucaugguuucacucccauugcccaggcuggagugcaguggcgugaucuuggcucacugcaaccucugccucccagguucaagugauucuccugccucagccucccgaguagcugggaucacaagugcacaccaccaugcccaguaauuuuuguauuuuuaguagaaauggagucucauuauguuggccaggcuggucuugaacuccugagcucaagugaucugcccaccuucgcccccaaaaugcugggauuauaggcaugaggcacuguguccagccuguuuauuuguuuuuugcuucaaagcuaaaacaucuucugaucagguagacuuguaaguacaaugauacgguauaugaagagcacuuagagcaguacuuggcugauagcuggggcugucuguuuccaugaaauuauuuuuacuauguuucaguacuguucuagaugcagaggauuuagcagcaagcaaaaggucucuggcuccaucaacuuacacacuagugggggaagggaacgagaugaaacuaaguaaauguguaccauguccaaagguguuaacuauccuggaaaaaauccaaugaaguaggggaagaggguuagggugcuccaggaguggggugcuauuuuuaaacagugugguuaggaaaguauucugucauaaaaugccauuugcauagauacucacagguaguggggcagugaacccuguaaaagaauuugcaggcaaggaaaaacacaaguucaaaggcccuggggugagcuuggcauguuugaagaguuucaagugaagcgggaguguccagucugucuggagcagaaugaacaaaagggagaaugacacaauuuggggagcgggcacagagaagacauuguucagagccuugucggccacuguaaggacuccagcuuuuaauugggagacguuggaggguuucaggcagaggaaagacagggucugacuucuguuuuaaaguggucccucuggcugcuguccuuaaauaucaauugcagagagguaagggucggaggaaagaauccuguggggagacuuacgguauucaggggaaggaugacaucaguaguagugugacagcaauagacaucaugagaaggggguuggaagugagcuuuuuuuuuuagaugagacagagucucgcuuuugucgcccaggccggagcgcaauggugcgaucucggcucacugcaaccucugacuccuggguucaagcgauucuccugccucagccuccuaaguagcugggauuacagccacccaccagcacgcccgacuaauuuuugcauuuuuaguagaggcgggguuucaucauguuggccaggguggucucgcuccugaccucaggcagucugcccuccucggccucccaaagugcugggauuacaggugcgagccaccgcgccuggcccuggaagugagcauuuuuacuguagucagcauaggugcugggcaugaggaccaagaaugaguucugaauuuuggggccugagguggagagagagcaguugcagguggcaauuaggagcuuggcuuugguuguaucaaguuugaauggucaggcuggcacaguggcugaugccuguaaucccagcacuuuggaaagcugaugcagaaggaucgcuugagaccaggaguuccagaccagccugggcaauaaagugagacccugucucuacaaaaaaauuuuaaaagccagaugugauggugcuuacccauagucccaacuacuugggaggcugaggugagaggaucacuugagcccaggagguugaggcugcagugagccauuauggcaucacugcacuccguccugggcaacagagcgggacccugucucaaaaacaaaaaaguuugaacggucaaugcaguaagagucuggagcccaggggagaggucagggcuagggguauuggaaaccucguggcuggacugggucuccuagugaacaaacacagaggcaaggagauccgaggacugagucuuguggccuucuagcauuuagaggguuaccgagaccaggagccugaacacccucccaagggcuggugggaauugcagccucaacucccaggcauccuggggcucuauccucccaccucagcucccccacccacucccacccccuguggagagcugucccaguuaccaugcugguuuuugcagguugugauuuucuucccacagagguuucaaggagcuguagucccaggccugggagaucugaggaagcgcacuucugguucucugggauauggggagcguggggucagugccuugauccuccucuccccucgcuucacaucacccuucccccaccgcucuucugcaggugucauggcugggugaagagccuguggcugggguguggucagagaagggccagguggagguguuugcgcugcggcggcuucugcaggugguggaggagccccaggcccuggcagccuuccuccgggaugagcaggcccaaaugaagcccaucuucuccuucgcuggacacaugggcgagggcuuugcccuugacugguccccccgggugaccggugagucccugggguguucaggagucccgggaggucgggggagcagggucugcaacaaggggccgggcgcuuagacuccaaggaggggagcgagcugcggccagguggggcgaggucauuuccugacucccuuccccaggucgccugcugaccggugacugucaaaagaacauccaccucuggacaccuacggacggcggcuccuggcacguggaccagcggccauucgugggccacacacgcucuguggaggaccugcaguggucaccgacugagaacacggugagggagggugggguucuggucguuuaguucugauggauucuaggccagggaccuagaauccuaggucugagggaaaagagggcugggagccugacggagguuuaguuuccaggccaagucauaguaaggggaacagugaaagagagaguagcccaccgcuggcgcuugggcuucacugcgggcuggggggcauugggaccacucagacuccgccucccccagguguuugccuccugcucagcugacgccuccauccgcaucugggacauccgggcagcccccagcaaggccugcaugcucaccacagccaccgcccaugauggggacgucaaugucaucagcuggagccgccgggagcccuuccugcucaguggcggggaugauggggcccucaagaucugggaccuucggcaguucaagguauuuucccagccggacaccugggggcuagagaagcuugcucccagcagccccugggauuuguaggauuuuuccuccuugaauaguuuuacacaaccagagcuggagagcccuuagaacuagacuccugccucuucaggguacagaggaggaaacugaggcucagcaagaggaaggguggcgggucuccacucuuggggucacucacucuaccaggggaacagcugacaagagauggaaggggcuggggcagcagagacuaggacucucaucugccugugggcagaaguacaggugucuguacggccagugcugagagcuucagagaguuguagauuucuagaugcaacugagaaucggggcccagccugcucguuguaggagaagacugaggcacagaaaggacaggagccgcugugacaugacagccaagcuagagguugacauuguggagcugggagggucccugugcaggagaaguugcagcguccggcaucccucuggacaaagccgcagcuuuguguggcucugccuucccgggcugccaugaugucauccuuuuucuccuccaguuugaucguuucuauagcgucagcccuggggaggaggcuggagacggauuccagccucccaggcccaccaggucacacagggcccagcuuguugaccauuggaacuucagagcagccucuccuaaugagagagacgccaauugagcggggccuuugcuguagugaaagugcugucauucuuagucuuucuuugggucggcuuccggggauuguguuucugccuccuuugaggccuuuguagaaucugcugggagagcucugggagagccaugcccuccuuuuuuucuuuuuuuuuuuuuuuuucuuuuuuuuugcgauggaguuuugcucuuguuucccaggcuggagugcaguggcgcaaucucggcucacugcaaccucccgcuccuggguucaagcgauucuccugccucagccuccugaguaacugggauuacaggcaugugacaccagcccggcuaauuuuguauuuuuaguagagaugggguuucaccauguuguucaggcuggucuccaacuccugaccucgggugauccacccgccuuggccucccaaggugcugagauuacagucgugagccaccgcacccagcccaugcccuccuuuuacaaggaagaaaacaggcaggcagagggaagagcaggggcggggguuuugcuaccugagcugggaggggcuucuuugcaggugaaucacaguucccagcaaccccugggcuggucagccuucuuagcagccagaauuacccugugucccuuuccuggacucugggcuugugagggcuuaagggguggggcccuggcugaacccugaggcuggagaaggguuggggcuucugccuggguccuccccagagucaggcugaggcauucagagcccguuccucccauccucucccucuagucugguuccccaguggccaccuucaagcagcacguggcccccgugaccuccgucgaguggcacccccaggacagcggggucuuugcagccucgggugcagaccaccagaucacacagugggaccuggcaguggagcgggacccugaggcgggcgacguggaggccgaccccggacuggccgaccucccgcagcagcugcuguucgugcaccagggcgagaccgagcugaaggagcugcacuggcacccgcagugcccagggcuccuggucagcacggcgcugucaggcuucaccaucuuccgcaccaucagcgucugaggcgucccacuggcucugaucuugcuuccugcuuggaaacugaagucgaauugggcuccccuggaagggguucauucaggucuguugacugagacuggccggccugugggcugccgugauggauucuguuugacguauuguucucuagaaggccuggcucugauccagugaccccucucaccaaagaacucgguuuaaccagggcucuguaagaccacucccacccagagacuuguguggccugguguggccugugugucggauuccuuccugucagcugugacccauuugaccuguguccccagaacccaguuuuuuguuuguuuguuugagacggagucuuggucugucgcccaggcuggagugcaguagcacgaucuuggcucacugcaaccuccgccuccuggguuaaagugauucucucagcucagucucccagguagcugggauuacaggcaugugccaccacaccccguuaauuuuuguauuuuuaguagagacgggguuucaccauguuggccaggcuggucucaaauucuugaucucaagugaucuguccgccccggccucccagagugcuggguugggauuacaggcgugagccaccgcguccggcucaggacccaguuuuggcugcugguucccagcaggggacucgggggauauacaguggcugcaccaaauuggagguguggguuccuccaacacaauuugcuucugcccguugucuuccugccagcuggguuuggccaggauuucuccgugugggggcuacaugcgacccucuccccuccucccugacuuuagaggcuggugcugugucgggaggaaggucagggcuccugagcagcaauaaaggaccaggaagaggccugagguguauuugagacucugguccuuug

SEQ ID NO: 15185 - RNA, 5205 nt, Homo sapiens
gcagagcccgcgguuaagguuuuauuuuuuggaggacgcgcggcgaggggggccgggaaggggcgggggcagccgagcgaggcggggcgcucacucccgcuuccguagguggauguagaugaugccgcugaccagggcgagggggaaggccacccaggccagggcgaagcaguauccgaagcugcccccucgcgggugcuucuccaggaucuccucggcgugaauggcauagaucaaggcgccaguaaacaccgccacgccugcggaagaugaaaaccacacgucaugcagugcccccucaagacuacauuucccaauaucccaugggggcaaagaagcgccggagggcccgugggcagcgccgcugccugcugggaguugugguucuuucccccccgcccagcgccgugcaacuguagcgcggccuuagguaacugauuuaaucucucuagguccaauaauaucucucuauccauccaaggaauauuuuugaguguguuucuauaagccaaacaugcaguaguaaauucauaaaccaagagagaagcuuugcaagaaccuauaauguuccccaaacugacugugauuaaguuagcccuuugcaccuuaagucaaaaaauuaaaaaguacgcaaaacuucuugaaguaucugaugcacaauaggcacgcaagaaacagcgguuggcugauauaaauaccauuauuauuaugauuuagagcucucuacugagguacuaauuaguuuauccccccacgucacggccgaucccugggaccaaaacuauuuaccuauaccuccuuccccagccccggcucccugaaacucugaguucccugaugacucauacgcacaagccauaacuaucauuagccacugaaaacuacaagucccagcaaucccugggggcagagauguagcccacggaggcaccucuuguggcucgugggguguugaaaguuguuuuuuucuacgagaggcccauucucagggcccccagcaucuugacacaccccacucccuucugcucaauucuugggggauuaggguuggggaggggcagugcucacuggugcaaagcuggcagaggccgguggcauagaagagaccuccucgucgcaugguguagagcuggaacaugaacaggaugaaggagagacagcagagaaugagggagagcaccaugaggaccugcaccgccuucagccagccugcaguaaggaggacacagagggggacaucaccguggguccagaguuccagcuucaccugcuugcucaccaugugacccuucucugccccaucccugcucccguuuaggcccauacaagccuagauacuuagauguaucacuuauuuugaccuugagcccuguuaccuugcuauauucccuucucaguucuaguaguugcuuugccaauuuccuuuuucuuuuuuuucugaaaccaggucuugcucuguugcccaagcuggagugcagugguauaaucauggcucacugcagccucguccuucagggcucaagaaauucucucaccccugccuccugaguagcugggaccacaggcacaagccaccacaaccuggguaauuuuuaaauuuuuguagagacaggguuucccuauguuguccaggcuggucuugaacuccugggcuuaagugauccuuccuccucagccucccaaggugcugggauuacaggugugagccacugugucugucugcuuugcagaauuuuaauggauuuucuacauaaacaacauguuuacugggaauagagacacuuuuuccuaauuuauuucccaugcccuuuauuucuuuuucuugccuucuugcauuggcuacuccaguaaaagguugaauagaaguggugagagcagaccacuuccuuuaaucuuaguuuugcauuaaaucuuucacacagaacuuuagauagaugcagcucuauuccuuuagaacuccaaugcaccuggccccaccccuuuagaaccuuaagugguuucagccccauccccuuggaauuuggaugaaauggucccaggcauccauucagagcaccagccccaucuccuuagagcuuuggaaaaauacucuugucuucucagaaucuugggagauuuuucucuauucuuuuuuuuuuuuuuuuuuuuugagacagaaucuugcucuguugcccaggcuggagugcaguagugcaaucucagcucacugcaaccuccaccuccuggguucaagcgauucuucugccucagccucccaaguagcugggacuacaggcgcacgccaccaugcccggcuaauuuuuuuguauuuuuaguagagacgggguuucaucaucuuggccaggcuggucucgaacuccuggccucgugaucuacccgccuuggccuccccucucuauucuuuaaaccuauagcaugcuuuuaucuauauggccucuucagaacaggagguacuggcuggaugugguggcucacgccuguaaucucagcacuuugggaggcugaagcagguggauuagcugaagucagaaguucaagaccagccuggccaacauggugaaaccugucucuacuaaaaaugcaaaauuagccaggcgugguggcacacaccugcagucccagcuacucgggaggcugaggcaggagaauugcucggaccccggagggagagguugcagugagccaagauugcgccacugcacuccagccugggcaaccagaggaaaacucggucucaaaaaacaaaaacaaaaaaaacaagagguagguacauccagacaggcgggacaugcauuagcccuaggcacucagccacucaggccuggaccccgcccacuccaacuuuguugggggaggguucccaauucucagucccaugaggacacgaaggguuuaccuuccccuuugaagaccagucccgccgcccucaccccucaccauucucgcugacauuacugcaggcccauguuuuggugucguuguuccacgugcagucguaccagagauucagggacucuuucccagggagaguccaccaggacugggauggacagagaacgaaacaaggggcaggguuaggaaaggagaggggauagggucaggcagacugugggaagggcugggaaaagggcaggguaucugggauggggcagaacuggggagaguuaggauuuaauaugagaggggguagggucaggacagggaggaggcaucggagguagagcuaaaaggguuaaccuggugguucaugccuguaaucccagcacugugggaggccgaggcagguggaucacuugaggccagggguucgagaccagccugggcaacauggugaaaccccgucucuaccaaaauaaaaaaauuagccgggcuugguggcaggugccucuaaucccagcuacuuggggggcugagacaggagaaucgcuugaacccgggaggccgagguugcagugagccgagaucgcaccacugcacuccagccugggggacagagugagacccuugucucaaaauaaaugaaauaaaauaaaaaagaaauacuagguaaaggggguggggccagaaugccuuuagaggaggggcguggcaagauuccaaaggggaacagaagggcccugagcuccaaguaggcuuaccuuguccaaaguggccacgaaaagcaguauaagaaugaggaugugaagggcugagaccaccagcaagaggagugacauggcugcaguggaagccuggggagggggagcaggggacggagucucaagagguuggcacaggccaggcacacucacgccuauaaccccagcacuuugggaggccgaggcgggaggaucaccugaggucaggagaucgagaccagccuggccaacauggugaaaccccaucucuacuaaaaauacaaaauuagcugggugugguggugcacaccuguaaucccagcuacucgggaggcugaggcaggagaaucacuggaauccaggaggcaaagguugcaaugagccaagaucaugccauugcacuccagccugggugacagagaaagacuccgucucaaaaaaaaaaaaaaauuuggcauaaaggcaggugagaugucuccugauggaggaagggcaugggugcagacuccugggucucucagggaggagaccgcuggggccuggauuccugagauccccauuggcuggagggguggagagggccaaagauggacucuuggguuccuugaaugaggaggacuagcaauguggcuccucucuccccagaacccugacucuggguuacauacaggccagauagugaaaauucaaguugagaccccacccugcaccccgacaucaggauugaggagcugcccccagcaacaggcauucuugacucacaccacuccucuccuggguugaggggaggagggggaccuggugagucaucuggugacucauccccacccccccccaucucuaagcaccagggaaaccccagccccuggcuauguccacgagguccucaccccacccugcugccagacuggugacuguuggacaucuucuggaggaaauggauaggauucgcgcuggggggaagagaggcccaagaaggaguuagccucccaggacucuuuggugcccaggaacaggggaccuagaggucucccagauuugggguguucucaugcaaugcccugaucucagggaccccagaggacaguggacaccgcugagggaaaaacugcaggaaguuuuccaguggagggcucugcugggaccccaaaacuuugccgggccccaccccuucccauauccccaccucaagugcuaagagaucacuuauuaaauuaaaaggauuuccaagagucagggacgucucucccagccuggggguguccuucccaaacugcuacauucccaaguaaauuaagaagucccagcccugaauaacggacuggaaacuuaccgagagccgcgaaaaaagucagagcuggagucggagucuugucccucgcucgggccuccgugccccgcccuucuccucccuccuuucacccucccgaggcccccgccucucucaccgccuuccucccucccuugcucuccccuccaauccagaacccuuucucucucgcucgcucuccuucugcgucucuucucucccuccugcccucacugucugggccuccuucucucuugcucccguuucucuuucucuccu

SEQ ID NO: 15186 - RNA, 5205 nt, Homo sapiens
aggagagaaagagaaacgggagcaagagagaaggaggcccagacagugagggcaggagggagagaagagacgcagaaggagagcgagcgagagagaaaggguucuggauuggaggggagagcaagggagggaggaaggcggugagagaggcgggggccucgggagggugaaaggagggaggagaagggcggggcacggaggcccgagcgagggacaagacuccgacuccagcucugacuuuuuucgcggcucucgguaaguuuccaguccguuauucagggcugggacuucuuaauuuacuugggaauguagcaguuugggaaggacacccccaggcugggagagacgucccugacucuuggaaauccuuuuaauuuaauaagugaucucuuagcacuugagguggggauaugggaagggguggggcccggcaaaguuuuggggucccagcagagcccuccacuggaaaacuuccugcaguuuuucccucagcgguguccacuguccucuggggucccugagaucagggcauugcaugagaacaccccaaaucugggagaccucuagguccccuguuccugggcaccaaagaguccugggaggcuaacuccuucuugggccucucuuccccccagcgcgaauccuauccauuuccuccagaagauguccaacagucaccagucuggcagcaggguggggugaggaccucguggacauagccaggggcugggguuucccuggugcuuagagauggggggggguggggaugagucaccagaugacucaccaggucccccuccuccccucaacccaggagaggaguggugugagucaagaaugccuguugcugggggcagcuccucaauccugaugucggggugcaggguggggucucaacuugaauuuucacuaucuggccuguauguaacccagagucaggguucuggggagagaggagccacauugcuaguccuccucauucaaggaacccaagaguccaucuuuggcccucuccaccccuccagccaauggggaucucaggaauccaggccccagcggucuccucccugagagacccaggagucugcacccaugcccuuccuccaucaggagacaucucaccugccuuuaugccaaauuuuuuuuuuuuuuugagacggagucuuucucugucacccaggcuggagugcaauggcaugaucuuggcucauugcaaccuuugccuccuggauuccagugauucuccugccucagccucccgaguagcugggauuacaggugugcaccaccacacccagcuaauuuuguauuuuuaguagagaugggguuucaccauguuggccaggcuggucucgaucuccugaccucaggugauccucccgccucggccucccaaagugcugggguuauaggcgugagugugccuggccugugccaaccucuugagacuccguccccugcucccccuccccaggcuuccacugcagccaugucacuccucuugcugguggucucagcccuucacauccucauucuuauacugcuuuucguggccacuuuggacaagguaagccuacuuggagcucagggcccuucuguuccccuuuggaaucuugccacgccccuccucuaaaggcauucuggccccacccccuuuaccuaguauuucuuuuuuauuuuauuucauuuauuuugagacaagggucucacucugucccccaggcuggagugcaguggugcgaucucggcucacugcaaccucggccucccggguucaagcgauucuccugucucagccccccaaguagcugggauuagaggcaccugccaccaagcccggcuaauuuuuuuauuuugguagagacgggguuucaccauguugcccaggcuggucucgaaccccuggccucaagugauccaccugccucggccucccacagugcugggauuacaggcaugaaccaccagguuaacccuuuuagcucuaccuccgaugccuccucccuguccugacccuacccccucucauauuaaauccuaacucuccccaguucugccccaucccagauacccugcccuuuucccagcccuucccacagucugccugacccuauccccucuccuuuccuaacccugccccuuguuucguucucuguccaucccaguccugguggacucucccugggaaagagucccugaaucucugguacgacugcacguggaacaacgacaccaaaacaugggccugcaguaaugucagcgagaauggugaggggugagggcggcgggacuggucuucaaaggggaagguaaacccuucguguccucaugggacugagaauugggaacccucccccaacaaaguuggagugggcgggguccaggccugaguggcugagugccuagggcuaaugcaugucccgccugucuggauguaccuaccucuuguuuuuuuuguuuuuguuuuuugagaccgaguuuuccucugguugcccaggcuggagugcaguggcgcaaucuuggcucacugcaaccucucccuccgggguccgagcaauucuccugccucagccucccgaguagcugggacugcaggugugugccaccacgccuggcuaauuuugcauuuuuaguagagacagguuucaccauguuggccaggcuggucuugaacuucugacuucagcuaauccaccugcuucagccucccaaagugcugagauuacaggcgugagccaccacauccagccaguaccuccuguucugaagaggccauauagauaaaagcaugcuauagguuuaaagaauagagaggggaggccaaggcggguagaucacgaggccaggaguucgagaccagccuggccaagaugaugaaaccccgucucuacuaaaaauacaaaaaaauuagccgggcaugguggcgugcgccuguagucccagcuacuugggaggcugaggcagaagaaucgcuugaacccaggagguggagguugcagugagcugagauugcacuacugcacuccagccugggcaacagagcaagauucugucucaaaaaaaaaaaaaaaaaaaaagaauagagaaaaaucucccaagauucugagaagacaagaguauuuuuccaaagcucuaaggagauggggcuggugcucugaauggaugccugggaccauuucauccaaauuccaaggggauggggcugaaaccacuuaagguucuaaagggguggggccaggugcauuggaguucuaaaggaauagagcugcaucuaucuaaaguucugugugaaagauuuaaugcaaaacuaagauuaaaggaaguggucugcucucaccacuucuauucaaccuuuuacuggaguagccaaugcaagaaggcaagaaaaagaaauaaagggcaugggaaauaaauuaggaaaaagugucucuauucccaguaaacauguuguuuauguagaaaauccauuaaaauucugcaaagcagacagacacaguggcucacaccuguaaucccagcaccuugggaggcugaggaggaaggaucacuuaagcccaggaguucaagaccagccuggacaacauagggaaacccugucucuacaaaaauuuaaaaauuacccagguugugguggcuugugccuguggucccagcuacucaggaggcaggggugagagaauuucuugagcccugaaggacgaggcugcagugagccaugauuauaccacugcacuccagcuugggcaacagagcaagaccugguuucagaaaaaaaagaaaaaggaaauuggcaaagcaacuacuagaacugagaagggaauauagcaagguaacagggcucaaggucaaaauaagugauacaucuaaguaucuaggcuuguaugggccuaaacgggagcagggauggggcagagaagggucacauggugagcaagcaggugaagcuggaacucuggacccacggugaugucccccucuguguccuccuuacugcaggcuggcugaaggcggugcagguccucauggugcucucccucauucucugcugucucuccuucauccuguucauguuccagcucuacaccaugcgacgaggaggucucuucuaugccaccggccucugccagcuuugcaccagugagcacugccccuccccaacccuaaucccccaagaauugagcagaagggaguggggugugucaagaugcugggggcccugagaaugggccucucguagaaaaaaacaacuuucaacaccccacgagccacaagaggugccuccgugggcuacaucucugcccccagggauugcugggacuuguaguuuucaguggcuaaugauaguuauggcuugugcguaugagucaucagggaacucagaguuucagggagccggggcuggggaaggagguauagguaaauaguuuuggucccagggaucggccgugacguggggggauaaacuaauuaguaccucaguagagagcucuaaaucauaauaauaaugguauuuauaucagccaaccgcuguuucuugcgugccuauugugcaucagauacuucaagaaguuuugcguacuuuuuaauuuuuugacuuaaggugcaaagggcuaacuuaaucacagucaguuuggggaacauuauagguucuugcaaagcuucucucuugguuuaugaauuuacuacugcauguuuggcuuauagaaacacacucaaaaauauuccuuggauggauagagagauauuauuggaccuagagagauuaaaucaguuaccuaaggccgcgcuacaguugcacggcgcugggcgggggggaaagaaccacaacucccagcaggcagcggcgcugcccacgggcccuccggcgcuucuuugcccccaugggauauugggaaauguagucuugagggggcacugcaugacgugugguuuucaucuuccgcaggcguggcgguguuuacuggcgccuugaucuaugccauucacgccgaggagauccuggagaagcacccgcgagggggcagcuucggauacugcuucgcccuggccuggguggccuucccccucgcccuggucagcggcaucaucuacauccaccuacggaagcgggagugagcgccccgccucgcucggcugcccccgccccuucccggccccccucgccgcgcguccuccaaaaaauaaaaccuuaaccgcgggcucugc

SEQ ID NO: 15187 - RNA, 2739 nt, Homo sapiens
acuaggggaggggcuuggauuucauucuaagugcaguggaaagccauuagguuuuaacagaguguaguaccaaagauuuuuauuuuuuuuuugagauggagucuugcucugucauccaggcuggagugcaguggcaugaucucagcucacugcaaccuccaccucccgguucaagcgauucuccugccucagccuccugaguagcugggauuacaggugcccgccaccacgcccagccaauuuuuguauuuuuaguagagacggggguuucuccauguuggccaggcuggccucgaacuccugaccuccagugaucugccugccuuggccucccaaaaugaugggauuacaggcguaagacacugugccuggccccaaagguuuacuguuaacuauuauuauuaauuuuggggauauuaaauuagggucggggugaugacuacuauguacacgagucucuugggaggggaccaggugcccagaacucugauaaauugagagcaggggaauucaaauccuggauccagggaagggaacuggaugaugggaugucuggguaucugaugggccagagcuggguuugggauagcuguuggugauucgggcucccugagggggugagggauggacaguucagugcuuggcuggguaccccaagaccuggaagcuggaauaccaguauagcacagacucuagagccacacugguuggacucaaaauccaagcuguuuuacucaauggcuguguaauuuuuggcaaguuacuaauaacuucucuaugccucagucucuucaucugaaaaauagagauaauaguaaauacauuauagggcaguucuuaggguagugcuagucauaucaggcauuggggcucugaguggagucaguacugggggacccugauucaggaucucuaggaguuggggaaggggcaaauucuuggguccauugggucucaaggcuaaaguugggaauccaaaaugagggucccugggggagaauaaguagucucaaacuuaagugccugagagacagaaacugggguccgcacucagaucccuaaggaaguugcaaagucugggucacugaaggaaaaauuaggggcuggggagacauacguuccucuuggggagcaggaaaagagggcuccacuuucuugagaggacuagggggagccaggggcuaggaagauggaaacuugagccggggaggugaaaaacacgagucuaggacucagaaucaaguucccugagugggaucggcgccaggcuuggguacccuggggauauuagggggguccccgcacuauggcuauguagaaggggaagaaucaaaggaucugaggguggcggcgggaucuccccauccugggccuccgagauuaugagcugagcugagcguacgcaggccgcuuccucccacaggaaaccgcaggcuucgggcacacccagccugcagggagaggcgcccacugcccgcccgcccggggaggcccacgugggcagcagccgccgccgcggagggggcgugccuuacagagcgaguggguguaaccagagggggcguggccagaaaccggggggcgguauggagugcccgaggucucacccacuuccgcccuccagcgcgcggacgugguaggcggccaagcguuuuuggcugcuucccgggaagccguuggucgcgcuugcguagugaaccgcugaggcuguguugagcgcuccuucuccgcgcaacucccggcuucgacaccgccuuccuuccuaugaauccuuaauuuaacguggucacagucagcuuaagaccggcaccucucgggcuccgucuuguaggaccucggccuggcuucgagggcuuccauacaggucaccgcaggcucuuucaacucccgccgcuuccaggcccgcgguacuagugagaccucagccucgaccuccccaggaccauuucgaccucccgcaggccuucaaggccugagcgccucccgauuagcccgcccuucaccgcccuuccaccgggccccucguaaggccuuccaaacgcgacccucgaagcccgccccuuacggggaagccccuccgcucgcugucugcgaagccccguccuguacugguguccgugccccuccccucgccggccccgaagccccgccccucgaaguucuucccacucacucuccucacaggucucagccccgcccaucacagcucccuacggcacgccccucucaggccucacagccgugcaccucucagggcuccgcagcaccgcuccacaggcccucccggcuccgccccuuucaggaccucgccgcccaucaguuuuguuuguuuguuuguuuguuuuuugagacggagucucgcucugucgcccaggcuggagugcaguggcgggaucucggcucacugcaaccuccgccucccggguucaagcgauucuccugccccagccuccugaguagcugggauuacaggcacgagccgccauguccggcuaauuuuuuguacuuuuaguagagacgggguuucaccauguuggccagguuggucucgaacucgugaccucaagugaugcgcccgccucggccucccaaaaugcugggauugcaggcgugagccaccgcgccuggccuugcccaucaguucucaguccgugggaacccugcaggucuacgccucgcauccuucuccgccccuccucccauaguuucucccgcggccucagucccucccuggccgcu

SEQ ID NO: 15188 - RNA, 2739 nt, Homo sapiens
agcggccagggagggacugaggccgcgggagaaacuaugggaggaggggcggagaaggaugcgaggcguagaccugcaggguucccacggacugagaacugaugggcaaggccaggcgcgguggcucacgccugcaaucccagcauuuugggaggccgaggcgggcgcaucacuugaggucacgaguucgagaccaaccuggccaacauggugaaaccccgucucuacuaaaaguacaaaaaauuagccggacauggcggcucgugccuguaaucccagcuacucaggaggcuggggcaggagaaucgcuugaacccgggaggcggagguugcagugagccgagaucccgccacugcacuccagccugggcgacagagcgagacuccgucucaaaaaacaaacaaacaaacaaacaaaacugaugggcggcgagguccugaaaggggcggagccgggagggccuguggagcggugcugcggagcccugagaggugcacggcugugaggccugagaggggcgugccguagggagcugugaugggcggggcugagaccugugaggagagugagugggaagaacuucgaggggcggggcuucggggccggcgaggggaggggcacggacaccaguacaggacggggcuucgcagacagcgagcggaggggcuuccccguaaggggcgggcuucgagggucgcguuuggaaggccuuacgaggggcccgguggaagggcggugaagggcgggcuaaucgggaggcgcucaggccuugaaggccugcgggaggucgaaaugguccuggggaggucgaggcugaggucucacuaguaccgcgggccuggaagcggcgggaguugaaagagccugcggugaccuguauggaagcccucgaagccaggccgagguccuacaagacggagcccgagaggugccggucuuaagcugacugugaccacguuaaauuaaggauucauaggaaggaaggcggugucgaagccgggaguugcgcggagaaggagcgcucaacacagccucagcgguucacuacgcaagcgcgaccaacggcuucccgggaagcagccaaaaacgcuuggccgccuaccacguccgcgcgcuggagggcggaagugggugagaccucgggcacuccauaccgccccccgguuucuggccacgcccccucugguuacacccacucgcucuguaaggcacgcccccuccgcggcggcggcugcugcccacgugggccuccccgggcgggcgggcagugggcgccucucccugcaggcugggugugcccgaagccugcgguuuccugugggaggaagcggccugcguacgcucagcucagcucauaaucucggaggcccaggauggggagaucccgccgccacccucagauccuuugauucuuccccuucuacauagccauagugcggggaccccccuaauauccccaggguacccaagccuggcgccgaucccacucagggaacuugauucugaguccuagacucguguuuuucaccuccccggcucaaguuuccaucuuccuagccccuggcucccccuaguccucucaagaaaguggagcccucuuuuccugcuccccaagaggaacguaugucuccccagccccuaauuuuuccuucagugacccagacuuugcaacuuccuuagggaucugagugcggaccccaguuucugucucucaggcacuuaaguuugagacuacuuauucucccccagggacccucauuuuggauucccaacuuuagccuugagacccaauggacccaagaauuugccccuuccccaacuccuagagauccugaaucagggucccccaguacugacuccacucagagccccaaugccugauaugacuagcacuacccuaagaacugcccuauaauguauuuacuauuaucucuauuuuucagaugaagagacugaggcauagagaaguuauuaguaacuugccaaaaauuacacagccauugaguaaaacagcuuggauuuugaguccaaccaguguggcucuagagucugugcuauacugguauuccagcuuccaggucuugggguacccagccaagcacugaacuguccaucccucacccccucagggagcccgaaucaccaacagcuaucccaaacccagcucuggcccaucagauacccagacaucccaucauccaguucccuucccuggauccaggauuugaauuccccugcucucaauuuaucagaguucugggcaccugguccccucccaagagacucguguacauaguagucaucaccccgacccuaauuuaauauccccaaaauuaauaauaauaguuaacaguaaaccuuuggggccaggcacagugucuuacgccuguaaucccaucauuuugggaggccaaggcaggcagaucacuggaggucaggaguucgaggccagccuggccaacauggagaaacccccgucucuacuaaaaauacaaaaauuggcugggcgugguggcgggcaccuguaaucccagcuacucaggaggcugaggcaggagaaucgcuugaaccgggagguggagguugcagugagcugagaucaugccacugcacuccagccuggaugacagagcaagacuccaucucaaaaaaaaaauaaaaaucuuugguacuacacucuguuaaaaccuaauggcuuuccacugcacuuagaaugaaauccaagccccuccccuagu

SEQ ID NO: 15189 - RNA, 7106 nt, Homo sapiens
uaucucacuuccccuuuaggacaggaaguagaauuuuauuugaacuaaaagccaacgaaaugccggccaggugcagugguucaggccuacauuuucagacccuuggccaguugagcccaugaguuagcccagcccggccaacauggugaacccccuuuuuuauuaaaaacccaaaaauuagccaggugugguggcccaugccuguaaucccagcugcucggaagggugaggugaaaaaauccccugaacccgggaggcggagguugaguaacccgagaucaccccauugcacuccagcuuguuugacaaagggagauuuugucaaaaaaaaaaaaaaaaaaaaaaaaaaaaaagagaauaaagauaaggaaaaccaacaggagagucauuccuuagguaaaaugagcgggacaaauuaaaaauugagucaggggaggcacggguguugauaagagauaaaucagagucggccaggcagaggggcucaggccuguaaucccagcacuuugggaggccaaggcagcagaucauuugaggccaggaguuugacaccagccuggccaacauggcgaaaccccaucucuacuaaaaacacaaaaauuagccgggcaugguggugcgcaccuguggucccagcuacuccagaggcugaggugugauaauugcuugaacccaggaggcagaguuugcagugagcugagaucgugccacugcacuccagcuugggcaacagagaaagacucugucucaaaaaaaaaaaaaaaaaaagaaagaaagaaagaaaccagaguccaagauagcaguuucuaggauagaacuccuaggauuaggcuucucuaagcaauguaccuuguuuuuauugagacagggucucacucugucauacaagcuggaguacaauggagugaucauagcuuacuacagccuugaccuccugggcucaagcaguacucuagccucagccucccaaguagcugggaauacaggcacaugccaucaugucuggcuaauuuuuuugguuuuuaguaaagaugagguuucacuauguugccuagcuggucuugaacuccugggcucaagcgauccuccugccucagcuucccaaaaggcuaggauuacaggcauaagccaccacacucagcccacaauguaccuucuccauaaggaaagagcucacugggggacaaggccuagaggcagagaguggacaggaugcaaugaauugggcaguacaaagucuguauacagagaggccuggaaacugcaacaaaauaaacugugaggcccugaagaagaagugggaauuuggggguagaaguccaaucugagauacagaggagacugauggaagacugcccagggcugugccagagccaugacuccagccacucagaagcccaggaugauggucagugcuuugccggcuuaggcuuacucaggaggggaagcuggggccgaaaaugaccagagaagcuuggcuugggucaugugaggagccugcauaguuacaggccagcugggaguccuuggucccccucagucacaggcucaucugccauggugcuguuuaucuuccauauggccucagaugaccauucuucccagaaagucugccucaauguucccaguuuccaccaacaaauucaauuugacaaacauuuauugaacaccucuaggugcccuauaccaguuccuggggacacaaagcucagugacccugugucccugucuggggggagaaguguguggcucacagcccaguuucccugagagcagaggagcaggaagcucaguauuucuuaggcaggccgucaggucugaagcggucggggucuuugccacuccggccccauuccucagcuuucucguuggacuucgaguccuccaauacagugcugcuguuuccaaauaaauagcagucuauuaaucccugaagauagacccuggaacggcugcaacccaaagaaaggagacaggagauuaaucucuugacucaccugcucaccugagacagcuccaccugcuaacucccuccucuucucccacccaaguaaugacugagaggaggcuggaaaacucaaggaaaggggaagaaaacuaucaaucuucuugggcaaaggccuaagucuacugauacuugcgcucugcaacagagugcuuucccuuuuuuuuuuuuuuuuuuuuuuuugagacagggucucauucuguugcccaggcuggagugcaguggcucaaucaugggucacugcagccucgaccuccuggguucaagggaucucccacuucagccuccugaguagcugggacuacggugcaugccaccacgccuggcuaauuucuuuuauuuucuguagagauaagagucuugcuauguugccuaggcugcucuuaaaucccugggcccaagagauccucccaccuuguccucccaaagaguuggaauuacaggugugagccccugcacccagccccugcaacagugugcuuucaagaccucuccucaguucuuacuuucccuugugggugaaaggagacaugucuucaccagccuugcucuggcucugccagccacccagaccccaggaguauguggaggaggggaaagagccacagguucuccugacucucaagacagauaggcacugcuggccucucacuggaguccccgggaaucuguguuaccugaugaguuuagcagcccagacacccccagguccucuuugggcagcaucauaguuuccccgagcauagagauaucuguuugaauuuuggugauuggauaucauuaugucccaauaggcucugcccauguccccaaccccuggaaagaaaaaaaaugacaaaaaugaacccagugacauacuggagaaauguagaaaugaacauuuuccacugauuuccagauuuuggcccuugacaaaauaauccuuugaaaucauacguggagauaaacauuacuuccugugaacagcuucccugaguaacuguaaggaaggugcuuuuccauggauuacauugaauuguauugguuggcaguugucaugcccugggcuacaucuuacaugggucugugugugcuguguacaaagaggggacgcucaugugaggaaugcuuuuccauggauuacauugaauugaauugguuggcaguugucaugcccugggcuacaucuuacaugggucuguguguacuguguacaaagaggggaugcucaugugaggaaugucacaauggagaauaguacuacagauguaagauccagggacauuacaagggacuuggugagaagaggagggggcugcacaucuaccauagcccauaagaaaaauacauccuuaccagcugagugaggacaacuaggacuugaauaaaucugacugcuaugggcauaaauggcacaagaaagccgagggaaugggcaguacgugaugagguggaaugaccugagagagcuucauaggaccuggauaaucagacuuaucaugaagggcaugaauguaaauguuuaacucucugcccugacaauuaagugucaguuuccacauucuucaguuggggggaaucauaccuaccucccugguggacuaaaugagaagauaaaaugagguaacauacauaaaaugccuagcauauuggaauacuugaugcaaauuggauuccuguuccuauuagugaagggcaguagugacaauaagauaccacuauacacccaacagaaugauaaaaauuuuuaaaacugacaauauaaauugugggcaaaaauguggaacaacuggaacucucauaauuguuuuggguuuuguuuuuuguuuuguuuagucacagucucccucugucacccaggcuggagugcaguggugugaucaugguuuucugcagccuugaucuccugggcucaagugaucaucccaccucagucuccugaguagcugggacuacaggcaccuaauaacacacccagcuaauuuuuuuuuuuuuuuugguagagauggggucucacuuuguugcucgggcuggucucaaacuccuggccucaagugauccuccugccuuagccucccaaagugcugggauuacgagugugagucaucaugcccagcucucguaauuguucauggaaguguaaauugguacaauuuugggaagcuguuugcugguaucuacgaaagcuaaauugacaugacuauaccuuaugacucuacauuuccauuccugaguguauacccacaacagaaacgagggcuuauguacacuaaaguacauguacaccaauguuuauuacagguuuagccaugauagcauaaaacuuuaaaaagccuaauuauccaauaauguaggauaaauugugauaucaguauacaauggaauacuauguagcaaugaaaaagaacaaaauauuaauacacaugacaaaugcugucauguauauuaguaugucguaauguugagugaaacaaagccggauacaaaagacauauucuguaugauuucuuuuauucaaagaucaaacacagggacacuaaucaacaaugauagagguaagaauaggaguuaccuuucgugaggguuguuaacuggaagagggcaugagagacccauccggggugugugaaauguuugacaucuugaucugaugguguaauauggauguuuguauguguaaaaaccucaucaagcuauacuguguacuauauguaaguuauauaucauuuuaaaguuuuuaaaaagauuaguggaaaaauagauguuugaaacaggucuaagccaggaagagcuauagaaaaugucuaucagugccuguguuguucaaucaauaaauauuuuugaguucugcugugguuuacguguuaccaaguucuuuaaaccaacucacuuggaaaaaagaaaagcugugauaaauaguuuuaauuguuacuuagguacuguguucuaagggauauuucucacuaacuucauguauuauuuugugucuguaauuuugucaaauaguuuaucucuggcauggcaugacuguccuuucucugaugcaugcuuuauguucauucuauguuuuccagaucuacuagcaagaguuuucuccaagcaucugacagauucugucacugggugacagaaaaacccaagacaguuguucucauuggcauugugcuuaaaguaaccuggggaguuuuucaaaugcuauuccuagucccacuucacuucuaagauucugacucaguaacuaugagaagaggcuucagaguguacuuuuaaaacaaacaccggccgauuuaaaugcugguggaccauacaacaaauucugaaauacacugaccuaagggaaaagauauucucuacuaugugcagaaaaacuuaguacaugcuaccaaaacuuuuuaaaaacuauuuauagaauaucauuuuuaaaagcacaaaaugcagaaaaaaugaaaauuuauaaaauuucaauugaaaaauuacaaaaaauucaacuacaaaauuaauaacaacacaugaaguucaaaguauugcauaaccugacaaacauaguuuucccauuuuaacagcuagucaauaagauucguuucccauccagaauggcagaagucaguuucccagccguaucucagcccuccuguggcuaaucaguagaaauuugcucuuuuuauuuauggauagaaguuagggcuuaauuuucauaagcucugcaucccaagcauuggccauuugcuuggguacaggaugggauuucucuacucucugcuaggcaugucucagucuuggaguauaauugugaacucaguauauucccugagguggaugagcuaaauaaacaucaugcccugagaaaucugccaucuguaaauuuccgcagugggagauaacccccuggaaguuuuuauccuucugcacucuacaccaagaguacaggcugggcccaaagcaucuuuaaccucucgucuggaaaccccaagggagggugauaaaucagaccagccuagaggaagaaacagauacagaaaaccacacuccugcucugaccucuguguggcuucucuaaggagcacucacauccagugaguauguggccccugcucagaaugaauccuggguaugugcccuccauccuccagaguucuuaccuuggagagccuccuugaaaaacgaacgccagcuuucacuggugacucccaugaccaaggagcagaaaacaaugccugugaaaagccucauugugcugaagagaaagaaagacaggggcagaggaucauaaaaaaaaacacagaucuauguuuugaggacugaauuucuuuccuuuuuuucuuucuuuuuuuccuuuucuuucuuucuccuuccuuucuuucuuuccucccuuucuuucuuucuuuuuuuuuuccuauugcccaggcuaaagugcaaugauaugauuaaggcuuacugcagccucgaccuucugggcucaagugauccucccaccucagccuccugaguauuaaggacuacaaacgugcaccaucacacucagcuaauuuuuuuuuuuuuuuuuuugguagagacaaggucuugguauguauguucggcccaggcuagucucgaacuccuggccucaagcaaucuuccuaccucaaccucccaaaggauuacaggcaugagccacugugccagccaaaggacugaauuugaaagacuaauuccccauuuccauuuguuuguaugagaaucauaacugcaugaaagauugaaacggguuuuaagaagaagcauaaacccuuaauucucagcccagaucucuagaaagaauaagaggauuccaacguguuauuuggucuguggucaauuugucacccaauacagcagacuaaagucaaucaagaagcauuuccugaguuccuacucuccucagcacugaccccguaaugagguagaaaacacaguuucucuccaauugaaauuugacaauuaugugagaaaaggaucucaaaagagucaaauaagagaaauuacuccuuggaagaaaccucaccuguggaccuuucuccagaugaaauuucaguaaaggcagagcugcugguaucuucuggccguggagcuauaguugguaccucugcuggcuuuggcauuaaug

SEQ ID NO: 15190 - RNA, 1290 nt, Homo sapiens
ggagccgcagcugggaggagggaggagggaggagggaggagggaggaggagguggaggaggugccagacugggggaaucaucaguauuuaaacagaccacaucacgggugagcuagugguccuugguucaggagguguugggcagucugcucugaugguucaguuuguucagggaauuuuuguugaaaaauaugacccaacgauagaagauuccuacagaaagcaaguugaagucaacugccaacaguguaugcuuaaaauccuagauacugcaggcacagggcaauuuacagcaaugagggauuuguauaugaagaauggccaagguuuugcacuaguauauucaguccacguuugacuuacaggaccugagggaacagauuuuacugguuaaggacacagaagauguuccaaugauuuugguuggcaauaaaugugaccuggaagaugagugaguaguuggcaaagaacagggccagaauuuagcaugacagugauggaacugugccauuuuagaauaaucugcaaagucaaaggucaauguuaaugaaauauuuuaugaccuggucagacagauaaauagaaaaacaccaguggaaaagaaacagccuaaaaagaaaucaugucugcugcucuaggcccauagucagcagcagcucugagcuagguuacaggaaugaagaacuauugccuaauuggaaagugccagcauuccagacuucaaaaaauaaauuugaagaggcuucuccuguuuuauacauuaugugaagaauuuagaucuuauauugguuuguauaaguucccuggagaaaaaaaacugcucuguguauaucucuuggaaaauaagacauaacagaugugaaaauauacuugacucuaauaugauuauacaaaagagcauggaugcauuucaaauguuagauauugcuacuauaaucaaaugauuucauauugaccuuuuuaucaugauuccucccuaucaagcacuaaaaaguugaaccaucauacuuuauaucuguaaugauauugauauugcaguagauaacuuuuuugaaucaauuaccucauuuuauauuuuaaaaauuauggaauauccucugucauuauauucuaauugaaauugugcauaaugcuuuggaaaaaugggucuuuuauaggaaaaaaacugggguaacugauuucuacgacuuucaaagcuaaaauauacaauauacuaaaccaacucuaauauugcuucuuguguuuuacugucagauuaaauuacaguucuuauguaugauuaaauuuuag

SEQ ID NO: 15191 - RNA, 28088 nt, Homo sapiens
aguuacgcagggacucgcgagcgcuguggcggcccugaaaggauauaggccguggagggaagggggcgggcagacggcauaggaaggcgccggaaguggucccgcagaggcggggugggaguggggcucccgaggcagugcaguuggcuguagcugggcgccucgguuaggugcgcugucaguccuuuccgagugccuggcccagucucucccgccucggcccaacauggacuucagagaaauucucaugauagcuuccaagggacaaggugucaacaaugugccgguaaguagcagcuggggcaucaauguaggggacccuagucuuccaaguucggaauguguguggcccauggaacuucugggcagccgccuaucggcuccgggagaggaaagacccggacgccuuauuuccuuuucuuggguuuauacucuugggaacucgggagaaaagagcuugggacgagacgcgggagccuuccugugaauggguuucgccggcuuauuuaccccugcaacagggacuuugcgguuuggguguuguagcuagaauugcgugaaagccgugagugagcugugccuggcacgcuguggauucuagcgcugguaguuuuuggcuuccacauaaacuucagccuagagauugggaaggaaauauguauguaagggaguuaggggguuugggguccuuggcuugauagcuuuuuggcuggcuucucaucgaucuucaagucaaacguuuagcgauuucuugaaagaauucucugacucggccccacccacucagccaccgaggugauuaaauuaucaccucccaggggauagguaucaucuuuugggaagagaaguuuagcagauuccacgaaauccuuggccaacagaauaggugagcuaguuucagcuucuguuuacuuguagccuuccagauuucagucuuuguuuaaaaucuaggucccauuuggucaguagauguuugucaguucgcuuacagucgcaagagcgguguaagacuuaaaugguaaagugguggagagcgccugguuucuggggguuauggcuguuuugcauaagcuaaucauuuccagauuuucagaugguacccacagcacagcuguaaaccgauaaguugcauggugaugccugcgguuugagcagugagguauagaacuaaaacggcucucaaagucaauucagcuagaauuuauugagcuccgacgaagugcucugcauuuccuagauauucguauauugcaauauucguuuuuuucucuucugcagcuuuuuuuugucuucugaggcuaguucauucuuuuaucccuuugaaaauauugaucugaaaaaggucuauauuuauguuuauaaauauauguauauauacacacacacagccaucccuuaucccaagaacucugaauaaccauuccucuaagccgugagucauaagcuuugcauguugaagguauagacucaaaccuuugaaacccagaucaacagauuuacuuucuagaagcaucuguaaauuuuccagaugaaucaauauugggucuaguaaccauucaucuuugcauaauuuggucuguauuucauucuagaucuuauugaauuucaguaaaggucaaagauaguacuagcuuugaugcccaguacuguucuguggaagaaucagaacuaagucauuucuuauucugaaagccaguagcugcugggagaaaagcagacagauaauccuaaagcagaaaauuucaaaauauguguauaugucauaauauaugcauuaucuaugauuggaauaacagaagaaucaaaaaggggaaaaaaguaauuuaaaauuuaauagaugggcgcaauggcucaggccuguaaucccagcacuuugggaggccuaggcgggagaaucaccugaagucaggaguuugagaccagccugacaaauaugaugaaaccccaucucuacuaaaaauacaaaaauuagccgggcaugguggugugcgccuguaaucccagcuacuugggaggcugagacagaauugcuugaacccaggaggcggagauugcagugagcugagaucgugcgauugcacuccagccugggcaacaagagaaaaacuucauuucaaaaaaaaaaaaaucaauagauaauauagccauauauuuuaugaaucaugcauucucugaccucuccccgccaaagcuaguaagccuagaaguuugauuuaguuaccagcauuauaauucuuaucuuuuuauguggaauuaaagucacaaaagaaacuauugaggaauaggauaagacuguaguuaaauuucuucuucuucuuuuuuuuuuuuuuuaagauagagucucacucugucguccgggcuggaggcuggagugcaguggcauggucucggcucacugcagccuccaccugcugaguucaagcaauucuccugucucagccucuugaguaacugggacuacaggcaccugucaccacaucaagcuaacuuuuguauuuuugguagagacaggguuucaccauguuggccaggcuggucuugaacuccuuccucaagucauucgcccaccucggcuucccaaagugcugaaauuacaggugugagccaccacacccggccaaauuucaugcuuuacuugauuugcuuuaacuugauucaucuaacuguucuauuuacuuuuuccuuaucagcuuaaaguaauuuggacacuuucaaacauaaggaauguuaacacauuucuaauauacccaaaccccguauuuagcauauuaacauuuccccauauuuauuccaucuauuuuaaaagaaauaaagcuuuuuuucuuuuuuugccaucuauuuuaaaagaaauaaaguguuuggugguuuuuuuuuuuuuuuuguuaucuauuuuaaaagaaauaaagcuuuuucuuuucuuuucuuuuuuuugagauggagucucuguugcccaggcuggagugcaguggcgaaaucuuggcucacugcaagcuccgccucgcagguucaagccauucuccugccucagccuccugaguagcugggaauacaggggugcaccaccacgcccaguuaauuuuuuuguauuuuuaguagagauagggcugguaucaaacuccuggccucaagugaucagcccaccucagccucccagacugcugugaguacaggugugaaccacugagccaggccugucuugaaauguuucuugacuucgaugguagcuuaaaaggauacuugcuuucuaauaaucuguuacccuguacacuaugucuaugauuuucacaauuauuaaaaacaaagagagaguuggggacuaucguaucaauuaacagcuuuauuucuggcugggugcuguggcucacaccuuuaaucccagcacuuugggaggccaaggugggcagaucaccugagaucaggaguuugagaccagccuggccaauguggugaaaccccgucucuacuaaaaaugcaaaaauuagccaggcaugguggggcacaccuguaaucucagcuacucaggaggcugaggcaggagaauggcuugaacuugagaggcggagguugcaguaagacagagguugcagugaguggagaucgugccacugcacuccagccggggugacagagcgagacucugucucaaaugaaaagaaaaauaaaauaaaauaaaaaaagacagcuacaucccucccugcccuauacacacccugcuguuauaaauuuacuugauuaauugaucugagaaccacagaggcuuugcaauaacuaacuaggcugcaucucucucuauugauugguucauuuuucccuguucgccaacuucuucucccaccuucauuuggaaccuaucagagcuaaugcucagaauuucagucuucagaguucuugggucagaccuuuacuaugguaaggaaauccagugacuagcgaugauuagacuaaaauccaaacaccuguacagccacuucagccuuucagacucuuugcagagcuuuuuguuguuauuuugagacgagucucguucugucaccaggcuggagugcaguggcgcuaucucugcucacugcagccuccaccuucuggguucaagcgauucuccugccucagccucccaaguagcugggauuacaggcgcaugccaccacacccagcuaauuuuuguauuuuuaguagagaugggguuucaccauguuggucaggauggucucaaucuccugagcucgugauccaccugccucggccucccaaagugcugggauuacaggcaugagccaccaugcccggccagagcuuuauuuuuauuuuuauuuuuugagacagagucuuccucugucaccaggcugaagugcaguggcauggucuuggcucacuguaaccuccgccuccuggguucaagccauucucuuggcuuagccuuccgaguagcugggauuacaggcacccaccaccacgcccagcuaauuuuuguauuuuuaguagagaugggguuucaccauguuggccaggauggucucgaucuccugaccuugugauccacccaccuugaccucccaaagugcugggauuacaggcgugagccaccgugcccggcagagcuuuauuuuuuaaagcuaccuauuguaucugucuugagaagcuaugaguauuucccuaaucaucauuuuuuuguuucuuaauuuuuaacaaauaguuuuuuauguuaaagguaggauugcaucaggcccagaaauaguaggcacacugucauuucccaguggaaaacugaauauauaauaacugcugaucaaggugaugaaacaaguugucgucacuggcucuguuuauauauaaaggagaaaagauauuuuugguaaacuugcacuugauuuuucucccuggguuccaguaggaaaaacaaaguaguuaacuuguuuugguagaauacuagagcuuagaauguggauucuuacagguuucacauagcuauaauuuuuuuuuugagacaaagucucacucugucgcccaggcuggaaugcagugagcgaucugggcucacugcaaccucugccacccggggucaagcgauucuccugccucagccuccugaguagcugggacugcagccgcacgccaccaugcccagcuaacuuuuguauuuuuaguuaagagauggggguuucaccauguuggccaggcuggucucgaacuccuggccucaagugaucugccugccuuggccucacaaagugcuggaauuacaggcgcgagccaccacaccgggccaucacauagcuauaauugauggcuuguaaagcauaagccaacuuauauggucuuucucccagugagacugugaaaaacaaccagaaaagcugcugaagcucugguaugaccuccacugccacaaaccgaaagguaaagggcaaaccuucaugugguaccagguauaccagaauuugggggucugccuauagccccuuaaggauaagaaccauagguagugaaaguaagagcccaggacauuaacuaggacagcaaauucagaugucuucaggggccagguagauaauguaaauucuugaaguagucugcauaaaaaaugauaggugccaagcuccauguauuuaaaaaaagcccacgauuugcauaguaguuacauuuucuuuuaaagaacagugugggccaacaaaaaguuuuuguagaugucuuuuuucugcagguaauguuugaucuauaauggauuguaacuggauugcuccccacccuuggaucuguuaaccuuaauaacgagguccuggcaauaugauauugagcuuauuugagugcaguuugaggauggcuaccugggaagacgcagacuccacaaagcagacagauaauccuacagcagaaaauuucaaaauguguguauuucaggauguaugcauucucuuaugugccagauaguucuucugccuuacuaaauagaauauaauguaauccagccuguggcuuuuuuucuuuauaaacaugauucuccacugggcuaccccuaugggauaggggagcugucuuuuaaaacauuccaguaccacaucuuuugauagcaaggucugauugcaacccccuuuugaaaggucuugcuagcucaauguuaaaaagaucuaugaucauaugccuaagagaaaggaaaacauacauccacauaaaaacuuguacacaaauguucacagcagcauuauucauaauagccaaauggaguacuccaaaagggagagaucugagaaucuuuuauauaggcaaggucuggggaagcuuaacaggauuucaguauuuucuguacaagguuaaugcauaguugcagcaauucgguaguaggcaguguuucuuuuuugggaaggguguauuuaacauuccacauuaaggguguaauaguaaaggggucucuuaucucagucagguuuuuuuuguuuuggagacagagucuugcucugucgccugggcuggaguccagugaugccacuucagcucacugcaaccucugccuccuagguucaagcaguucuccugccucagacucccgaguagcugggacuacaggcaugcaccaccaugcccagcuaauuuuuguauuuuuuuuuuuugagacggagucuugcucuguugcccaggcugggaugcaguggcaugaucucggcucacugcaagcuccgccucgcgggcucacgccauucuccugccucagccucccgaguagcugggacuauaggcauccgccaccaugccuggcuacuuuuuuuguauuuuuaguagagacgggguuucacuguguuagccaggauggucucgaucuccuaaccucaugauccaccccccucggccucccaaagugguggaauuacaggcgugagccaccgugccuggcuaauuuuuguauuuuuugguagagaugggguuucacuauguuggccagucuggucuuggacuccugaccucaagugauccacccgccuuggccucccaaagugcugggauuacagaugugagccaccacgcccggugaaggguuuuuuguuguuguuguuguuuuuggagauggagucuugcucugucacucaggcuggagugcaauggcaugaucuuggcucacugcaaccucugcuacccagguuuaacccauucuuuugccucagccuuccagucuuugcugggauuacaggcaugugccaccacgccuggcuaauuuuuuuuuuuuuuuuuuuuuguauuuuuaguagagaugggguuucaucaugcuggccaggcuggucucgaauuccugaccucaggugauccacccaccucggccucccaaagugcugggauuauagacaugagccaccaugccuggccaagggucuuuuaucucagccauguggucugagccugguacaaaaaaauaaggaaguuaauuuaaaacaaaaggucauuaauuaauaggucaugcuccaagacucugucuccaaagucaaccuccucagggcugaacaaccuuuagaagccccaaauagacucuccauuuucuuucacagaucugaagaugacuugucucaugucuggggcaguguuggauuucuagccuagagcaguaccucucaacuaguguuuuagggagagggucuuuuagaaacuacuguucaccuuuuucccauagagguucuguuauuucccuuccccaucacuaccaagauaaucucuuucugaauaacaauuaaccuuuauagugcauacucugugccaggcacuguucuaagcacuuuauauauuaauuuaaucaucauaauaaccauauaaugagcaguauuuuacuaaugaggaaacugaggcccguaacuugcccauggucacagagcuaacgcuagauaugguagagcagagaaucuaauccaggcagauuagcuccagaguucuugcucuuaaucaugagcuuguguugaaugaggggcguguacugaggaugguauagugaggaagguuguuaccuacacagcuugaacccauccaguucccuauccccaacuccagccuuaggcaguaacucuguuuuuuuuuuuuguuuguuuguuuuguuuuuuaaugacauucuuaguauacaguagagucugaugggagacaaauguaaaggcugaaccaaaaucauuuggaaacugauaggcagaaggauauuuacagcuuguuuaggacagugccagcaugguuaacagaaguagagucugaaggugagggaggauaagauagaaguuugguuguagaccuuucugaaguacuggcauuauccaagaggcagguggaaauuagggaaaggagguuagaacuagagauccaaguguuggaguuaaauuaaaaacuagagaugaaagugguggagccaggcauuguggcucacgccuguaaucccagcucuuugggaagcugagguggguggaucaugaggucaggcguucgagaccaaccuggccaacguggugaaaccugucucuacuaaaaauacaaaagauuaccugggugugguggcaggugccuauaaucagucccagcuacuugggaggcugaggcaggagaauugcuugaacccaggagguggagguugcagugagccgagaccacgccacuguacuccagccugggcaacagagcgagacuccaucucaaaaaaaaaaaaaaaagaaaguguuggaguuaaauuagaagugaccaucaugggcaacaaagugagaccccccccccaaucucuacaaaaaauacaaaaauuauuaauagccaguugugguggugugugcuuguagucccaguuacucgggaagcuaaggugggagacucacuggagcccaggaguuugaggccacagugagccaaggucaugccacuguacuccagccgccugggugacaaaucaagcaagacccuauguauuucuaaaaaaaaaaaaugagauguguuguagugagaauauuuuggggcugaguuaggcgaucuggauucuaauucagacucugcuauaaaccgugugauugccaguaaauacacagguguucugggccauuucuaacauagagguuggacuggagacuccaugagacaccuaucugauauuauuacauuuuauaaucagguauguuuuuguaaacacaauaacaguaaaauuuacauuuaacuccauagcaauuaugaauagcaucuuuuggggcagguuauuaauuuuuauccucuuagccauccagcuaagcaguucuaauggaaccauugguuuuccaggccuacuuucuuucucugacucugauguucugagaaaauuuuuaaaaacuguggugauuauuaaaguuaaggaugcagcauucuuugaauauuccuaacuccuaauucuaaccaguuauaaaucucuuauguaaagccaucaagaaauuuauauuuucuacagucgaaacaauauguuaucuccuggguaaagaacagcuuucauggaggaauugacuuuuuuuuuucuugagacggagucucgcucugucgcccaggcuggagugcaauggcgcgaucuuggcggaccacaaccucugccucccggguucaagcaauucuccugccucagccucccuaguagcugggauuacaggcaaugcgccaucccgccuggguaguuuuguauuuuuaguagagaugggguuucuccauguuggucaggcugguguugaacucccaaccucaggugauccacccaccucagccucccaaagugcugggauuacagacgugagccaucacgccuggccagggauugacuaucgauuccaacauaacauacaguagucgguguacacauguuucuagacuaaugucuccuuauuuucuuaaucuggcuuagaugauacaguuuaaaugcaaggaacagauauguuuuaaaguggcuuaauauuuucuaaagcucuuggcuucagaguuacaaaucuuggcaaaaucucugauguuguauuuaaaugacaagcuucacugugguggaucauucauugggguguagcagaaugacugaguuggcuugcaguguaauaaaauggauaugcuuaggauaaaagaaacucuuguccagcugcuuuccaugaagcucaaacaaugaagcagccuggugccuugacucagauucagaauugauggaugcauccugaugugcugcugcuagagcuaaauaugaccaugugaugcgaggggaagugccaaauaguucuucuggguuauuaaauagaauauaauguaauccagccugaagcuuuuuuuuuuuuuuccucucuuuuuaaaaauguuucuccacugggcugccccucuggggaacugucuuuuaaaauauuccauuacaacacaucuuuugauaccagggucuauugcaacccccuuuugaaaggucuugccugcucaaugagaaaaagaucuguggucauauaccuaagagaaaggaaaaugugcauccacauaaaaacuuguacacaaauguucacagcagcauuauucauaauagccaaaaaguagagacaauccgaauauucaguugaugaauauaaaaauaaugcaugguauaucuauacaauggaauauuauucagccacaaaaaggaaggaaauauugauacaugcuacaacaugaacuuugaaaacaugcuaagugaaagaagccagauacaaaaggccacuguaucugucaguguucuccauggaaccaguaggauuuauuuuagggaauugauuauggaggccugacaagucugaaauuucucgggcaggccagcaggcuggaaaaucaggcaggaguucaugcuguagucuugagauagaacuccuuuucuuagaagccucggguuuugcucuuaugccuucauuggcaugauuggaugagacccauccacauuauggaggguaguauucuuuaccuaaagucaacugauuguagauauuauaucuacaaaauaccuucacaguaaugcuuaauguuugauuaaauaacuggguauuauagccuaguccaauugacauauaaaauuaaccaucauagcuacauauuauacgauuucauuuguaugaaauguccagaauugguaaaugcauagagacagaauguagauuagcguuugccaggggcugaggggagacaagaacauggagucauugcuaaagcuaagagauuuuuugggagaaugauuaaaauuuucuggaaucagauggugguguugguuauacucuguggaugcaguugacccuucaacaacauagguuugaacuguguggacccacuuauacauggauuuuuuuccaauaaguuuuuuuuuaaauuugugauaacuuaaaaaaccugcagaugaacauagccuagaaauauugaaaagaauuaagaaaaaaguauaucaggauucauaaaauguauguuaauugacuauguuaucaguaaggcuucuggucaacuuugaguuguuaguaaaguuuuuaggcagucaaaaguuauacauggaauguuguuguuguuguuguuguuguuguuguuguuguuguuuugagacagaguuuugcucuuguugcccaggcuggaguacaguggcgcgaucucagcucacugcaaccuccaccuccuggguucaagcuauucuccugccuuagccuccugaguagcugggauuauaggugcgugccaucacgcccagcugauuuuuuguauuuuuaguagagauggauuucaucauguucaucaggcuggucucgaacuccugaccucaggugaucugcccgccucagccucccgaagugcagggauuacaagggugagccaccgcgcccagccggaauuuuuucuuacugcacagggugguggcaucccaugcuaccauguuuaaaggucaacuguauaucaaaaaccauuuaauaguauacauuaaauggaugaauuuugugguauaugaauuuuaucucaaagauuuuauuuuugagacagagucuugcucugucacccaggcugggguacaguggcacaaucauggcucacugcagccuccaccuccugggcggaagccauccucccacaucagcuguguagcugggacuacaggcgugcgucacaauguccggcuaauuuuuguauguuuuguagagaugggggucucauuaugcugcccaggcuaguuucgaacuccugggcucaaucaguccuuccaccucagccuuccaaaguguugggauuacagacaugagccaccauaccuggccauucaaagauauuuccaaaaauauaaagaugaucucgagugacccagucuuuuuuuuagguugugaaccuaaacuuugucuaagaguguuuuaauaucuuauugguauuugugcuguugagguuuuuuugguuuugguuuugguuuuuuuuuuuuuuuuuugagauagggucuuacucuguuguucaggcuggagugccauagcacaaccauggcucacugcagccucgaccucccuggcugagacaauccuccugccucagccucccgaguagcugggaccacaggcauaugccacugugcccagcuaauuuuuaaauuguuuggagagacagggucucccuauauugcccacgcuggucucgaacuccugugcucaagcgauccucucgaauuagccucccaaagugcuggaauuacaggugugagccacuaugccugaccugaguacauuuuuaagcuacagaggauauaagaaauuaauugauuauggcucaguucauauaaacaagauuaagccucauuaaagcagugcugaccuugccuuacugcuagcuuuuuaaguuguugaagaucaacaaaauagacauuguauagauuuauugaguuucugcugcaucauaaggacaguacaacaaguacugcaaaguuguuggguuaaaugugagaccagcuuaaguauccuuaaugauuagagguguuuaaaaaggcagaauuugaaguugacauauaaauugaugagaauagguguauacuuugaaaaaaagcuaaaaguagccuuuguuauucuuuucaaagcaaaucugaguuccugaacaccaccuuccuuguuuuuaugccuuuccuguauuuuuguucccuaagucaguguuucuuuucuuuucuuuucuuuucuuuucuuuucuuuucuuuucuuuucuuuucuguuuuuugagacagaguuucacucuucucacccaggguagaguacaaucacccaggcugaagugcaguggugcgaucucggcucacugcaacccuucaccuccuggguucaagcaauuacugccucagccuccagaguagcugggauuacaggugcccaccaccacgccuggcuaauuuuuguauuuugaugggguuucaccaaguugaccaggcuggucucgaacuccugaccucaggugauccacccgcuucagccucccaaagugcuggcauuacaggcaugagccaccacgcccggccucagucaguguuuuuaaagagcagcacauauagggccuggauauaaaugguauacaaauauaccauuuaaaauauuucuacauuuuuuuacaaauaaaauauuuuuuauuuuaauaguauuuuuuuuuuuuuuuugagauagagucuugcucuguugcccaggcuggagugcaguggcgcgaucucggcucacugcaagcuccgccucccagguucacgccauucuccugccucagccuuccgaguagcugggacuacaggugcccaccaccacgcuuggcuaaguuuuuuguauuuuuaguagagacaggguuucacuguguuggccaggauggucucaaucuccugaccucaugauccgcccgccuuggccucccaaagugcugggauuaaaggugucagccaccgugcccggcuuaauaguauguauuuuuauaugaauuggaaaaauauaacuaguuguucaagucagucauuuuguggauauuauugcugagguaaagcuauaauaacggcucaugauguuuuuguuuuuguuuuuuugagaccgagucucacucuguugcccaggcuggaaugcaguggcgugaucuuggcucacuacaaccucugccuccuggguucaagugauucucgugcuucagccucccaacuggcugggacuacaggcgugagccaccaugccuggguaauuuuuguacuuuuaguggagacaggguuucaccagaguucgaggccaggcuggucucgaaccccugaccucaagugaucugcccgccuuguccucccaaagugcugggauuacaggcgugaaccaccgcaccuggccaacucuguauguuuuuuuaaauuaguaaguaaugguagggguaguauaccacaaaggcaaaaaucauaaagguaguaugcaaaugacugaagcuuacugaacacugcauuaaacuaugccccauugacacugauguuuucccuuuuggauaccaguauucagucaagagcagcuuuucgguuugucauaucccacuuucuaucucuugcagucccagguuaagaugaaagauaucuaucccaaaaucauguuagauagugcucaaugcuggguuauuuggacagcaaaccaguccuguuuaaaauaaguaaugcuaauauauguauuugcauuuuucuuggggaaaaccuugcauggggcuuugauuuguauggggcuuuguaacucuaugagcuauauaauggacagggacaggaaauuuuuguuuuuuguuuauugagacggagucuugcucugucaccaggcuggagugcaguggcgcaauuuuggcucacugcagccuccgacucccugguucaagcaauucucuugccucauccucccaaguagcugggcuuacaggcaggcaccaccacgcccagcuaauuuuuguauuuuuaguagagaugcaguuuuaccauguuggccaggauggucucgaucuccugaccuugugauccgccugccucagccucccaaaguucugggauuacagguguaagucacugcacccagccuuuuuuuuuuuuuuuuuuuuaaagagaugaguucucaccauguuguccaggcuggcgucuuaacuccugggcucaagcuguccucccgccucagccuccuaaagugcuaggauuacaggcuugagccacugcgccuggccaggaaaaucuuaaguguuagugaaaaaaaauccaccuucuucugcuuccaaaucccuuaaugggauggaguggagugagugugugccucugcuuaugaguuuuuuguaugucuucauuugaaucauauucauggugcccuuuccacaaugaaaauguaagcuccuugugauuaauaccuauguuugugguucuuuucuuguaaacaagggcaauuuuauauauaucuaguuagguuagcaguauuacuucuccuuucuccucucccuuucuuucucccuuuucuccuuuaaauauugagccccuauccacuauggaaagagucuaaaauuaaauuuacaaagauauggacuuuaaaggaucucacuauggccuagccaaggugacugggaaagaaaucuggaugcugucuugggacuucucucuauuagggauaugucacuucucagcauugcuaucaugcaagauuuucagguugaauuagagccugcuuccuuggccagcugcuuuguuggcagacuaauuuaguugaaacuuccagccuguuucaagauacgucguauuuggcagccuuauaguaagcacauaucuuuugguuuuccuccaagaauuucauacauauuugggaauacuuuuuugguuccuaaguuguuccuaaguugucucaauuuguucuuggacauguuucuuuuucugcuagccacagcaacagguacguuagaugagaaugcaucugccuaacaaaacaaaaaaaggaggauacuuuaaaaaucuuauuuccuggauuuaauguggaauggucguagaggugaaucaucccuggucugaauuuauuuuagcucuauguucgucauauuucucucauaauagguacuuauaaaguggaaauauuuuuccuuuuauaguucaaauuaacauuacuugaguuuaguaauuucuugaugcaguuauauaaaaacugagguccagagacuucaucugugccaggauaauguaagcuuuuuuuggguguuauaggaaccugucuaaaaaggagguugugaggcaaauuaacauuuagugaacauaagagcuacaguuaaagguugcugggaauugggccuuuauugcauagauuuuuugaaaugcuuuuuugcugugguuugccccagccuuuguguguggucaaaguaaaaccucaguguuuccguguucuaagcaaaauaaaacauguagcuaugagucucuacuaggaaaucaucuggaguagucaggagagaaaauaguugugaggaguaguuuuuucuguucguuugaaaaguuggacuuugaaaugcuucuuucuaaggcaggcuauuuuuaaacucagaauuuuauacauuuacuuacuuacuuacuuacuuauagauugauggauugagacggaguuuugcucuguuguccagccuggagugcaguggcgcaaucucggcucacugcaaccucugccuccuggguucaagccauucuccugccucagccuccuaagcagcugggauuacggaugugcgccaccaugcccggcuaauuuuuguauuuuuaguagagacggaguuucacuauguuggccaggcugguugcuaacuccugaccacagguaauccucccaccucagccgcccaaaguguugggauuauaggcgugagccaccgcaccuggccuaaaucagauuuuuuuuuuuuuuuuuuuuuuuuugagacggagucuuacuuugucgcccgggcuacagugcaguggcacaaucucggcucacugcaaccucugccucccggguucaagcaauucuucugccucagccuccugaguagcugggauuacaggcacccgccacuacgcccagcuaauuuuuuguguuuuuaguaggaaugggguuucaccauguuggccaggcugaucucgaacuccagaucucaugauucgcccgccuccgccucccaaagugcugagauuacaggcaugagacccugagcccagccuaaaucagaauuuuaaaacacaaauaaucgauucuucuaaguggugauuucauuuaguuacccaguccagguucuuuuuuggaaaauagccugaaaacaguguuucugugaauuguucauuuaugcauuauuuugggauguuacauggaaacuuuguaccccaaaaucaccauacguaauaaauagucugaaauuuuauagcuaagcuuuauuauggguuauaugaucucucaauuauucagaauagguuucacaguuaacauuuauaccucuuauuaccuggcacagugccuuauaccuaauaauguauuuuaaaaguugaauugcuucuaacuuuuacuguuuuuguuuuuagaaaagguauaguuuggcaguggggccuccaaaaaaagacccaaaaguuaaagguguccaaucagcagcuguacaagcuuuucuuaaaaggaaagaagaggagcugagacgaaaagguauguaucuauagccuuauucucaauuuuaaaguauuccaucuucaccaucuagcuuguacuaaaccaguggcugucuauaaaaacauaacaggccaacagauuugggaggguguguguguguguguguguguguguguguccagguuaacugacuguauucauggcuuuacauauguuaccucgaucauuuguauaaacguuuucuuuuuuucuccccuugaaguaacagcuuuuuggggguuaguagccaugucuucuaauuggccauaguaaguccccaguaagaacuccauucuuucuuuaaucuugguucugaaaguguuucuacccauuuuguauuuuaauuuuuauuaacagaaugcuaucuaaaaggcuaaaauagagauaaguuuuaaagucuuuauuucgaauaguucuacuucaugcaaauacaaagaaacugauucaauauguuuaaguauucauugaaucauaauuaauaacaacuacuaaguggauacuaauguucucuuaacuugguaauguauuugguuugaaguauuuuguauauuuaaagcugaaaaccaagucucccacuugcuuagucauauagaaaaacccauaugucucccacucauuauguaaagaugacucaauugauacuuguucacaugacuuccucauuugauuccuagaugucuucaaacuguaaccugaacguuguguuuucacuugagcauacugcaaucuugagaucucgaaguaauaacauauucuuguuuugucccuuuuagccuuagaggagaaaaggagaaaagaggaacuagugaaaaagcgaauugagcucaaacaugacaagaaagcaagagcuauggccaagaggacaaaggauaauuuccaugguuacaaugggauuccuauugaggaaaagucaaagaagaggcaggcaacagaaagccauaccagccaaggaaccgaccgagaguaugaaauggaagaagagaaugaauuccucgaguacaaucacgcagagucagagcaggaguaugaggaagagcaagaaccucccaaaguugaaagcaaaccaaaggucccccuuaaaagugccccaccacccaugaacuucacugauuuacucaggcuggcugagaaaaagcaguuugaaccaguggaaaucaagguagugaagaaaucagaagagcgaccuaugaccgcagaagaacuuagggagcgagaauuccuugaacgaaagcauaggagaaaaaaacuugagacagauggaaaacuaccuccaacuguguccaaaaaggcacccucucagaaagaaagugugggcacaaaacuuagcaaagguucuggagacaggcauccuucuuccaaaggaaugccccuuccucaugcugagaagaaaucaagacccagcauggccaaugagaaacaccucgcuuugucuucauccaaauccaugccaggagagaggaucaaggcaggaucuggcaauagcucccaacccucacuucgugagggccacgacaaaccuguuuuuaauggagcuggaaagccucauuccagcaccucuucaccaagugucccaaagacuucugcuagcaggacucagaaaucugcuguugagcacaaagccaaaaaaucucugucccauccuagccauuccaggccugggcccauggucaccccacacaauaaggcuaagaguccaggugucaggcagccaggcagcagcucuagcucagccccugggcagcccagcacagggguugcucgacccacaguuaguucuggcccugugccuaggcgccagaauggcagcuccagcucaggaccugagcgaucaaucaguggguccaagaagccaaccaaugacucaaaucccucuaggcggacagucagugguacauguggcccuggacaaccugcaagcagcucagguggcccugggcgacccaucagugguucaguuaguucugcaagacccuugggcagcucucguggcccuggccggccugugagcaguccacaugaacuucgacgaccagugaguggcuugggccccccggggcggucugucaguggcccugggagauccauaaguggcucaauuccagcuggacggacugucaguaauucagucccaggaagaccagugagcagcuugggaccugggcaaacaguuaguagcucaggucccacuauaaagccuaagugcacuguugucuccgaaacaauuucuuccaagaauaucauuagccgguccagcaauggacagaugaauggaaugaagccuccccuaucuggcuacagagcugcccaagguaaaauuuccccucacccgaaagaguauauauuugucauuaggaaauuggaaagaguuuuuauauuaucagggacccuuugaaccccucaugugcuguccuuuaaugugcuguaguguugauagaaucgugauguuuuaucugccuugugguugagaguuccuuguuuuuuuguuuuugagacagggucuugcucuguugcccaggcacaaucacaggcucaagcaguucucccaccuuagcuucccagguagcugggacuauaggcgugugccaccaugccuggcuaacuuuuuauuuuuuauagagaugggguuucaguauguugccuauacuaguuucuaacuccggggcucagagauccgccuuccucagcuucccaaaauacugggauuauagucaugagucacuauucccugcugagaguuccuuuaauggcuuggaaaggucuuuagaaagagacuugucuaggaucucuguguucacccuugaaaugucccuaagugugauaaacuuagcuuugugauuugugaacauucagggugaauguacgugacuuacauauguaugcugcaauggaugaauuaaucuacuuuuuccugaggacuaaagagaccugucuucaaggaucaggguauaaucggaagcuuauucagcagauauuucuugggcacccauuaugugccaggaacuguuuuuagauuguacuuguguuucugcuuguuauaaugguuaguaucaagauccuaaacacugauccuucaggaaucugcugucccaagguauaugaucauugguggcaccugcuagcugcuaggucguacuugcuuuaugcuaauagagauuuauuaaagcacuuguuaggcuccacggagaauauaaaaaggaaccaaugauugaauuacuuguuuuaaauuuccuaguucaacuagaccauugauucuuaacaagggcaauuuugcccuccaggggacuuuuggcaaucgucacaacuggggaugggggaugccacuggcaucuacugaauagaggacagggaugcugcugacaaacaaugcaugggauagcccccugacagcaaagaauuaucugguccgaaaugucauugagcuaagguugagaaacuaagcuagggagacaagccaugcauauuaaaaacaaccguagaagaacaaaagaagugucuguaaucaaaaacuagaaaguaguuguucccagauccugggcuguugaucaaugccugucuuuugcaaaguuuuuaucagucuuuugguaaaaugacaaaaauaaggauaauguagugaguuuuuccuacagucaaacuuacucaguuugaacaauauaauucugagagucauucauacuucauucaacuuuaaauuuuuaaaugaaauugugauuauaguagaugguaguugcuacuuuuggugucuuggcaaaaguuaaugauucuguggagguuuguaaauuguauuuauuuuuagaaauuuuacugauuuuggccgggcgcgguggcgccgccuguaaucccagcacuuugggaggccaaggcagacagaucaccugaggucgggaguucgagaccagccugaccaacguggagaaaccccaucucuacuaaaaauacaaaauuagccaggcguuguggcacaugccuauaaucccagcuacucgggaggcugaggcaggagaauugcuugaaccugggaggcagagguugcagugagccgagaucgcaccauugcacuccagccuaggcaacaagugaaacucugucucaaaaaaaaaaaaaagaaagaaagaaauuuuacugaucuuauaaauucagaaauauuggcacuacuaagcuagaaaauguaacaagauauuucugguaagcccugggauaaaacaggaguucuguuccuucuggauaccaugacacagcaaggaugauggcucugcgcuaagggccagccugcuugcucugguuuuaaaggauaccaucuuaaugaugacucacaauuucaguuuacauagaacugcauuggaacuauuuuaaauuguaauauucuuauaaauaaugguuucuuagguccucaaaggcuucccuucccuacugguuacaaaaggcagcgagaauaugaagaggaagaugacgaugaugaugaauacgacucugaaauggaagauuuuauugaagaugaaggagagccucaggaagaaauauccaagcacauuagagaaaucuuugguuaugaccgaaaaaaguaagacuaaagaagauucagauaacuaugacauccuuuuuuuauuuugaauaauucaugucaugggguaauaaacuaauaguggaggcacugaauacaauucuuaauuaggaacccuugggugauuguuauuuaaauaaacguacucuuuuagcacuaaauauuuuauauuuaauucaaaauaguuucuguaguuauuugcaugaggaacaaaaaauaacccuuuuaaauuguuauucuuauaagauauauauuuagugagauggaagcagcuuaguguaguagaaguagauuggcucuugaaaaaacaagcuguauguucuuggucagucuguuaacucaacugcuucaguuuccucuggucuaaagucuuuccccaccucaugauggucaugaagcucaaauuagauuauuauauauaaaauaauuuucauauauacugugcuuucaaauuuuaauauaaauuaucaaguaaauguaggugagugaguugaggaagcacuguaggauugguaccuucaugaacauuagcuucagaauaguugcccucugaggguaauaagggcuuaucuaaaacuugucuuuacuucagaaaccuauccauccuccacuccccucacucgcugccaagcaaggaauaauucuaaaugugugcuugauuuaguuuuaaaggagauauugauuuuuuaaaugagaggacguaguuccuuuagaaaauugaaguuuucucuuuuuaucauuuugauuuccuuuuaucagauacaaagaugaaagugauuaugccuuacguuacauggaaaguaguuggaaagagcagcagaaggaagaagcaaagagguaagcauaaaauuuagcauacuugugcaaaaauguccuaaaaauuccuuucugcuuauugcuacaauugcaccauugggaacuggggcuuugggccagagaauucuggauuccaauccuguuuacuagcuguggggccuuggacaaauuccuuaacaguucuguuuuuucacugguuuuuguuuuuuuguuuuuuaacagagauggggucucgcuauguugaccaggcuagucucaaaccccuggccucaagugauccucccaucucagccucccaaagugcugggauuacaggcaugagccacugcacuggaccaucacuguuuuuuuuguuuguuuuguuuuuaagagauggggucuugcuuuguuauccaggcuggucccaaaguccugggcucaagcaauccuccugccuuagccucacaaaguguugggauuauaggugugagccaccaugcccagccuauuuucuuuuguaaaaugagaauauacuguuuuacucauuuaaguauaaugaggauuaagacguguacaagaugccuagugcagugccucacauguguggauacacaguaaauguuagaugcuuucccuaauccuguuguagcaaauucuugcuuuucuuucugcaucagacacaucucaaucuugguaaccuguaacauugcuggccucagggauguagguauauuacauuuccucugauuucuguuuggcuaucugauaguaagcuaaugauacuuucucuauugggguaaaaaguaauuacuuuguuuauaguauuguuguuuuuuuuuuuuuuuuuuuuuaagagacagggucuugcucugucgccaaggcuggagugcgguggcauggucacggcucacugcaacccccaccuccccggguucaagcgauucuucugccucagcuucccaaguagcugggacuacaggugugcgcuaccacgcccagcuaauuuuuguaauuuuuaguagagaugggguuucaccauauguuggccaggcuggucucaaacuccugaccucaggugauccgccuggcucggcuuccuaaagugcugggauuacaggugugagccacugugcccggccauaauguuauuauagguaaauaauucacuucagucucaagccagaauacuauaucuuuuucucccucuugcccauaaaauuucaaacuaaaguguuggaagagaacaagaauagaauguuaguuaaugaauaaaugcuucuugcuguuuauuuuuaaaagcuauugagauaaaccuauauuuuauuauuuuaauggaaauaguaagguuuuuguggugugugaguucuuuuucccacgacaauuugagucuguggccccugguaaaaaaauaucccugcuaguuuguuuucagugguaaagccuugaggcauuuugagagcaucagcacaauccaugugagcucccaguuggaauuuucauucuuuuuaaggaaaguggucaucucauguauauugacaaauacccuuuaaaaauucuuuggcagcuuaagacuggguaugcaagaggacuuagaggaaaugagacgugaagaagaagaaaugcaacgucgaagggccaagaagcugaagaggcguuagcugcugcuuuuauuuuugugaaauucuagagcugcucugcugcaaggauuuccugccuucagacugaagaagcccccuuaucauuuuagauuuauacuuggguacucaaggagaaggaaugcauacugucauuugcaggcugucauuugagcauaaaauauuuucagauauuuuccagggugaaaucuguaaugcagaugauauaaugcccacuugugcucuuaugaaguuaacuguucacagaugccagccuugauccugaugagcuaugcacucuaauguggggccacucaccagucagccaaucuuuuauuguuccuuugcuacuuugaaaggaaaaaaaagguugucucuugauuucuguaauucuucugcugaucugugaguagggcacugcccugcucccaaucaaacuuagucuuuuuaugagaaaccuggaccuuccaugaauguugccagcaauaaagugacuuguccuaaucuauggauugagaacuugaaaauguagaguagaauuuauaacuaucauauggaugucauccugugacuuugaaguacaaaguagaauaaauucuguauucauggauuggaugcugagcauucuuacucauuaauuuagguggcuaggaauuaaugaaaaaauuuucaaguuaaaauacagguuauaacaguauaauauucuuuucuaaguuuuccuuucagauuuacuguuauguuggcuuuaguguaagacaaggucacugugcugauugauuuuuaucuaaaaaaauucauuuuuauaucgaagaaaaaauauuuuauucaaacauuagauuugaaagaguaauaguuuauaaaauaaggaaguaacaugugaggcucuccccuccuccccucccccaucauaaagauauuuugaaaucccaaggugcccucauaccucuugacauuaaugacuucauuuuuuagcuugaauuuguuagcaaauauuaauggcagaaaaccaaaaacuaaauuuaugguaucgagagcaccaccuucucuuuuugcccauauugcacuuugauuucaaacuaugcacugugaagagauuuuuuuccccagguaggaagggauguucccuguuaucguuauuuuacugagcuguggaaacucauuuuuacccuuuuuaaagucauaaauauggacuuaauagcccuuaaccuucaaguccaagcaguuccaaucaggcugacuuaggaucaugcuggaaggaagccaagucucaagaacugucagcaacagaaaaugagauaugaugcuagagagcauuuguccuugacuguaaguacagaggcuuaggggaagugagacauaagcuuguaggaauaauaaacguucuacaauaaacguuuuggcuaucuuaagccauuguaugggggggauuaggaaguaggagggauuguccuacaacaggcccuuauacuucaacagcccaaauauuuugguuuauuccuuuuuauccauaaagucuuuauucuucaaguuuggguauuauagauuaccauuguuagccucccuuaaugggaccauaugagccaggcuuuuaagacggacucauuuugaauugaguuucaaacuuugaaagugcaaggauuuaauuuuuaaguugaaucccaugaaaggugucaucaucacuaggaauaacacccuuuguaacuacauauagaacuguuacaaugguagcagaaaauccuauugauuucaucucacccauuucagauaccuucagugaaauuaaggguagugugaugucccauguaauaaaacaggcuuagaacaucaauuccucugcugccauuuaugugcuuuuauucccccuucaaaaauuuuuuauuggauauauauauuuuucaguauucagacucugaaaucugucauuacaaucaagugcuugucacagcugaaagauuucugguggcuuaaaguuuacuagcaguaaauuuaugauaugguacaguucuuuguacagaaaggcaccauuauguuagaauaaauuuccagaacuuagugggaagaaucagguuuuaaccuugugugucuguuacuucugagugcauuucuauaauauaaauguugauuugcgucaacauuauaaaagagcacuucuguggcucauuuaaaagaaaaaaaagguuaagucuuuuaaauuuuggccuuguuuccaaauccugucuuccauguuguuuuucugcacuuccugaccacucuuauaaaaagcucacaaaccuuugaagaaacuggaguaggcuguuauuucauuaagguuuacaaauuaaaugcuugauuuuuaauguauucucuacuguuuugauuuuuggauuuucuuaauucaacauuugaagaugugccuuuuggguaauguuaaucacgaauguaguaauauuucaugauuguaauaauguuacaugaucauggguguggcauucucuaacaaaugaugugaaaggaaaguaguuuucauaaaacucauggcucugauugcacagucccacuugcuuuugauauugcuaugucaaagcaaagggcacuucuuuuaaggcuacuuucagaacuuuguauuuucgcuaaacuauaaaugcaguuguguccaguuggaggccaggguaccacaugucacaggcggccuuacaugugugccgugaaaagguucaaagaccguuaacaaaaaaguaagucuggccgggcaugguggcucaagccuguaaucccagcacuuugggaggccgaggcgggcggaucacuugagaccaggaguucgagaccagccuggccaacauggugugagaccccgucucuacuaaaaauaaaaaaauuagccgggugcgguggcacacaccuguaaucccagcuaccggggaggcugaggcaggagaaucgcuagaaccugggaggcggagguugcagucagccaagauagcaccacugcacuccaggcugggugacagagcgagacuccaugucaaaaaaaaaagaaugugggaacucaaauuuucauuuuuaauguaauccccaagauuuucuccaagaaauaaauuguuguuuuguauuuuguaacuuaaaagcagcuauugguaaauuucugagauauagcaggagaccaaaacauguuuggaaagagaauaaauauaugaagagagacugguuguuuuauuuucaauguauugaauauauuagacuacuauuuauuuucugaguggaugugauuaaauauucagacguuuaguguaugauuaagagugagauagagauuucuuuggaguaauuaaauccauccugucuuuuacacaauggacaaaucaaguuaaaaaaauuuuuagauagcuuagcuuguuuucuggugcuguugaccugcaagagaauauacuuuugcauauacaggugaaaguuuugcaauuuauguauacaagaaauuguaggcauuaaaaauauuuuauugauauuuuu

SEQ ID NO: 15192 - RNA, 971 nt, Homo sapiens
cuaauuauuuucaguguuuuugcuaagucgaaaugaccuuacagauccaagauaacucuccaaaagaagucaggacuaggaucccaaugaauaugaauaugaagcauauguucaucaguacaccaaaguuaugucaaggcugggucuguaugugaaauuccuuaauccauugccugagcaaaaacacagguuggcugcuccacauaaaacuuacuuucuaaacggggcaaaagaaguaagcgcgugcccccauccccggcacgcgugcaucugaguaggagguaagcgcacggcauguggccgaauuugaugaguaaugggcauccaagacaggaccacggcgcugcugugugcgccugcgcagcuucgcgagcgccuagacacaaguagcccaaaccccggcucgagauccgucuguucagcuguuguggcgccgccguuuuggaucuaagcgccuacccgugacacccagagaacccaggccuggcaaguaaacccucuacccccucacuuucucuacccagcgcucacaaggagcaacaagaugacaagaccgcgcgcccgggccaccagggaagccgcucucucgcuuagccacacccccuugguugcuaaaaugccuagucccugccccucgggucgacgccagcagccacguaucacguuuguacgugucucggccuaaaagcggaaguuacgcagggacucgcgagcgcuguggcggcccugaaaggauauaggccguggagggaagggggcgggcagacggcauaggaaggcgccggaaguggucccgcagaggcggggugggaguggggcucccgaggcagugcaguuggcuguagcugggcgccucgguuaggugcgcugucaguccuuuccgagugccuggcccagucucucccgccucggcccaacauggacuucagagaaauucucaugauagcuuccaagggacaaggugucaacaa

SEQ ID NO: 15193 - RNA, 4656 nt, Homo sapiens
cauuggcccuggcagcggugacgucacggggcuagcugacagaaccccggcgccgggcgcucgggagguauuguccgucccuccgggcuuuguagaaucgucgccggcuuaccuggccgugggcgcguccuggccgcugcagcccggagcagggugccagccgccgccgccgccgccaugguguccccggucacuguggugagugagcgagcgagcgagccagugcccggcgcggcuggagcccaccggccuggccaccggacuucggcaggccgagcugccgaaggggccgaggcggggcgggggucccguggcggccggagucccgcggcgggaggcgggcgcugucaccgccccccgcuccucagacucgcggcgccccuccucgcgcgcccccagcccgcccgcggagggaggaaaacacuggccacgugacucggaagcgugacuuuguugaucuccauguauuuggcgcgggucggcggggucgcggcccgggagagggaggggaccgcugccggccgcagaguuccgcguaggcggaccacagggaggcgugggggcgggggaugcugggaggauaacagggaccuccugggaaugccgucccaaguuuguuuccuaaccuuccucauuuuguaaacaaguuggcggacgccccugagucuaagaagcgcugauaacgcgcugggggaaaagggggcauucucuaugacauccccugcuuuucagacuuucucaacuugaaccuuuuguuucgucuccccauccuccuuauucuacuacuggguucccuauaacugucagggucucuccagcuacugccaguaucuccuucuagaaaauauggggcugggagaggccauggagcggagguuaaugcucccaggggcuggcaggugguugcugggcauugugggccugggcauccccuccagccgccuccucugaccaugccccuacccugaccagccuuaauuuccaugggaaguggaagucaucucuucucacugcucuuaccucuggcagaacaaggaaaggcuuggacccuggaaccacccauccgccucuucccaauccuccucaucacagucugaucaguccuuagguaccuggucgucuggacucugaguguuucccaaguccugugcugggcagcucaccuagccagagacacaaucgcuuugggcagaguguggguguacagggaacuccagcugcuccauaucacccucaauggaucuguuagcagcccaaggaaaggaguuucaaggaucacagauucagaacaucgcugcagcccccucccccagcuuggacucugccugcaguggccuuggguacaaccuuucuuuagcugcccucugcuaauccggcugagaccaagucagcugcucuaacuucccccucucaguuccccaucucccagccugucugcuggcuccagaucagaagcugggaauagaaccucuccccccuuuccugccucuuucugguguggcuugaguugcucuuguucucugggaaaugaggcugacugacacacacccucccuucccccaauccuugaaaucuuugguguuugaaggacaauuuucuugcucccaacucauggguccauuuaucuagccagcaucccuagcauagcccuccuugcccuugaugccaccuucaggcuggggcagguggaguggaggcugaggaacagacugguugaggaggagagaggcugugguggcugaggugauugccauugccugcuuucccacauuccuggcacacaccugguguugccagggcccuaaggcugcacccuggccccaugcugaggaucacgaguuggccagucagggugucucugugguuucccacugacuucacuccauuccagagugaacagcugggggcuguugcuggcagagaggaggggcuaaaggggcccugaggagggagaaggagggggcaggaagggagaagcacacuaggcugcagaagggugccccuccuaauauacugagccucagggcaguaauggguuuggccacaaccugcuggcugguagaggcaggccaggcuggguuucucugugucagucuucucagguuggggguggaagugagguggggguauggaugggagugucucugggguggaugccuaggcugagggugcuggcuuucaacccccaaguucugagugcugcccuuguccuguguccuccaggugaagagugaaggacccaaacuggugccguucuucaaggccaccugcguguauuuugugcucuggcugcccucaucuagcccaucgugggucagcacccucaucaagugccugccuaucuucugccucuggcucuuccuucuggcccauggccugggauuccugcuggcccaccccagcgccacccgcaucuuuguggggcuugucuucucugcuguaggugacgccuuccucaucuggcaggaccaaggauacuucgugcauggucaguggccauaguaguugccugggaggaguccuggggcugggggauagaggguccugggcugugggcaaagauuuggaagagggaguucuugaaccagaguguggggagccugaggguuucugaggccagggacugugaggguccuuguuaggggaugaccucgcaggggaacuagugaucaguuccagaguccuucaggggacuggggugguggucuuuaacuuuagaucuuccuaccccuguuaucccaaagcaaagcugcuggguuaucccaaacacuccacuccaucgccacauccaucccuacccccacccuguuacucauucuucaucaagcuugcccucagcugccuuugccccucuuacccccaggucugcugauguuugcugugacccacauguucuacgccucggccuuuggcaugcagccacuggcucuucggacaggucuggugauggcagcgcugucgggccugugcuaugcccuccucuacccaugccucucaggugccuucaccuaccuggugggggucuauguggcccuuaucggcuucaugggcuggcgagcuauggcagggcugcggcuggccggggcagacuggcgcuggacagagcuggcagcuggcaguggugcacucuucuuuaucaucucagaccugaccaucgcccucaacaaauucuguuuuccugugcccuacucucgggcgcuuaucauguccaccuacuauguggcccagaugcucgucgccuugucagcugucgaaagccgggagccuguggaacacuacagacugaccaaggccaacugaggugccagggucuggucaccccucucuccuccuggggcuggggcccagauccuggggaccugcaggagcuggaucaggauggcugcagugccagccuggggcagcagguacugccugaggaauuugcaaguucguguggggaggcuggaaaaggaucucccuagcagaacucgugguucaggacaaugcugagagcuaaaagagccagccuaauaucagacuggagccagaaguagacaucuccccaccucuacccuaucaggacuuucaaaaccccccuggaaggugauggugcucagcuucuugacacccccccacccacuuccccuaccagguggaagagucugacuccauguguuaugccuaggaccaauggcagugcuggguucacccacuccuccccuuuuucaucugcacaaaguugagggaaacgggagaaucugugcugagaagacucagacccaggagccccuuucacaggccccuaguugggaagacuggaugagaguggagccuccguuucuuuucccucuucuauccuuguuacuugaacaaucucagucucuaagugguggguggggacaugaagagguguggguccagguuaggcaggagagagaacuucuuuggucucggaguuuggggucucaagaauucaaguagccccaucucucucucgggcaagcccaaagcucaggucccauacgcuacccuuagauccuauccccagggcuagggugaaccaugccaaaggaaggggccagcuucucuguguguguguguagccugucuccuagucugccuaugucuuucucugcuauauguuucuguccugcugucugucaaaagucucacagagagagggccucagggagcugcugaggggugcugagccuggcucagggagcugggaccccuccccuccaacacacauacucacagugcuuuccuccuugucccuccuacacuaggagcaagaggagggggcuccaaugacacuccgggguuuuaagacccaaggcacauucaaugcaaggggagcaaggaugggacaacuccaucuucugcugcccaugugaaaaauaauaaaaaucaagagccauuggcugcccugcuugugggccuguguggcacaugccuaucuuggagagggcaugggggcauggugccagaggcucuggcuguccucacagccuagucacaguccugggcagugcaucuuggugccaggcuggcuaccuggcucuggugacacugugccgguuggagugugucucacuucccuggugugggugaggaugugguuuaggaggaugggggaugagugguauuugccacuguccaaauuuguccuug

SEQ ID NO: 15194 - RNA, 995 nt, Homo sapiens
caggggcaccagacugggguuucugagcauggauccaaccaucccagucuuggguacagaacugacaccaaucaacggaacugaggagacuccuugcuacaaucagacccugagcuucacggugcugacgugcaucguuucccuugucgcgcugacaggaaacgcgguugugcucuggcuccugggcuuccgcaugugcaggaacgcugucuccaucuacauccucaaccuggucgcggccaacuuccuccuccucagcagccacauuauacaucccuguuacaccucaucaauaacguccaucccaucucucuaauccucuagccugugaugaccuuucccuacuuggcaggccugaauauucugagugccaugagcaccaagcgcugccugucaauccuguggcccaucugguaacgcugccgccaccccacacaccugucaacggucguguguguccugcucugggcccugucccugcuguagagcauccuggaguggauguucugugacucccuguuuagugaugcugauucuguuuggugucaaacaucagauucaucacaguuacguggcugauuuuuuuauuugugguucucuguguguccagccugguccuaguggucaggauccucuguggaucccagaagaugccgcugaccaggcuguacaugaccaucugcucacagugcuggucuuccuccucugcggccugcccauuggcauucagugggcccuguuuuccaggauccacauggacugggaagucuuauauucucauguucaucugccuuccauuuuccugucgucucuuaacagcagugccaaccccaucauuuacuucuucauggguuucguuaggcagcaucaaaauuggcagaaccugaagcugguucuccagagggaucugcaggacacgccugagguggaugaagguggauggugccuuccucaggaaacccuggagcugucgggaagcagauucaggcagugag

SEQ ID NO: 15195 - RNA, 1023 nt, Homo sapiens
cucauggccccaaucugcuucccgacagcuucaggguuuccucaggaagcugcccuccaccuucauccaccucaagcauguccugcagagcccucuggagaaccagcuugagggucuuccuguuuugaagcugccuaaaggagcccaugaagaaguaaaugaugggguuggcacugcuguuaagagcagacaggaaaauggaaauuaaacgaacaacacaagguaagucauccaaauccuucucgauccaguauaauaggaaucacugaaugcugaggggcaggcugcagaagaggaagaccagcccugugagcaggauggucacauacagccuggucagcggcaucuucugggauccacauaugauccugacaagcaggaccagggugaacccacagagaaccacagauuaaaaaaaucagccacacagcagugaggaaaucuaauauuugacaccaauuaucagagucaacaucacuaaacaggaagcuacagaacauccacuccaggaugcucugcaacagggacagggcccagagcaggacacacaugaccgcugacagguguguggggcaguggcagcaguaccagaugggccacaggacggacaggcggugcucggugcugauggugcucagcaugcucaggccuguaauacaggcggagaacaacaccguggugacaaaucuagagaaauggauggagagagaacuaacaaagucacugaagaaauuaaugaauguuauaaucuggaagcaggugcagaggaagucagcccuggccagguugaggauguagagagagaagguguuacugugcaugcagaagcccaggagccagagcaugacugcauuuccugccagcccgaccaggucaaugaugaggaucagcacuaugaggaccaggaccuccaugccacaacgaugaggaugggucuccucuguaucacuaauuggugcaauuucuguauccaaggcugggaugguuggauucaugcucagaaacccuagucuggugccccug

SEQ ID NO: 15196 - RNA, 1129 nt, Homo sapiens
gaggaaccacugagacauuccugaggugcaacgcuaagaaaaacacaugcaauugucaaggauggcagggcaguguugcucucaaagucccaucugacaggacagaggcucuuccucacugcccaaaucugcuuccugacagcuccaggguuuccucaggaagccaucguccaccuucauucaccucagucguguccugcagagcccucuggagaaccagcuucagguucugccuauuuugacacugccuaaaggagcccacgaagaaguaaauguugggguuggccguuaagagaggaaaggaaaauggaaacuagaugaacgugacaauauaagacuuccaaauccacgugguuccaugaaaauaggaaaaaccgaaugccaaagggcaggccacagaggaggaagaccagcgcuaugagcaggauggucacguacagccuggucaguggcaucuuccgggacccacaaaggauccugaccagcaggaccaggcuggaaccacagagagccacacauaaaaaaaucagccccccuacuaugaugaaaucugauguuuaacaccaaacagaaucagcaccacuaaacaggaagucacagaaacuccacuccaggacgcuccgcagcagagacagggcccagagcaugacacacacgaccgcugacagguguaggggcgggggcggcagcgcuaccagaugggccacaggacguacaggcagcgcucggugcucauggcgcuuagaaagcucaggcuugcaagguaggaaaacaucaucacagggcugaggauuuugaagaugggauggaggauauugaugaggcuuaacggaaaacguauaauguggcuucugagaaagaggaagucggccauggacagguugaagauguagauggagaaggcguuccugcgcaugcggaagcccaggagccagagcacgacugcauuuccugucaucccgacaagggaaacgaugcacgucagcccugugaggcucaggguuugcuuguagcaaggagucuccucacguccauugauuggugucaguucuguacccaaggcugggaugguuggauccacgcucaggaacccuagucuggugucccugggaacacaaaccagagguga

SEQ ID NO: 15197 - RNA, 1129 nt, Homo sapiens
ucaccucugguuuguguucccagggacaccagacuaggguuccugagcguggauccaaccaucccagccuuggguacagaacugacaccaaucaauggacgugaggagacuccuugcuacaagcaaacccugagccucacagggcugacgugcaucguuucccuugucgggaugacaggaaaugcagucgugcucuggcuccugggcuuccgcaugcgcaggaacgccuucuccaucuacaucuucaaccuguccauggccgacuuccucuuucucagaagccacauuauacguuuuccguuaagccucaucaauauccuccaucccaucuucaaaauccucagcccugugaugauguuuuccuaccuugcaagccugagcuuucuaagcgccaugagcaccgagcgcugccuguacguccuguggcccaucugguagcgcugccgcccccgccccuacaccugucagcggucgugugugucaugcucugggcccugucucugcugcggagcguccuggaguggaguuucugugacuuccuguuuaguggugcugauucuguuugguguuaaacaucagauuucaucauaguaggggggcugauuuuuuuauguguggcucucugugguuccagccugguccugcuggucaggauccuuugugggucccggaagaugccacugaccaggcuguacgugaccauccugcucauagcgcuggucuuccuccucuguggccugcccuuuggcauucgguuuuuccuauuuucauggaaccacguggauuuggaagucuuauauugucacguucaucuaguuuccauuuuccuuuccucucuuaacggccaaccccaacauuuacuucuucgugggcuccuuuaggcagugucaaaauaggcagaaccugaagcugguucuccagagggcucugcaggacacgacugaggugaaugaagguggacgauggcuuccugaggaaacccuggagcugucaggaagcagauuugggcagugaggaagagccucuguccugucagaugggacuuugagagcaacacugcccugccauccuugacaauugcauguguuuuucuuagcguugcaccucaggaaugucucagugguuccuc

SEQ ID NO: 15198 - RNA, 59296 nt, Homo sapiens
accgcagcggcggaggugagggcgccagcaggaagugggagaagaggcgacccaaggcgggcuggcgggcuggcggcagucgcuacuugccuaguagccucagccgcugugggcuccuggggagauggaggggccggggcugggcucgcaggugagugcggccgggcgguggcuguccugggggccgggagagcggcugcagcuguggaggaaaggauggugugggugagaggccgcucgaugaggggguuucgggagcggcggggccuaggucugggaagcgggagccuggaaacaccacgaacgaugcuggaaauugucucugaggcgacugggaagaaaaggcgaggacugaggggugagggcccgagccggccccuccagccuccaucccuggccagggcgcccccuggggccgguacccggagcccggcggggaccucugugggccuggggaggggacgauggcccuucccgggagaggugucaggugacacaccugauucggacccgcccgucuugacguuggcccggagucggagcgguucuguugauuucuuuuucagcccuggcgucuuagcacccgccuucaccccacccaguccaguuuucgcuccuguuuccgcauccuugcuuacuccuugaaauaauuaaggcugcuuguuuaggauggaggaaaggggcguggagaggggagguacaccacagcgaucugcagaaucucaaaggacaauauuccguggaggagguguuauauaaaagccagacggagguccaaagaagccaggcgggccagucggagaaguuacaggagguagauguugucuccaagaaaacaagauuuuugugcuuuuugcuuauggcccuuuccuagugccuagaguacugacuaguauauuguagacguucacuuaauauuuauugaauaaaugcagaauuuccagguucagccaguuuuagugagugcauaacccaugucagaugcuuucauaugcauuauuuuauuccagaauugaagcauccuuaagaagauauuauccccauauacagaugagaacgaacacuaaagcugucuucagcuggaaucaguuaggcgguagauucucaguuugggaugauuggauuaccugaucucuaaaaacguuuuuccagucccgagaguguuccucaugcuuucccuuucccuucuuucagcacgaucuuguguagguuuaagugagggacaagaugucuggggaaaugucaagguguucuuauugguuauucuugaauuuuaacagaaaaaaaauaguucucaggcagacuggauuuuaccaaaggguguugaaucuucacauggaaacagcgccucauucuuuuucucagagaggcucaaagaaaaguugguaggaguaacuauuaugucuuaauuacugccacucauuuacagaaggcuucaagugcuuaaaguucacucucucaugcugaagggaagauuagccuugucccaguuccauggccuauagagagggagagaaugauuuggugguugaauuuaguagggaaagguagagagaucauugucguuguuaauaauaauugcucuuguucacuuuuucaguaaugugaagaccucaccuauauauacugcuuugcaguuugcaaaauacuuccccauuuuugauccucacuauaauccucugagguggggagaaaugauuauucugauuuuagaaaugagaacagaggcucagaaaacuggaaucacuugcuacaagucaaauagcugcuaagugauagagccaagacuucagucguucauucagcaaauguguuuugaaugucugccaggcaccguuuuaggugcugugauaaauuagugaacaaaacagacaaaaacauuacugcucucauugaauuugguucuuuugauuccaagaucggugcuguuggauuuuugccaggauuugccuauacaaucaggucugcaguuuccuuucugaccucaucuuuuuuuucuuuuuucagacagagucuugcucuguugccaggcuggagugcaguggcgcgaucucggcucacugcaaucuccgccucccggguucauaugauuccccugccucagccugccgaguagcuggaacuauaggugcggaccaccacacccugcuaauuuuuuguauaguaagaugggguuucaccauguuggccaggauggucucgaucuccugaccuugugauccgcccgccucggccucccaaaaugcuggcauuacaggcgugagccaccgcucccagccugaccucaucuuuuacugucuugcuugcccggucauccccagccacaccagccucagagucuuucauacuuacuucuggaaugcucuuuccuugugugcccacuuggcuuauucccccaccucuuuaaagucuugacacaaaugucaccucuguguggcauucugugacccccguauuuaaaauugcaagccuuuuccaucaucagcacuaccagcaacacucccuggccuccuuccuugcuuuagauuucuccucagcauuuaacaccauuuaacguacuuauuggucuuguuuauuguuucuuucuccuccacugaauguuaguacuauagggacagugauuuuugucuguuauguucacugcugugugccuggcaucuggaacaaugccuagcacuggugaguacucuguaaauacuugucaaugaaugaacuuggaaacuaaacucugguacuucuguuaaugagaacuuuaaugacaugagaacuuuuaaugagugucacauauuucucucucacucgcuccuucucucucacucucuuuuuauucgauaaucuggcaggauaaugccugucauuggaguuuaagugugguuuucuaaaucuugauuuuggcuuaaauuaaugcccacuguaacuuuaacaauucuuauauacaauuuagaaaaauaaucucauucaugacaucucugugugagaaguauuacaugaucccucagagcuuaaagaugcccuaguuauuuauuguguaagaaaccaccucaaaacauagugguauaaaacauggcuuugucaugcucauggacucugugugucagggacuuggagagacugcagcaggguugguuuguuucuguuccaccaugucuagagccucagcugcaaagacucauaagcuggagaugaauugagagcuggggccaguaucuaugagugucuucacuuacaucuggcaguuaacuuucaguagagacaccuacacgugaccugggccucugcacaguauaguggcugaguuccauuagugaccaucuaaugaaagagccaggaagaagaagcugccaguuucuagggccugagccugcaaacuggcacagcaucacuucugaaauauauuauuugugagguagucacaaagcucagagucaagaggaagggacauagaccuuuaccucuugauggagaaguagcaaauaauuuugaggcuauguuguaaaaauuaccacacauguauucauaugucuguuagauaauuuucauaauaucuuguucugcuuuucacucuucuguggaggacagugagcuagcuacauauuucuuucuugguaucucucuuuuuucccucuuuaaauuuuuuuucccuuuguaucuuaauuaaaacaaaaacaacaaaaaaaccauuuuauucuaguaucuugaggugguuguagacuggaauccuaggaagacgagaggaaguaaaauggaauagaaucauagaauacuuggagcuggaaggcuuuucagugaauuaccuaguugagagauucuuaaacuggcauauaggauaagcuucagggcguuagugaacaucuugaaauuagugaacaucuugaaaaguuaguuuacaugugcaguugugcauuucucuuaaguagagaggccuuaauuuugguaacauuuucaaaaagguccaugacauuuggaagguuugagaaccauuuaucuagucuagcccuuuaacuuuucccaugaauucaagacgcaaaaauaauaacuuacuuuccaaagguucauggcaaguuagcagagcccaggugucagggcuccugaugcagugcauuuucauugcuagucaggugguccagucaugauacgaucuuguuugauuguuugcugccacuuggaguccacccauucuuuaggucaaggucugaggaguagucuguauuuuacucugcucugaaaauggggaagggaguauaucccuaacuagaauauaaguuccuugaaaaccaaggaccuugucuguuguucauugccauguugcugugucuacaauagugcccagcacguaguaggcauucaguaaaugucuagaaugaauguauuauggaaggaacugugucuuauucaucuuuuaucccugauuaccuacuucugugauuuguauagguguucuuuauauuucccugaaugaauaauugaugaaaacucuugggaguuggcuggcaucaugagaauuugcuuagucuguucuguuaccuuaacauuguaggcagccauguagcaguuaagcuucuuuauccauguaguguguuuguucauacaguaaauucuuuaccaguucacaagucaauagugacuauuguaauagcucaccuuaggaccaugcaacaugagacuuagaaggagcuuuauggguguauugauaugucccuuucacuuuaccaacguagaaaugagccaaaaauagaguagaugauucaccacuaucauacagucaauguggcaguaccaggaauuugguuauuuggcccgugucaucagugcaaucaggagagauuaggcugagagaauacuguggaagcagggacucaaugugucuucuucccuaucuuuugagacucaagguuaccugucuucuucucuguuguguccuugcccuccuuuuccugaccuugcuucacagaaaacuucacagaaaauaaaaauuucagcucucuucuguuugaacauggggauaggagcuggcggccaauuucauauugucgugggucauguuauuguaggauuugacauguauuucuaaauuauauucauuaacuaauagcucaguauauguucauggcaagauuugaauuaaagauggugguuauaaaucugccucaauuuagccucuugacaauuuugaauuuuuuccaaggggguacugacuugucagauuggauuagaucaucuuuguuuauacuucaugugucugauaaagaguuccugaucugcuauuuucuuauuugcuugugcuuauuauuauuauuauuauuaccucaauucauggcuucuuuguagaaaucagcuuaagcuacuugcucauuuugggagagguaauuuaguuaaaauuuaacaauauaauuugaaaauaaucuaauauauauuguaaaaugcugaagguccuacugucaacucucuguuuguggaagcuuucucugcccuuagguuaccuuguaaacagaguauaaggagugaccugcuuggcauaucaauaaaugagacugccaucguuaaaaauuaguaaagcuuuccugccagcagaggugugcuaaaaagaaaaaauaaauuugguaaagcuuuaaaaacucaaauuuguaaauuuuauuuuuccuuuuuaaguaaaaagauaaaaaauuauuauaauagaagcuuuaacauuuucucacauuaccuagugggucacugcauauauggcuuugaguguacuuuccucacuuuguagaugauugacuucaaacacaagcuuugaauauagucauuuuuagguuuuacuuugaucugcaugcggguaaacaaugaugacaugaacggaagauaucuucuguuuucuaguuucuuaaaguugccauuuaaucauauauaaucacauauugccugcuauuauuauuucacucugucucugacauaucucccuuauuagacuuaaauuccuggaggauagacacccaugucuuauaugcccuuagcguaauuguacaucauaaauacacaguaauuaauugccgacuaaacaaauauucucaauuguggauauucuucacauuaaaacauguaaaccuccucaacuuuauacaugaaaaauaaagcugauguccuuaaugccuuaaaauaguauaagaagcaacaaauuuguaucuagaaugagucaguuuucugugaugaaaaaucuguguauaaacaaagggucaggguggggugugguggcucaugccuguaacccuagugcuuugggaggccaagacggaaggauaacuugaggucaggaguuuaagaccagucugggcaacauaacgagaccagucugggcaacauaacgagaccuaucuacagaagaauaaaaaaaucagcagggugugguagugcuugcuuauaguccuaccuacuacggugggucaggugguagaaucacuugagcccagcagauagggcuguagugagauuugauggugccacugcacuccagccugggugacggaguaauaccccaucucaaaaacaaaacaaaaaaggcuuaaucuuucuaaccuacaaagagaaacagauaugugcaauucauuagaaaaacaaguagacuaugaaaaggcaauccacaaaagagaaaauauggagagccaguauaccuaacaacaacaacaacaacaaacaaaacacucagacucauuagcaacuaggggaguacaggugaaagauaggaugccauuuuuagccaucaaagugucaagguuguaaaaagauugauaauauucaguucugggaagguuuguagggagaaagaacacguauauacuuugcuauugggacugugaauuggggagaguauuuggucagaaucuauuuauguuuaaaaugcacguuuuuugacucaacaguccuacuuugaggaaucaauccuauagaauuagaaugcccaggguguugauuguguauagauaugaaaggcugaaaucaaccugugucucuaaccaaaggggaguguugaaugaauuauacuagaucuauauacaauggaacaauagugaaauauuacugaacugcaggacuguacaugauauauuguuacaugagaaaagcaaguugaagaauaauguauauaaugugauacuauucuuuguucaauaaguauaagaagaaaaugauuaaaaauguggauguauguauguauauagcacaauauuauauauguuaaaauauauauacauaaugagggaagaugcacccaauuguuaauaaugguuaucucuggugguacaguauugaagaggaaagaguccggauuguuaacccuguauucacuucuguauugcuagaucuuuaaaauuaauauguuaucauuuuaugguuuuaaaauucuaguaaaaauuuuuuauauaaaaauacacugauuuuuuuugucaaucuuagcugcacuuuuuguuauaccuguuacuuauugagauucuagaaauuuuuaguauaguucaacucuuuuccucaacccuuugccuucuuccaauugaauauaauuacugugauaucaggaaaagcauccuaaaguaauguuuuuauuuacauuuuaaucuaacuaccuacauguuuauuuuuagcugugugugauucugcguguguguggggggguacugauuauuuaccagauaaaucagaauuuaccuauucagaaaagcagguggacugaagaagaaaaagaccggaauucaaaaaccaccaaaucaguagcugauuuaccuuuuuucucucugauuugcccccagccuugacuugagcccuggaaauaagcaucagugcagacgagugcucuaugagaagcuaucuaguuaaagcucaaggagccacaaagggauuuccuggcagcacagucaccagaaacacugagggagaacucucugaacagaggaauugugaccccaagacaguaguuuuuagacgugacaccaaaagcacaauccauaaaagaacaaauugauaaauuggacuuuuuuaaaauuuaaaacuucugcucuaugaaacagacuuuuaagagaugggaagguaagguacagaccaggagaaaauaucugcaaaucacauaucugacaaaagacuuguaucuagaauauauaauauaaagaacucucaaaacuuaacaguaagaaaacaaacagcucaauuaaaaaauggacaaaagacuugaacagacacuucaccagagaagauauacagguggcaaauaagcaugugaaaagaugcucaacuucauuagccguuaaggauaugcaaauuaagaccaugaugagaugccccuauacaucuauuagacugacaaucccaagugcuggugagaaugcagaacaauuguaacucucauaguuguuaguggcaaugcaaggugauauagccagucuggaaaauaguuuagcaguuucucauaaauuuaaauauaccuaacauauggccaagcagucuuauucuuagagaaaugaaaggauguucacacaaaaguuuguccacgaauauuuuuagcagcucuguuuaugauugccaaaagcuggaaaacaacccacgcagacuguuuggauagauuaucugugacgcacccauauagugggauacuacacagcaguaaaaaagaaggaauuauugauaacauacaacaacuugguuaaaucucagcaccauugugcugaguggaggaagccccuccuaaaagauuguguacuguaugauuccauuauaugacauucugggaaagacagaauuaaugacaacagaucagugguugccaagaguugguugggguuacgggaggguaugacugcaaaggaugaugguggcgguuacgugacuccauacauacauguguuaaaauucauacagcuguauaccaaaguuaauuuuacuguaaauuaacuuuuuaaaaacagugccccuucaaaauaaucccuugagggauuauggacucauuuaaguaaaacugaaaauuuuaaaacuuucuuuuaaaaacuuuuguuuuagguuuggggauacaugugcagguuuguuauauacacaaacuuaugucauggggguuuguuguauagauuauuuccuuacccaaguauuaagccuaguacccaguagugauuuuuucugcuccucucucuccucccacccuccacccucaaguauaccccagugucuguuguucccuucuucuuuuuuucuuuucuuuuucuuuuuuuuuuuugcaguggagucuugcucugucacccaagcuggagugcaguggugugaucucggcucacugcaaccucugccucccagguucaagugauucuccugccucagcuucccaaguaacuggaacuauaggcacauaccaccacccuggcuaauuuuuuuuuuuuuuuuuuuuuuuuuuuaguagagacggaguuucaccauguugaccaggcuguucuugaacuccuuaccucaagugaugcacccaccuuggccucccaaagugcugagauuacaggcaugagccaccaugcccagccugcuguuccuuucuuuguguucaugaguucucaucauuuagcucccacuuauaagugagaacaugcaguauuugguuuucuguuccugcauagggguaauagccuccagcuccauucguauuccugcaaaagacaugaucucauucuuuuuuauggcugcauaguauuccaugguuuauauguacuacauuuucuuuacccaguuugucauugaugggcauuuacauugauuccaugucuuugcuauugugaauagugcuacagucaacauucacauacaugugucuuuauaguagaaugauuuauaguccuuuggguauauacccaguaaugggauugcuggguugaaugguaguucugcuuuuagcucguugaggaaucgccauacugcuuuccacaaugaacuaauuuucacucccaucaacaguguauaagcauuccuuugucucuguaaccuugccagcaucucuuauuuuuugacguuugaauaauagcauucugacuagugugaagugguaucucauugugguuuugaguagcauuucucuaaugaucagugauguugagcuuuuuuucauaugcuugcuggcugcauuuaugucuucuauugaaaagugucuguucauguucuuuaccuacauuuuaaugggguuuguuuuuguccuguaaauuuaaguuccuuauagaugcuggauauuagaacuuugucagaugcauaguuugcaaauauugucucccauuuuguaggaugucuguuuacucuguugauaguuuauuuuacugugcagaagcucuuuaguuuaauuagaucccacuuaucaauuuuugcuuuuguugccauugcuuuuggcaucuuuguuaugaaaucuuugcccauuccuauauccaggaugguauguccuagguuuuuuucuaggguuuuuauaguuuuggauuuuacauuuaaaucuuugaucuaucuugaguugauuuuuuauaugguguaaggaaaggguccagcuucgauuuuucugcauaugacuagccaguaaucccagcaccauuuauugaauaaggaggcuuuuccccauugcuuguuuuuaucagcuuuguugaagaucugauagucauaggcgugcagccuuguuucugggcuuccuauucuauuccauucaucuaugugucuguuuuuguacugacaucaugcuguuuugguuauuguagugcuauaguaucguuugaagucagguaguguaauuccuccagcuuuguucuuuuugcuuaggauugccuuggcuauucaggcucuuuuuugguuccauaugaauuuuaaaauaguuuuuuccuaguucugugaagaaugucuuugguaauuugauagggauaacauuaaaucuguaaauugcuuuggguaguauggccauuuucaugauauugauucuuccuauccgggagcaugggaugucuuuucauuuguuugugucuucucugauuucuuugagcaguauuuuguaauucucauuguagaggucuuucaccucccugauuagcuguauuccuagguguuuuauucuuuuuguggcaguugugaaugggguugccuuccugauuuggcucuuggcuugauaguuguuguauuggaaugcuaacgauuuuuguauguugauuuuguauccugaaacuuugcugaaguuguuuaucugcugaaggagcucuugggccaauacuauaggguuuucuagauauagaaucauguuaucugcaaacagcgauaguuugacuuccucucuuccuauuuggaugcccuuuauuucuuucucuugccugauuguucuggacaguacugccaauacuguguugaauagaagugcugagagcaggcauccuugucuuguaaaaacuuucuuuaaaauuaaaaauuucuaaaaaauauuuaaaaacugucuuuuaaaaaugaaauuuaagaaacuuucauucuuaaaacuuuuuggaacucuuggagaauugacuuuggcacauuauuucaaaugucuucaauuuuuuauucucaauuguguauucauccuuagagaaugauuuucuuuuuaaacugaaaaguucauggaaauagguuuggugauaagguaggugaaagcuagguaacuuuauugaugguaaaaagcaagaugagauuaaaaaauaaugucaguuuucauuuauagcaauuuucuagggacaguuauauaucccacaauguuucgaucaacgccagaccacacauaugauguugaucagagcaguaguuuauaucaucuagccuaaguguguaauaugcuauacugcccaggucuguguaaauacacauugugauguuugcacaagaaugaaauagccuaaugauauguuucucagaauauauccucauuguuaaugaaagcauggcuauauuugauguaacccucccacugaacacaccaaaaaaugcaggguacaguauaaaagcauuugaaguauuuuaccuuuuugaugcuaguguaaacauuuuuuuaaagauuccuuaggauuuucuaugcauaugaucauguuuuugcaaguaaaaauggauuuacuucuuuucuaaucuguaugcauuuuuauucuuuuuccuauuuuauuaugcugucugguacuuuaguacaguguuaauuagaaguggugauaaugagcauauuugcuuuguuuccagucuuggaguaaaaauggucuuguaccauucagugugaugguagcuguagauuucuuguaaauguucuuuauucgauugaggagguucccuucuuuucccuuguguugaaagauuuuacaaauuuugucauaugcuuuacauaaagaauuuucauauaaagaauuuuguuaaaugcuuuauucuacugugaugaauauauauuuuuuacuguuuuauauuugaauauauauuuuauucuguuaauaugaauauucaccuuauuuauuaauaugguggguuacauugauuuauuuugaaauguuuaagcuggguuugauguauagucuuuuuuauauauuacuggauucaccuuacuaauauuuuguuuaggauuuuuguaucuguguucaugagggauacugggccuauaguuuucuuuacuuguaaugucuuuguugguuuugguauguagugauucugccucauaaaaugagcugggggccgggugcggucgcucacaccuguaaucccagcacuuugggaggccgaggcggguggaucaugaggucaggagaucgagaccauccuggcuaacacggugaaacccugucucuacuaaaaauacaaaaagccggaugugguggcacgcaucuguagucccagcugcucgggaggcugaggcaggagaagggugugaacccaggaggcagagcuugcagugagccgagaucacgccacugcacuccagccugggcaacagagugagacuccgucuuaaaaaaaaaagagcugggaagcauucucucuucuguuuucugaaggaguuaguaucauuucuuccuuagauauuugauaggguuaacuaauuaaguuauaggggucugaaauuuuuuaugagaaagauuuucauuaugaaucaaauuuauuuaauagauauuauguuauuuauuacuuuuaagauccauuuugauaaugugugucuuuuaagguguuuguauauuucacuuaaguugcuaauuuauugacauaaaguuguucaaaauauucccuuuuuauccuuucaaaauuuguaggcuuuuggagugaugucucuuuuuuaaaccugauauucgucauugauacuuuuucauuuuucuugaucaaacugaucaaagguuuaucacuuuuauugacuuauucuuucuagagagccagauuucggcuucaaugauuuucuguauuguuucucuguuuuauaguuaacgaauuccuucuauuuuuauauucuucuucuuguauccacuucgaguuuaauuuucuuucucuagguuauuaacgugaaagcuuagauaacuuacuguaggcccccuuuuuuugguaauauaagcauuuaaagcuacaaauucccuguaaacacugcuuaggcugcauacuaagcucuuuaaaacuguugugcuguugcuuucuggcuugccuuaugucugaugagaagucugaguguauucuuaucuuugcugcuuugaacauaugugucugauuuuuccagacugguuuuuuuuguuuuuuuuuuuuugaaagggaauuucgcucugucgcccaggcuggaguacaguggcgcgauaucggcucacugcaaccuccgccuccugggcccaagugauucuucugccucagccucccuaguagcugggaccacaggugcgugccaccaugcccggcuaauuuuuguuuguuuguuuguuuguuuagauggagucucgcuuucucacccaggcuggagugcaguggcgcgaucucggcucacugcaagcuccgccucccggcuucacgccauucuccugccucagccucccgaauagcugggacugcaggcacccgccaccaugcccggcuaauuuuuuguauuuucaguagagacgggguuucaccauauuggccaggcuggucucgaacuccuguccucgugaacugcccgccuuggccucccaaagcguccagacugauuuuaagaucucuuuauuacugauuuuuagugauuugauuaugauaugucuugguguaggauuucggggcuuauccuacuugggauccauuaaacuuguaguuacugugaguuuauaauuuucgccaacuuuggaagauuuuugguauaauuucuucaaauauuaaaaaaaacuuuuuuccuugucuucuggaacugcaauuauacaucuucagucgucuucucucugugcugcauuuuggauacuuuuccuuguuguuucuucaauuuaaauggucucuucuucuauacuguuuaaucugcuguuaaucuaaucugguguaauuuguauuuuagagauugauuuuuuuuuuuucucuuuugagacagagucucacucuggugcccaggcuggugugcaguggugugaucuuggcucacugcaacugccucccagguucaagugauucuccugccucagucucucgagcagcugagauuacaggcaugggccaccaugcccagcuaauuuuuguauuuuuaguagagacgggguuucaccacauuggucaggguggucuugaacuccugaccucaggugaucugccugccucggccucccaaagugcugggauuacaaggagauugacuuuuauccgcagauacucuaaccugaucuuuugucauaucuucaauuucuuugcucauuuuguuaauguuuuccuuuaaauacuuauacauacuuauauuagcuguuuuaaugucuuuuucagcuaauuuugucaucuuuauaguuucaagaucugguucuuuucuucuggcuauggaucgcauuuuucuugcuucuuggcauguuuagugaguuuugauuugauaguggacuuugugaaugcacguugaugaguaucugguauuuguugccugucuuuaaagacuauuggauauuguuuggcaggcgguaaaguuaauguugcucaauuugaguccuuugaagucugauuuuaggcuucucuagagugguucugguguagucuuuauuccagauauaguucaucccuacuucuaagguguggcccucugauaucuccacugaauaacccaagggaucaucaaagagucuccgcuuuggcugaucagaguuugaacaucuuccugcuacguauaaacuccaguaauuguucaguuuacaaaucuccauuuuuugccuauccuugucaaguuucccuguauacauuacuuguccuaguacucugcaaagacucagugggccuccuguacagauuuuuuggagcccccuuuuuucugguuggcucacuucucucuugaaaugugcccacaacugccagcuaucucagccucucugaucucaaauuucugucuccucaauuuagcaaggcugcugggcucuaaaacaaaguguuuuccucucagugcccaugauugcaaaauugcuggggugaugguggggcucaccuuguguauuuguuuuguuuuguuuuuuucucauaucuuggcaaucacagucuuacuguucucauuguccaaagucugaguacagguuacuucauauauuuuguucacuuuucuagguuucuuuauuauagcaagaaagcaagagguuaagugcaauccuacuuaucccaucaugcacagaaguagaaggcucuacuucauuuuuaacuuaacauauagccaacaaggaguaaccagaauuuauaagggcuaccauucaagaagaaaaagagagaaacccaguaaaaacacaaaaauggacaaauugcuuaaacauguacuuuauaaaagaagaacucaaaauggccaguaaacaugaagaaauacacaacuugauaauuauagggaaauacaaauuauuaucacuacaagauauguuuacacauucaucagauuggcaaaaguuauggagucugaugauaccaaguauuaguaaggauuagagcaacagaagcacucauacccuucaggggaaaguuuaacugguacaaccauuuugaagaugaguuaagcauaucuucaaagccaacaguuccacuuccagauauaugcuuuugagaauuguuuacauauauauauauauauacccacacacauauauauacacacacacacacacacacauauauauauauauaccuagagacauguacaagaauacucauagcaauauguuuuuuuauaauagccccaaacugggaacaguccaaauauccagccauaguaaaauagauaaauuaauuguaguauguuacuguauuggaauguuauacagcaaugaaaaugaaccuguuguagcuuucauaacaacauggaugaagcuuguaagucuaauguuaagcaaaacaaaugauagagaauacguaugauagauuccauuuguacaaaaauuaaaaaauguaaagcugaacuguacuuuuuaggguugcauacauuagagauaaaacuauaaagaaaagcaaaaaguaauuauaacugaagucaggaaacuguucuuuuaguguggggaugugguggagcauagcauguguccgggcagucuucuaaggugcuggcucaguucuauaucuugacuuagguagugguuucauggagguucauuuuauauuuauucuuuacucuuuacgaaagaaguccauauauauauauauauauauauacacguauguguuuuauauacuucagucuuuauaauaaaucauaauauuuucagauauucagagguuaaaaauaugagucucuuuuauauggcucugaggacaguuucagaaaggaaauucugaaaacauuucaaggcaaugcuauuggaauaacuaauaaucuccugaggagacuauuuugaagauauaauuucugauacauuuauuuaaaaaucagcuuuuuaaaaauuguagauagguaacuaaauuugcuuauuaagcacuaauucaggucaggugugguggcuuacaccuguaaucccaguacuuugggaaacagaggcaagaggaucgcuugaggccaggaguucaagaccagucugggcaacauaguaagacucugucucuacaaaacuaaaaacuaaaaaauuagcuggguauaccaaaggauuauaaaacauucugcuauaaauauacauguacacguauguuuauugcagcaccauucacaauagcaaagacuuggaaccaacucaaaugcccaucaaugacagacuggauaaagaaaauguggcacauauucaccauggaaugcuaugcagccauaaaaaagaaugaguucauuucuuuuguagggacauggaugaagcuggaaaccaucauucucagcaaaguaacacaggaacagaaaaccaaacacugcauguucucacucauaagugggaguugaacagugagaauauauggacacagggaggggaacauuacacacugcggucugucaggggguggggggcaaggggagggauagcauuaggaggaauacguaauguagaugacagguugaugggugcagcaaaccaccauggcacauguauaccuauguaacaaaccugcacguucugcacauauaucccagaacuuaaagcauaauaaaaaaaaauuaaaaagaaaaaaauauuaucuggguaugguggcaugcgccgguagucucagcuacuuaggaggcugaggcaggaggauugccugagcccuggaauucgaggcugcagugagcuaugaucacacugcugcacuccagcgugggcaacagaggaagacccccucccaauaaauaaauacaucuuuuaaaaaaagugguaggagccaagauggccgaauaggaacagcucuggucuacagcucccagcgcgagcgacgcagaagacgggugauuucugcaucuccaucugagguaccggguucaucucacuagggagugccagacagugggcacaggucagugggugcacgcacggugugcgagccgaagcagggcgaggcguugccucacuugggaagcacaaggggucagggaguucccuuuccuagucaaagaaagggaugacagauggcaccuggaaaaucgggucacucccacccgaauacugcgcuuuuccgacgggcuuaaaaaacggcgcaccaggagauuauaucccgcaccuggcucggaggggccuacgcccauggagucucgcuggauugcuagcacagcagucugagaucaaacugcaaggcggcagcgaggcuggggaggggcgcccgccauugcccaggcuugcugagguaaacaaagcagccgggaagcucgaacuggguggagcccaccacagcucaaggaggccugccugccucuguaggcuccaccucugggggcagggcacagacaaacaaaaagacagcaguaaccucugcagaguuaaaugucccugucugacagcuuugaagagagcagugguucucccagcaugcagcuggagaucugagaacgggcagacugccuccucaagugggucccugaccucugacccuugagcagccuaacugggaggcaccccccagcagggguagacugacaccucacauggccggguacuccaacagaccugcagcugaggguccugucuguuagaaggaaaacuaacaaacagaaaggacauccacaccaaaaacccaucuguacaucaccaucaucaaagaccaaaaguagauaaaaccacaaagauggggaaaaaacagagcagaaaaacuggaaacucugaaaagcagagcgccucuccuccuccaaaggaacgcaguuccucaccagcaacggaacaaagcuggacagagaaugacuuugacgagcugagagaagaaggcuucagacgaucaaauuacucugagcuacgggaggaaauucaaaccaaaggcaaagaaguugaaaacuuugaaaaaaguuuagaagaauguaugacuagaauaaccaauacagaggagugcuuaaaggagcugauggagcugaaaaccaaggcucgagaacuacaugaagaaugcagaagccucaggagccgaugcgaucaacuggaagaaaggguaucagugauggaagaugaagugaaugaaaugaagcgagaagggaaguuuagagaaaaaagaauaaaaagaaacgagcaaagccuccaagaaauaugggacuaugugaaaagaccaaaucuacgucugauugguguaccugaaagugacggggagaauggaaccaaguuggaaaacacucugcaggcuauuauccaggagaacuuccccaauguagcaaggccaacauucagauucaggaaauacagagaaugccacaaagauacuccucgagaagagcaacuccaagacacauaauugucagauucaccaaaguugaaaugaaggaaaaaauguuaagggcagccagagagaaaggucggguuacccacaaagggaagcccaucagacuaacagcagaucucucggcagaaacucuacaagccagaagauagugggggccaauauucaacauucuuaaagaaaagaauuuucaacccagaauuucauauccagccaaacuaagcuucauaagugaaggagaaauaaaauacuuuacagacaagcaaaugcugagagauuuugucaccaccaggccugcccuaaaagagcuccugaaagcgcuaaacauggaaaggaacaacagauaccagccgcugcaaaaucaugccaaaauguaaagaccaucgagacuaggaagaaacugcaugaacuaacgagcaaaauaaccagcuaacaucauaaugacaggaucaaauucacacauaacaguauuaacuuuaaauguaaauggacuaaaugcuccaauuaaaaggcacagacuggcaaauuggauaaagaguccagacccaucagugugcuguauucaggaaacccaucucaugugcagagacacacauaggcucaaaauaaaaggauggaggaagaucuaccaagcaaauggaaaacaaaaaaaggcagggguugcaauccuagucucugauaaaacagacuuugaaccaacaaagaucaaaagagacaaagaaggccauuacauaaugguaaagggaucaauucaacaagaagagcuaacuguccuaaacauauaugcacccaauacaggagcacccagauucauaaagcaaguccugagcgaccuacaaagagacuuagacucccacacauuaauaaugggagacuuuaacaccccacugucaacauuagacagaucaacgagacagaaagucaacaaggauacccaggaauugaacucagcucugcaccaagcggaccuaauagacaucuacagaacucuccaccccaaaucaacagaauauacauuuauuucagcaccacaccacaccuauuccaaaauugaccacauacuuggaaguaaagcucuccucagcaaaagaacagaaauuauaacaaaguaucucucagaccacagugcaaucaaacuagaacucaggauuaagaaucucacucaaaaccgcucaacuacauggaaacugaacaaccugcuccugaaugacuauuggguacauaacaaaaugaaggcagaaauaaagauguucuuugaaaccaacgagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaaacccuucaaaaaauuaaugaauacaggagcugguuuuuugaaaggaucaacaaaauugauagacugcuagcaagacuaauaaagaaaaaaagagagaagaaucaaauagaugcaauaaaaaaugauaaaggggauaucaccaccaaucccacagaaauacaaacuaccaucagagaauacuacaaacaccucuacgcaaauaaacuagaaaaucuagaagaaagggauaaauuccucaacacauacacucucccaagacuaaaccaggaagaaguugaaucucugaauagaccaauaacaggagcugaaauuguggcaauaaucaauagcuuaccaaccaaaaagaguccaggaccagauggauucacagccgaauucuaccagagguacaaggaggaacugguaccauuccuucugaaacuauuccagucaauagaaaaagagggaauccucccuaacucauuuugugaggccagcaucauccugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucauaccugggaugcaaggcugguucaauauacgcaaaucaauaaauguaauccagcauauaaacagaaccaaagacaaaaaccacaugauuaucucaauagaugcagaaaaggccuuugagaaaauucaacaacccuucaugcuaaaaacucucaauaaauuagguauugaugggacguaucucaaaauaauaagagcuaucuaugacaaacccacagccaauaucauacugaaugggcaaaaacuggaagcauucccuuugaaaacuggcacaagacauggaugcccucucucaccacuccuauucaacauaguguuggaaguucuggccagggcaauuagguaggagaaggaaauaaaggguauucaauuaggaaaaaaggaagucaaauugucccuguuugcagacgacaugauuguauaucuagaaaaccccauugucucagcccaaaaucuccuuaagcugauaagcaacuucagcaaagucucaggauacaaaaucaacguacaaaaaucacaaggauucuuauacaccaacaacagacaaacagagagccaaauuaugagugaacucccauucacaauugcuucaaagagaagaaaauaccuagcaauccaacuuacaagggaugugaaggaccucuucaaggagaacuacaaaccacugcucaaugaaauaaaagaggauacaaacaaauggaagaacauuccaugcucauggguaggaagaaucaauauugugaaaauggcccuaaugcccaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacaaagcuggaggcaucacacugccugacuucaaacaauacuacaaggcuacaguaaccaaaacagcaugguacugguaccaaaacagagauauagaucaauggaacagaacagagcccucagaaauaacgccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccuaggcauuaccauucaggacauaggcaugggaaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacuccaacaaauuuacaagaaaaaaacaaacaaccccaucaaaaagugggcaaaggacaugaacagacacuucucaaaagaagacauuuaugcagucaaaagacauaugaaaaaaugcucaccaucacuggccaucagagaaaugcaaaucaaaaccacaaugagauaccaucucacaccaguuagaauggcaauccuuaaaaagucaggaaacaacaggugcuggagaggauguggagaaauaggaacacuuuucaacuuuuggugggacuguaaacuaguucaaccauuguggaagucaguguggcgauuccucagggaucuagaacuagaaauaccauuugacccagccaucccauuacuggguauaugcccaaaggacuauaaaucaugcugcuauaaagacacaugcacacguauguuuauugcggcauuauucacaauagugaagacuuggaaccaacccaaauguccaacaaugauagacuggauuaagaaaauguggcacauauacaccauggaauacuaugcagccauaaaaaaugaugaguucacguccuuuguggggacauggaugaaaucggaaaucaucauucucaguaaacuauugcaagaacaaaaaaccaaacacugcauauucucacucauaggugggaauugaacaaugagaacacauggacacaggaaggggaacaucauacucuggggacuguugugggguggggggaggggggagggauagcauugggagauauaccuaauguagaugaugaguuagugggugcagcgcaccggcauggcacauguauacauauguaacuaaccugcacauugugcacauguacccuaaaacuuuaaaguaguauaauaauaaaaaaaaaaaagaaaaaaaaguacugauucagggagguuucucuuuaagguaucauuucuuuagagaaugcaauauacuauguuuuauuaaaguugauuacuuuaacaggaaucuauuucuacuuggaaaucugaauagccuaugagauuagaggauugguuauuauguaaaugaguagucaaagauaucacugugauuagggucacacuguagagucuuuuuaaaauguauuuagaauauauguaaauaauauguacauuugguguauuugugcuuuuaggaaacagaaacuuugaucaucccacaucuuuagcugaaggaguccuucucucaaguaaaacuaagucuuuguuuagggguauuaaagugauuuagugagcaucauuugugcuaaagauuuuaacucccucugccugccugcuuguccaccaaauauuuuagcaaaguugucaacaagugucaaaauugcucaucuuaauugaucaucuacccaucugcccuagaagugauaaugaacccaaaaggcuguaguaauggaaaggagaaauaaaauguauucauaauccacagaacggauaauugaucuuagauuuuugugggcuuuuuuuuuuuuuuuaacauuagcgaaccccguauugguuuucugcuaaggucuaagcucaguguuugagauuagaaacacucaaauuaguuugaaugacaaaucuaagauaauuguuuaaagaaaaauuuuuuagcuugccaugugcugcugcuucuaauaggugauccgaauguaacauuuguugauucagcuagugggacuaucuuggcagucauucuuuuuacccucccaaauuaugcagucacuucuguauuaguuacccauuacuguauaacaaauuaccacgcauuuaguggguuaaaacaacaccuacuuauuagcacuaugcuuuaaccaacugagcuagcacgccacccguaacaccuauuuauuaugucauaguuucuguuugucaggagucuaggcauggcuuagcuggauccucugcuaagggucucucacaguugacaucaaggcugagcuugggguccucuuucuaguucauuugguuauuagcagaauucaguuucuugcuguuguaugaucaaagucucauuuucuuacugguugucagcaaggacuguuuucacuccugaagacugcccacaguuccuuguuauguggcucucucacaggcccucgcauaucauggcagcuuacuuuuucaaggccagcagaagaaucucuugcuucaguuggcuaagacagagucugauauaacaugaccaugggaguaauugucucaucaccuuugccauauuccauugccuagaaacaagucacaaguucugccugugcucaagaggaaggaauuauaugagaacuugauuaauugggggguucgaggauauucuuaggguauguccaccacaacuccaaaaaguagaggccuggcaaacuucuuaccaagucaguagcaaugguccucugcccacuacaaguaacaagguccauuugugccuuuucagaugaccuuuguuuuaugaacaaaauauguaauuuggauuuuuuguaauaguaagcaucuuuucuacugaacagaauuaagauaaagaaaaucuuccuuaggauacacuuuuuuuuucuuuuuuuuuugagacagagucucacucugucacccaggcuggaaugcaauggugugaucucagcuuacuacaaccuccgccuccuggguucaagucauucucaggauacacuucuaaaacuccaaaaaauguaauuuauuaauauagauauuguugauaguagcaaaugcuucauuauguaauugagugugacauuaauucucucaugcuuugucaaaugacucuuacucuucagugcaggaaucacagccauggcccccacccuccaggauuuggucgauauggcaucugugcacaugaaaacaaagaacuugccaaugcaagagaagcucuuccucuuauagaggacucuaguaacugugacauugucaaagcuacucaguaagucuuccaaaugcuuugguuuauccuuauguucucuagaauuaauaguaauauauguguaguucauggagcuucauauguuuaccucucuuaacuucauaauaguaguuaacaccagcaccaguauauuugucauaccaacaccacaguacuuaguacaguguaccugagcuguuuauguaccaggacgucccauuagauuguaggcagguucuuagcaaaagcaugucuucaucuuuguagcuccagugcuuuugcacaguuccuucuuguguaagguacccaauaaauguuccuugaaugaauggaugauuuuaaaugacacuaagccaaacucuuuauuugaaacacaaaucuaagucuuuuaaaauauacuacaaccugaauagguagauggaaugaaaaauacugacuuacacauuuauagauauuuuuaaaaaucauuuauuucuugaguacuuuccaugugcuuguugugcuggacuaacuagaagaaauacgguaagguaagguggaaauauguucucugaccacuugaaacacauaguguguuguuuugcuugcacuggauauggaaguacauuuugaaaguuuccccuuaagaucuccauauguggguauuugcauuaagucaauuauuuccaacauuuucaccuucauggaucuuguugauuauuaacaucuaucacaccucuugacauugagcaaauuuugaaguauuuuguacaucagacuacaucaaguauuaauccauuuuuguaguaaucaaacauaaaucugcccagcagauugcccaucaaauaaaaaucaugccaaucuaaucagccugaggggaacuaauguuaccauacuaacuugauauaauuucuaucagaagcaaagauguuuggagauuaauuagccuguuuggccuugauauggacuaauguauugucuauguuaauuaaaaaauauauugacaauuauuugaguauucuaauuaccaauuuauauuaacucuagaggccuugggaaccacucuuuuaguugaauauuauuugauauuguuuauauuuuauuuguacaaagaugagcauauucuuaagguaaauauuugcuuuaauuaggaugcaaacauuuaaaucuuucccuguugcccauaaaacucuuaagauaaaugucagaaauuaggcucuuuuuagagggaaucucaguaaaaacucgcauuuuaugucuuuccuaaaauuuucuucagguccuggaccuucucaagugguugucgggggaccuguagguaguaucugggaagggcauagagagcuauggaguguguguguguguguguguguguguguguguguuuucuaaaccagcaaaaccugaauguauauucuuauuauguuucuaaaauaaagggaguauuuauuuuccaguaaaauguuaaaguugacauuuaaaagauggagaguguaaauguaugugugucauuuucaaaaauuuacucuuuuaaaaaugccaaaaagacacacacacgcacacacacacgcguguauuuugguaaggcagaaauuauucuaauuuacagugugagaaacagacaauucugccauuugguuugauuuuugauccuugcgggcuuauuggaacuuucagguaguuuuaaguagaaauaaguuuuaaagaaagugcuaaagggucaguugggacuucauagaaauauugcuaauaggccgggugugguggcucacgccuguaagcccagcacuuuggcaggccgaggugggcagauuaccugaggucaggacuucgagaccagccuggcuaacguggugaaaccuauuaaaaauacaaaaauuagccuggugucguggcacacgccuguaaucccagcuaccugggaggcugaggcaggagaaucgcuucaaccugggagacagagguugaagugagcugagauugcgccacugcacuccagccugggcgacaaagcaagacuccaucucaaaaaaaaaaaaauauugcuaauaaaugauuugccucuuuauucucuaugaaauaugucuuuuuaaugcuauaauuucucuaugaaauaccucuuuuuaaugcuauacuauuuaacugauuaacuaguaguuaaaucucucucaagcccaucauuccuuuucuguuccuauugcuucacucuuacuuuaggcucucauugucucucaccuguauuuauugcaauaaucucuaaauucguauuucacucucuguccucacccugcucuaagcagcuuccauacugccuccaaugcgaucuuucuuaaaacucaaagucugagugcuuuccucuuuaaaacccuuuauugguuucccauugaacuguacauaaagcuaaacuucauagcauagcacagaaggcccaugugaucuuugccuauugcgucugaccucaugucucaccauucccucucaugcuuuaugcuuuagcaauguuaaauugcuuuuauuucucugaacauccauguaguuucacauugcugauuuuuguacaugcugcuuccucugccugaaaugccuuuugucaaccuauaaaauauagcuuaguuucaucuccuucaggaagggcuaaucauuuguuccucugcuauaccuauauucuuuccauauuucguuguggaauuuaucccauucuaaguuugcuuuuagucuuuaucccuuauugugagauuauugcaugggcuugguuugauucagggguaagauuauugucaggaauuggcaccagguguuucuggcacauaguggagaucagaugaaacuuauugaaggaaggcaauguaaguuuaaaguuuacuuaagaaagucaaguucaacuccaaagagauuaaucugaucaguacauaaaccagguuuccuuuugcuguuuggcuuuauacuguguccucucuaugcaugucuuuguuaauuauuauauuucuguauugacugaaaggcaguuuggauagugaaaagauauaguaaagugaagaaauuuugauauuugaaaugauuuuaauuguaucaauuaugcuuuuuuuuuucuucuuugagauacggaauuuuugaacgauguaaagaguugguagaagcaggauaugaugucaggcaaccagauaaagaaaaugugucgcuucuucauugggcugcuauuaacaacagacuggaucuuguaaaguaagaugggauauguguguuaauuguguauuuauaauuuuagaccucuccuucauuuaucuuuuucuuuaaguauggguauugaaccauguguaauccucguguaaaagaacacccgaaacuuuuucugccacacacguugguuauuauaaaguugaaagggaccuuagagaccaugccugguugauccaaaagggaaaauuagagauaaagccaagggggccaaucauaaaguuuagaaaguaaaagugaacauuuuuuaaaaaaggaaaaguauaauaaacuuuuucagaagagaaugggaagucucaucuaguuuagaagaagcauugaaauauuuuacauuuuaauaccacgaagaauagauagguaggagauuuaaccuuuuaaaaaaacuaaauauggaauauacuuuuaagugggcauguauuggauuguauaaaauauuuccccuucauaaagcacuacugccuacccauuguuucuuuuaaacagcuuaacauguaaaauguacauguguaugugaauguguauauauuuuguguuauaggauuagauauuuaaaauccucaaaguuuaagaaauuuauuaagguuuaaaauguucuaacacacaugaauacucacaggcaaacuccucuucuguggaaauaaacuggcaugguauuuagauaauaugauguaugaagcucaacuuugaaguaaugagacuaauuccuauaaaccauagaagaaaaucagucuuauuaccuuauauguccaccuuauacagugccucucaucuccguacccuaaauacagggcaaaacacucaaaaugucuaacuuuuccaaaaggauuuuaaauuaauucuuuacuacuuacuuuuaaaauucauucccacauaguaauucuacuuuuaaacuguugaaggugacauaacuuuaccuuucuccuuccagucaaguaagaauaucugucugauccuaaaccuuuugaauauaaacaauuucaagagugcugcgguaguuagacuaugcagagaguaguuaugauguauuugauauguaaguuauaauggaaugcuaauuacagcaggacuaauuacuuacauccuaaggauguuucaucagggauuugucugauucugccaugugaaccuuucauauuucuauagaucuggguguuuuagggauuauuacuaucauaauuuguucuccaacauauuuauuacuaugaaaaaauuaguauuuucuuucucaauaugaagcuuaaguuucaaaucuuacuuucauuugugucugcuuuuaacagguuuuauauuucaaaaggugcuguuguagaucaguuggguggagauuuaaauucaacuccucuucacugggccauccgguaagguuucuuugaacacugaaauuaaauagccacauauagcuaguggucaccauauaaaaaaucaguuauagacgauuugaaaggcugucuuuucuucccccccccccuuuauuuaaaaauaaauuucagcuuuaaagaguuugcagaaaggauguuuucgauauuuaauuuagggcuucauuaugauuauccaacucaaauauguguuuuauaguuucuuuuuuguaauuagaauaaauaauuuucauacuugguaacauaaauaaaaauaguaguucagugaagugcaaacucauucaguucaggcuuaugacagaugucuauuuagaaauuuacgauuuuauuucagaggugaguuuccucuuaaaugugaaguauaucucuauaucuuagggccaauugagucaacucuuuuaaaaguuguugcaggauuaacaagaaauuuugaguauaucaacuuagaacauuuauauuguguggucacucuccuuuuuucucuguuguauauuggccaucugaaacugaaguuaguaagucuugaauacuuaucaguuucuuuuauuaauuuaaacuccacucucggugguuggugggguugacaggaaucugaaacugaagugaauaauuguucauguaagucaaggaguugaaucuuuucuccauagcuaagaguuuugaaacucuaggguuacuucaugcccuuuaagcuacugagguacaguacuuuacaugaaaaaugaaccauagucaagcauaagaaaagcauaugaauauauagcucuuaauauuaucacaguaaacccauaguuuaugaauauuauauuucuguauaucuggcuuaugauuuuuugauuuuaaaaugacagugacaucuaaguggucuuagaaucuucauuguuaccaugucauaaagaauuauuauucacguaugguaaugugugaaggucagguuuaggguagauugggaaguuaucaaguuuaucacuugcacucaagaaugauuauccaggccgggugcaguggcucaugccuguaaucccagcacuuugggaggcccaggcaggcagaucaugaggucaggagaucgagaccauccuggcuaacacaaugaaaccccaucucuacuaaaaauacaaaaaauuaggugggcaugguggcaugcgccuguaguccccgcugaggcaggagaaccgcuugaaccugggaggcagauguugcagugagcugagaucgugccacugcacuccagccugggucacagagcgagacuccaucucaaaaacaaaaaacaaaaaacaaaaaaaaacgagaaugauuauccauauaguucuaaguuugcagcaucuaaguuaaaaacguuuggacaaucaccauuguuucaaaaaucuuacuguuaggaaauauuuuuuauauguaaccaaaaucccucaugucuuaggaauaucagucucucccugacuuuuugcuuuuucugcaugcuacagaauggcuuuuugucuucuauuugcagacaaggacauuuaccuauggucauauuauuacuccagcauggugcagaccccacucuuauugauggagagggauucagcagcauccaccuggcaguauuguuucaacacaugccuauuauagcauaucucaucucaaagggacagguauguucugaaaugugucuuauacuccaguuuuuaucaucugaagagguuggggaaauuauuaguaguagucucuucucauuuuuaaaguggagguuaauggauauccagauauucagauauuagccucaguacguuuagccauugaauacugcuuuucagcuucauuggagggaaaaggacaggucauuuagcucaguaacguauaauagauguuucugaaacuuguaagcugguaauaguuuuucuuaugaacccaguaauuugcagaguuucucaaaaacaugacuucaaagccuguauuuuucuucuaguugaauauaaaaaugguagucaaaucacuaaauuaacccaucauuugcuuucauuauuugagcccaaaugggaggccaauuugaauauauguuucuuauuguucucuaaaguaauuccaugaaaauugacuugccuugagaggcacagguuaaauuauagguuauuguaaguuucacugucaauuauacuugccuggaauauguuuucugguagcaaaguaguuuauguauuagcagacuugccuguaaaaggcaugaaaacguguuugcacaaaugcuguuggaaugauugugcucccuuuaaauaagcacuuucucucagacuuagcugauugaaguagaauuauaaccuccuagguuucauuguuggaaaaauauaaauauaugaggaagaguccugucugcuucucuuugggugccuucccaaguccuguuccuccaaggcccauaagaaucuucagaagcugaaacuguuuuucuuuggcuuagcugaaaccauugcuguauaccuuaaaccuagaccugucuuauuaaaaggacuguauccucauggaaauaugauuuccuuuuuuuuucuguguuccagaaaauagaaaggaaauuuucauauuuuacuauuuaaaacuuaauaugauaaguccagaaagacaaguugccucagaagauagggaguucacuauuuacuggaaguguuugaguagguacugaaugacuuuguauaagaaaugauaaugcgaauuaaugugucaacuaaggucucaacuaggugacuuuuaaggucucuaccaucucuuguauuugaugguagcuaucaacauuuuacucuuucccuuaacuguguucacaucauauaacacuuuacauuauauauucagauuuucuuuuuaaaaauauucuguggaaauccauggauuuuuacccuauggaagugagcaaaacauucuuuuuaucaaaugauauuugagcccuuuauguagaaauaaugguaguauugaauguauuaaagagauauuucuauuaagagaacaaauagacuuuugaguguauuuacaguuaugcuaauugucuucuuuuugaauagagugugaauaugacagauguaaaugggcagacaccucucauguuaucagcucacaaaguaauugggugaguuuaauuuaguccacucaaucucauucuugguuccaacuauuucuuuucuguguauguaauuuuaaguaucugugucuaugugagaugauaguacauugaagaaaauaagauuuuucacacagagacugugauaauugacuuuuaagguaguuauaguuagaaaagcagccuugaaauacauuuucucuuuucugauagcuuuggcaaaaaguuugaaagcuacuaauaagaaaaaaauuuccuuaccuaucaaguagauauaccuugaaauauacuuguuaacaugacuuguauuucuuccuuuggcuuuaaaaaaauggcuauaauuuuaaauguucucauaauuugaaaucuaagugauaaaucugcuuucuggaaaauauuaaauuuugagauucucugacaucauucuugacuacuuugaaaauaucauuaacugaaaagagucuguauguucagaucaggcacuuacauauucaaguuuuucuguguauuuauuucuauaaacacaugauuaaugaccacuguauaguucaacuucugguauuuaucuaggcagauacuuacgacaguucucacuuuagcaguuuguuucuauguuguauugaaucucugauuuugcuuguacuuaggacuucuaggaacuguguuaguucuaaugcuauuuccuuuuuguucauggaaugguaggacuggagguagaauuuuauuaaaaagcauuuucucuucugugcugguaaaucugaagucagguauaaucucuauaaagauauugauagaauaaauaaaguagaauauuguuuuauuaaaagaaucucuucaguggucaugaaggaaggaaagguauugguaaaguaaaaauauuuuacugaauucugucuucuaguccguaacuuucuaagauauacaaauauuuuagggcauaauuuauaccugcuuuauuuaacaguugauuugauggagaguaugaaguuagcuccucaacuaagacauacauuuagucuuuaauugaauaaauagcauagcauuuaauauuggcuaaaguuaaaucuauauucaaagaaaaguguuagccaauagaacaacaauaugaaaggaaaaguuugaaaaacaaaagcaguuauuccacugcauuguuaaaauuaucuaucuguauagcagucgucauuuaauagaugucuuuuuuuuuaaucuccuauuaguaccuagaauagaacucaguacaaagaaguuucucaguucugaauacuuaacugaaugguuaauugauggcauuaucuuaaaagauucauaauuugcauuuacuccuuaagucaucaucucuguuaaugccucuugguauuuuauuauuuugagacaggccagaaccaacuggauuucuuuuaaaguuuaauccuucucucaaugugguugauaaaauacaccaaaacacuccacuucacugggcaguugcagcaggaaauguuaaugcaguugauaagcuuuuggaagcugguucuagccuggauauccagaauguuaagguauggccagauauuuaucucccuuaguuuauuauaucuugaguuagaagauugauaaauuaacguaaagauaagcuauauaauuguuuucaguuaccccaagauagauauaaaugauaauagcuggcuauccuuggaauaauguguugagucuaugauucugguguuuuuaaaaaaaguuuagcacucauaauauauuaaaaauacuuuuaaacuuuuuacccuacucuuuuuuaagggagaaacaccucuugauauggcucuacaaaacaaaaaucagcucauuauucauaugcuaaaaacagaagccaaaaugagagccaaccaaaaguucagacuuuggagguggcugcagaaaugcgagguauuuucauauggggucuuuucuaugggauagaugacuuuuuuuguucauuugguuuuguuuauuaaggcaucagaggaaaccagagaguuggcuuuuugcugcauuauaucugcugacuauaucuuucccccgcauccuauuacccaaaguuggaaauuuggcacuuucauuggcuauuuauuguugguccucaacuagaugcucuaaaagugcuuguuaccuuaugaauaucauuguguacuuccacauuuauuuaaugaauguauugaaaugcaaaagguuuugauuuuuagagacacaaugggaaaaacaccuuguugcaaggaguuuuauagaagcuuguaggaauaguuuauuccuuacuaaaauuuuauuucuugaaaagaaaauaauaacauuuacaauguuuccuuagaaucauaaggacuuuaaaaaugauaguguugaaaauuuuaggcauaugaugucacuucauaaaagaaaacacuggaauuuugagagauuaaauccaaauuuuauucauuuuuuuuagcuuagcaauucugugugguguuccucuaaacuuuaaaaugaacugaauaauggaaaacuuuagaaacuucagguuauucucaugaaugucuaagaaaaucuaagucauagaagugaauacuauuuaaauuguuaaaauggaauauuggauugauuccacuguuucuaguguuuucaaauaugauaccaucaucuuauuaauaauaauuaguaauuguacuuucagagugauucuaaauuaacagacacuguauucuuauguagaggaucaucaugaaugcuacacugcuuuugcauuaggcauguggaguggggagagaaagaaauagugguuauuccucagucuccuuugccagcuccuccacuucucccccaucucuuguugguagggugccccaggauuuuguuauugagcuuccuugcuaucuauucauucccuaaaugccaucuauauguugauaacucccauauuugucucucuagucuagaccuuuccaugcucauauauccaauuaccuacuuuacucauccgcuuugaugucuaauaggcaucuccugauacccuccccacccuuccccugacuaagccaagccuuccccaucucaguagcugguaacuccagcauuccucugucuucgccuuuuuuuuuuuugucauaccacauaugcaguccauuagaaagacggguuaacuaguucagccuucaguuuauguccagaaucugaccccuucuuaccacucuaccacugccauguugguucagcagaugaaucuucuaaaauguaagucgggucaugucacuuaucagcucacauuccuaugaugucuccucauuucucccagaguaaaagcaaagucuuuaugauggccuauagggcccuuugucauccagguuuuuauauacuauaaaauucacuuaguauauuuauuugucuaucuuccccagcuagaauuuaagugagaaaaagaucuuaaguucauugaugugucccaagugccuagaauaguaccuugcauauaauaugcccucaaguauuuguugaaugaauagggcagcuugucuguaagaguguuauaucuaggauuuagaauuuugagauccauauuuaauucuuaucucuguucugagauuauguugcuaggagauucuaaauuuacauuaaaaaaaaucuaaacuagcccauuuugugucaucaugccaauuggaauaggaaacauuuuaaagacuuaaugucauuugaaauuauccacuccuagauauggcguagagaggugaaaauggaggaagaaagaaggaagcccugcuuacuuucaaggucucauaucuugucauuaaagacugcauugcacaaacauggggcccagcuucaauucagucagaccauuguuucauagaaguuucauucuuuuaacuuugccaaaauaaaccugaauuaguagcaucaugaggacauauuucagucuuugaucuccaugugacauuugacacugagaacaucccccuucucgaaacucucuucccuggauucccugaaaccuuucuuucugccgguucucauccugccuuucuggucaguuguucuugguuauuuuuggugacuuugcuuuuuuccccuuaaguguuuguuuuggcuaagauucugcccccuuucuaccugcacacagucuuugggauguuauucacucacggcuuuaccaccuauguacugauaaauuucaagucuuccagaaugcuagaccuacuuuugacugccagcugguugucuccuagauguccauaggcauuuaaaauucuacguucuccaaacauagcucaucuuuucugcagaccuauugcaucugaccuucugcauuagggauggcauggugcagugcccagguuggagcucuuauaguucccucauugagucuuuuguauuaauuucuauguagucccuugagcuugcuuuaugcuuuccaauauagaauacuguuugcaagaaguaauuuugaaaaaucuuagcucucauuaacaguuuucuaaaagaccaccauuucuuguagagaagaaaacaaaacaaaauauguuuaaguaacauuuuauaaaauguaggguuuuuaaaagguuguuucccacuuugggaggccgaggcagguggaucgccugaggucagaaguucaagaccagccucgucaacacagugaaaccccgucucuacuaaauauacaaaaauuagccaggcaugguggugggugccuguaaucccagcuacuugggaggcugagccaagagaaucgcuugaacccaggagacagagguugcagugagccgagaucgcaccauugugcuccagccugggcaacaagaaugaaacuucaucucaaaaaaaaaaaaaaaaaaaaagauuguuuccaagauguacaaucucucaaaccucaaauuuaucaaucagcaauuuuagaggaaaacuuuguguuagcuuuguuguuguauuaauuguuauuauauacuuuggaaguaguucuuauauugcacuauuauuagauacuuaagagguaaaauccauaaaguucuaaaauucugaaucucuuaauagcucuuccugcugcugaugcuuucugugauuaccaugugggcuauuggauacauauuggacuucaauucagauucuuggcuuuuaaaaggaugucuucuaguaacacuguuuuuucugacaucuuuguuuccaagguguguauguuaauuuuugcaaggcugguuauuguguuucugauuuuauuucuuauuucuguuguugguuagcuggagucacagauuuuuaucaugcuguaaauauuacuuaccauauaacagcauccugcggguggaugggaggaaagggcucugguagcauauuauuuggcugaaagcaaguugcucaacccaguaacuugguugacuugacaacugguggaaaauaaauauccugggucacguuuuaauuguuauuuuuggugaaugauggggagauuuuuguaaucauuucauaauuauucaagauuuuguaaucaucuugaagcauuuuugcucauuuuucagaaauuuuuuccuuuuucuaaauuuauuuuaagcuaguuauuuuugcugucagucauuuuuaguugaguuaaauugugagagauuauaaaauaguaaauaugguaugguuuuauuuuuaggacaguauuuauacaugauuauauauaguuaaugguuaagagucagacugcuugaauucaagucaagcuuuaccacaugacagucugacauugaacaaguugcuauaaaaugaggguuaacuugugauaaugccugccucaugguuaacacauauaaacacauagaacuauagcugacacauaguacucaauaaucauaucaccccccaucucuucuucucucuuaccuuucucagucaaauggcauccaguuccucaaaugaauaugggugucaugcuuggauuacugucauccucuccucaccucccacguccaacccauuaccaaguguucccuaccugccugucuccaucuccacaacucgcauccuagaccaagucuccucacuggucuccugacuucuuaucccccuggaguuuacccccacuuagcaaucaagggagucuuuuaaaaagcagauaaguucuuucuuuucucccugcuuaaagugcuuuaguaacuuuuucuuguacucagaacaaaauccagacuccuugccuaugggguaugaugugauucauucccuccccagcgacuuccucucuuucccuucuccucauugcacuguaccuucuuucucacacaucaggcucauucccaccuggggccuuggcccuugcuugggucuuugucugaaguguugugacaccuuaucuuuucauaguuggauaugucauucaggccucaguucagcugucaccugcuuagugaggccguuccugacugaugcugcugcaucccuguuuuauuuucuuguagcacuuaaucacuuuccugcaacguaaagcccauaaaagcaggaaacuugucucugcuguuaaacauuuucauucacugaaugaaagaaaaauguaaugaugaugauccauagaaaagaaucuaaagggaaauacaggguugcucuuugcagauuaugauuaugaguauuccucugucuuucugucgcuugccagcauucucuggcauaagcaugcccugcuuuugucauaagagcaaaugaaguauuagaggaaucuuacuacuguaucacccaagagcaggacaauuggcuggaaaugaauuagaauuuaaauguaaugugaaaacucaaauuucugaaaaauagcaaaaugccuaaaauugucugcuauucagacaacuugugacuuagagauauuuauucacuuuccacuaauuggauuaacuugggcucuaaauaaauuuuaagccaaaucaccagggaucagagucaucacuccuuuuucagagaggaagcaagggcugguaauaucuacuccccuaggauaggaacauuugagauuauguuugguuguucguuuauuguaguugaagccuacauuauaaaaauggacgcaauucaaaugugagucaaaugcauaugacaacuuuauucauacaucccuuauuucucauauuccucuauagggucccaauuucauggaggaaagcaacuguaaacuacuauuauuacagggcaguugcuuauugaucugggcuguuaaccugacaccugucaggaguggacauguagugguagcaggcucuuguaaauuaguaguucauugcauuaccuaauuggucaaaugcauuuuuugcugcaagaucuccgacagaccauacccuggagguugcaaggguuucauuuggccuauuuuggcagcauguugagcaucuaaaguuuggauucuuuaguucuucucaaauaugaacuuaccauuauuaugguuaugauccugguagcuaauuuuuuuuaacccuucauaccuacuguuaaucauuguuuuuuccuggaauaaauuuuaaaauauauucagguaaacuauauucaugcauaagaugacuguggugaguauuuaguguaaaagacauuuucuuuugaaacugcaguauuuuggauaaauuacaugugaaccucaaaucgccugugacccaagugagauuguuaguguucugaauacuaguaucauuuuuagccuuuguguaucuuuuuauaugaagugucuacuucucaagcugauuauaggaugaaugugcuuaagguugugugcaucaguaugcuuaacaaauaucauuuuagucucuggaagaaagcuugcuaaauguaaaggugaaucucaaguauauaaauuuuugcauuauaguguauuuaaaaauauaugccaaaaaagaaauaaaaauauauaucucauuagaaauacaaaagauccauugaaaacauauauuaaaucguugugaauuaaauauuguaugaguugguuagaagaacuagaacauacacuucuugagagucguugugcuuuaguuuucuccuguguaaaauggggggaugauguugcauaacucuauuaccacauggaaagugacacauaguaagcacucaguaugugaaagcuauuacuguugcugcugguauuauuauuacuaccauuauuauuuagggaaauuuagaacuaaaauuaauacaagucauacuaauaacuuauauuuaucuuuuuucuuuuagguucuugguuggguauaagaaccuuguauacuuaccaacagccuuucugcuaaguucuguuuuuuggauauuuaugacuugguucaucuuauuuuuuccugauauccuuuaagcaucaauuuugauguguaucucauuuugccuuuaaaagaguaauguuauuguuaggaauuuagguauuggaaaaggcccagggaaugcaacuuauauuugcauucauuuaaugguucuggaugaagacguuuaauguugaaaaucuacuugauucuaaaaguagucucagaguacauuauggaaacaguaaguaucuaguauuuauuacucauaggaggggaacaguagaauguauuauuguuuuacuuguaccauaauuuguuggauugucuugagauuccuucaaggucagaugguucucauaauuuggucagcaguuacaguuaauuaauacauuuucugaguacuaagacggacugcaugaaagggauauuggggaaaauauggcuuccucaguaacgguaaguguuagugauauuaucuaaggcaaugauucucaauccacggugaaaauaaauuuacuuugccacucaacauauauguaaaacaaagacuguacuccuaauauaugcuuuacucuaugguguuauuucaucccauuuccuuuuuaaaaaauuuuaaucauggcccauuuaauucuuucaugacucacuaaugaauagcagccugagauuaaaacaaaaacaaacaaacaaaaaaacucauccaaggaauagguuuauuacuuaaggaucagggcccaggaccaaguccagcuuagggguguguuguucucuuaguguuggccaaguccugucaccuagaaauggggagagggguuacuugggcucuaaccauuugugacuucagguagguggaaggcauuuucaaucuucccaccucuugccagacucccuucuccccuuccaaggacccugggaagcccugauggccuugcuuugcuuauggaguaggagaagaaggaauguuguagauagaaauauaccuuucaguguguucauuuaaacuuccacauuacuucucuuucugguaauagcauuuccgaaaagaaagaacagaauguuuaugggagacaugcauaaacugaauucaagaauauuuuuuccauaggaauaaaugugaaaugagauggccauaggaguucucaaaguacauauguccacauccauuauagcauguuuuuccuuuaugcuccuuuuuauuucugagcauuaucucuaauuuaauuuuucagauuucuuuaaaugaauggcacagcauacauuggggccauuuggcuuuuuucaaaagauuuuauuaucucuucuuugucucauaauuacugauuugguggcaguuuuuuaagcacuagccuuauuaccaccacuuaaugaaggcuuggaugauauuauuauuaugauagaaaaauacaugauuuuauaaguagucaugagugcaucaaauaacagcacaggauacaacaaaaucacuugcagaagaccuaacgcucauaaauucuaggguaauugacaugacacugaggaaggaaaguuagcugauauuuuuguuuaccaauccauauggcaguggaauaaaacaguuuuaaaaauguguuuuuugauaaauuuuuaaaauuugagaaacaugucagauuuugcacaaauauugaauuauuucaaauuuguagaaucaaagucauaaaugguuacaacccaaguaaccccucuccccauuucuaggugacaggacucggccaacacuaagagaauaacacaccccuaagcuggacuugguccugggcccugauccuuaaguaauaaaccuauuucuuggaugaguuuuuuuuguuuguuuuuguuuuaaucucagacugcuauucguuagugggucguggaagaauuaaaugggccgugauuaaaauuaacaaaagagaacugauuuccauagcuagacagaaucuuaagauguuggaaucaacaagauggaugauuuuauuugcuuguacaaccuaaagcccuuuguucuaggcaaccauaugaaccugcuacuugugagggcauauaagucaguagguggcauacuucaccaucagaauaauguucuucaaacuaaauuuuaaaucuuggaacugccuuguggaugaacugagaugccgcccuggguuuuaggcuagcuuugucucaggcugccgucuggauugaauaagggcaucugcuuccgcagauacuggccuauuaggggaagacauucuggggcacuauggaagaagacaaaacgauuuugaguuuuagcucuuuucagacuaguuaugcaccauuggggcaagguacauaauuucaccaagccuuaguuuuucuguaaauuggagauaacagaaacaagcucaugguguggcugcaaggauuacuauaaagugcucaccacaguccccauggcaaaauuggcauucuauaaauauaccuaauauuuuauuauuaauuauucuuaugaauaaaauugauguggaaggcugcauguuuaaacuaauuucaagggcaauucuagguuggcuucucagaugaucaguuucuuuugguaccuuuuauaaguucagcaaguaaugucuggcuugugcgaggggggauugaauacaauaaaauggaaccuuauugaugaguuugaagguaaaauucaaacucaggagagaaauggugaaucacugaauauuacauuugugauauuggcuguaacuaacugaguuaaguuuaagagggauaaauacauguaaagucccauacugaguuucagaaaaucaguuauacaagugcauguuauggugagcuaugacauagcuucuggucaagugcaaaggaacgaggcgcugugacuaaaugcucaguguggcuagugaugcagcugucaagaaagcaaguauauucucacauaguauuacaaggauuugaguguccaagcaaaagacaacagcagcuucucuguccucuacacugguguuugcucuguuuugaauuauauccuuuuaaaagagagaaugacaaaugggagcaugaacagaggaacaugaccaggaaaauguuauauaaggacaguguugcuguuuaucuuggagguaugaucacugucuuccaauuucaaguguuuggaagucuaucauuuggaagccaaugcacuauguagaaugggcacucaguaaaaauguauugaaccaaugaggggauaagcuuauguagguuagaucuaaaagacagcuacugugcagaucuaaaggaucuaaugaaugaaaaucaguugguugaaguuauagaaaggcaaauuuuagcuccauauugagagacuuaacugcaaaaguguuaccagcuuacugggaaggcugugugucuauaaacuauaguccacaucugagugccuuagauaaagcauucuuaaauucagggaagggagaguaugauucucuccagggaaucagaaaagauugcaaggaaggagggaaaauauaaguuagguuuuaaucgcaguuaagacuuggauacccuaaaagugugguuuuagaagaaaaugagaggaaguaggggacauuuuaggucagugaaccacacaggcaagagcaccaaagcaaggagugucuucagcuucuaugugaggugauaggguguaauucacuuuacuuggagaguggugauccaaugauuccccugccauuuguuuuguaaguuaaucaaaauaggagccgaaaauucagucagcucagcgugcaggaucauugcauuaugaaacugaacguauuuuugagaacugaacguauauauuuugagucgugugucgaucaggauuucauaaagaaauuaugaugugauucuuucacaaaggaucuugcccuauguaccuuuaauagugucuuucugcaaacauguaucuaauauauagggaaauacuuuuauuuggaaucucugaaucaagaggguuguuucuuugaaugauuuuguuaaaaugaucaaagaauauuuuucuagaugcucacaggagagccacaauuacaccauuagagauaaauuuauuuggucuugagugucacuuuucaggauguuccucauaaguugcaacuauuccuaucaaguauuuaauaugagcuucaacuaauaaggaaacauuaauuauuagccaagugggaacaaauuccaguaggauuagaacauaggaugggaagagauuuaggggcagggacaugugugcauaaggaaggugagauucuuaggugccaaugaugaaauuugcuuacaucauaauuacauuauuuuuaaaggaaguuugguguauuccuuaacuuggcuuuaacauuuagcaggagccccuuucuauuucaguuucauuuucagcauaguagccuuucuauacuuuuucuauaagacuugggcaacugauccaggcuucacuaaggcuucugaagaagaaaagaaaguggugagauuucuucguuacugauauuuuuaauaggaggguuuguaaacuuuagaaaguuuauaugcacauaugcagauguguugcuuuuuguuacggcugcaugacauguggggugauauagcaaaaauuagauuuccacucuuacaguuuuuucauuuauguauaugaaaguuuuaacacauauuuuuauuuucuguugaaauaauaccccaccaagacuuuuucagaugugauuccuuuuaggaauaugaucuccuacuuccuuguaauaacauuuucauaauggucauuuagcuuacauuuccccacuaaauaaauggagaguaacuagucagugaccagggagaguccuucugcuuauuggcugaggagaugccccuccuccuccucaaaugugaaguugucagaugacauggcauguuuuccguugcucaugaauguuuagaaguuggagaauguugucuuuguuaccuaaagccaguguuccugaaagacccagcccuuggugcuuguaacuuucaguuuugauguauacugguggguuuuucuuuuuuaauguguguguauauuugcauauuuauuuuucucuagcagaucauaacugggagaugauugccauucacagagaugaggugauaggugggagugguggggugguauaauuuuuaugcauccuaauuuauuagcuguugguugaaaaugcaaccuugaagagucacaucauuucaagcacagaaugauuugguggcaaguauuccaaauugcuuuucuaacuacuucaguuuggagcgagaacugugagaaugguguauaaccaugcauaauacauuuuccaauaaaaugugguaauaggucaaacuucaugucuuucagaauaucaucacccuugcagaaacuggcucucuggacuucagaacauuuuguacaucaugucuugugaguuuuuucauauaauuuuuuuccguagugaaagcaaagucuugguaacguugcugauguaagcauuugucagaucuucaugguauauuuauacaccuuuguuuuuacccauuucuaauuuuacauuccugucugaacagcuuucugucuugaacauauggcagaaugauguuuauaaucucuugaaguugucucugguuacaucucuccgugaauuauccauuguguguuuuauuugcuuuucucugucaugaagcauauauuagaacuaacgucaaaucagaggcucauaaugaccuuagaaaccacuuagugaaaccucucauuuugcaauugaggaaucaagggaggaaguaaauucucccaaauuauugguggugcuaaaaauggaacuuggguuuccuucccuugguugagugcuuauuuugcucugugguacugccucauuucugcuuagccagugugaacaggcucuggaauucagaucccacuuagugauguccuaaucaaaguagacauauggaaguaaauacuaauaaggcauuccacagccucugugugaauugauggucuguuuaggauuugugccaaugccucugugaccuaaaguuaaaauuuugcuugugauuuguuaccacuuugagacacugguuuuugcuuaggccucucuuaauugcccacuuagauaaggaagccauuaaggucacuccacugccauguaugcaacugcuguguggcucgauaugaucaacacugccuguggacuggacggugcauaggugagagauuuaauuuuucaauuacuacugugaaguuaagcauauguuuaguuaugacucacagaaaaaguggaagggcauccuagggcuccauuuucaauauucuaguauuccaauagcaaugggcccaugcaucguuauuaugcuacagguaacauaauauuugcacaugcaucauucuguuugguagccacaggccugugaaguagacagaaaaaauauuaucuccauauuacuuguaaaaacgcuagaucagagaaguuaaaacacuuaacuuacagugacacaacuaguaauacauaagccuaggucuccugauuccaauggguguuguuccuucugccggguuuugcugcuccaggagaaggucggaccaugauguaguagcugaggaguauuugugucauuagcauugaaaugcucccaucuccagcauugagaaggcagcgugugcaagagaagacuuagcugccuugcccuucccgcuuucuucccuucuguagaaguuucucagauuguggguugccacucuuugcauguccaguagcaacauguaaauuuguugcugcuccucaguuucguuuucuguguucccccugauuaagucaauccuugauauucagagguggugcuuuuacaaacauguuacauggaaggaggaaagauacuggguaugauuuguccaaaaucccgccugguucccuuacuucugucacaggauaggacagccuagcuagaaaaguguuugcuuaguuaacuuuauucuauuccagaaguugcacuuuuacaaacauguugcauggaaggaagaaagagacaggguaugauuuguccaaauuccugccugcuucucuuccuuccaucacagaauaggccagccuagagcaguguuugcuuaguuaacuuuauucuaguccaaaaaaguaucuucuuuuaaguaagcaaugaauaaauauuaguucaguuaacauggacaauugacugugacauaucagaaaugugugguuugauuuaaugguacuuaaaagcaaagcaacagcuuuauuucuguuuuacuuuggugaagacuuuugacaggaaagugguuaaggaggucuuauguugaaaaucagaagaaacgaaaauauuaaguauguuuuuuuucuuuuuucuugagguuuuggcaaccaucacuauuacauauucuucuuguuuuuccuuuccaugguauguggcuggauuauauauggaucuuucaucuguaaguguaaauuuuucuuacaacaagcacauacaucuacacccauuucuacuuuuccuuguaaacccuuguauaucacauucuggcugggugacuauaaaccauacuccuaauaaaaacaaagcaaaugccucuaagacucccucagcauugggaagcugcaagaaauacaagaugagguuaguucucaguacuuuaggaaaaaaaugugauaaauuugaaaaguagucaaaaauagaaauucauuuaaggcaagugcagauuugcuccccagugaagaaggaaagucagcugcugaaguacaaagcuggaggugguaacugaauaaaacaggaaaaaaaaaaaaaaaaggucagugguagagagguugggggauaguuguccagucauuaaggaacaaaccucugaaagcccaugccauuugguaaguaucaaguugaaacugagaacugaugggaauacuaacaguuaaaagguuggaaauaguaacuuggaagaaaacauuagaucacuuauucugcggcccugaggaaggaaaaaagcuuucaguagcgguuuaaaaaaguauauaggggucucacauagggaaugacagccagcuguucugaggugguugacuaagaaggacaggguuuaaauugaaccaagaaagauuuuggcuaugucuuaagaauugcauuauuauguuuuucagaccuuggaaauagguuaccuaacuggaaaaaccuauagugcuuguaguuuauuuauuuggacuuuaacuguuuauuauuuauuuauuuuaaggcuuuuggagaauugggcucuaaacacagaggcuucacuuccauccacccucuuguuacauucuuggucaaaucuuagacuuuaccaguaggguacuaguuuguugcuugagcugaagucuggaguaauuccgaaagacauuaagaauguuauuuuccccuuagcaucauaagcccaauacacauacacauuuuuccucucuuucucucuucugugucucucugucucuuuaguuuaaaauuuuuguuaguuuucgaaaggcaauucuuuguacacuugccccccaggcucccaguuucccucccuagaaauaucaaguauuacaaauuuuguuuuguuugggguuucauuuuuagagauuauuaacuaguaucuauguguaaugaguuauuuuuugcccugccauaggcauggagggcuucaguuaccuugucagacccuuuccuaccugacgccuugggugucuuugaucacuaggcaaugcuuuuguagcuaaaugugacugucaccauuuuaaauaggucuaauagucagaagguuguaaucucugagcucaguucuugucaaaaaggccaccaguaacccugagcauucuauuuuuauuuuaauuaauuuuaauuuuauuuguuuguuuuuugcuuauuuauuaauguauuuuuugagacagggucucacucugucgcccagacuggaaugcagcggcaccaucauggcucacugcagccguagcuuuuugugcucaagugauccuccugccuuggccucccaaauagcugagacuacaggugccugucaccgugcccaguuaauuuuuaaauuuuuuguagagauggcaucuucaccauguugcccaggcugguuucaagcuccaggccucaagugauucuccugccucagcuucccaaagugaaguacugcaccuggccagcauucgauuuuuaaaacuucuuagauuaugucuuaugguguaaaaaguaaaagaguuuuugacagcgcuugguucuauugagaaagcugccuuucaaggccugacaguaaagcauauuccuggaaaaccuuuguaaguuggcacauagaccaacuugucucuuggacuggauccuaugggagaggagccagaguuuacaccacuccugccucucuucucuucucucucuucacuaaaaauagucaccuuuguuuggcaucuaugaccagcauaagacuguauugauaaggacagaagugauuuuccaucacauucagucuuuccaaguuaguuuuuuuauuacacauguugauucuucccuucucuuugucuuuuuucucuggcucugaaccaauuuucauauuacauuuuguuucauaagaacagucccaccuuauauucacuuacaacuguauaaacuagcugaguguauuuuguuaccuuuauuccauuuauauuccagcaauauuucuuuacacugaaugagggccuugugucauuuauuauuauuucacagacaaaacaugaacuugugcuccauuucucuaaugaggccucacugucaucccaccucccuuguuuaccauuaaugcuguauuacuagagcccugcucuauacucuccuucucaugugauccaauagcugcuacuucuguacagccuccauccauuucaucuuuuguaaggucuguuuacaagguggauaguaagugacuccaaaagugucagcauccuacaaguuacagaaagaaagauuguagauuaccaucaggaagaacucuguaacugucagagccaucuaaagaugaaaacguuugaccuggaaugaugugaguucccuaccauuagccacuggccagcugauaagaauguauuagcacaaauuaaaguguuacauugcauaagauaauguacgugacaacuugcuguuguaucuuugauauuaaaucugaaaaccaguauucugaaaacuucagugugagaucaugcuguauuaucaaaagaauucccagaagggagcaguagaaauccauaaacugaaagaaaauagauauucuuucccaaucaacagcuguuuucuccaccuacuguuggaaauuauauucuuuuuugugauaucaggugcaugggaugcaucuuucuuugccauccuaaugagaugcucuagagagaguguaauuugccuuaacuugaaccuugauugcuacucugugaugauugcucuuagaaugcuucuggcauauauucaugaaagaugguugggaaucagagacuuaaagagaaaagaaaaguagauuuuuaggauuuaaauggacaguugacaggaaagucauagacucauuuucuuccugucccuggaguucuucagagcagcauugggaaaauguccaaaacuguuuaucaaauugucagaggcauuuaugaaaccucaaggugcaaaucgacagaauuaucuuuuaaaaauaauucacccuuuaugcaugggcagggugccuguaaaagucauuggauuuacauaaccuugaagauccguucccuuguuucugcugcuuccuguguguauuucuccuuacugcugcuccuagcuacauggguuaggagguugauaugaaaggccauaguaaaguucuuuaauuggcacaccuggggagaaacugagcugugaccaucugaaucuugcucuauauucuuuucccagguguaucugucuugugagucccuucaucuggccuuucuuccucugcagauuuaguuauggugucagugcagaaguauacccaugcccagcucccugcaugcuauuagauuguauucugaugauaucuaggugcuugugggauaucuugugcccacagcaauggccuguucaucugaaugcuuaauaagaguuuauauucaguccuguaauagacccauaguugcuauaaacaugaauaagguagggaguguucuaaacaaauaauuaacuucaggcuaguauaucuuaugcugaaugcugauuuuaguaaagauuuuacggacccuuuuucuuuauuccuucacuguuaacuacuuauacaguguuaucauagccucaauuaacauugagccaccauuuugucaucuuuaguuuuugaacugucauguggaaaaugaaauccuaaaauugaaucaugaucugugccauacuuucucuucucccuauauagaacugcagugauuuuaucuucuuggagacugauaaguaguuuauugccuuuuuuuuuuuuuuuuuuuuuuggugaauucacagauuuguccagucauugugccacaacauucaaagaagauggauuauggacuuaccucaaucagauuguggccuguuccccuuggguuuuauauaucuugaugcuagcaacuuuccauuucucauggucaacauuuuuauuauuaaaucaacucuuucagguauuuauuucucuucuuauaauggcuuugaguaaaauuucuaaaacuuguagugagacagccuugaauuuaaaaucagaagaugcacauucuguuuuuaccucugucacugacucugugggucuagccaugucauuuaaccacacuugaauuucagguauuuugucuguaaaaugaggauaauaacgccugucuacuacauuaaaccacaagaugguuuaaagguuagcauaauaaauuauuagaguaugaccuaggaguuaccuaaucugaccucuuuauuuuacagauagaaguacagaaagguaaauugaauugcucaaggucacccaguguguggcaaaaucagaacuggaaacuuaggucuucugccagucccauucaagggcuuuuuccauuguacaguuaaauuauauguuguguguaagcauaguauaaacuguaaaccaucaugcaaaugucagaugauuguuuucccucaguuuuuccagcgcuguuuguuacccuuauuacuaugcaguguuuaaauggaugagagugguaagaaaugaaaaauacaucacuaaccaguggucauaguaauuacauuuucagagaaggccauggccauuagaaaguucaagcuccagggcaguagucaccuucagcuuucuccaaagcuuuagucccuucccugcuggcuuccauccccuaugagccuaaccuaauucucauuauugcuguguccugcccauguggaaugggcagcagguggucaucagucugaaucaauuacuguaagaccucagauaauuagagcauuacucaaccaaagcaaaguauauuccacuuuuaugggaaaguaaucaaucucaaaauaauaauaaugauaauaauaacaagaagagaaggaggaagggagggaaaaagaaagaaagagaaaaaagaaaauguuuagggaugaaacugaguuaauaauauugacuaaacugagguuuccgaacauuccucucacucuccuaucacucugacuucaauagacuccagcagcaagaauagauacuagcaucugugauuauuaguauuaucauuuauaauaccuaguauuuauaaugcuuugagacauuguuucuaauuaucuuucuuuuuuucuggaaucuuagaauaaguacaaguauaugagaugauaauauccuuaauuuuuuagaaaaaggucaauaaggcaaaaaauggacucaaaguuucagauaauuuucaaaaggaagaauucagaacaaagcuguuuucuuaaugaacaaaacaauccaguucuucggaaacguucauuuccugagcgcucuggguagucguggcuuugacuguagcaagucaagaugagugucuagguuguugguuaggagcauggcuuuauucucacacugaccaaggagucagucccagcucucccacucuaagcuguguggcuuugaaucaguuacuucaucucucuaauccucugcauuagguauuugauuuuauuuacuuauuuauuuauuuauuuuuugagacagaguuucgcucuuucacccaugcuggagugcaguggcgggaucucggcucacugcaaccuccgccuucccgugucaagugauucuccugccucagccucccaaguagcugggauuacaggugcccaccacuacgcccagcuaauuuuuguauuuuuaguggagacgggguuucaccacguuggccaggcugcucucgaacuccugaccucgugauccacccgccucggccugccaaagugcugggauuacaggcgugagccaccgugcccugccgcaguuagguauuuuaaauagacuaucucaaauccuuaaaauaauaugaugagagugguaugaugagcugcuuuacagauaaggaauuugagguuuaaaugagauaacucugugaguaguuaugguuuuuaaugauuuaagaauuuuuaaguuaccuuaauucucagucuuccccauguuuuuggaauuaaauguucuuuacuucugauuaacuuuuucuuugucccuuuucaaggagauacuaaggagaacacacaaauugagauaauugcacugauacugaucuuauauuguuuuauuuaucuaaaaguugcacacugaaugugugcaaccuuccacccuucuuuuucagauugccuuucugggccugaccucccaugagagaaucagccugcagaagcagagcaagcauaugaaacagacguugucccucaggaagacaccauacaaguaagcgagaccuguuuuggaugcugaguccuguggaagaucccuagucacugguuuccuaagcuggugccacuacccauggccaugcugcuguucuguaauuugccaucuaguacaguugaccccccuuuucuuagagaagcuuuagugauggggugagugguaaagucgugagccccacggugguaagaauucgagaguuaguuuacuggacacagcacaaauaguaagugacuuugaaguuuugccaagguggggaaucucuccagucaagccacauggucacaagguuguuuguugcuggcguggaguugaugugagauaauuaaguguauggcugagagagccagccacagggugcucuguagagagcguucacuugugugcuuugccaggauuuucagccuggcuuucuaucaccacuaauucuucuagcccuauguugaaugugcccucuuguaccagggagaagccaauuuuucagauuuggauuuguucccccuggagcauuugguuguauaaaacacguuuucaguugaaaaugagaguauguauagaaagaccuucgucuuacgauaugaaagauugggcuuugaagcuuaucucccugccacuuauggcagggucuuggaaacugggagugcugcagaggugacccagagcccucuggggauuugaaugcucgcugcauaucucaugagcagucuauuuuaaagcaugcuguugguacaagaugaaacuguuaggcuguuagacaaggggaucagagacugggauauaacuacaauguguauuuaggagaggagagaaauugacuuaacugggaagagguggcuaaagcaauggcgaguggaaaggagcguaaacuugugaugauuguuucacauugacagugauaauaaaaucccuuucuuuguagcuaaaccagaggaauaaauguuuacuccacuaaacuauggaagccugugauagaguuggaauuugaagcugagccuugagagauguggggcagggcacaauggaguugggagggaggaagggcauuccaagcccuagagaagagucugaauagagggacacaugagagcacuagagcacguuugcugaaugauggcagcaucaacuagaggaacucaagggaaaaccugagucccgcccaaaccaaagauuuuacuuguuuuccuccccuaaguuacuuuuacucaguacaguagucacccuuucuccaugagggauauguucuaagaaccccaauggaugccugaaacugcagauaguacugaacucgguauauaccauguuauuucagucugauaacccaacaggcagguaguguagacagaguggaaacaccagacaaagggaugauuuaugucucaggcagacagagcuggauggcgugagauuucaucaugcuccgcagaacggcaugcaaguuaaagcuuacuaauuguuuauuucuggaauuuuucauuuuaauauuuuugggcugcuguugaccacagguaacugaaacugaaaccaaggggaaggggacacuacucuaacuagcuuuugaaccaggcccuauacauuucuagcaugcauccccacugccaacccaucaacuccacauagccuucuucccaggaaguugcccucugaguaguguugguccuuuacuggcagcaaugccaucauccccaugcagaacacaaucuucuaaacagcaacgcagucauccucauggacagguguguuuuguuguguguaagggauuggguuaggcacuuaaaagauagagcauaugcguaaaaaugagcauuucucauaacuggaauagauagugguacuuccgaaauuuaauggagaaaaaaugaugccuaagacagugcagucaggaaagcuccaguggaaauguggguauuggccugggccuugagaacugguaggacuugaaaggauaaggggguuccugagcuaaguguagagcagugugcguuccaggcccacgcaucuaugaucaugggaaaaauagagccagaguagcuggagcaggagauuuauaaagaugcacagaggagcuagaacuagagggauaccuuauauagagccuugaauacaaagaggaggaauguuuauuugagccucuaggcagaggaguaucuuuaaaggguuuugauugggaggugaggggcuaugacuauaucaggguuuuuggaggacaacagucugcaauaugcaagaugaauuaaaaggaauugagacagagaauucauuuagagaguuacuuauaagguuuagggaggccgggugcgguggcucaugccuguaaucccagcacuuugggaggcugaggugggcggaucacgaggucaggagauugagaccauccuggcuaacacggugaaaccccgucucuacuaaaaaaauacaaaaaauuagccgggugugguggugggcgccuauagucccagcuacucaggaggcugaggcaggagaauggcgugaaccugggagguagagcuugcagugagccgagaucacgccacugcacuccagccugggugacagagcgagacuccgucucaaaaaaaaaaaaaaaaaaaaaaaaaaaagguuuagggaaaaucccaucuuguugauuacaguuguucuggccuauguggccuuugagguaaucaaggucugaauuagggaaguaggaauagaaagaaagaaacuuauugaugucaguggccaguccauuaaguggggaauccaaaaugaagugaugaugaaaaacccaauuaaguggcugagcgagcagaagccaggaaaucuccaaauauagauucagguccagaaauaggcuucaguuuuaagguaccagaagcccaggaacuaucugaucuaccccaucuaccccuggauuucugcaagauguucaaaggacauugcauauuauagauucuccauaaauguuugucaagcuacacaggaaauauaguaagacauguucucuuuuuuuuuuucuuggcagucuuggauucaugcagaaccuggcagauuucuuucaguguggcugcuuuggcuuggugaagcccugugugguagauuggacaucacaguacaccauggucuuucacccagccagggagaagguucuucgcucaguaugaagaaaagcaacccaaaacucucaaucugauuuguuuuuguuuaugucgaugcccuguaguuugaaagugaaguaaagauuuagaauucaccuaaguccaaaggaaaacacgugguuuuuaaagccauuagguaaaaaaaguucucaauaaaggcauuacaauuuuuuagguuuagaaagauggacuuuucugauaaaucuuggcagacaucuaaaaaaaaaaccauauuuuucacaagaaaaugcaaguuacuuuuuuuggaaauaauacucacugauuauggauaaaauggaauauuuucagauacuauauuggcuguuucaaaauaguacuauucuuuaaacuuguaauuuuugcuaaguuauuugucuuuguuguaucuauaaauauguaaaaaauauuuaaauagauguaccuguuuugcuuucacacuuaauaaaaaauuuuuuuuuguaguugag

SEQ ID NO: 15199 - RNA, 1787 nt, Homo sapiens
aaaaagaaaaaaaaaaagauccauuuuuuagguucuuuucggucuccagcugacaacccaacuggacaaugaucugucuggugcaggagaaggcaaaaguuucuacaagucuacaugaccuugcugauacuuguucuaauagaaacccagucugcugugucuucaacauacugguauuuucauuacaaaguaugguaaauuuuugaguuguuuguuucuguuuuguaaagagaauccuuauuggacaccagugaaggugucucuguuuuaaugaucaggguuuuuauuccaucuuuugcauuucuucuauuucugaagguuugucucuuggcaucuuuuuuuaguuucuuaccauaagaguuugacccgaaacugcucacuucacauuggaugacaccauguucuuccucuuugaaaagaaaaggggaaugugucccacuagugaaaggaaaacuuuucaacacuaucccugcuuuagucucagcaaacucagacuauucugcuuagccuucauuagucaucugggugugagugugucuuguucuguuuuucuuuuuaauaaaacuuuuaaaccauauauuuagccugugaccaggggggccaaacccuaagauuucugguaaaccugaaggguggcccuccucagacaauuuaucucccagcaaugacccuacuacacucgcguacugugaauuugggaggagguaaaguugacuucuccucgugggcaguuuuccaaucaccuugugaguagacaccugccaauauuguuugaaaccuuuuuuuaauaugacauccucucuugucauucucuucuccccuuucccacagacuucccuccuggguccagguucagaaccaagacuucuguaccuagugcugccugauuggugaacauugacuucaaguagcauagcccuugugugacucacaacuccguguccuuccuaaaguuucgggaagcaggguugucuaauaugcacauuucuuauuuuggucauauuuuuacuuuagugucacucaccuuuuacaaagugacuuuguacucauuuagggcucuaucggaaaugcuuccauuuugccuuuucuacaguuaggccaauuuugaaauauauaaauucuaugcaacauuuauguugaguuaccaauggaagccaaaaguucucuucccaaacugccaagaaugauacaggccauaauugaaaugggaauaccuuuuaaguuucauuagggguggggugggagugggacaggaacaagacuugccuagaucuuuguuguaucuuggggacuuuuacuuuguuguuugaugcuuaaacuucaaaauucucuguauucaaauuugauuguggcgaaucuacuucaaaaaggaaaaauaauccaacuuuguggauauuaaauggaagguuugcuguuuugaucuaguuguuuccaguggagcaguuuuaugaaauauguucuauaagauguacauuuuuucauuguaacauagaaauuguaaauaauugauuaaagugcugcauuuugaugaauuuuuucuagccauuuuuaaagagaaaacuaggaauugaguauuuuguguacgguauguuuccauccucccuccccuuccuccuccccuccucucucucucuuccuaccuauuuaauuuucauuugucaugagguuuuuggauuugccaaugaucugcuggacaucaugccccaugucauagagaauaaagcugaugauuguaccagucuuaaauuauucaugauucaauaaaauugaugcuuauuuauucagau

SEQ ID NO: 15200 - RNA, 1787 nt, Homo sapiens
aucugaauaaauaagcaucaauuuuauugaaucaugaauaauuuaagacugguacaaucaucagcuuuauucucuaugacauggggcaugauguccagcagaucauuggcaaauccaaaaaccucaugacaaaugaaaauuaaauagguaggaagagagagagaggaggggaggaggaaggggagggaggauggaaacauaccguacacaaaauacucaauuccuaguuuucucuuuaaaaauggcuagaaaaaauucaucaaaaugcagcacuuuaaucaauuauuuacaauuucuauguuacaaugaaaaaauguacaucuuauagaacauauuucauaaaacugcuccacuggaaacaacuagaucaaaacagcaaaccuuccauuuaauauccacaaaguuggauuauuuuuccuuuuugaaguagauucgccacaaucaaauuugaauacagagaauuuugaaguuuaagcaucaaacaacaaaguaaaaguccccaagauacaacaaagaucuaggcaagucuuguuccugucccacucccaccccaccccuaaugaaacuuaaaagguauucccauuucaauuauggccuguaucauucuuggcaguuugggaagagaacuuuuggcuuccauugguaacucaacauaaauguugcauagaauuuauauauuucaaaauuggccuaacuguagaaaaggcaaaauggaagcauuuccgauagagcccuaaaugaguacaaagucacuuuguaaaaggugagugacacuaaaguaaaaauaugaccaaaauaagaaaugugcauauuagacaacccugcuucccgaaacuuuaggaaggacacggaguugugagucacacaagggcuaugcuacuugaagucaauguucaccaaucaggcagcacuagguacagaagucuugguucugaaccuggacccaggagggaagucugugggaaaggggagaagagaaugacaagagaggaugucauauuaaaaaaagguuucaaacaauauuggcaggugucuacucacaaggugauuggaaaacugcccacgaggagaagucaacuuuaccuccucccaaauucacaguacgcgaguguaguagggucauugcugggagauaaauugucugaggagggccacccuucagguuuaccagaaaucuuaggguuuggccccccuggucacaggcuaaauauaugguuuaaaaguuuuauuaaaaagaaaaacagaacaagacacacucacacccagaugacuaaugaaggcuaagcagaauagucugaguuugcugagacuaaagcagggauaguguugaaaaguuuuccuuucacuagugggacacauuccccuuuucuuuucaaagaggaagaacauggugucauccaaugugaagugagcaguuucgggucaaacucuuaugguaagaaacuaaaaaaagaugccaagagacaaaccuucagaaauagaagaaaugcaaaagauggaauaaaaacccugaucauuaaaacagagacaccuucacugguguccaauaaggauucucuuuacaaaacagaaacaaacaacucaaaaauuuaccauacuuuguaaugaaaauaccaguauguugaagacacagcagacuggguuucuauuagaacaaguaucagcaaggucauguagacuuguagaaacuuuugccuucuccugcaccagacagaucauuguccaguuggguugucagcuggagaccgaaaagaaccuaaaaaauggaucuuuuuuuuuuucuuuuu

SEQ ID NO: 15201 - RNA, 5450 nt, Homo sapiens
auccauucuacuuuuauuuggcauuuguucauuugauacauauauacauauauaaaaaucuguacaugauaaaaauacaaaauaaguauuucuucauaaguuaugcaauuaaacagcuaccuuuuuaaaguuuaaaagccauugcaaaacaaaaaagugagaaaucuagucaguccuuuauagucauucacaauaaccuugguauaaaauauccauacaaccuguguguacaaaauaguguacaguucauaagagcugugcaaagacagcaaaguucaguuaaaaaaaaaaacaaagagacuguacaggucucucuguccacaucaugcccaguuccaggaggucugcagcucagcaacaccucccuaggaauaacaaaagggcacaagguagaguguguggugcguauaccauggauacagacauuaaaaagaaaaagcuuuaaaacacacauacaagaauagggacugcugcuuuuuucccccuuuagagaacucacuucuuucgccagagagcuuuuggaaggugacagagaagacucaauauguauguugugccuugaaucagaaggcacuaauauauauauauauauuuccuuuuugaaaaucuugagcuuucuaagagaacaucuaugggaagacagaagugggguaggggguggaaaugagagacuggagugaaauaggagccccuugcuaccuauuaggggaggugaagggaucuagagggucaacggugcuggaguuaguuauaugguuugguguucucacucccaacucgguuuccuccuccauaaacagguuuccuaccauauagggugguuacugcuaacgaccagcagagugugucucacaguaagguccaggccgugggaccacagaacaccccacuguguuuaaaauaguuuguaauaaacaaaauagaauggaguccuugcugaaaaguuaaggcugggaccaagacuuaaagugaacugauguggggagaacuauuuggaguugguuuuguugggaaggaaaugucucuuuggggcuaccgcagggccgguggcgcccucaaugaggugaugguuucuaccgucgggagaggcagcaucugggcacggggacaaagugaaugcgcagacuggaccccaccucuucgauuucaaagcacuuaaaaauaguacucuggcgugcgagcggcuucuaggacacggugauuuccuccuguuccucgcccuccucuuccuccucggaaucugagaaguccgaagguuucccgggacugcucgagugcgcgggcgaggggggcagcggcccuggcagccgcgggucccgcaggugcugggggucggaggacgcgugguaggccaggcgguggcuggggcugcccgggcccuccuccuccucuucguucccagggcccuucuggcccacgucgcugagguccgggugcggauugagcuuggugggcagggucugcucgcgacagcccccgcuagacaggaguucgcgcuccuuggaguuccgccauuucaugcgucgguucuggaaccagauuuucaccuggaaugucccggccggcgagaagaagggagaagcagaggucagaucaggggcuccgggggacgcacgggggcggggaguggagucgggugcaggcucuguccuucgggcuguguccucuccccacccccagaaaugaguuccgguggauucccgcauugacuccgcccccgccucagcucgcgguuccguuugccucauccgcugccacccugccccgaagggcgggguugggggccggugaggccgggagagaaggcggggagucgggguggggagagaagagggcuauccugcggagcuucgaggguaguggcccguguacucacucccucucuaggccucgguuuucccaucuguacagugggaccuaagccguuuccgaacccuugcaauugacgggugcgccggggaggggugaagggcgggggcggggggggugcuguggaggaaaugcgcucaccugcgagucuuucaggcccagcuuggccgccagcuucuugcggucgggcuugcugauguacuucugcuucuggaacaucuucuccagcgccuuccgcugcacgucggagaagacugcucgacgcagcaugccccgccgaggcuucccgcgcgcggccagcggccaggagaaggucccggggaugggcaccacgcuggaggaagcugcaggguggggggagguggcgagugagugggcguacgccccccagucccaacacggcucucccuggcuuuuugcucugaucccuucaucucuuuaaaacgcuccuuuuucucccccuggagaauaggccacgaaccuacaaaccugcgagagugaaaggcgcuuuccgcccaaacaacuuucccuuucaaccgugcaaacccggauuagguaaaaccacggaaacagagaaaacagcccccacaauagccuguuucguuuuuccauucaguggacuuagggaaacaaaccugcguacaucaacuaaaacagcaauagaaaaaauaaauuacuaaaauaaaaauaaaauauccagccgaggccacuguguuucuccccuaagcuuuuaucauuucaguggcuuuugcauucuuuagaugaaaaugaggugcuuuacuauuuugauaaagagggaaaaauccgauuuagauuuuuugaaaaauccaauaaguauucaucuuuuuuauauuaauccuuccuccccucccccacgaaacguaaagaauucggcccgaauacaugaaaaguggcagcuaauuagcacauugacugcuucccaauggguauugguaugauaaaaggggggagaguuuugcuuuaagcgaaagaaaaaaacaaaacaaaaagaaacagagacucuaaugaagcgugaaugguaauuguguaguaaugaacuaacagaaaaagacugaggacaagcagcgaaagccauauauuacugggacaaaagagauuuacacuuucaaacuaaacacaacugcaggccaagaccauugggagaauacugauggcagaagcuucucuuccccgaaucguuuucauuaaauggacaugaaaagcuauuuauaaagcucggguuguuuuuguuagagcauugagaugagggagaaagggagcaaauuccauuauuagcagcagugugaaugguggugguggugguggugguggugguggugguggugcugggggguggggggagggcgaauuaucucuccccuuuaaaaaaucaauugcuuguuucuuuugcugauauuugggagugcugucgugauuuuacccaucccccgcaggccauacccaguuuuucuucucuguauagggacucuccugccuccuuuuuaguuuugaccaguggcagaguuuuugagccauaguuugaaucaucagugagguuacaggaagaaaaccugguggaagcugccuaagguguugcuguuuuaggcugggacacaauuaugggcuuucuucuaacugcuucuuauuuugcaagaucaacgguauuuuauaauacagggugggaaaggaguaugagaagggguuuggaaaucaggcuggaaauagguugggauugggggaggaucuaaucccccucccccugggcgacccuaggcaucccacacaagagggcaccccauguggucuugugaaaagcccgaagcccugaaugagucuuaaagagaaauuagccccggcugguaggugucucucggcggcguggagggacuagggccggucuguguguggcugcccggaggagcugaccaauuggucauggugcugaaaccuuuguggggaaucguggccaagugcacugacucugugggaaaacggcggcgugaagggaugccaacagcuccucgccgggaagggaaccgccucaaauugggaccaugacaauuccugcuaauuuguagagcagggaauuggugcaaagugucaagcagucacugcuugugcucaauagggcaucaaauuggcgcgacggauucaugaauguuauacgccucgcaaccucugaaccagagcauaaccccgagggguggacggagaaauacggcuucggagcagggagcgaugggccggggcuggggcgccgcccugccucgcgcaaagaagggggacgagaccuaccugggaaauaagaagaucugaugaaaggcugaaaagacccuucgaaguagggaaaggcgaaggucuugggagggacgcucuggagcaaggcuggggauguuucuggugggcgauggaggggggacagaaggagagagggagacagaaagaaucugauuacguacuugccuauuguauagcacacugaacacacgauauaauuagcccuucaucugguuucaaagacaucuuucuuauacguugacaggguaaaauaaaucuucccaacauugucuuaucuguaaaacucuuuucuuucuccccaacguaauucucugcgccgucccacucuaccccaaucuccauccuaggcacuaacgagauaggacugaguggggaggaaagaaauugcagauuuauaauauuugcuaauccaauaaauauaucauauugaguuuaaaaaaaaaaacugucuccuagaagcucgaaggcagaaacgcagacguccaggagcgugcgcucagcguuacugcaccagaugacugcgcacagucuccgacugcgugugcucaaguucacuccgaggauggggcgagccuggaggcuuuucuuccccggaauugacuggacuauucucacauugccugacguagggucucagaguucgugcguauugugugugcaccgaugugugugugggggcccgcucgcuagaggaaacugaggccaggaugacuccgcgcaugccuaguaccugaaugggcccuuaggguucugaccucgcuuaccuguucugggccccgaggagaggauggcguucacuccaaacuucagaaacgucgucucgcuggcaggggagaaggcagucggcggagagccgccccgucggcugccgggacccggggagcccagguccgaggcccccgugucggugagggccgugggggcccccugccugggcggcgacaugcuggcggugggcacgcugcggggcagguaggcggggggucggcugaugcggaucagauccuccaccaggaagcuggaguggccggaaaaugccgacugcaaggacuggggcagcgucaaggugggcgugggccgcaggaggcuaggguacccggcggggggcgcgaggaggccggggaacaucaugguaggcgcgggcgggcgaaauaacccuucuuucaguggccggaggguaaacgccucgcuucccgccccucccgcccccacaguguccucucucuugggcuuagcaaacgucuccaaguaacaaucccacuugggcgucugcgaguccuccg

SEQ ID NO: 15202 - RNA, 5450 nt, Homo sapiens
cggaggacucgcagacgcccaagugggauuguuacuuggagacguuugcuaagcccaagagagaggacacugugggggcgggaggggcgggaagcgaggcguuuacccuccggccacugaaagaaggguuauuucgcccgcccgcgccuaccaugauguuccccggccuccucgcgccccccgccggguacccuagccuccugcggcccacgcccaccuugacgcugccccaguccuugcagucggcauuuuccggccacuccagcuuccugguggaggaucugauccgcaucagccgaccccccgccuaccugccccgcagcgugcccaccgccagcaugucgccgcccaggcagggggcccccacggcccucaccgacacgggggccucggaccugggcuccccgggucccggcagccgacggggcggcucuccgccgacugccuucuccccugccagcgagacgacguuucugaaguuuggagugaacgccauccucuccucggggcccagaacagguaagcgaggucagaacccuaagggcccauucagguacuaggcaugcgcggagucauccuggccucaguuuccucuagcgagcgggcccccacacacacaucggugcacacacaauacgcacgaacucugagacccuacgucaggcaaugugagaauaguccagucaauuccggggaagaaaagccuccaggcucgccccauccucggagugaacuugagcacacgcagucggagacugugcgcagucaucuggugcaguaacgcugagcgcacgcuccuggacgucugcguuucugccuucgagcuucuaggagacaguuuuuuuuuuuaaacucaauaugauauauuuauuggauuagcaaauauuauaaaucugcaauuucuuuccuccccacucaguccuaucucguuagugccuaggauggagauugggguagagugggacggcgcagagaauuacguuggggagaaagaaaagaguuuuacagauaagacaauguugggaagauuuauuuuacccugucaacguauaagaaagaugucuuugaaaccagaugaagggcuaauuauaucguguguucagugugcuauacaauaggcaaguacguaaucagauucuuucugucucccucucuccuucuguccccccuccaucgcccaccagaaacauccccagccuugcuccagagcgucccucccaagaccuucgccuuucccuacuucgaagggucuuuucagccuuucaucagaucuucuuauuucccagguaggucucgucccccuucuuugcgcgaggcagggcggcgccccagccccggcccaucgcucccugcuccgaagccguauuucuccguccaccccucgggguuaugcucugguucagagguugcgaggcguauaacauucaugaauccgucgcgccaauuugaugcccuauugagcacaagcagugacugcuugacacuuugcaccaauucccugcucuacaaauuagcaggaauugucauggucccaauuugaggcgguucccuucccggcgaggagcuguuggcaucccuucacgccgccguuuucccacagagucagugcacuuggccacgauuccccacaaagguuucagcaccaugaccaauuggucagcuccuccgggcagccacacacagaccggcccuagucccuccacgccgccgagagacaccuaccagccggggcuaauuucucuuuaagacucauucagggcuucgggcuuuucacaagaccacauggggugcccucuugugugggaugccuagggucgcccagggggagggggauuagauccucccccaaucccaaccuauuuccagccugauuuccaaaccccuucucauacuccuuucccacccuguauuauaaaauaccguugaucuugcaaaauaagaagcaguuagaagaaagcccauaauugugucccagccuaaaacagcaacaccuuaggcagcuuccaccagguuuucuuccuguaaccucacugaugauucaaacuauggcucaaaaacucugccacuggucaaaacuaaaaaggaggcaggagagucccuauacagagaagaaaaacuggguauggccugcgggggauggguaaaaucacgacagcacucccaaauaucagcaaaagaaacaagcaauugauuuuuuaaaggggagagauaauucgcccuccccccaccccccagcaccaccaccaccaccaccaccaccaccaccaccaccauucacacugcugcuaauaauggaauuugcucccuuucucccucaucucaaugcucuaacaaaaacaacccgagcuuuauaaauagcuuuucauguccauuuaaugaaaacgauucggggaagagaagcuucugccaucaguauucucccaauggucuuggccugcaguuguguuuaguuugaaaguguaaaucucuuuugucccaguaauauauggcuuucgcugcuuguccucagucuuuuucuguuaguucauuacuacacaauuaccauucacgcuucauuagagucucuguuucuuuuuguuuuguuuuuuucuuucgcuuaaagcaaaacucuccccccuuuuaucauaccaauacccauugggaagcagucaaugugcuaauuagcugccacuuuucauguauucgggccgaauucuuuacguuucgugggggaggggaggaaggauuaauauaaaaaagaugaauacuuauuggauuuuucaaaaaaucuaaaucggauuuuucccucuuuaucaaaauaguaaagcaccucauuuucaucuaaagaaugcaaaagccacugaaaugauaaaagcuuaggggagaaacacaguggccucggcuggauauuuuauuuuuauuuuaguaauuuauuuuuucuauugcuguuuuaguugauguacgcagguuuguuucccuaaguccacugaauggaaaaacgaaacaggcuauugugggggcuguuuucucuguuuccgugguuuuaccuaauccggguuugcacgguugaaagggaaaguuguuugggcggaaagcgccuuucacucucgcagguuuguagguucguggccuauucuccagggggagaaaaaggagcguuuuaaagagaugaagggaucagagcaaaaagccagggagagccguguugggacuggggggcguacgcccacucacucgccaccuccccccacccugcagcuuccuccagcguggugcccauccccgggaccuucuccuggccgcuggccgcgcgcgggaagccucggcggggcaugcugcgucgagcagucuucuccgacgugcagcggaaggcgcuggagaagauguuccagaagcagaaguacaucagcaagcccgaccgcaagaagcuggcggccaagcugggccugaaagacucgcaggugagcgcauuuccuccacagcaccccccccgcccccgcccuucaccccuccccggcgcacccgucaauugcaaggguucggaaacggcuuaggucccacuguacagaugggaaaaccgaggccuagagagggagugaguacacgggccacuacccucgaagcuccgcaggauagcccucuucucuccccaccccgacuccccgccuucucucccggccucaccggcccccaaccccgcccuucggggcaggguggcagcggaugaggcaaacggaaccgcgagcugaggcgggggcggagucaaugcgggaauccaccggaacucauuucuggggguggggagaggacacagcccgaaggacagagccugcacccgacuccacuccccgcccccgugcgucccccggagccccugaucugaccucugcuucucccuucuucucgccggccgggacauuccaggugaaaaucugguuccagaaccgacgcaugaaauggcggaacuccaaggagcgcgaacuccugucuagcgggggcugucgcgagcagacccugcccaccaagcucaauccgcacccggaccucagcgacgugggccagaagggcccugggaacgaagaggaggaggagggcccgggcagccccagccaccgccuggccuaccacgcguccuccgacccccagcaccugcgggacccgcggcugccagggccgcugccccccucgcccgcgcacucgagcagucccgggaaaccuucggacuucucagauuccgaggaggaagaggagggcgaggaacaggaggaaaucaccguguccuagaagccgcucgcacgccagaguacuauuuuuaagugcuuugaaaucgaagaggugggguccagucugcgcauucacuuuguccccgugcccagaugcugccucucccgacgguagaaaccaucaccucauugagggcgccaccggcccugcgguagccccaaagagacauuuccuucccaacaaaaccaacuccaaauaguucuccccacaucaguucacuuuaagucuuggucccagccuuaacuuuucagcaaggacuccauucuauuuuguuuauuacaaacuauuuuaaacacagugggguguucuguggucccacggccuggaccuuacugugagacacacucugcuggucguuagcaguaaccacccuauaugguaggaaaccuguuuauggaggaggaaaccgaguugggagugagaacaccaaaccauauaacuaacuccagcaccguugacccucuagaucccuucaccuccccuaauagguagcaaggggcuccuauuucacuccagucucucauuuccacccccuaccccacuucugucuucccauagauguucucuuagaaagcucaagauuuucaaaaaggaaauauauauauauauauuagugccuucugauucaaggcacaacauacauauugagucuucucugucaccuuccaaaagcucucuggcgaaagaagugaguucucuaaagggggaaaaaagcagcagucccuauucuuguauguguguuuuaaagcuuuuucuuuuuaaugucuguauccaugguauacgcaccacacacucuaccuugugcccuuuuguuauuccuagggagguguugcugagcugcagaccuccuggaacugggcaugauguggacagagagaccuguacagucucuuuguuuuuuuuuuuaacugaacuuugcugucuuugcacagcucuuaugaacuguacacuauuuuguacacacagguuguauggauauuuuauaccaagguuauugugaaugacuauaaaggacugacuagauuucucacuuuuuuguuuugcaauggcuuuuaaacuuuaaaaagguagcuguuuaauugcauaacuuaugaagaaauacuuauuuuguauuuuuaucauguacagauuuuuauauauguauauauguaucaaaugaacaaaugccaaauaaaaguagaauggau

SEQ ID NO: 15203 - RNA, 3341 nt, Homo sapiens
caaaauuaaacuaucaagauuguuaaaacuauaaaauuaucaagaucaauagcaauuccaaauuucuugaucuacaaaaaguguuguaauagagauaaauauucaaaugguaaauggaauuucuuuacuuuccccuagauuggcaagaauucuauuugauugauagugacuaccugacuuguugaauugagaaagauacugagaccauguuggaacucagcgauugcugauuaguuucugccagcuccacugggaugaaagauuagggacauguacagcauauauuuaccauaggcugccucuaacuuuucauuaggaauauuuauuucucuguguagauugucaguuggucaaaccaguaauagaaaaugucucuacuuagcugucuuuaugauuuacaucauaaguaaagacuauucuacaccauuauguuaguugaugguaugguucugcuacaguucuguuacugggcagggacaggguuucagaauaacauagggggaugugauuauuuuaauuuuuagcuggcauaugguucuuuuauugaagaaagaaaucccuccugcugauucgguuauuuuucauguuuauaagguauaaguauaggcucauaugguagauccauaugaagcagucaauugaaaauaacuuauaaaacaugauuuauuuauauuaguuccauauuuuccuuuuuauauaaaauguguucuauauauuaugccagagugaucacauuuuaucauguacauuuugcaaagauuaugguuauccuuucuucuuugcuuuuuaguuuaaaaugaaauuuauuacuuuuggcugaaaaagcacuuauaaugggaaugccauaugugccagcaaagauagcuuacauuuuugcuugugcuggccuuggcugacugucaucucuguagacucacuuucucacucuugcugaauuuuguagucuccaacucgggaucuuagaguguggccaugcgaggaauuucagaggcuggcaccuuucaucaugacuucauguaugucucugccuuucacaacucaggggguguucuuaauauauuuuuuuuuaauuucaaaacuaauuuaaacccauauagagagcaaaaauaguggaguuccucuucauacugccgcuaucaccuauaaccagcuucuuuucauuuuucagggguaguuacuuauaacaauuagguauguauccuuuuaagaagaaaagauuguuuaaaaacucucaguuauauuauacauauuguucaguaauuuguuuacucaucuaauuacauaucuugaaaauauuucaaucuuugaucaucuauaucuaacuuugucuuucuaauagcuguauauuauucuguuauguggauagaucauuauauauacuauauauguuauuacacaaaucauaauauauauauuuagaauauauauagaucaugcucauuuuaagagcauuuagguuucuguuuauuuauauuaaaaugcugcuauaugcauucuuuuucagacaucauuuuauuauuuuuauuugacaacuaaaaaucauauauauugauaguauacguguucauccauuuguauugcuauaaaggaauacccgaggguuuguaauuuauaaagaaaagagguuuauuuugcucagaguucuguguguuauacacaaagcauaguguuggcaucugcuucuggugagggccuaaggaagcuuacaaucgugauggacggcgaagggaagccagcaggucacguggugagagagggagcaagagaaagaggcaggaguugccaggcucuuguaaacaaccagaacucgugugaacucagagcaagaacucacucauuacugcaaggacugcaccaagccauucauaagggaucugcccccgugacccggacaccucccucuaggccccaccuccaccacaaggucacauuucuacaugagauuuggcggggugggggggacguggaucaaaacauucuaacuauaucacuguacaacgggauguuuugacacagguauacauuguggaauggcuaaaucaagcuacuuaauauaugcauuacuucacauacuuaucauuguuuuguggugggaacacucacaaucuacuugcuuagcaauugucaaauauacaauguaucguuuuuuacuauaguuagcauaauguacaacagauaucuugaacuuauuuguccuaacugaaauuuuguguuuguugaccaacauuuccuuaaucccccaugccccagccauuuuacuaucuguuucuacuauuucaacuuuuucacauaccauauauaagggaggucaugcaguguuugucuuucuguuccuggguuauuucacuuaacacaauguccuccaaguucauccaugucauagcaaauaaugaaauugcccugauuuuaaaggcugaauaguauuccuuggugaauacauaccacauuuucuuuauccacucaucuuauauuuaauuuauauuuaauuuauuuaaguuuaucuucaauccaccugggauuuauuuuuggcuguaguggguacaaauggagauauuaaauaguuuuccacuggauugcaaagcuaacuucuuuuuuuaacauuuuagcuuuuauuuuagguugagggguacauguacaaguuuguuauauagguaaauuugugacucagggauuugguguacagauuauuuugucacccagguacuaagcauauuaccuaacuauuugguucuuuuuuuuugauucucuccuuccucauugccuccucccucaaguaggccccaguuuuuguuguuccccucuuucucuccauggguucacauuauuuaguuuccacuuauaagugagaacauacgguauuuggucuucuguuccuggguuguuugcuaaggacuaacuuuuuaaauacuaaaauucacauccaaauguuucuagacucuuccuucuguuugacuauuucuucacuaaaaccauucuguuuucauuuuuguaugcuuauaaugugacuugauaccuaguaagaaaauauuccuugcacuauuuuuuaccagacacuuuuuaguuacucuaucuauuuuucgacuccagguggacuuuagaauuugcauaugaaauuccaucuaaaauuguaauggcuuucucauuggauguuguugaauuuuuaucuuaguuuguggcauuuuuaaaauuuguaagucuucccaucuaggaaaauuuucucucucuccuuuuauucagagauuuuuaucuucuuuguguuguguauuuauuuuguccuuuauguuauguuauuuauucuuuauaguuucugaacauuucuuguuaaauuuuuucccagcuau

SEQ ID NO: 15204 - RNA, 12121 nt, Homo sapiens
aggccucggcaagacgcgcaggaagaccagcgcgcgggaugcgucccccacgcccagcacggacgccgaguaccccgccaauggcagcggcgccgaccgcaucuacgaccucaacaucccggccuucgucaaguucgccuauguggccgagcgggaggaugaguugucccuggugaaggggucgcgcgucaccgucauggagaagugcagcgacgguugguggcggggcagcuacaacgggcagaucggcugguuccccuccaacuacgucuuggaggagguggacgaggcggcugcggaguccccaagcuuccugagccugcgcaagggcgccucgcugagcaauggccagggcucccgcgugcugcaugugguccagacgcuguaccccuucagcucagucaccgaggaggagcucaacuucgagaagggggagaccauggaggugauugagaagccggagaacgaccccgagugguggaaaugcaaaaaugcccggggccaggugggccucguccccaaaaacuacguggugguccucagugacgggccugcccugcacccugcgcacgccccacagauaagcuacaccgggcccucguccagcgggcgcuucgcgggcagagagugguacuacgggaacgugacgcggcaccaggccgagugcgcccucaacgagcggggcguggagggcgacuuccucauuagggacagcgaguccucgguaagugcgcugcgcccacagcuccggcugcaggcaguaaaugcgccuugcgcggugggucugugugccgcgcccuuuucacauugugugaguacacuagaaagagcgggagacgcagaugaaugcaauuuaguauaauguuugcuacuccgugauuuacuugcaucuguuuuggggauaguggguguccauuucuggaggugggagauuaacuaaaaagauguuuuuagcucacagaggugguucugcuucucucccaagauucccccucuuguauuucacaggcucaaacaucauuuucucuccugguugcccauucuguguacguagaaggcccgagugauuuacuuuguuucuauucggucugugucccagagaaagcauucuuugcaagacugguggcugguuucugacaccuccuuuuguuguuugcuugcuuucucuuuguaaaccauauaaucccaaggucauugccacggcaggcagcgccacugaguucaucucucaaaagcuuuuaaagcacuuacgagauaaauugaaaagaaaacagggguucuugggagagaugaguuuuguuugugugcagugagucggagauaugaggccacucgacuggggcagcagacccaguucagcggugggcaggcugggggcggugaguuucaggcauggggucaagccugcaucccagaaggcaggcuuuucgugugugaaggaaauacucgaccaguuuugcaaacgucuuuccgaauacaccuucuacaaucgagagacuuccaaaacaagcauuuaggagauagaguuuaauguauuugaauuguauugguucuaggaggcuucaauuucauuuuuaaaugcacgcuauaagacuaguaaguauguacuaccugcugccacugcuguccucugaaaagauuacuggcacaaugaauaagugcucauucaaggguccuguugacugaucagagaggcauucaaagcccuccagagagaggcgacugggaugugcucucuuugaggacggagcaucguggugguggaaacuggacuccuuuauggugucaucaauuuugcggagccuuacaugugcuuggacgggaaugccaggcugaaagcuaacuucaucugaaaucugaacucugagauuuaucaagucaccagaguuuaucauuccuggcaagacaucacauugaauuguucucacaugacgagagcucugugcaccacuucuuuuagaucguguuugaagccuuaagcaaauuaaggacagcagcgcuuuuaacucaaucgagcagaaacuuagagaaagcgcuggaaaaccaauuacaauauuaagugcuugguccagaguccuuaagggcuaaguauaaugcacaaaauaugaucuuggcuuaaaauuuuuugaguuugaggagacuucucagaaggaaguccugcaguguggagacauuggucccagucauuauucuuucugccuaagauuuggggaaaagaggaaagacuuuagaggguagaugaaaaagguguucuccgggguugcuggccuuagggaggaccuauggcuuuucuguggaacaugcacagguggucauugcugucugaauucagggaccaagucccuuuggauaaggagggaugcaugcauugucuggguuucaucucagaacucugcaccccacugucucaguugucuuauauuguuagagaaugagcuaacuuuuucuaaagaacuaaagcacgaauuguuuguauuuccuuuuaacaguuuuuuaaugggggccuuucaggguuuuuugcauucucuccuaacuuagaaagucaaggaacaacauauaugauucuaggaauauagggcggaaagagcuuuacugggacuugcaucggcucugcacacauagcagcaccgucuuugucugagguuccacguggccugaugcugugcagggcagcuuguccugauggaucuugccgugacacgggccauuuucagcuguuagugugcaugccuuguuccauggggauucugcaagagcccugagguguguguguggcuucuuuucuccugacagcagaaccaugccagguuugcuguauuuccuguucauaaccaaggcguucucagcugucaucugugacuaccagggaccuguccugguggacaaguggacaaguccuuugcuuguuuuuuucccaccauccacugccuccccccguccccauguguuuuccugcucauuuuggcauuucucagguuagagcuggcuuucgcagccaccacuaggccaccaagagcccuuagguucaugaucugacauaauuccuucgcagcaugccaggauggaaagguuucugagggguucagccucccugcaggacucagucaggcaucuuuauuuaauuuccuuuuuuucuugcagucuuugggccugggccuuuaauugagguuaucacaugaggccuggcuucuggauaagcacagcuguuuuuuuuggaauggaucuucaauaaaauauccugagugauugcaguguaaaugagcuagacccuugcuugacgauauugaggggugcguauuucagggaagacaaacauugccacaugcuacacuauccacuaucaguaagugcuggguauuucagaaguaucuguuggauauguuagaugaaucagugaaccaacaaacgaacgaaccucuuggacccucuuuccuguccugaacuucaguaccuacugcuuguccuuccauuucuuccuccucccucgcucuccucucucaucuacaauugucauuuauccuuagcagcuaaaggugaugcauuguuguugcuuauucuccauauuucguuaucauaccuucaccugugagccauaccugcuuaaauccagaaaacucagaaauccuacucacccuguguguguccauuauaaauccuuuuauauuacauuuuguccacauugauucuauggauguggcuagaaagcuguacuuaaaaugaacaguaacccuuuacuggguuucugguaaacuguacaaguugucaauauuuuauuuucuuaauugcugcaucucccauccuuguaaagcuuguucagaaaaugacagaucacaacuaggauaugguuggaaaaggugcagagcuggccugcaagugcgggaggccauuuuccucuguaagauuuuaguucccgaagauaucauguauuuauuauguccugcaauaguauuagauacuaauauuuuuugucauacaguacuuuuuuuuccaguagagaaaaacugucucgcuaaggauaauuuaaugcacauauuuguuucauuucucuuuuuuaaaauauaugaaaaguauuuggcugggaaauaaaauagaauagcuccuuucuguauuuuuaaaguuauaauauuucuuaaagaaauuauaacuuuuacccaaaacucuauuuucaggcaauuucaucauuccauuucucuaaauaaugauucucuaacuguauguaguguguaucagaauugccuugaagcuuguuaaaacaaauugcuggguccuaccugaaaugguacugauucaggaggucuggggcccaagaauuugcauuucuauuaauagcacguuucuugguggugaugcugcugcuuuugggaccacacuuugaaaacccuugaucccuaugaugcauucuuagugguuuuauauauucuugcagcuguuauuaaaaccauuucugcauaauacuacauuuccaugaauuauaaaaauauugucauaaagcugaacuucauuuagaacugaagcuuuuguugagugggauuuaucucuugaaguauauuucuguugaguuuuuuggggggcuuuuuuguguuuuuguuuguuuguuuuuuacuguuuagaguuugaaaauaaacgugcuguauuugcuguguuucugcugaugaauuaggaggagguagauugucagagcaaugugaaagcugcuuccaggguuucaugguuaggcuccgugauccaugguguuucuucauaaaugaguuaauguuaagaugacuuaaccuuagguugcugugagcagugccuguaggcaucuuuccaguuucaaagauaacaaguuauuuuuaauugccaggcuuuuugcccaguaccaaauggaaguuuuaagccuggauuuuuguaauaguucuaauuuuaagcauauuuaacucuugaagauggaaaggccugcaagaucaugcaguacaggcuguuaucuggaaguuuagugcucaucaccugauucugauucucaaaugggccagagcccuugaagacucugccuucucacucuggcuggcucuucaaugcugaccuuuaaaacagacaacauccagcaucaccagcaaacuugcuagaaugcagauugccccagcuugcugacuucgaaucucugggguagggcucugcaaccuugguuugaagaagcccucugaguccuuuuuuuguuccaaauccugagaaccuaugaacuccugaauaauucugaugcgccaauuugagaaccacuacguuguggaguaugcacuugauucaagcccuuuugcauacuguuguguaauaugguaaaauucugacuuaaauguaucacucagucacaucagguaugacacuauggaaagacaaagaauaacaaggacaauauucuacaggucuauauggugagguauuacaugugacuuuaggaaauacauuuggggauagggagggcuaaccacacacaugcauacuaacuggaaaguggacagggaacgcuccguuugccuagauuagguagaugggacuuggacagcugcucuguaguugaugauugacuuuucauuuauguaaauaagauuacuuccaaaguuaaugagaugaauauuugaacaugucaguguggauuggcuucaggccuguggaguaaauauuuuauagagugaacauugauaggagaauaggaaaagcuggugagacucuucacacuuggggcaaggaagagauaaucugauguaaaaacaaagaacauagggucaacugacagcuagcagcauaaguauaggcaggaguaauuuuuauuaaaagaaggcuaccuuagacaacuagggcaggugaccaaauagaaugguaaaacugaaaggcaguuuuucugagauaaaaacagagaaacuauuaaucaguggaucacgauuugccucuaacccauuuguucucacuuuugggagguaaaugaaccacuucuguggacagaagagugccuucuguaaagaaguaaaaggggaaaaacaugucuuuaccaaaagaaaagaaugauacaacuugugauaagaaaccaacagggugaccucucucuggggguagaaggagauguguagauuauugaugcuuggagacuucagcguggcuggagaucaguccagggucuguguggaaggccuggugaaucacacaaagggcauuucuacccucaucauuucauaaaguccaaagugaaagauaaggagaaguuuuaagguuuaaagaaccaaaaguaccuggagcaaggccccucccucccguuuccucaugacuauugugcuuagaagaaaaucgcauuaauacauaagcuuucaggaauggaggaggaaauaaaggauauuaaagucuguccucggcauucauuuuuuuccuucuaugagaaaacaaugauuaaaucuugagagagggagaggcguaucugaucaggacaucuguuuuauaaaacugcaaaggugcuuuucagcaaguauuugaggcaauggaucaagcuggcaaagccauagagaugggaucaaagagugugcucucuacuguucuuuucuaaaaguacccacuuaucgcgagcacaaauugcaaagagaugagguguaagaauuaccuaaaggaaugaauaauggaagagguagucaaaauuagaaauuuuuaagucugcacguuuguugaacaccagauacucugagcccgguguggggauguggagcuaaauaggguucuugcacuuaguuguauucaaacacagaaucuaaagccuaaacaaaaauaaugaugauagaggccccgagagagguugguuuuccgccaaccuauuaauuguccuuagauuccacuuggaaaaugacuucugaaaagaagggucaaaugaauggguuguacuaauuguucauucuccagaaccauugauucaaaaacuaugagaauggaaaaaucauuccuuauaaggaguacucauagaaggacauaacaggaagaaguggucugauguuugaaaauuugaagaauuugcccaguagucagcacagagaaauuacuauauaccaaguaaguacaguguuuggagauggaaaguguaggaaaugcggacagugggagguagcacaaagguggcaauuaaagaggagaaaucaaaggggagauguuucaaaacccggggacugagucuaguuagguuuuaguccaaucauagaaaauuguaaugaguguccuguccaucuaugauggcuuaaaaagauguccauaaauucuuugguacucuuugcuucagaagguggagccugacccucuucccuucagcaugggcugcacugagcaacucacuucuaaugaccaagauguggcagaagcgauggagggcagcuuccgagaugggcauuguggcugccucuuugcucucucuugggucacuugaucuagggugagccagcugucauguugagaguacauucaggcagcccuacagagcccccuagggguucaugugagcagacugccuuggaaguagagccugcauccccagucuagccuucagaugacugcagccucagccagcauccugacugcauguuucaaaaauguguuaagauucuuugacaagcuuaaauguagaguacucuaccauacuaucaguacucuaguacuuguugaggagcaaguguggcaugguccuuuuucauccaauuucuugaaaucuguucuagaaagccaaccguggaaggacugcaacagaugagaauaggacugauggaguugcuuucaugggaaucauucccuggcucccucuggaggcagaguuguuuugggucgggaguaacuccaucuccaucagaugcagggacugguggcucacuuugaaaggaggagaccauacagcagugucccagcugucccuucaggggaaauucccuaugagagaugucuggagcagagccagaguccucaggacagaauuggaaaaguauccacagacuggagcucccuccaucaugggcugcuuugcccauaaauggcauucccaucuuuuucuggugaccaaacauuuguugguggcuccagcacugccgauguuuguuccagauuuucuuucuuccaguucucaaacugcaucagaguccccugaagggcuuauuaaaacacacggugcuggagguuaaaacacagauggcugggcuccaccccagaauuucugcuacagcaggguugaggcagagccugagaauuugcauuucuuuuuuuuuuuuuuuuuuuuuaauuauuuugagauagggucucacucugucaucuaggcuggagugcaguggcccugucauaccucacuguugccuugaccucccgggcucaagugauccucccacccuggccucccaaguagcugggaccacagguaugcaucaccacaccuggcuaauuauuuuaaauuuuauguagagauagggucccacuauguugcccaggcugaucucaaaguccuggccucaaguaauccugccaccauggcaucccaaagggcagggauuacaggugugagcuuccauggcuggcccuugagaauaugcuuccuaaccaguucucagaggaugcucaugcugcuggucuugagagcacacuuggagaacaucuuaacuaguucaucuucacacuucacuuagagguguucaguggucauauguaacgguguauguuaguauacagauuguucuuuuucagauuuccuacagaaaaucuacuuaguuuaaauuaaagaacacuccccaacuuuuagcacuccugcuuggcauaaauugguucuacauccuuaacuuuuaaagguuucugcucaggagcccacgaaauuaaaaauuaccucuucugcugcgaaaauuuuauugcugcaacucaugcaugcauacaggcacacacacaccaugauguuaaauuaaggagcuugaauuaaaagcaaauuucccuuauguagaaagucaucuguugaucauuuggcuuaauuaaaauuggguguaucuuacaucuaccaugauucacucccauacugccuccacuaaaaaugaugccacauuaucucuaaauugagccuggcuuauaguaaacucuauaagugagacugcccuucaucuuuuccuaaagauacaacuucuaguacagaauauuaaucaucuauaggcugaggccuaaucugagauuaaccuucugguuucuuccuggaguuucauccaggaguaugcccugggccucacauggggaugagauggggcuuuucgccucaaagguuuguucuuauuuggucuauuugagacagaggcaugcauaaauacaaacuauacuuacaauuguuccuuucauucuuuucuguuaacagcuauggcugcugggugagcccagcugccuugcacaauuugagucuucucagacacucauuccccugaguugucauugguagaaauggagugauuccuuguuuugcaaggguugcacacuucucaucaaacauuuauuugggcuuuugugaacucuguaauagacaauggccuaguccuuuguuaacugucuggagguccugcugggaggucgcagagcagggcugagcugcuggacccucagagcaggaaguuucugggcuuugagaaaagcagaaaacuggucugggaauuccaggaagaauuucggauguuaggcugugguccugccacuggccaggcauguccgagguaccagcccugccucggagagcacaugcucagcuccacauuguccagagggcucuccugcccccacacgcacuuauacauucacacagaugaacucacacgcuacgcauacucucacacacucucaauacucacauacucccucucacaucugcgcacgcucacacacuuagagcugcgguaucucaugcuccucuuucaugcaacucuuuuuuuuguuuguuuucuuuuuuuuuuucauagaacuuacugcccugugcagccaucuguacaccucuauuuaucuguuccccacaccagauugucacagagcauauguccugcaugcacacacauguauccagggcaccgccugccuggcauguguuaguaacuaauuguuauucauuuaaugaauugaucaaaacuugauauuuuuguacaaagaacauuuaucguucaguaucuucuuuccugcaugcuuuucagcaaaugagauaaaagaccaauuuuuuuuuuuuuuuuuuuuuuuuuuuuuuuuuuuugagauuuuucgcucuuguugcccagaccagagugcaguggcgugaucucagcuuacaacuuccaccucccagguucaagcgauucuccugccucagccucccaaguagcugggauuacaggcacacuaccaccaugccuggcuaauuuuguauuuuuuagcagagaugagguuucaccauguuggccaggcuggucucaaaguccugaccacaggugauccaccugccuuggccucccaaagugcugagauuacaggcgugagcuacugcaccuggccaauaaaagacacauuuuaauuaaaauaaugacauguuucuaaaauauucugaaauagaaggcacaucacagaauuuaaauauuuuucaauaaaaucuguaaucaaaccauaguucagcuuccucugggauauugugaacuauguuuaaaaugcgaccggaauuuuccacugcuguucauauuuuuaaaugcuuagaauuagaaaaauuagccaggcaugguggcacaucgggaggcugaggcaggagaaucugcuugaaccugggaggcgcagguugcagugagccaagaucacaccauugcacucuagccugggcaacaaaagcaaaacugcgucucaaaaaaaaaaagaauuagaaaaauuuugaugucuuaauuucuaauaggguuagacaucagaaguaguaaaauuucuagcuacugccugcaugcaaaccacucuuaauaaauucccaguuuaucaaaaaauaguuugggaaaugaaaaacagcaaauuucuugagcagucagggcaacacuguauauuccauagugaagugcuguauauuccauaaugaguuugcacuuuucaaauaacuaaaacgcauuuagcacugaaacugggcuaagcagaauuuauuuuuucuuugguucagaauuucagaaucguggacuaccuccaggucuuucugaacaucagaugccguucuagauauaaaacagagacccggcugggcgugguggcucaugccuguaauccgagcaauuuggaaggcugaggcugggagggggguggggaucaccugaggucagaaguucaagaccagccuggccaacauggcgaaacccugucucuacuaaaaauacaaauauuagccgggcaugguggcagguuccuguaaucccagguacucgggaggccgagacaggagaaucgcuugaacccgugaggcggagguugcagugagccgagauugggccacuacacuacagccugggcaaaagagugaaacuccaucucaaaaaaaaaaaaaaaagcagagacccaguguuugagcaaugggugguuuggauuuagacgcacaagagauguggauggauuuagacacagcuccccgcuguggcccggcuguaacuguguucuguuuccuccccagcccagcgacuucuccgugucccuuaaagcgucagggaagaacaaacacuucaaggugcagcucguggacaaugucuacugcauugggcagcggcgcuuccacaccauggacgagcugguggaacacuacaaaaaggcgcccaucuucaccagcgagcacggggagaagcucuaccucgucagggcccugcagugacggcgccccggccccacacucgccucccgggccccacgguggagcugcccgcccggccuuguggcagaggcuccucccgcggggacggccccgacggcuucucugcgagucucucuuuauguucaggucgcuuggucgguucgucucccauuugccauccaggccucacacccacacucgagcccacccggccggccagcuuuagaggaggggaggagcagggcgaguucacauuauuccuuuuccaucggaaguggcgcucgugcauuc

SEQ ID NO: 15205 - RNA, 711 nt, Homo sapiens
cuuucagcaauucaggauguuccuuuucauauuuaagacaagcacucuugcauacaaauuacauagcugugggcugaaugaagaugcuaccauugcuguacuucuacacagguucuuuucauguaaugaaaucagaagggauggcuuuuccauuucaagcuucuguuaauaaguagucuuagaauugccuuuguguacuguagccaacaccccaacucauauauuuuuauaaucuuugugaugcagaauaaauucugaaacuuuccaccuccuaauuaaauauagaaauacugaaaacaauaaagcaccauguauucacuauggacauaugucacauuuugucacuuucuugcacucuuguaaucccucucuaaagcucauguuaaacucauguucuuuauuuucuucucagaugauuccuuuggcacugcauguaacaguacaggaauuucuuccuuucguacuuccaacaaauacuuuuuugucucuuaacagaugugaaccauaaugcuguucuuuagaaagcaaaggaugaagugcacagcaguguuuucuauauaaagcuaaugggucauaaggggaaauauggguuauuuccagcuuguuaauugucuuaauacauuuuuccuaagaauucuauugugccucugugguuauaugcaccaauauugauaaucuuacagcgugccauaaauaaggauuuuuauauua

SEQ ID NO: 15206 - RNA, 1675 nt, Homo sapiens
uucccauucuuauucccucuuuuaggcugaaugaaaggcugggggagugaauuuaaaaauagauggaucucagcuggagaauggguuggucacguaucucaacugauauuaaauaauuucuuaaauccuggauugaagauuauaagaaaacaguaaauguuugcucucaguucauuucuuuguuuuguuuuuucauguacaguuuuaggcacuuguaacugcuggaugcaugaacuacuuucuaguucuuucaggccuacuuuuagauaucugcuguggggacaguccucaacacuuaaaguaauuuuaaauagugauaggcagaacuaggggucaguuuuacugccuaugccugugcugaauuugacauggcauuccuaggaggggagguggaacgagggcggugcacacauuguccauauugcuagucagugccagauuuugagaaacuggggcuaaucucucucuuaaauggucaagaucuaauuccccaaagugcuguuucagauaaccuaguauuuguccaaaauugcccugcuacaauaguauuuaucuuauauauauguauuauauauauaauauauauauaaucuuauauauauguauuauauauauuauauauauaaucuuauauauguauuauauauauaauauauauauaaucuuauauauauguauuauauauauaauauauauauaaucuuauauauauguauuauauauauaauauauauauaaucuuauauauauguauuauauauauaauauauauauaaucuuauauauauguauuauauauauaauauauauauaaucuuauauauauguauuauauauauauaauacauauaaauauauauauauauauauauauagguuuuuuuuuguuuuuccuccugagauguagucucgcccuguugcccaggcuggugugcaauggugcagucuuagcucacugcagccuccgccuccuggguucaagugauucuccugccucagccuccugaguagcagagacuacaggugugcacuaccacgcccggcuaauuuuuguauuuuuaguagauacaggguuucaccauguuggccaugcugguuucaaacuccuaaccucaggugaucugccugccucaaccucugaaagcacugggauuacaggcaugagccaccacaccaauccuauuacauucuuaaaaaaauguuuguuuguuuguuuuuguagagaugaaguuucacuauauuacccagccuggucuugacuccugggcucaagugauccuccugccuuggcgucccaaagugcugggauuauagacaugagccacugcguccagccuguaucauauuuuuauucugauaucuuuuguaauuuuguuuuuagugaaguagggagguuuauauuagauaaucuuccaagguaauuaucagcuuggacauuauaugcuaauaugucuuuuguuuguuuuuaaaauaaguguauauguuuuaauuguaaaauuuuuaaaacauccagaaaaugacauagcaagugccuauuuauccaccaccuggaaauauaaauuauguccauuuuuaucccuugggggaaaggaugcaguuauauaaucacuuuuaacaaccccaacuguucaaguccuguuacccgucucuacacaaaguaacaacugucuugaga

SEQ ID NO: 15207 - RNA, 2074 nt, Homo sapiens
ccccgcccugcccgucgcugcggaaggcgccgcgcgcagcaacgcgcacuuccucuccaggaauccgcggagggagcgcaggcucgaagagcuccuggacgcagaggcccugcccuugccagacggcgcagacaugucagaacaaaguaaggaucugagcgacccuaacuuugcagccgaggcccccaacuccgaggugcacagcagcccugggguuucggaggggguuccuccguccgcgacccuggcagagccgcagagcccuccucuaggcccgacggccgcuccgcaggccgcgccgccuccccaggccccgaacgacgagggcgacccgaaggcccugcagcaggcugcggaggagggccgcgcccaccaggccccgagcgcggcccagccgggcccggcaccgccagccccggcgcagcuggugcagaaggcgcacgagcucaugugguacgugcuggucaaggaccagaagaagaugaucaucugguuuccagacauggugaaagaugucaucggcagcuacaagaaguggugcaggagcauccuccggcgcaccagccucauccucgcccggguguucgggcugcaccugaggcuaaccagccugcacaccauggaguuugcgcuggucaaagcgcuggagcccgaggagcuggacaggguggcgcugagcaaccgcaugcccaugacaggccuccugcucaugauccugagccucaucuacgugaagggccgcggcgccagagagagcgccgucuggaacgugcugcgcauccuggggcugcggcccuggaagaagcacuccaccuucggggacgugcggaagcucaucacugaggaguucguccaaaugaauuaccugaaguaccagcgcgucccauacguggagccgcccgaauacgaguucuuuuggggcucccgggccagccgcgaaaucaccaagaugcaaaucauggaguuccuggccagggucuuuaagaaagacccccaggccuggcccucccgauacagagaagcucuggaggaggccagagcucugcgggaggcuaaucccacugcccacuacccucgcagcagugucucugaggacuagcaaagucuggaggcagaugaaugguuucugacccucaccagggcuguggaagggugggggugggucauuauaguauucaggauuuacagugcaguauucacguguaacuuuuaaguuuucaguacagugcuuuuauaccuuuaaugcaauguuguauucauuuggguacuauuguguaguauuuaggauguaugcauguuuguuuauauguaagcuugguuggugcuuucgcuuuugugcuaccuuucuuggauuuuuguaccagagaugugcuaaacugaugaaauacauugagaaaguuuccaucuuauucuuuuauaugggacugaugauguguguugggguagacugcuccugcagaguuuggaagaagucaccagcaaagccggccuaaccaagaaaagucaaggcccuucaugaccuugcugggcacagaaaacacccucguggaguacacuaauuugaacuggacuggucucagugugagcacuuggcacacuuuacuaaacacauauacaaccccaccgugagucaacuuuaaaguaaacauuaaagauucuugugauacaaucauuuuuggaaaaguguacuuuaucauuuuaacaaagcaguaugguugggaaugagacaauucucuauuuuacaguguauacagauacaacuauuuccccuaauagggugggaaaaaucgcuacucaugauuacuccuaaauuugugaaguuuauaguucuauugucuuuaaauguaacucauguuuauuucaaaaacauucacaaauauagaaaaguauacaaaacaaaacaguaagauugucuguaaucacaucauaugggaauaaaaaacaaaaauaauuuccuucccuuaaguuucuacauuuuaucaaaauuaauagaugucuugugacaucuauuaauauacauauaacauauuuauaauauaaaagagugagacauugugcuaagcccuaacaugua

SEQ ID NO: 15208 - RNA, 3521 nt, Homo sapiens
caugggguacacagacagcaacagcaagacagggacucaccaggacaggagcucccucuagcuccaaaaugacaagagaaccaguaggagauuccagacuccugcagaggagcuccuagccuuccugccggaucucagagucacuccagcuccccaggugggagggccccagggguucuggcuaugugugccugugccugugcauggggugggggccgugggacaaggcgggguuaggccuugugagaagacuuggugagaggaagggggcuggggucaagccuggaggggcacuaggugcccuggagcccugaagggaggcuguaggaggguugggggaacuguggggagcugggagaggggcuaagccaugcugggguuuggggguccuacaggugccaagcagaggggggacucuucggguaccaggcugcauggccgggugaugcaggguaggggaccgcaugcaguugcggggagagugggguggguggggauuggaguaugguugggcggggcagcugcucagggcugcgcguuacauaaauguucccuggcgccacagcgaggccgcgagcggagcagcgccccgagugagagcaauugccucaucuuaucaggaacacagcgucccacaugcugcucuugcccaagccgcaggcccaggcggggacaacguguucucucagagagccagccggaaggggggcgcaggggcucucucuccuucagcugagcccccaauccgccucaacacccaagucccaggcccuccccucucccccacagcagccacaugcaaaugcagccagcucaggagugugcgugcuccagcucaaagccugagcucagacucgggcuguggcauggacuccacucugcucugcccuccugcgcaaagggcacgcuccaaguuaucuccugcaauccagccuuagccaaacucccccccaaccccccacaggugagugggcccccccaccccacccggcuccagcugcaccuguauaaaccacacugcagaucuuucugucugcgaaccuccugugggaagccuguugaguggucauuuuugcaauguuuccaaugcccgguaccaagcuggggccagagcagcgucugccgcaagggccucuucugccggccuccugcugggucuucucuaggaagccucgcugagcuccccuucauggaagggagaagggaagaaaugcaacuccuaccgggagguccuggaaaggcaaaugagccaucacccucacagggaugucuuggauacaacagaccucuggagcgcaaggguccauguggguguguaucuggaggcaauggcaggggcagcgcuggucagacucaaagggaggcacagggagaggcuuccaaagagaaauugcuugcccucaggcucccaggccacuguccccagucuccagguauuccccaccagugagugggcugucauucacugauggacagcucugcccugugggcacugguuuggggccacuucuagcucccaaccucaagacugcaauguuuuucacuccaggaagacuguucacccuccuguucuggagcaggucagcauggccaaacacaggggcugaucaacugcuggccuccaaugaaacucaggcauacagccucagggguagcagaaaggccuggccucuguggugggggguggacuuccuaacuccuuaggaggccauuugacuguccugcucgucucuagaaauguuagugguuuauuaagccacauggagcugacaugcacauggcuucgcaggaaguccagguuggaagcucuuacccacccacugagcagguaagggaagugaggcccaggaggagagagugagcugucauucagcuggcuggcgccagagcuagagccgcagcuggaaccugccuggggcaaggaagcagccugcucuaccuccacuccuuuguugaugccucagggauugucauccagccuguuucucagucacugugaggguuaagugggagaauacguggggcacaugccugcugcacaguggugcuuggaggagauaacaauguuaucaccuaugggccaaggggccccgggaagcauguuugugagccgcccaguagugaaagagacauggggggcaggugugcccugucccaggcgcucuggucuagugccgcugaucacacacuacuauccacucuucacaugcaagagcuggcagggugcugaagccuggcuggagacugccacagugucggaggcaacacugcuucagugagagaauccuccuugggcaaauguguggcuccacauuucuacaaugcuugcgaagauauuuuuuaaaguaggcauuuuucuuguugcuuugcuuuguuuucgaauaggauaacuugauccuaaaaauucauacagaaaaacacacaguaauagccagaaaaaaauccugcaaaacaaugacgugggggaaacgagaccaccaggauucaacacaguuucguaagcugaucacuggccagugaagcccagcagaaauggcagaauuagaacgaaagguagugguaacugugcaaaggacagagugacaucucgaaccccuagggcagggagcagucaauacauguuaugaggacacuucgguagcaucuggaaaggcuggguucauacuucccacccuacaccaggauaaauucuaaaugggucaaagauucuaaugugaaaaauaaaaccacaaacauucuaggagaaaacuguaagacagaaguuccuucuaugaaucaaaguccacaaaccauaaaagaaaagacuaaaggcugggcaugguggcucaugccuguaaucccagcacuuugggaggcugaggcaggaggaucaccugaggucaggaguucaagaccaaccuggccaacauggugaaaccccgucucuacuaaaaauacaaaaucagccgggcgugguggcgagcgccuguaaucccagcuacucaggaggcugagacaggagaaucacuugagcgugggaggcagagguugcagugagcugagaucacaccacugaacuccagccugggugacagagugagacucagucucaaucaaucaaucaaucuauuugacugcacaaaacaguauacuauacuucuccaugaacaaagucaccauaaacaaaggcaagagauaacugacaaaacugagagaaaaaauauuugcagcuccuaucacaaacggcuaaucuccaauacagaaagagcucacaggaauuuuaaaaagaaaaauauccaacagaaaaaugggcaaagcccauucauaaaaaaggaacuacaaauggcucucaaaugcaugaaaagaugcuccaccucauccaucaggagcuaauggcagaugagacacacugaaaugcagcuugguagcuuaucaccuuggugaggcugcagguaagcaggcauucuuugcugaugggaguacaaacugcuacaaccuccauggagggcgauuuggcaauaccuauuaaaauuagaaaugug

SEQ ID NO: 15209 - RNA, 3521 nt, Homo sapiens
cacauuucuaauuuuaauagguauugccaaaucgcccuccauggagguuguagcaguuuguacucccaucagcaaagaaugccugcuuaccugcagccucaccaaggugauaagcuaccaagcugcauuucagugugucucaucugccauuagcuccugauggaugagguggagcaucuuuucaugcauuugagagccauuuguaguuccuuuuuuaugaaugggcuuugcccauuuuucuguuggauauuuuucuuuuuaaaauuccugugagcucuuucuguauuggagauuagccguuugugauaggagcugcaaauauuuuuucucucaguuuugucaguuaucucuugccuuuguuuauggugacuuuguucauggagaaguauaguauacuguuuugugcagucaaauagauugauugauugauugagacugagucucacucugucacccaggcuggaguucaguggugugaucucagcucacugcaaccucugccucccacgcucaagugauucuccugucucagccuccugaguagcugggauuacaggcgcucgccaccacgcccggcugauuuuguauuuuuaguagagacgggguuucaccauguuggccagguuggucuugaacuccugaccucaggugauccuccugccucagccucccaaagugcugggauuacaggcaugagccaccaugcccagccuuuagucuuuucuuuuaugguuuguggacuuugauucauagaaggaacuucugucuuacaguuuucuccuagaauguuugugguuuuauuuuucacauuagaaucuuugacccauuuagaauuuauccugguguagggugggaaguaugaacccagccuuuccagaugcuaccgaaguguccucauaacauguauugacugcucccugcccuagggguucgagaugucacucuguccuuugcacaguuaccacuaccuuucguucuaauucugccauuucugcugggcuucacuggccagugaucagcuuacgaaacuguguugaauccugguggucucguuucccccacgucauuguuuugcaggauuuuuuucuggcuauuacuguguguuuuucuguaugaauuuuuaggaucaaguuauccuauucgaaaacaaagcaaagcaacaagaaaaaugccuacuuuaaaaaauaucuucgcaagcauuguagaaauguggagccacacauuugcccaaggaggauucucucacugaagcaguguugccuccgacacuguggcagucuccagccaggcuucagcacccugccagcucuugcaugugaagaguggauaguagugugugaucagcggcacuagaccagagcgccugggacagggcacaccugccccccaugucucuuucacuacugggcggcucacaaacaugcuucccggggccccuuggcccauaggugauaacauuguuaucuccuccaagcaccacugugcagcaggcaugugccccacguauucucccacuuaacccucacagugacugagaaacaggcuggaugacaaucccugaggcaucaacaaaggaguggagguagagcaggcugcuuccuugccccaggcagguuccagcugcggcucuagcucuggcgccagccagcugaaugacagcucacucucuccuccugggccucacuucccuuaccugcucaguggguggguaagagcuuccaaccuggacuuccugcgaagccaugugcaugucagcuccauguggcuuaauaaaccacuaacauuucuagagacgagcaggacagucaaauggccuccuaaggaguuaggaaguccaccccccaccacagaggccaggccuuucugcuaccccugaggcuguaugccugaguuucauuggaggccagcaguugaucagccccuguguuuggccaugcugaccugcuccagaacaggagggugaacagucuuccuggagugaaaaacauugcagucuugagguugggagcuagaaguggccccaaaccagugcccacagggcagagcuguccaucagugaaugacagcccacucacugguggggaauaccuggagacuggggacaguggccugggagccugagggcaagcaauuucucuuuggaagccucucccugugccucccuuugagucugaccagcgcugccccugccauugccuccagauacacacccacauggacccuugcgcuccagaggucuguuguauccaagacaucccugugagggugauggcucauuugccuuuccaggaccucccgguaggaguugcauuucuucccuucucccuuccaugaaggggagcucagcgaggcuuccuagagaagacccagcaggaggccggcagaagaggcccuugcggcagacgcugcucuggccccagcuugguaccgggcauuggaaacauugcaaaaaugaccacucaacaggcuucccacaggagguucgcagacagaaagaucugcagugugguuuauacaggugcagcuggagccggguggggugggggggcccacucaccugugggggguugggggggaguuuggcuaaggcuggauugcaggagauaacuuggagcgugcccuuugcgcaggagggcagagcagaguggaguccaugccacagcccgagucugagcucaggcuuugagcuggagcacgcacacuccugagcuggcugcauuugcauguggcugcugugggggagaggggagggccugggacuuggguguugaggcggauugggggcucagcugaaggagagagagccccugcgccccccuuccggcuggcucucugagagaacacguuguccccgccugggccugcggcuugggcaagagcagcaugugggacgcuguguuccugauaagaugaggcaauugcucucacucggggcgcugcuccgcucgcggccucgcuguggcgccagggaacauuuauguaacgcgcagcccugagcagcugccccgcccaaccauacuccaauccccacccaccccacucuccccgcaacugcaugcgguccccuacccugcaucacccggccaugcagccugguacccgaagaguccccccucugcuuggcaccuguaggacccccaaaccccagcauggcuuagccccucucccagcuccccacaguucccccaacccuccuacagccucccuucagggcuccagggcaccuagugccccuccaggcuugaccccagcccccuuccucucaccaagucuucucacaaggccuaaccccgccuugucccacggcccccaccccaugcacaggcacaggcacacauagccagaaccccuggggcccucccaccuggggagcuggagugacucugagauccggcaggaaggcuaggagcuccucugcaggagucuggaaucuccuacugguucucuugucauuuuggagcuagagggagcuccuguccuggugagucccugucuugcuguugcugucuguguaccccaug
